United States Patent 7,834,146 (RECOMBINANT POLYPEPTIDES ASSOCIATED WITH PLANTS) - sequence listing, part 5

SEQ ID NO: 13662 - DNA, 1511 bp, Sorghum bicolor
  Clone ID: SORBI-28MAY03-CLUS6522_1
tgagatccgaagcgctctccaagaacaggctcctgcagcggctgccataacaggggcccctgtcccgactgattatgagtctggtgcaatcaaaggaatggcttacatggacttcaaggatcaggattcagtgtccaaagccattgagctcagtggcaccaatatgggtggtgaccctgaccaaaaggtgcaggaagccgcgccttcagctgataaggagggaggcagcggtgaagatgaggatcgaagtactggggaaagttctgatgatgagcctacaaaagctgaacaaaagaaggcacctaaagcatcagcaagcagtggatctgaggatgaatcttctgaagatgatagtgatgaagacagtgacgagcctgctaatactccaaagaaggaagctcctgtgcgggcctctgaaaagcaaactgctaccaaagaacctaaaacacgtatgggctcccaaaacgaagcaacggagtaggtgaggacactttttatggcaaacgtcccctggagagatgaatttgaagatgtgaaagaattttttgcggatgctgatggagttgttgatgttcgttttcctacacatgattacgtccatcgtaaaggattttgctatgttgaatttgtttcagctgaggctgctgaaaaggcatttaaagagaagcaatcaacagagttgcagggtcgtgaagtaagacttgattttgccaaggggggaagaaatacacaaactcctcgcagcggcaatgatggatctttccagaagccagctcggggaactagcaactcgatatttgtccgtggttttgataaagaactttcggaggatgagatccgaagcgctctccaagaacattttaaaaaatgtggtgacataacaagggtctctatcccgactgattatgagtctggtgcaatcaaaggaatggcttacatggacttcaaggatcaggattcagtgtccaaagccattgagctcagtggcactgacattggtggtggctatgagctttatgttgatgaagccaagccaaaaggcgatggccagcgtggtggtggcagatttggtgaccgttctggtggcagattcggttctggtggccggcgtggtggcggtggcagatttggtgacagatctgggggcagggatggtggcggtagatttggtggacgacgtggtggtagggatggtggtgcccgtggacgtggtggcggcggccgtggctttggaaggcagaatgctggcactcctagtgcaggaaagaagaccacgtttggtgatgattgaagatgaatccggcgggattttgcgaggacacttttggtgatggctgaagacgaatgagagggatgcagaaagagagaatgaactgctgttcctgtgaaattttgagttattttgttttgtgttgtggtaccggtactggtgttttggtatctgttatcaagtattacaatattgtgaccgttgcgttaacgcagtgatttctcgatttccccttaaaaat

SEQ ID NO: 13663 - DNA, 1286 bp, Sorghum bicolor
  Clone ID: SORBI-28MAY03-CLUS66309_1
tcggcaacagtcaaccgacgactgcccagttccactgcacagggactcgatggcgtcctcctccctcccggcgcccgcgcccggccgcgccgagctcctcaaggccttcgacgacaaccgcacgggcgtgcgaggcctcgtggagtcgggcgtctcctccgtcccggagctcttccgccacccggacccatacggctccatcccgctcgccccgcctggcgcctccatccccgtcgtggacctctccctcccgccccacctcgccgccgccgccgccgcgtcggccgcccgcacctggggcttcttccacctcgtcaactaccaccacgcgctccccgcggccgcggccgcggccgacgacgactaccccgcgcgcgccttcgcggcggtgcgcgccttcaacgagctccccgccgccgagcgcgcgccgcactacagccgcactacaggcggggtcaactactcctccaacgtcgacctgtacaactcccccgcggccagctggcgcgacaccatccagatcctgttgggccccaaccgcagccccgacctcgccgaccggatcccggccgtctgccgcgccgaggtgctcgagtgggaggcccgcgccaccgccgtcgcgcgcaccttgctgggcctcctttcccaggggctcgggctcagggccgaggcgctggaggacgcgtcctgcgccgacgggaagctcatggtgtgccactactacccgcactgccctgagccggagcgcaccatgggcctcgtcccgcacacggaccccggcgtgctcaccgtgctcgcgcaggacgccgtcgggggcttgcaggtgaagcaccaggacgaggacggcaaaatctcctgggtggatgtgaagcccgtgcccggagcccttgtcatcaacgtcggcgacctcttgcagataatgtctaatgacaagtacacgagtgtagagcatcgggtggtcatgaacacacgtgaagaacccagggtttccatcggcatttttttcagtcctgggaagagaggggactcggtgttctatggaccattgccagagctggtttcttcagagaacccgcccaagtacagcaactttaccatgtccgagttttatgggaaattcttctcacgagaccttgcgagcaaagctctactcgataacttcaaactgtcatcttaagtgccaactccaaaagtttggactcgtgtattataatcatgtatatgagttgtaattacggtaatgtaaagaaattgctctgtcctctccgaaaatgggttcaaactga

SEQ ID NO: 13664 - DNA, 381 bp, Sorghum bicolor
  Clone ID: SORBI-28MAY03-CLUS6468_2
cgtgatgccactagaggtactgcttactagctacaagaggcttgttgtgaaggactctgctgtaaatgctatctgctatggtgctaagcttatgattcccgggttgctccgatttgagaatgatattgagaccggggaggaggtggttctcatgacaacaaagggtgaggctattgcgattggtgttgctgagatgactactgctgtgatggcaacctgtgaccatggtgcagttgcaaagatcaagagggtcgtgatggacagagatacatacccaaggaagtgggggcttggcccggtggcactcaagaagaaaaaacttattgctgagggtcttcttgacaagcatgggaagccaaatgagaagacaccaactgagtg

SEQ ID NO: 13665 - DNA, 1816 bp, Sorghum bicolor
  Clone ID: SORBI-28MAY03-CLUS6468_1
acgccgtcgtggacccgcggtctccccccctttcctccaccgtccccccacctccgccgtcgccgacgccgaccccccacaccggccgccgtgggagcgccccggcaccatctccgcacgcgcagatatgggggatgtgtgtttctcaacaccgctaattgaccgcgatggggtcttctacgtctccggattggagaacttcatgagggatgccagattcggtgaatggggacgctattgcgatggtgtttgattagttggccaccgctgtggtggcaaaaggacaccttggtaccgtctttttgggcccaagggtcgtgagagggaggccttcagagcaaaggaagagacggcctagcccggagggactccagaggccaaaactattgactggtgcacctctggactggattgggaaggaacaggaggaggagagagcggagaggatgacgaagcaggtgagacccacaggggatggtttgctttggccgtttcggacagcgggttgattaatatgtggggccatggcgttggcagagaacacgctgcaaacaggcctcttgtgaaggctgttttccaggccatggtatgatggttatgttcctgctacactacctgcgtggatgttcatcgtgacggatgccactcacccttagaaagtcgagaaccgattctaggggaagacattcagaagatatgggattctgttccaatgccccatgcccataaagaaactccacttagtgaatttttcgatgtacaagttgtggcactggaaaaagaagaaaaagaagagcaaggaaggaagcgacgcggctctgcctgagggggctcggttcggcgttcgctccctcctggcggacttgctggggatcgtcgtggtgttgtcccagctgcacggggctcatttagttcccaggaattttggaaagtcattaaggagaacaaagaccttgatctgcctgctcataaagttatggtggctactgtacgttgtgaggaaattggtaatgagaaagttgccagttttacagctgatgaggaatggcaacaatttgaggaggctgttcaacatgactttgttcctggatttgggaagaagctcagcagccttcttgatagatgtttgcccgaggatgacatggaggctatttattttgatgaaggtgtcagaagctctaaaagacaacaacttgagtctaaactcttacagcttgtcaatcctgcctatcaatctcttctaggtcacttacggactagaactttagaagcatttaaggagtcctttgacaaggccctagaaaaggagggatttgctgttgcagctcgcaattgtagtcaaactttcttggagaagtttgaaaaaggatctgaagatgctgctattcaacaagtgaattgggacacctcaaaagtgaaggataagcttagacgtgacattgaggctcatatagcttcagttcgagctactaaattatctgaactttgtgccaaatatgaggcacaacttaccaaagctctggcggaaccagttgaatctcttctagattcagccagtgaagatacgtggccagctattagaaagcttcttcaacgcgagacaaaaactgctgtttcaggtcttgaatctgctgtgtcagcttttgaactcgatgaagcaagtgagaaagagctgcttgtgaagctggagaagcatggaaggagtgttgttgagtcaaaggcaaaagaagaagctggaagggttttgatccgcatgaaggacaggttctcaacactgttcagccgagatgctgactctatgcccagggtttggaca

SEQ ID NO: 13666 - DNA, 704 bp, Sorghum bicolor
  Clone ID: SORBI-28MAY03-CLUS67060_1
cctactggatgcagtgcaagtccaaccaaaccttctcttcaaacgtttacaacaagcatctaataataagcaaagatggccatggccaagagcttatcgccgccggcggtgctcatatttgccttgctcttcagctacgccgcctccatcgcgtcctcccaagctacatcgtcgtccgatggcttcctccaatgcctctcggcgagcatccccagccagctcgtcttcacacagagctcgccttcgttcacgccgctgctcaagtcctccatcaagaaccccaagttcttcacgcccagcatcgtgcggccgctctacatcgtcacgccgacgaacgcctcccacgttcaggccaccgtgctctgcggccgccggaacgggatgcgcatccgcgtgcgcagcggcggccacgactacgagggcctgtcgtaccggtccgagcgccccgaggtgttcgcggtgctcgacctgtcaaacctccgcgccgtgcgcgtcgaccggcagacctccaccgcgtgggtcgactccggcgcgacgctcggcgagctctactacgccgtcgggaaggccagcaaccttctagggttcccggccggcctgtgcccgaccgtcggcgtcgggggacatttcagcggcggcggcttcggcatgctgctgcgcaagtacggcctcgccatcgacaacgtcgtcgacgcggtcctggt

SEQ ID NO: 13667 - DNA, 973 bp, Sorghum bicolor
  Clone ID: SORBI-28MAY03-CLUS68855_1
gcacgagggcaggatcaaaaggaataactgcattcataatcgagaaagggatgcctgggttcagtactgctcagaagttggacaaacttggcatgagaggaagcggcacatgtgagcttgtttttgagaactgctttgtgccacgtgaaaatgtcctcggtgaagaaggcaaaggtgtttatgtcatgatgtcagggcttgatctggaaaggcttgtattagctgggggtcctattggccttatgcaggcatgccttgatgttgtacttccatatgttcgccagagggagcaattcggccgtccaattggtgaatttcagttcatacaggggaaaatggctgatatgtacacctcattgcagtcgtcaagatcatttgtatactcggttgctagggactgcgataatggcaaagttgaccgcaaggattgtgcaggagtaattctctttgctgctgaaaatgcaacccaagttgcacttcaggcaatccagtgtcttggtggaaatgggtacataaatgagtacccaactggtcgtctcctgagagatgcaaaattgtttgagattggtgctggtactagtgaggtaagaagaatgataattggccgtgagctcttcaaagaggactgaaacttctatttttgaagccagataccagtgcatattgttaactggaggaggtgagcgagatttagatacttagcaaatcacccctgtggttcaatagttgattccgagctatgctagcattctcatgcttttgtataactgcaaacaaatgtcaaataaagtttgcttccttgtacttgctgcttgcagtggctctatttttctatcaataaagttctttatatgactctgtgacttatgcaatattggccagttgcattttatcatattagtatagatgttagagcagaccagtaatataaatgtttcaagaagtgcagaatagaggcattgcttttataagg

SEQ ID NO: 13668 - DNA, 776 bp, Sorghum bicolor
  Clone ID: SORBI-28MAY03-CLUS68948_1
tggcttctgggctagtacagtactgccttgcacccgggtcccctccccccgcatgctaaaggactagtacagtactagcttgcagccgggtggtttggtttgctttggttacgtgccgcgctccgctccgaccaggcccgccccgaccgaccgacgatgcagcggtggctcccggcgctcctccgccgcgcggcgcccgcggtctccggcggcggcgcggcgcggctcttcgcctcgtcctccctcctctacgacgacacgcaggtgcagttcaaggacagcgtgcgcaagttcgcgcaggaggcaatcgcgccgcacgcggcggcgatcgacgcgtccaaccacttcccgcgggaggtggacctgtggaggctcatgggcgacttcaacctccacggcctcacggcccccgaggagtacggcgggatggggctcggctacatgtaccactgcatcgccatggaggagatcaccagggcctccggcgccgtcggcctctcctacggcgcccactctaacctctgcatcaaccagctcgtccggcacggcaacccggagcagaagctcaagtatcttcccaagctgattagtggggagcacatcggggcactggcgatgagtgaacccaactctggctctgatgtcgtcagcatgaagtgcaaagctgagaaagtggacggcggctatgttcttaacgggaacaagatgtggtgcaccaatgggccgtctgctcagacactggttgtttatgcaaaaacagatctggctgcaggatc

SEQ ID NO: 13669 - DNA, 1473 bp, Sorghum bicolor
  Clone ID: SORBI-28MAY03-CLUS71559_1
gccaaatgagccttcactgccccgggtgagcgagctgccactgccagcttcccggtgcgcaagctgtgctgctgctcgccggcgcaggcgcagcgcccactcccccggccgctctccgtctcgtcaccgcgccgcctgctggtaatcggtctatatataggtggttcgtggtgatcagaaccacacagacaagatggcgaacgtacacaagatcacccttgttctcatgttctgcctgttagtgttggggagagcagattacctcaagtacaaggatccgaagcagcctatcgctgttcgtgtcaaggatctgctgagtcggatgactcttgcagaaaagattggccagatgacccagattgagagggaaaatgccacagccgatgcactggcgaaatacttcataggtagcgtactgagtggcggaggcagtgtgcctgctcctcaagcatctgctgaggcttgggcctccatggtgactgagatgcagaagggcgctctttctacacgtctaggtatcccgatcatctacggtattgatgctgtgcatggtcacaataacgtctacaaagctactatcttccctcacaacgtcgggcttggagctaccagggaccctgacctcgttaagagaattggagaagcaactgctcttgaagttagagctactggaattccttatgcctttgctccatgtattgcggtttgtagagatccaagatgggggcgctgctatgagagctatagtgaggacccaaaggttgtccagtcactgacttcactcatctctggcttacaaggcgatgctcctgcggattttgtgggaagaccatatgttggtggaagtaagaaggttgctgcatgcgcgaagcactatgttggtgatggtgggacgtatatggggaatcaacgagaacaacacgatcatcgacacacatggactgatgagcatccacatgcctccttactataactctattattcgaggtgtctctacagtcatgacctcgtactccagctggaatggaaagaagatgcacgcaaaccatttcctagtcacagattttctcaagaacaagctcaagtttaggggttttgtgatttccgattgggagggcattgatcggatcactactcctcctcacgccaactattcttattcaattgaggctggagttggtgctggtattgacatgatcatggttccattcagatacacagaattcatcgacgacctcacgacacaagttcagaacaaggtcatccccatgagcagaatcgacgatgccgtctacaggatcctccgtgtcaagttcaccatgggtctatttgagaacccttaccccgatgctagccttgccggtgaaatcgggaagcaagaacaccgggagttggcacgcgaagccgtcaggaagtccctggttcctctgaagaacgggaaatcctcctctgctcccttgctgcccctcccga

SEQ ID NO: 13670 - DNA, 883 bp, Sorghum bicolor
  Clone ID: SORBI-28MAY03-CLUS14833_1
ccgggagaccatagcacgaggccgccctccatcctcgactcgttcccgatctccatttccaatagaacgaaggagaagaaaccgaggcggcagacatggcggtgtcgatcgagctcaccaaggagtacggctacgtcgtgctggtgctggtggcctatgccttcctcaacttctggatgagcttccaggtcggcaaggcccgcaagaagtacaaggtgttctaccccaccatgtacgccatcgagtcggagaacaaagacgccaagctcttcaactgcgtgcagagggggcaccagaactctctggagatgatgcccctgttcttcgtcatgctgctgctgggcggcctgcagcacccgaccatcgccgccgggctgggcgtcctctacgtcgtcgcgaggttcttctacttcaagggatacgctaccggcgttccggacaaccgtctcaagattggggggctcaacttcttggcggtgattgggctgatcatctgcacggcatctttcggcataaacttggtcatcagggagacactctaaacttcaggtttacgtgtgagctgctgcagacttgattaatggaacaagttacttgaggcctgagcaacgtaactttgtgtgacatgagtcagttgggtttgcatagtcgtatgctcgtttctttctttgtgtgtgtgtgttgattagcaaagtagtgactgcgtctgcgtctcacttttggctgtgccggaataagaggagacagatggcttgaagcatgaatcctacagttcttgctgcttgtcactctctggtttcgttgtagatgagatggttgttgatggtttgtgtttgaggcacgatccttaatttttaccgatctaaaaaaaaaaaaaaaaaaa

SEQ ID NO: 13671 - DNA, 2451 bp, Sorghum bicolor
  Clone ID: SORBI-28MAY03-CLUS14268_1
aggtggtcatctgcccacttcaccgcttcccctttctcccaccttccttccccggctcctcgctctcctccgccgcatcccgcgcgcaccctccgccgccggcgccggggacctcgccgtgggggggaggccgggctgtagaccgggatccgggaggattctgttgcgtccttaacggacacggcgattcgttcggcgtgtccacatcgaggcacagcttgagccactcctctagctgccactgaactcggtcgggcggagcttagatctgatcccaacgaacctgcagtcggctgcagccactcctctccggcgatggatttcatgaaggttttcgatcagactgtgcgcgagataaagagggaggtaaatctgaaggtgctcaaggtccccgagatggagcagaaggtacttgatgcaacaagtgatgaaccgtggggccctcatggaagtgccctttcagagcttgcacacgctaccaagaagtttgctgagtgccagatggtaatgaatgtcctctggactaggctgtccgagagaggcgcgaactggcgtcatgtgtataaggcattgacaattattgagtacttgatagccaatggttctgagagggcagttgatgacattctagatcattattctaagatctcggttctttcgagttttgaatatgttgagcctaatggtaaagacgctggaataaatgtgaggaaaaaagtagaaaccattgtgggcatcataaatgacaaggagagaataaaggccgtgagagacaaagcagccagtaatcgtgataagtacctcgggctatcatccacaggcataacatataaatcaagctcagcctcatttggtagcaactacagttcaggcgaacgttatgggagtttcagtggtgaaaaggaagctgactcatatggtgacagttacagggacaaagaacctgttaaaacctccacaagtaatagtggcgtccggaaatctggcagcaagctgaggaaggatgcgaagcctgataggaggaatgaggattcacccagctctttcaacccctcatctaatacaaataacactgaggacggctttgatgacttcgatcctcgcggatcaaatggaaaaacaactgctaaaccaaatgaggtggatctgtttggcccaaacttgatggatgattttattgatacctcggcggcaactccagcaacagagagtgctgtagagccacaggtcgatctgtttgctgatgcagatttccaatcggcaacagagacagctgcaaatacagatgtccagggcaatgttgacctttttgcggaaaaggcatcttttcctgcagcatttccaccacaggctgggtttattccaccaccaagtgccgggacatcttctgaaaatacttctgtatccaagaaggctgctcctgaaccttttgatccttttggtgctattcccttgaacagttttgatggatctgacccatttggtggcttcagctcaaatgctggatcatctactgcagcaccacccacccacagttctacaggaaatatcagcacacgagaccagaaccttcaggctgcatccgacttcggtgccttcgtatcaaacaatgagggagcagctaaagatccatttgatctttcttcaagtgccaatgtcagaaaaacacctttggcagctccgaagattgatgcatctgattttggtgcatttgtctctagtactgaggaagcagctaaggaccctttcgatctttcttcgggtagcaaccttggaaggacagaccaagcacccgcggcagctcccaagcctaacatgaagaaagaaaattttcaggtcaagtctggcatatgggcagactccttgagcaaaggattgattgatcttaacataactgcaccgaagaaggtgaacctagctgatattggcatcgttggtggccttggtgatgggtccgatgagaaggccatgccctcgtggaccatgggcaccggatctgggctaggaatatctgggattccaccatcaacacaaggcggtggcatcgagagcttagccaactacaacaagcatcaattcggcttcaaataagccttgagctttcccctttcatacaggaaaatatgtcacctgcggtttcctcctctgccggcctgctccttccatataccttattgatttaatcacttttttgtttttggttttggtgatttcactacattacattacattgcattgtgtcaaccaatcttggcccgtcttgtcacgcgtgtatgttatttatcgggtatgttggtaaaagcatgcaactacccatcacacaccctgtgtcaattcgatgataggtatgttcgccatgcagtatgtgtaattctgtgacctgcctctgtactttatacagtactgtagcatttcgcagtgcttaataatagaatatatgccgttgatgtg

SEQ ID NO: 13672 - DNA, 1235 bp, Sorghum bicolor
  Clone ID: SORBI-28MAY03-CLUS16552_1
ctgcaagactcgcggtgccgacctgccgttccccatttgtatcgtccttcttccgctgcatccgtctcgcctcttctgctcgcatctagccctcagccctcagctcaccaaccaccacgaaccgagggagagagggaagggaccgggagagggacgaatggcgagctctcagtgctgcgataacccgccggccctgaacccggcctgcggggagggcaaggtcgtcgacagcttcggcgggctcaaggcctacgtcgccggccccgaggactccaaggccgccgtcgtcctcgtcgccgacgtcttcggattcgaagcgccgattctgaggaagatagccgacaaggttgcttcgtcagggtactttgttgtggtaccagatttctttcatggggatccttatgtacctgagaatgggaagcccatccctgagtggctaaagtcacatactccggaaaaagggtttgaagaggcaaaaccagttattgcgactctaaaggagaagggagtgtctgctgttggagctgcagggtattgctggggtgcaaaggttgttgtggagttggcaaaagctcatgagatccaagctgctgtactgttgcacccttcttttgttaccattgacgatatcaaagaggtcaaatgcccaatttctatactcggagctgagattgacaaaatgtccccaccagagttagtcaagcaattcgagcaggtcctttctgtgaactcaggggttggtcactttgtcaagatcttccctggtgtggcgcatggatggagcgtgagatacagccacgacgacgcagctgccgtgaagagtgctgaggaagcctttgcggacatgctcgactggttcaataagaacctgaaatgaactctgcaattgcatcctgccttgtaataatgcatattccaatgtcctgagatcgaatctgctgtgttagggcttgcgtggtcaggccattcagagttctcatggtcttagggttgtattagtagattggttgtgctaaatccataataaaacgaggtaaactattttagagaggattaaggcttttccccgtttgttattaagaaaaatagtttctttctctatgccactaaatttaaagcgggtctctatgctatgacatttatctcttttgtctagcatgccattctgtccatctcctgtttggatttcaatatttgatagctctgaagcggctttcaccatggccttgtttagt

SEQ ID NO: 13673 - DNA, 925 bp, Sorghum bicolor
  Clone ID: SORBI-28MAY03-CLUS8032_1
cgaggccgggccagggtttccctccgtgcttgtttgctctagggtttttgccacgccgccgccgtccctctgcccctccgacaccaccgatacaccaagatgacggcgcaggctgcggaggagctcgccgcccagatcgagcagcagaagctcgaggagcagaagactgaggcagaggaggttgtggtggaggatgaggacgatgatgacgaggacgatgacgatgatgacaaggatgatgatgaattggatggacatgaaggggatgccagtggcaagtccaagcaaagcaggagtgagaagaagagccgcaaggccatgctgaagcttggcatgaagcccatcactggtgtcagccgagtcactgtgaagaaaagcaagaatatgctttttgtcatctccaagccagatgtgttcaagagcccgaattcagacacctacgtcatatttggcgaggccaagatcgaggacctcagctctcagctgcagacccaggctgcagaacagttcaaggctcctgacttgagccaaatgatctcgaagcctgagacatctggcctgggtcaggaggacaatgaggaggaggttgacgaaactggtgttgaggccaaggacattgagctggtcatgacccaggcaactgtttcgagggccaaggctgtcaaggctctcaaggcttctaatggggacatcgtcactgccattatggagttgactaattagtgttatttttgtcaacccttttttttaaaccagatgtatggtatgttatgcagcttgagcattatctgtggaccataatgcttgcttagataattttatcatgcttgcttcttcggtacaaggtcattcaaaccatggtttcatctttgctggcttacgcatagcacacagtttatggcacaggctgttcgtcaatgctctg

SEQ ID NO: 13674 - DNA, 1692 bp, Sorghum bicolor
  Clone ID: SORBI-28MAY03-CLUS942_1
agtccagtagataagccgtaagcgcactaggctagtttacggcacctgcgcgattctcttcttgcgacggaagcaaaacctgcgcgagagagagagagacaggcagacgactgcgggacgacgagatggccgacggggaggacgccgccgccgcgcgccgccgggccgccataaccgactaccgcaagaagctgctcaactgcagggagctcgagtcgcgcgtcggcaccgtgagagaaagccttaaaaatgcaaagaaggattttaccaagactgaagatgacttgaagtctctgcagagcgtggggcaaataattggagaggttctccggcctcttgataatgagcgctttattgtgaaggccagcagtggtccccgatatgtggtcggttgccgaagtaaagtggacaaggagaagttaacatctggaactcgtgttgtacttgacatgacgaccttgacaataatgcggactcttccacgggaggtggatcctgtggtatataacatgcttcatgaagatccaggaaatgtcagttactccgctgtaggcggtttgtctgatcagattagagagctcagggaatccattgagttaccacttatgaaccctgaactctttcttcgggtgggaattaagcctcctaagggtgttctactctacggtccaccaggaactgggaagaccctattggcaagggctatcgcaagtaacattgatgccaactttttgaagattgtttcaagtgctattattgacaaatacattggagaaagtgctcgtttgattagagaaatgtttggctatgcacgtgatcaccaaccatgcatcatcttcatggacgaaattgatgccattggtgggcgaagatttagtgagggaactagtgctgatcgtgagatccagcggacattgatggagctccttaaccaattagacggatttgacgagctaggaaaggtaaagatgatcatggccacaaaccgacctgatgttctggaccctgcgctcctgcgtcctggacgtttagacaggaagattgaaattccgctacccaacgagcaatcaagaatggaagttctaaaaatccatgcagctggtatcgccaaacatggggaaattgattatgaagcagttgtgaaactagctgaaggtttcaatggggctgatcttcggaacgtgtgcactgaagctggtatggctgcaattcgtgcagagagagattatgtagtccacgaagacttcatgaaggctgtgcggaagctaaatgatgcaaaaaagctggaatcgagtgcacattacagtgcagattttggcaaggagtaatgtatgatgctgatgcaatggacaactgcatatggcgtgtatcatcagggagctcagtcagatgcgatgcaaaagggagaaagaaaccagctatttatgttcaggctccaggcagctcctctttttctgatattcacaattttagtgaggaggattgtcaagctgaccagtgggagaaaccattcgagaatttagtagttttgcaccagatgctctttgcttctgtaaatcatacgctatctgctttcgtgcgtgttagtctggtaataactctggtccgagctgttctgttttcacatgtactttggacagtgtggaaaaagaaccagtttttttgcaaaaaaaaacaattaagggcggcgtt

SEQ ID NO: 13675 - DNA, 2060 bp, Sorghum bicolor
  Clone ID: SORBI-28MAY03-CLUS993_1
gcacgagggtccctcacctccgactcccggcgccctcgagccatccatccacccgtcggctgctccttcttcccgtcggtccgtcggtccgtccccaggtgtgcttcagctatgcagttcagcagcgtgtttcccctagagggaaaagcatgtatgagcccagtgaggagaggcggtgaaggcgcttggagtgagagggtgaggattgggaactcctgcagcatcaggcgcaacaaggcattgaggaggatgtgttttggtgcaaggggtgctgtgagcagcgctcagtgcgtgctcacatcagatgctggcccagacactcttgtcgtccgaacatcctttcggaggaattatgctgatcctaacgaagttgccgccgttattttggggcgcggggctgggactcagcttttccctctcacaagcacaagggccactcctgctgttcctattggaggatgttacaggcttattgatatccccatgagcaactgtttcaacagtggcataaacaagatattcgtcatgactcagttcaactcagcttctcttaaccgtcacattcaccgtacgtatcttggtgggggaatcaacttcactgatggatctgttgaggtgctggctgcaacacaaatgcctggggaggctgctggttggttccagggcacagcagatgctgttagaaaatttatctgggtacttgaggattattacaagcataaagctatagagcacattttgattttgtcaggagatcagctctatcgtatggattacatggagcttgtgcagaaacatgtagatgacaacgcagacattactttatcgtgcgctcctgttggagagagtcgagcatctgactatggattagtcaagttcgacagttcaggccgtgtaattcagttctctgagaaaccaaagggggctgctttggaagaaatgaaagtggataccagctttcttaatttcgccattgacgacccaactaaatatccctatattgcttcaatgggagtttacgtttttaagagagatgttcttttagaccttctaaagtcaaggtatgctgaactgcatgactttggttctgaaattctgcccaaagctttacatgagcacaatgtacaggcgtatgtcttcactgactactggggaggacatggaacaatcagatcattctttgatgcaaacatggccctctgcgagcagcctccaaagtttgagttttatgatccgaaaacaccattcttcacttcccctcggtacttgccaccaacgaagtcggataagtgcaggattaaagacgcgatcatttcgcatggctgcttcttgcgtgaatgtgccattgagcattctattgtcggtgttcgttcacgcctaaactctggatgcgagctcaagaacaccatgatgatgggtgcggatttgtatgagactgaagacgagatttcacggctactatcagagggcaaggtgcccattggggtaggggagaatacaaagataagcaactgcatcatcgacatgaacgcgagggtcggaagaaacgtctctataacaaacaccgagggcgtccaagaagctgaccggccggagctaggatactacatcaggtctgggatcgtggtgatcctgaagaacgcaaccatcaaggacggcaccgtcatatagagacaatctacccatggtgcagtgcaaggctacaggttctcatcactcgtcgtcttgagagttagtttgaggcgcccaaccttgacttgagcttagggacaagaatagaggaagaagatgggctggtgccggatgcaatggaagacaagagaaatggtttgatgctatatcatcggttccagtagctcttcctgatgttatatgtagctgagtagtgtgaacagtgcaataagctgggcgagcaaagccgcagcaacttttggggatcgttggtgcatcttgtaaataaactcggacccaacaaatggaacttgcccgtcatctccatatctgattctttgttcactcgcagctatggcagctccagttcatcgtagcatatgcgttgt

SEQ ID NO: 13676 - DNA, 1404 bp, Sorghum bicolor
  Clone ID: SORBI-28MAY03-CLUS7873_1
gtgcgaggacgaggacgacgcgggcgcacgcagcgcaggtgcaggccgcagcaagagcaagccctgaaaccgccccgccccccaccacctcgctctccctcctctcgcagcgccgcagagccagggtagccagtcagaagaggaacacacacgggggagggagcggcagccgcagcggccgagggcggagcacgcgaggcatggatagataccacagggtagagaagcctcggaatgacacgccaatcagccagaatgagatcaggatcactactcaggggaggatgaggaactatatcagctatgggatgtcgctgcttgaggaaaatggccatgatgagattaatatcaaggccatgggacgggccataaataagacagttatggttgttgaattgatcaagagaagggttggaggtcttcatcagaacactgctactgaatctgttgatatcacggacacatgggaacctttggaagaaggccttctcccactagagacaactcgccacgtgtcgatgatcactgtaacactgtcaaagaagcctctggatacatcatctccaggataccaaccacctatcccagctgaagaggtgaaacctgcttttgactatgatcatgaagaatcgtatcccactggtcgtggaagaggacgttttggtgggagaagaggcaggggaagaggtatgagcaatggtccccctccacctgcttatggttacaatgacgagtgggaggaggatggagattattacaacagagggcgtgggagaggaaggtcacgtggacgaggagggagaggccgtggtggctactatggaggtgggaggcgtggtggctacggttatgattatggctatggcgggagaggcgggtactatgaagagcaagatgaatactacgatgagcccgaagaatatgcccctccccctggccgtgggcgtggcagaggaagaagggggatgccttggcgcgggcgtggtgggcgtgggccgccgcgcggcggccgaggaggctactactagacaagaaatgcgacgtgccaaatgggtgtgctgaagctagcaatggcgtgcctagttatctgttagcgtttgctctgtgctcttctatggagctccgacccccggactggaattatcccgtaggcctttccaggtgctactttacttcagctgctgtgcctgtgcaactcgtctgggcaagttttgtggctcgctcgtggttttgtagctaggttaagcgagtgaagttacactcggtagcgcagtgtttcctccatcggacgatatgcgagattgtttattctgctgttaatctacctaccttcctatttcgtatggatgatggatactggatgtacgagtttcttcatgttcatttatttaatctagtactttc

SEQ ID NO: 13677 - DNA, 463 bp, Sorghum bicolor
  Clone ID: LIB3476-040-P1-K1-E6
agattattacaacagagggcgtgggagaggaaggtcacgtggacgaggagggagaggccgtggtggctactatggaggtgggaggcgtggtggctacggttatgattatggctatggcgggagaggcgggtactatgaagagcaagatgaatactacgatgagcccgaagaatatgcccctccccctggccgtggtaagccccagactgatgacgttacatgctgatgtggattttgctctgcattcctaaattctcatggtttgcggtctgctgtttcgcatggcgtggcagaggaagaaaggggatgccttggcgcgggcgtggtgggcgtgggccgccgcgcggcggccgaggaggctactactagacaagagatgcgacgtgccaaatgggtgtgctgaagctagcaatggcgtgcctagttatctgttagcgtttgctctgtgctcttctatggagct

SEQ ID NO: 13678 - DNA, 2228 bp, Sorghum bicolor
  Clone ID: SORBI-28MAY03-CLUS10_1
gcacgagccgcccctggcgctactcgcaccagccacccgcctcgccccccccgcacccctgggcgatggctgtagctgcgagcgcagtggcagtcgtggacattgagtgtcaccaacttgtagtccccaaaatgcacataatttcaggtgcttgtttgaagagagtattattggctatggaagcagttgtcaatttgtcaatttggctaggggttcgttaaccttcttcagattttgtgcgtgtggaacgtcgtccgtcgtccacgtcttccggcaggatgtacctatggcagaaagcgaccccagaggctctgaaagagaggacaaaggcatcctacgtcaataagtgccgcagacagcaaattaatggggagaagaaagtgaaacttttttcctggtcctacggaaccaaaagaaggagaccgtaaaacaaagggggagcgctgatctacatggacatctttgctggtggcacgtgcgcaaacctgtacagcgagcgttgtttttaccctggctccgctcctcggggctttcgagactccaccttatgggctgatgggcattccgcgtagcggtacaccttctatccgcccaatgcgtcggcgccctcgcggctctgcttcttccagataggatctgacagcattgcacgaaatgctagaaaagacgggctacaaggatgatgaggggactgcaaatgagctctcgtttcagatgtggacaaatcagatgcaagatacattgaactcaaaaaagaagggtgacaatgcttttcgacagaaggattttactactgccattgattgctattcccagttcattgaagttggtacaatggtttctccaaccatttatgctcgacgctgcctgtcatatctgatgaatggcatgccacaggaggcattgaatgatgcaatgaatgctctggtaatatctccgacatggtcaacagcattctatcttcaggcagcagcactattatcacaaggcatggagaatgaagcccaagaagcactcagggatggttgtagcttagagcaaagtagcagtggtggacattgagtgtgacaaatttgtagtccccaaaatgcacataatttcaggtgcttgtttgaagagagtattattggctatggttcatatgccgaccaacattccaccgcctcctggccaaactcagtttatgcctggtccaccacgcacgtttgctatgcccccatcatcgcacatgccgcccatggtcaatcccattggaattcctcagcctccagcaccgcctctgcctccgcagcctcctgctgaagagcaaccgcctccacctgatgaaccggaacctaagaggccgagaacagatgatgcttctcttatcccagtggaacagttccttgctcagcatccgggtcctgctagcatctctgtatctgtacccaaccttgacgaagggaacttgagaggccaagttttgcagatccctgttcaatcactgtcagacacagttggtagtctgaaggagcagatagctggagagttgcagctccctgctaataagcagaagctgagtgtgaggactagtttcctcaaagacaaccttactcttgcttactacaatgtgggtcctggagtggtgatcaatctaacactgagagagcgtggtgggagaaagaaatgagtaaatgagtcttttggttctcaatgtagtgtggcaggttaagcttacaactatacatcagcagctatcatggagaacctttttgctggatcttgctgctttacctttcattttattttcttttgtatgctaagtgcaatcatttgtgtaatgtgaacggcgtacattcctctatatcttgatatagttaaatgctgtgaggggttctgcctagtatgttacttgaggttgctactggatacctacatggccacttaatgttaaatcgtatggctgctctagctctagcttcttttgcttggtctttgtgagacgcctctctatattaagagtgcaaatttctgttttctattcaaagttttgtttttttccttgtcttatgggtgtacatgttattttgtagattcttatgtacaacattggtgatggtactatttgttcggtggttattttgaaagaatggcttggaatccattgcgtcacaactgctgaaatatcagaagtaggaattatgtttgtttgtataagctggaatctgaagtaggaattatttttgtta

SEQ ID NO: 13679 - DNA, 708 bp, Sorghum bicolor
  unsure (1)..(708): unsure at all n locations
  Clone ID: SORBI-28MAY03-CLUS1027_1
cgacaacagcgaacatctattgccaagcgtcaaatcttataatattaaaacacattaaaattgcacgtacataattaagttcacacaggaccggaccggagtacttccattatgctagcagcgtatgccctctctcccttgaccccttcttaaccactaaacaacaatacacaaaccaaagttcaaacgtaccttaacaacgtaataacacttggtgcatgcatgcatcatcagttagatgcatgcaaatcgatcgatcgcatcctataccatcatacattataagcagccattgcagctacttactaggcgtccatgcgcgccgggtactggtcgacgcagtcgagccaggggctgcgcgcggggcggcgcacgcggcgcacggcgcgccacaccgcgctgttgcacttgaatcctgacccgaaggcgagctgccagacgcggtcgccccggcggacccggcccttggcctccaggtacgccagctcgtaccagatgctgctgctggaggtgttgccgaatcggtgcagcgcggcgcgggaggcctccaggtcggagttgcgcaggcccaggttgctctgcaggtgctccagcacgtcgcggctggccgcgtgcatgcagaagtgctcgaacgcgcgcttgaagtccgggatgtatggcgcggcggcggaggcgtcccccggcgtggtcngcggcggcggcgtggag

SEQ ID NO: 13680 - DNA, 1582 bp, Sorghum bicolor
  Clone ID: SORBI-28MAY03-CLUS10664_1
gcccaagccgctagcggctcgttgcctgctgtgtcaattcggtcactgcctggggatcacgcgcggcccggccgacgcggcctccctgctgccaccgccggacgggcgggtgcgcggatccggcgaggtggcctctgggtcgatctggcgccccgcaaccccggcgccgcggttgatacgcgggtcggcgccggtgtgggggctgacgcaggaggccgccaagcagtcccgggagggctcgggttcgactggagattggaccgaagtccagggagcgtgggtattgcgaccgaaggcctcggtgccaccatttgtcctccacgttggtggaggaatttttgtcggagccgctccccagatcacataccgcttcttccttgaatggctcgcgaacaggggagcgttggtgattgctacgccttatgcgagcggctttgaccatttcttcattgcagatgaagttcaatttaagtttgataggtgtttgagaaacttggatgagcctgtaaatgatatcccaacatttggtgttggacattccttgggatctgttatccacatgttgattggatcaagatatgctgtgcagcgaagtggaaatgtactgatgtcctttaacaacaaggaggcaagctccgcggttccactattttcacctgtaattgttcccatggcacaaagttttggcccgatactgtcccaattgacatcatatccaacaatccgatttggggcagaagcagccattaagcagcttgagaatctaagcccacctgtggttaagcaacttctacctttacttcaacaacttcctccgttgtatatggacttagtaaatgggagggaggacttcattccaaaaccagaagagacacgccgcctgataaaatcctactatgggatttctcggaatctcttaataaagttcaaagatgatcaaattgatgaaacctctacccttgcacaagtactaagctccgaagcagctattagctcgttgcttgatatgtcaattcgatcacttcctggggatcatgggctaccattgcaacaggttcttcctgatgttccaccagcaatggctgatgcagtgaaccgtggaggtgaacttctggcaaatctgacaatgggcacaccatgggaggctgttgctaaggaggttggtaccagtttgggtactgactcaggcattctacgagcacagatctcaaaagacattgaaactcttgttgatgtaattgcttcatggatatcttcaaattctggtccaagactacttcgcccatgatcacccagcagtctgcgtacataaatgttagtaacagtgaagagcgacatgattgcactgatgaattgtgagttccgaaaaagttagattgcacttcagtgtgacatcttagtattttagatccatactgtagttcagaaaaaagtgaagatgtgtatttagatggtgtatttttgaactaagatattttagtagaaggaagcttaaggaatagaaataaaatgatagattctggctatggtaaaactgctaagctgtatgaaggagttttggcaattcaataattggcgattc

SEQ ID NO: 13681 - DNA, 1014 bp, Sorghum bicolor
  unsure (1)..(1014): unsure at all n locations
  Clone ID: SORBI-28MAY03-CLUS1043_1
gccggccgggtcgggatcggccgtgatcccgcaaccgcatcgactacttcccctatccgcccggggcatctcgcccgtccatctccgcaccgacggtcgggtccctccgtttcctcttaatttaaatacgctacccgccggcggcggcccggcaacccccaccgtctcctccaaaacgctcccctcgctgcgactcgtgtcggcgctcctctgcaaaaccgcacccgctccaagggaagttgatcgagaagtgttggtggacatgggtcagatccagtactccgagaagtacttcgacgatacctacgagtacagacacgtcgtcctcccgcccgaggtcgccaagctcctccccaagaaccgcctcctctccgagaacgagtggcgcgcgatcggcgtgcagcagagccgcgggtggatgcactacgcgatccaccgtccggagccgcacatcatgctgttccgccgcccgatcaactaccagcagcagcaggaggcggctgccgcgcagttgctcgccaagtgagcccctgctggcaagggtggcgaccagaaatgtttaaaaccctagtccccttttcatctctaaaaggggcgtcgctattctgttgattaattcctgtgtctgttggttggaaacttgggatctggctgttagggtggtgtctgccttgtgttcgtggaaatgcctgtgaaggaactgccatgtgttaggctgtgttatcatgaccattttcttaatgttatctgttactatgtcatcaggatgacactcctaaaaaaaaaaaatctgtgtgatggtgtgattctgtgaccaggatgacactcctgtgaaggaactgccatgtgttaggctgtgttatcatgaccattttcttaatggtatctgttactatgccatcaggatgacactcctgttgtgatgtgatctgtgtgatggtgtgattctgtgaccagnatgacactcctggtgcaaaaaaaaaaaaaaaaaggcccctaggccgcggccgctct

SEQ ID NO: 13682 - DNA, 1072 bp, Sorghum bicolor
  Clone ID: SORBI-28MAY03-CLUS24221_1
gcacgaggagctcttgaaccactaccgttataactggccggttaatcacacatccgtgagcccggataagaaacttttggctgtggttggagatgatcgggatgctcttcttgtggattcacgaaatggaaaggtaacctctaccctagttggccatctggactactcatttgctacggcatggcacccggatagccagacctttgcgaccgggaaccaggacaaaacctgccgcatctgggacacccgcaacttgtcgacctcgcttgcggttttgcggggcaacatcggtgcgatccgttgcatccgctactcctccgacgggcggttcctggtgttctcggagcctgccgactttgttcatgtgtacagcgtggcagcagactacaagaaacgacaagagatcgatttctttggtgaggtgtctgggatcacgctcagcccggacgatgagtccctgttcgtcggagtgtgcgaccgtgtctatgccagcctgttgcagtacaggatgatccatgcattcgactatcttgactcgtacgtgtgaagaatagagctttgtgttgtgctgggtactggctgaaggtcacttgctctcggtgacggttctggtgcgcagttcagggaatgtatctgcctgctgttgtgcgctagactcgacgtcagcgagtctgccgtgtaaatagttcagcaattgaagcgtagtgctgtggaccaatattgtctgaacatatgagcagagtaatgtatgtttgcgttgttggttccagactccagaatacaaatagttttggaccaaattcctaaagcggtgtactgtggaacagatgaagggctagtttggcttcaattgtattcacttcgatctctattggagtggattaaggtagaaattagtcaattttgcatttcaatccacttcgatacgtgattgagatggagggtagttaacatctgttgtttttattaagagcctgtctgttagggtttttgtcctagatttacaaactgtttttctaccttctactaattaggaccctaatgaaataattttaatgtagaagctatcttg

SEQ ID NO: 13683 - DNA, 1436 bp, Sorghum bicolor
  Clone ID: SORBI-28MAY03-CLUS24532_1
ctactggaaggcgaagtgtatagtgtggccgagtccaggctccagcgtaacacggagcaggatgatggccgccggccggccctgccctttgcgcggcaatcctcctctccaaaagcagggcacgcggacacccccagacaccaccaccccccccccaagctgaccagcacaagcaaacctcaaaagcgctgcgctgcgctgcgtatcatatcgccgtgcgcccctgcccctgctacgcagacaccaccccagctgcgagcgacacgagagacaaccacggccagctcctgcctatgttattcttctcgccttcttgctcgccggcatagaccgcagctcgcatgatcggttgcaaagctcgaccggggagcgagatagaccgccgatctagctagctagtccaaggcgggccagggcactgctggtggtggacgtcgaccatggtggcgctcgggcagggggggaacaggacgaaggaggcggaggaggaggcggcggcgcggtgggagagcgagaaggaggcggagatcgactacgtgttcaaggtggtggtggtgggcgactcggcggtgggcaagacgcagctgctggcgcgcttcacccgggacgagttcgcgctcgactccaagtccaccatcggcgtcgagttccagacgcgcaccctcacgctccaccgcaagcgcgtcaaggcgcagatctgggacaccgccgggcaggagaggtacagggcggtgacgagcgcctactaccggggcgcgctgggcgccatggtggtgtacgacgtgacccggcgcgccacgttcgagcacgtggcgcggtgggtggaggagctccgcgcgcacgccgacggctcctccaccgtcgtggcgctcatcgggaacaaggccgacatgcccgcggggaggcgcgaggtggccgccgacgaggccgcgcgcctcgccgaggagcaggggctcttcttctccgaggcgtccgcgctcacgggcgacaacgtggagcgcgccttcctcacgctcctcgaggaggtcttcgccgtcgtgtcgcgcagggcgctggagctcgacgaggcacgccggatgcgcggcgaccagggccagggcgatggcggccgaggcggcgaggtgctgtcgctcaaggggaccgccgtggatgtgggctccatcatggagaccagcgccatgaagaggagctcgcagtgcgcttgctcatgatgcgtctttagtgcacatgtaggagatattattatttaaaaatataccttttctaagaacttcacatttacaagatgcagattattacactcttcatggtttattaggcaatgttaccatgtaaagctttgtacgtgtatctgatccatctgtcattcatcatttttttccttcgattttttgatgcaaagaatatgcggatttgtgtcaacaaactcgtttttc

SEQ ID NO: 13684 - DNA, 693 bp, Sorghum bicolor
  Clone ID: SORBI-28MAY03-CLUS25340_1
gcggcaaggtcacgctcgccgcggtggagaagatggagctggccaagtccgtggtgtgggagtcgctgcgcctggacccgcccgtcaagttccagtacggccacgccaagaaggacctgctgatcgagagccacgacgccgtgttccaggtgaagaagggcgagatgctgttcggctaccagccgtgcgccaccaaggacccgcgcgtgttcggcgacacggccaaggagttcgtgcccgaccggttcgtcggcgaggaaggcagcaagctgctgcagtacgtgtactggtccaacggacgcgagaccgagaaccccagcgtcgacaacaagcagtgccccggcaagaactttgtggtgctcgtcggcaggctcttcctcgtcgagctcttcctccgttacgacaccttcaccgccgaggtcgccacggagctgctcggcgccagtgtcgtcttcaccgccgtcaccaaagctacctcaggtgcgggcagcgagtagatcaccggccggcgcgtcgtcattggttggatatttggagggtcccatttcctatatatatatttcgtctctttttttcccctagccttgtaataagatttctctctctctctctctctctcctcttcacgtgtggttttgtaatgcatgttggcatgttgcataaattgctccagacgaaatcttatctttccca

SEQ ID NO: 13685 - DNA, 1200 bp, Sorghum bicolor
  Clone ID: SORBI-28MAY03-CLUS13902_1
tgggtacttcgcgcgcgggcctcgtcctcttccctcttgccgtgcccatccctgtcccaatcaaattgatcgattcatcgcccgcaacgccgcagcagctgcagcagccggcaagcaacaaggcgagatcgttcgtcggactcgcaggcgcagttactgaagatacagtatgacttctctggacaccgtgagaggagatcttgccctggttattttgtacctaaacaaggctgaggcaagagataaaatctgcagagcgatacagtatggatcaaagttcctgagcaatggagaaccagggcctgcacagaatgtcgacaagtcaactagtctggctcggaaagttttccggctttttaagtttgtcaatgatctccatgctttaattagtcctcctgccaaaggaactccacttccactgatcttactcgggaagtcgaagaatgcgatgctgtcaactttcctcttcctggaccaaattgtgtgggctgggaggacaggaatatacaagaacaaggagcgagcggagttccttggaaggatagcattttattgcttcctcggttcaaacacctgcacaaccattatcgagctagctgagctccaacggttatctgcttcaatgaagaagctagagaaggagctgaaacaccaagagttgtacaagaatgagcagtaccggatgaagctgcagaagtcgaacgagcggctgctggccctcatcaagtcgagcctcgacatcgtggttgccgtggggctgctgcagctggcgcccaagaaggtgacccctcgtgtcacgggcgcgtttggtttcgccagctcgctgatcgcttgctaccagttgcttccaagcccaccagcgaagagcaagtgagtacacgacggcggcggctgctgcatatgcagagatcggcttggtgcgtcgacgatttgatggatggcatccttgtcagcaggaaataattcccggatggaactctcagctctgcgtgtagcgtgtactagtaggtcggttgccacgcaaggtggcggtaaccacggcaattgtggtgtctgttctggtggactaatcataaataatcatattgttgatggtttggttggttggttatgtagcttgaaggcacagtgacctgtggcagaataaagaaaatagccacctgtgaaaacgattcgtgttatagcatcaccaagtactag

SEQ ID NO: 13686 - DNA, 928 bp, Sorghum bicolor
  unsure (1)..(928): unsure at all n locations
  Clone ID: SORBI-28MAY03-CLUS11131_2
cggacatcgagaggtgaaccagcagcctcctccaaataagagccagccaaaagaaactaataaactctcgccgtcgtcgccgctccaccgagagagagaaacaagcccgccagccagccagccgaccgacctcaggtaagccgccgccgccgccgccgtaccagtaccgccaccaccaccgcaagagcgagatggagatgaagatgaggatcctcttcgccctgttcgtcgccgccgcgtctgtcaccgcggtgctggcctccaccgaggccggcgccggtgccgccgccagtggcgccgtcccgactgcctccgaagtgtccgccgccggcgccgaggcccccggtggtgccgccgcagcaggtggcgccaccgccgccgcggngcccggcgcagccagcggcgcgcccgccctcgccgncgncacccccgncgncgcgctcctcttctccctcctcgcctactacctccactaagcgctcgcggatgatggatggacggatcgacccaccgttgccttgcctcggtgttgctgcggtggtcggtcggtcgagttggcgagatccaaatttggcttgcaatggcatatgaagccaataggaggcacaaggattgcattgcattgtacaaagagttggagagtacccaccctatgatcaacatcagacggcaggcagctgaacttagatacattttagaggcacccaagttgaagatatcaaacgacgaggtggtcacaataccacaaattgggagcagctgggattggtatgctggaacatggagcgacaaaatcaaggaacaagaggacaagaaaagaaagatgattgctgctagcaaccaagttcaaccttctccaaacatctttggagacttctctttcttgcgactgccaagtgaatggaaaaagagtgcatgggtgattgta

SEQ ID NO: 13687 - DNA, 1312 bp, Sorghum bicolor
  Clone ID: SORBI-28MAY03-CLUS11131_1
gccccccccccgtcgcaggtggcgtggcctgttctttcccggcgcggggcgccggcctcctcctcggcgacgccgccagcctgggggcctaccacgccctacgccgccggaggacgcacctctaccgtcgcaactggggctccaagcccctgccgcgcccgccggtctggctcggcgcggccgctcgtgtttcacggaatcgcgacgaccgccgtggccacgtgcccaggttcgccgcctccgcctcgggcggccgtgacgagcccggggagctagccgaggacgaggcgcagaggaagagggagcgggaggcggagctgaatcgccgactgaaggaggccgaggagatggaggagttggagcgcaccgccgagcagctgcagagccaggccgccgccgaggcccccgaggagtcggaggaggagaagcgtgagcgtgtacgccgcgagctccagaaggtggcgaaggagcaggcggaaaggagggagacggcgaagcaaatgtttgaattggggcaaagggcctacgggaaaggaatgtatggacgctcaattgaattcttggaggctgcactcactatcatacgtccctcctctctcctcggtggcgagatccaaatttggcttgcaatggcatatgaagccaataggaggcacaaggattgcattgcattgtacaaagagttggagagtacccaccctatgatcaacatcagacggcaggcagctgaacttagatacattttagaggcacccaagttgaagatatcaaacgacgaggtggtcacaataccacaaattgggagcagctgggattggtatgctggaacatggagcgacaaaatcaaggaacaagaggacaagaaaagaaagatgattgctgctagcaaccaagttcaaccttctccaaacatctttggagacttctctttcttgcgactgccaagtgaatggaagaagagtgcatgggtgattgttactttgtgggtccttttgattggaacagcaatctatctgcaaacatgaacaactcctgcaactctgaaacatgccactcgcatctttgccaggcactgatccatggttcaaacccagagatgttgctaatatggccgtgcctcagactcctctaagacatgataggccctggtggattgcatttgttattttaggcgtgctatccaagaatgcatcgtatactcttccggactggcatgggccatttgtcatttgaagattttcttttgctgcaatgtaaatactaactattgtaactagcaatgcaagcagatgtcatctagttcaattgatta

SEQ ID NO: 13688 - DNA, 1052 bp, Sorghum bicolor
  Clone ID: SORBI-28MAY03-CLUS13992_1
aaaaaacttccatcaactttcacttaagcccacggatccagcggcccagcgtgagcacgaggactctctggccttttttctctcggtcccaagcagctgcacgcgcgcaccgcccctcgccgccggccacgctcctctccctctccgccgccgccgcagctgcaggaactcgcctcgccggagaccatgtaccgcgccgccgggagccacctccgctccctcaagcatcatggtgcttctaggtttgccagcacaaatgttgtgaagcagtcctcaggtggtctgttcagctggcttcttggtggaaaatcaagccaactccctccccttgatgttccgctcccaggcattgccattccctcacctctaccagattttgtagagccatctaagacaaaagtcaccacacttcccaatggcgtcaagattgcctcggagacatcatcgagccctgcagcatctgtgggtctgtacattgactgtggttccatctacgaaacacctgcttcatctggagtatcacatctgttggagagaatggctttcaagagcacagtgaatcggactcacttgcggttagttcgcgaggtagaagccattggagctttggtcgccgcttcggcttctcctgagcagatgagctattccccgctcgcattggcgtcatggggcgatgttattcatgttcctagctacgagtctgtcagccgcaagtttcactcgaagtgaggattcagcattggacttgcatgacctgttccaacaactgaaggtgaagcctgcaacggcccctcagctggaatagttactcacagaataaaaatcatgtgatttctagtgccccttccctgcgtgtatacgctaaacatgtttttgataagaatcaggcaacttatttttcagtatcgcagcggcactagattttgtggataaatgagctttctgggtaagctcgtgcagaaatattttcccaacatattttgcagtttagacgagaaagacacatgtcccattttgcatgtttgtgttggatgcatggcgtactctttcgc

SEQ ID NO: 13689 - DNA, 446 bp, Sorghum bicolor
  unsure (1)..(446): unsure at all n locations
  Clone ID: LIB3480-010-P1-K1-E6
ggcgatcatgtccaacgaggagttcgaaacaaccttctgtctgaccttccgtgtgtgaaacgtcctgaagagccaaaatctgtgtacgtgggaggggactatcgctgccaagcagattctccaagcacacacattgcacttgcttttgaggtgccaggaggctggaatcaagagaaaactgcaatggttgtgacggtgctccagatgctcatgggaggaggagggtccttctctgctggtggacctggaaagggaatgcattctcgattgtatctccgtgtcttgaccaacttccaacagattgattcattctctgctttcaacagtgtctataacaattcaggcctttttggaatttatgcagtcactagcccagacttttcatcgaaagctgtggatttggcagcaggggaactcctggagatngcaactcctggaaaagttac

SEQ ID NO: 13690 - DNA, 1223 bp, Sorghum bicolor
  Clone ID: SORBI-28MAY03-CLUS1211_1
atgaaaacagcatacaagaaaccaaatgcgctcccaggttacttagaaacaaagcttagctcatctaagccaagcatataaatacatcattgcctaccctctattatttttaatctagcaatttgatgaataaaaagtgaatttattgtcgcataaaaacaacatagacctactccaacaatgtatagaaacttatgctcacaagcattaagaatacaaaaatgcatagaagtgctccattgtgtgtatagaaacttatgcacacaagcataagaacaccaaatttaacaaacaaaatgcaaaaatccttggtcgcgtcgcgctgctcctttgctatcttccatccaaccgaccaccaccgctgattcgcactagcgccgccaccgtgaactacacgccaccacccgccaccgctgcttcatactagcaccgcggccgtagattgcatcatgcagtggacttgccaccagaatggttttgcgttgatagcttttcatttcatgcaaaccacctattcatccaaggctgcaaccaaaaaatcagataaaacccatacaactaagcatagaagaattgtgcgcagataattattctaacagtgcatataaaagtgatacataattagtgttatctaataaacccaagaccaatatataacaaagagataatgattacaaaagtataagtcgaattggtcttaaagtgcttagaaaattgctccacaatgtataatgaccgatcagatacttagaattagtagtcaagttgcgcagaaacatatacagctacgcttaattatagtttcaccatgcatcagaatctacacatgcaaatataagaactattatctttcctttggatcagcatgcaaaaatcttagcacccaaccaacaacaaaatgtataaaatgtgctccaagcaatgtataaaaatagtagtaacaaatcagagaaagttttgagtatacacatagaaagactgaggataatcatacaacctgcatagaaaaaatatgaaaaataaatcacagaagtggaaatgttgagcaccctctgcagccagcaatgctagaatgctcccaataaatcactgagtagtgcgtagaaacatgatactagttttttatcaggtacgagaacacaatttcatcatgcatacacaattaggcatgaaaccatagtaaccaagtaaaaaataaaaaaatatagaactagtcctcgtgc

SEQ ID NO: 13691 - DNA, 360 bp, Sorghum bicolor
  Clone ID: LIB3476-040-P1-K1-G3
cggtcgaccacgcgtccgtcaatgtgcctcagacatatgacaccaatggaaagaaatccttccaaccatgctacatcacaacaaagccaccattgacctcccacgaaatagaggaatctattttaaccatcctgtggaagacatccttgaccgagtcacgccattgctgttgtccacaccaccatccaccaccacccattcgcaccacactcatacatgcagtttcacaaataacgggtaattcgtttagacagcaagacaggcataggaacatgttttagcaggagaaggcatatgaacttgagcaagatttatacgtggacgttattgagttggcacgcatatcctagatatatgact

SEQ ID NO: 13692 - DNA, 393 bp, Sorghum bicolor
  Clone ID: LIB3480-034-P1-K1-G7
gacctactccaacaatgtatagaaacttatgctcacaagcattaagaatacaaaagtgcatagaagtgctctattgtgtgtatagaaacttatgcacacaagcataagaacaccaaatttaacaaacaaaatgcaaaaatccttggtcacgtcgcgctgctcctttgctatcttccatccaaccgaccaccaccgctgattcgcattagcgccgccaccgtgaactaccagcaccgcggccatggattgcatcatgcatggacttgccaccagaatggttttgcgttgatagcttttcatttcatgcaaaccacctattcatccaaggctgcaaccaaaaatcagataaaacccatacaactaagcatagaagaattgggcgcagataattat

SEQ ID NO: 13693 - DNA, 337 bp, Sorghum bicolor
  Clone ID: LIB3478-028-P1-K1-C12
ggaacatgtgactagaggcaaggaggatcctacacctactgctgcagctcccccaggctccccatgtgttctatgcttgatgagttaggtttttacacttttagatcaagcctttgactatgaaatttgattgtttttttttgcagatttagaatacgacacatatcaattttgtgtgcttgcatttcttgattgttcaaattattcatgcttagttttattcatgcttaggtttctacgtaattttgatttaaaaaattgatgtatcccgcgagagacacctggtgagtttctatgcatgtggatggattggtctatgcattttttgcatgctgat

SEQ ID NO: 13694 - DNA, 1337 bp, Sorghum bicolor
  Clone ID: SORBI-28MAY03-CLUS1615_1
cggcacgaggctctctctcgcctctggtgcgcagagctctcttgaagcctcgagacccgtctcgccactgctgctgttctcagctctgccgctgcgcaagctgttgcattgcagtccgcgagccttgagctgcagctgctagctcgctcttcaccacagtccgcagacatggagttcgaagaccgctgccacaaggtccaggagcccaagttcgactgcctcctcttcgacctcgacgataccctgtacccgctgagctccgggatcgcaggccatgtcaagaacaacattgaagattacatggttgagaagctgggtattgatgagagcaagatcgagaacctgggcaatctgctgtacaagaactacggcaccacgatggctggcctcagggcgatcggctacagcttcgattacgatgagtaccacgccttcgtccatggaaggttgccgtacgacaacatcaagcccgaccctgttctcaagcacattctcaagaacctgcgcatccgcaaactcatattcaccaacggcgacatggtccacgccgtgagagccctcgagaggctaggcctggaggactgcttcgaggggatcatctgcttcgagaccctgaacccgccgtgcccgccgcagggagacgaggagccggagatcttcgacatcgccggccacttcgcccgctccggcaccgccgacgagcttcccaagacccccgtcctgtgcaagcccaacgtcgacgccatggaggaggcgctcaggatcgccaacgtcaacccccacaaggcgattttcttcgacgacagcgtacgcaacatccaggccgggaagcagatcggcctgcacacggtgctggtgggcaaatcgcagcgggtgaaaggcgcggaccacgcgctggagagcatccacaacatcagggaggcgctgccggagctgtgggaggaggccgagaaggccaaggaggacgtgctctacgccgaacgcgtcgcgatggagacctcggtcaccgcgtaaaacctcccgaatcctccggagccgaactttctcgacatccagaaacgcgacgatcacacatcactgcccgagccagggctggtgagctcacgctggaactgactgaatccagcaatggccgggccaaggatttccgacagcaggagggggtgcagcatgtaaaggggggaacagcagatgagatcatgtttgggatggtcccaatatatagttatgtatcagccagacctttgtttgtaaattaccagcattagaagtaataaggaaatggagtttacttgtacgtttcttgtgttctgtcatctgaagcaataaaacgggtt

SEQ ID NO: 13695 - DNA, 1033 bp, Sorghum bicolor
  Clone ID: SORBI-28MAY03-CLUS16319_1
ggcgctgatcctctccggtgtcgccatcgcctccagaacctccgcctcgtcagggtgcctcctggtgccgttgggacccgggcgccgcctgccgcattcccctgcgtcgccaccacacgcacacggaagcgagagcttatcggcggcggcgaagatggtgtcgctgaagctgcagaagcgcctcgccgcgagcgtcctcaagtgcggcaaaggcaaagtctggcttgaccccaatgaagtcagcgagatctccatggccaactcccgccagaacatccggaagttggttaaggatgggtttatcatcaagaagccccagaagatccactcaagatcccgtgcaagaagggcacatgaggccaagcagaagggaaggcactctggatatggcaagcgcaggggtaccagggaggctaggctccccaccaagattctgtggatgaggaggatgcgtgttctgaggcgcctgctccgcaagtaccgtgaggccaagaagattgacaagcacatgtatcatgacatgtacatgaaggtcaagggtaacatgttcaagaacaagagggtgcttatggagagtatccacaagtccaaggctgagaagctcagagagaagacactttctgatcagtttgaggccaagcgtgcaaagagcaaggcgagccgcgagaggaagattgctaggagggaggagaggttggcacagggcccgagagaaccaacagcaccagtctcagccactgctccatctgctggggcaccaaagaaagcaaagaagtgaagtattgaaacaaagctgcttgctagtactatataagcataattttggagcacctgaactattttgctgttatatagtttggtgtcttgatattctgagtgtcatatctcgactgttctgttggataatgcagtagagttgtttatggagtttcgttggaacaggatccccaaaaaatgtttatttgacagatgatctacagatgatgatctctggatgtgtggttatcttttatgaaaattagtcttatatctt

SEQ ID NO: 13696 - DNA, 905 bp, Sorghum bicolor
  unsure (1)..(905): unsure at all n locations
  Clone ID: SORBI-28MAY03-CLUS14000_3
aacaatctggtcgatctctcccgccaaacccccaaaaaaaaacacccaacccaatccgatcccacagaaactctctcagtttcagttcgatcgatcgctcccgtctcgatcgtttgcacaaaaacatggccttcaacctggctcagtgcgccaccgctgcggcgtccgtcgcgccccgcacccctcgccctgctaggtccgcggtcgcggcgtccgtgtctgtctccacaaggaaggcggcggacggcaggctgcggctgcagcggcaggcgagctgcgagccgtcggtggcgccgtcgcgttcggtgttctgccgggccgcggtgtcggggaagagcgcggccgaccgggccgcctccaccaggaggaggtccggcgtgccggtgttcgtcatgatgccgctggacaccgtgaagaagtgcggcagcgcgctgaaccgccgcaaggcggtgcaggcgagcctgtccgcgctcaagagcgcgggcgtggagggcatcatggtggacgtgtggtggggcatcgccgagagcgacggcnccgggaggtacaacttcgcggggtacatggagctcatggagatggcgcgcaaggccgggctcaaggtgcaggccgtcatgtccttccaccagtgcggcggcaacgtcggcgactccgtcaacatcccgctgccgcggtgggccgtggaggagatggagaaggaccaggacctctgctacaccgaccagtggggccgacgcaactacgagtacgtctccctcggctgcgacgccatgcccggcctcaagggccgcacccccgtcgagtgctacaccgacttcatcgccttcggattcacacacgcagccgccgcatgaatcatcatatcaatcatcatttttttcgcaaaaaaaaatcggacgcgtggg

SEQ ID NO: 13697 - DNA, 834 bp, Sorghum bicolor
  unsure (1)..(834): unsure at all n locations
  Clone ID: SORBI-28MAY03-CLUS14000_2
cagcgtccggcctgctgtgctggtcctcggcctctgcctgctgctgctgctgctgcttggtgttgcgcaggcggtggagtttgagttggtgcctgatgctggtgccattgatccgatgatgatgcctgccatggacgacgtcgacggtggtggtcgtgagccgccgcgcgagtgcatgacaccggtgagcgtggaggaggcgtgccgcggcgcgtcggagctgcacgccggcgtggactacgaccactgcatggcgtcgctgggtgccgacccgcgcagcaaggaggccggcaacaagaacatgcacggtctggccgtgctcgccaccaagatggccatcgaccacgccgccagcaccgagtccaagatcgacgacctcgccgagctggatgcggataaccagtcgtcgtcgccgcaggcccgccgcgcccgcttcaaccactgcctcgagcagtacggcggcgccgccgacctcctccgcgacgcgctcgacaacctcaaggccaagatctacggcaaggccatggagcagctcaccgccgcgatgggcgcctccgagagctgcgaggacgcctggaagggcgaggaggaaatccccgtcgccgcgcacgacagggagtacggacggatggcgcacatcgccttcggattcacacacgcagccgccgcatgaatcatcatatcaatcatcatttttttcgcaaaaaaaaatatatcaatcatcatctatatatgcatccatccatgaacgtaagaactccgtcctcttcttcttgcatcgtccatccaacatccatcatgcatctncgtcgacgtactcngcggatcgatgat

SEQ ID NO: 13698 - DNA, 675 bp, Sorghum bicolor
  Clone ID: SORBI-28MAY03-CLUS14000_1
gcgggcgagaacgcgctgccgcgctacgacgagacggcgcacgaccaggtggtggccacggcggccgacagggccgccgaggaccgcatggtggcgttcacgtacctgcgcatggggcccgacctgttccagcccgacaactggcgccgcttcgccgccttcgtcaagcgcatgtcccagccgggcgcacgggacgcgtgccgggagcaggtggagcgggaggccgacggcgtcgcgcacgccacccagccgctcgtgcacgaggccgccgtcgcgctcaccaactgacctcgatctgatgcgcgcggtggccggcgttcccaccctctttgcctgcccgtgttcactagtagacggtgttatgtacgctactctactacctcctcctcagtacctaatcatacataagctgtgcgcccgccggcgtgtcgtcgattggtgcgtgcgccgcgcaatagtgtacgtaaaagggatgctgcgaccgaggtaggggtcggtgactgggtacggggtacggtacacgttggaggctttggcgttggtcagagcttggcaggagatgggtttgatgttctgctgctgtgttactatcctacacgtacagaatcatgatttgtactgctataatttgaaacaaagaaacgaacttttcaaaaaaaaaaaaaaaaaaaaaaa

SEQ ID NO: 13699 - DNA, 1257 bp, Sorghum bicolor
  Clone ID: SORBI-28MAY03-CLUS28732_1
agcaaagcaataaggcaaagccaacgacgctctgcactcgtctcttgtccttactgccgccagtcccagacgccgacgtcgaccagaccgttgcatcaccatcagcaccaccaatcgtgaatcctcatcatcagcctctgctcttgccttgctgctcctggcgcgcgccctcggcggcaccgcggcggcggagctgtacacgggcctattctccctctcctcccccggtgtctacggcgccgacaactcggtgatgaaacccgccatcgacggcgagaagcacatgggccccgacctcgtccgtcttttctcccacgactgcctcgtccagggctgcgacgcgtcgctgctgctatacgacacggactttttccagggcgagaatatggcgacgcacaacaaccgctccgtgcgaggcttcgggcacataggcgacgactgctggggcgtcgagtaggtctgccccggcgttgtcgcccgccgagacatcctcccttgcggcgcgagcgactgcggtgatgcctggcgagtgacgttttggagcttcacatatattttgcaactgtgaagtcattgtgttgtgtttgatgtgtttgcatgtcatttctttttaaatcatgaatgaatcactccttgttctttccgccgcgcaaggcctctcccaaaaggacatggtcgcgctatctggagcccacaccattggcttagcacgctgcaccaacttcagagcccacatatacaatgacaccaacatcgacggcagcttcgcaagatcaaggcaatcggtttgccctaggacctcaggttcaggtgacaataatttggcgccactagcccttcaaaccccaactgtttttgagaacaattactacaagacccttgtttacaagaaggggattttacactttgaccaagagtttttcaatggtggatcaaccgatgcgcaagtccaatcatacgttagtagccagagcgcgttttttgcggactttgtgactggcatgatcaaaatgggtgacatcatgccattgaccggctccaacggggagatcaggaagaactgcagaaggattaattaagaggcagtgcccactagctatttatatttctgttgaggattttcaacaacgtcctactttatttcaagtttgtaatccttccattttttacaaaactatgaagtcattattatggtgtactaatttgttgagcttatgtatgtttgtttaaataagtagtgatatatcatttgttttg

SEQ ID NO: 13700 - DNA, 1785 bp, Sorghum bicolor
  Clone ID: SORBI-28MAY03-CLUS3068_1
accgagagtggtaggaaagctcgtcgccgtacggggctcggctcaggtgagagcgagcgtcgggtactgaggccggaggcgatgccgatgggccgcctccgcgacgggcgagccttcctccaccgcgcgctggtcctctcgtcgctgctgctcctcgcctcgggcgaaatcttcttcgaggagcggttcgatgatggttgggatagccgttgggtgaaatctgattggaagaagagccaaggacaaaccggaaccttcagacacacagcaggaacctattctggagatcctgacgataaaggtatacaaacaactggggatgccaaacattttgctatatcggcaaaattcccagaatttagtaacaaggaccggacattggtgatccagtactctctaaagattgagcaagacattgaatgtggtggtgcttacatcaaacttatgtctggttatctcaaccagaagaagtttggcggcgacactccttacagcttcatgtttgggcctgatatatgtggggatcagaaaaagaagcttcatctcatactttcataccaagggcaaaactaccctatcaagaaagatctaaaatgcgaagcagacaagttgacacatttttacacatttattctaagacctgatgccacttatagcatccttattgataaccgggagagagaatttggaagcatgtacactgactgggatatccttcctcctcgtaagatcaaagatgttaatgcgaaaaagccaaaagactgggatgacagggaatatattgaagatcctgatcaagttaagccagagggatatgattcaattcctaaacagatacctaatccaaaggacaaaaagcctgagtcatgggatgatgacgaagacggtacatggaagcccagaatgatacctaatccagaatacaagggaccatggaagcggaagaaaattaagaatcctaactacaaaggaaaatggaagaccccgtggattgacaatccagagtttgaggatgacccagacctatatgttttgaaacctttgcagtatgtggggattgaagtctggcaggtcaaagctggttcggtttttgacaacattttgatttgcgatgatccagactatgcaagacatgttgtagatgaaacttttgctgcaaataaggaggctgaaaaagaggcctttgaaggagctgaaaggaagaggaaggctagagaagaagaggaagcacggcgagcacgggaggaaggggagagacgaaggcgggagagggatagggaccgtggcagggaccgttacagggatagatataagcgccatagacactacgactaccatgacgagctatagatcatgtgttttgaaatctgcacgttattggttgtctatggaactgggccttgatgattgtgtcaataaggtgtaccacttcagggcgagcacagatgtttgaagtccttaaccgtactgttacagtcgttgagagcacacgcacacgtgcagaacttgtatgttgtacacacgaatcaagctgaatttgtgatttttggcgatgggtagagattgaccatcgcggctgtaactaaatttccccattgcgaggcaatatgagctgtagtatccttgcactatcatttacctcgaaatgttatattcgtgctgcatacgttgataaacctttcattgtcaggagtcgggacaaggaaaaacacgaaatggccctagtcactcaactttttacgacttaaaatgactagtgtgcccgaatcagaatccttttatatt

SEQ ID NO: 13701 - DNA, 825 bp, Sorghum bicolor
  Clone ID: SORBI-28MAY03-CLUS32738_1
ggtaccttcagcctgcgccagatacgatttgccagtgtggatatggaacttcatacaacttatgatcccaatggctcactgtccatatatgatgttgaccgaagagttgcagaacggacacaagttcttgctcctctgccggaagacagattcctgtgcagctttagccatatttttgcagggggctatgctgctggatactacagttacaagtgggctgaagtactgtcagctgatgcattctcagcttttgaagacgctggtttggataatgagaaggcaattgaggaaactggcagacggttcagagacactgttcttgcgcttggaggtggaaagtccccgcttgaggtgtttgtttcattccgaggacgggagccttcacccgaaccacttcttaggcacaacggcttgcttcctgttgctgcgtagtgctcagtgctcagcagcattcaaagatttctcggcccggggcgtcgaccgaaaagattgccgtgccaattaggctgttatttatgcttaaacagggatcgtttgtggtggttacaagtataataatcttataacgcattttcatagcagttgattgtatatcgactagtggcacaaccacaaacaaagccggccaatcgcagtattttcctagaaaaaaaagaatagttgtttggccccttggtttgctttgatgaagatagacgtttcggtggtaacgtagttgtagctttaacgaatattagagtttgaaaacctatttatggatcgtcatctgtaggtttctatatatctttttatttagacatgtgaaataaatccaacattaaggac

SEQ ID NO: 13702 - DNA, 780 bp, Sorghum bicolor
  Clone ID: SORBI-28MAY03-CLUS1728_1
gatgcacaatgcacgaaaaatatccgcctcctttttacaacattcttagggatccgtaaaaacccacggacaaaacgacggtttcatactgtaaaaaaacaaaccattattcacgcaaacagtatgtctatttacataaagaactacgtggcaattatcatccttcttctcccttccagaaacctagtccaataatgcttcgcaatccacaatgggtggcttaagctcaggataatagcaggcaaccattggctcaccatacaaatttccctctttgtcaagccatcttcgctctggtcaggcagcgacgagccagagaccccctactcctatagttcaggaggttttcatccatcatattccccattggcaaacttgtcctcagcatagcagacagcgaccacagggttcccaccaaatttccttccatgcaatgctgtctttgctttggccgcaccatcgatatctgcatattccaggaacaccttcccaactcctgcgactggctgtccgctggggtcaggacgtgggatgatgactttcaccaaagtaccatatttgcctgcttctagcctcatgtcttccataatgtcctcatattcttcatcatctttcaattcatctgctgttaccacctgggtgaggcaaacaacctttgtagggagcgccccaacttgatacacaagtttctgtaactgcacctgttgctgtgcctgcaataggatactttcctgctctggtctgggctgagatgccccctggtttgctcgtctgacagta

SEQ ID NO: 13703 - DNA, 1225 bp, Sorghum bicolor
  Clone ID: SORBI-28MAY03-CLUS17718_1
gccggccgggccgggaggcgccatcaacctctgcagctgcaggatattgtggttgtggctgtgcttccgttttgcagcctctagggtgcttgcatttgcattcggtagtgcaggtcactgacggcgaagaatggaggcgtacgctgccggagccaagttcgactgcttgctatttgacatggatgacactctgtacccgctgagccttggcatcaacctagcatgccgcaagaacatagaggagtacatgctgaacaagctgcggatcgaggagagccaggtccccaagatgtgtctcgacctgtacagggagtatggaactacaatggccggcctcaaggttttggggtacgatttcgactacgacgacttccatgcctgcgtccatggaacgctaccgtacgagaaggtgaagcctgacccggtgctcaggcagctgctgctttccctgccgcagaggaagatcattttcactaactctgacaaggcccacgcggcaagagtcctggagaagctcggcctcgaggactgcttcgaagggatcatctgcttcgagaccctgaatccgccgccgaccgagaagaaggacgatggcagggggatcctgtgcaagccctcgctggagtccatggaagccgtcatcgagatcgccaagctcgacgccaagagaacggtgttctttgacgacagtgcgcgcaacatcgccgccgggaaggccgccggtttccacaccgtcatcgtggggagctcggcgctggtgccaggggcggacgtggcgctggagagcatccacaacatcaaggaggcgctgccggagctctgggaggccgccggcgaccacgtcgaggccgtcctccggtcggccgccgtggagaccacagtgattgcctgaataatatgaagaaattattaacaggtcacggcctcacggccacgtaatgcgctactgtatagtttatatgtcgtgacgtgcaaattaaaatgccaatgtggtgtgcctgattaagccttattaagcaccgtacgtagtatataattaccaaggaatctcaattactaatatgtgccggaccggaacttactggtactaataaggtttgtgtagttcatcctattggtccgtgtttttttatggcgcggccccgttgtgaaaatggatggctcgttgaaatggacacgaatttttgttgcctaagtgctgcgagcactgtgccacgtattgaaa

SEQ ID NO: 13704 - DNA, 1222 bp, Sorghum bicolor
  Clone ID: SORBI-28MAY03-CLUS17664_1
gcacgagggtcccccttctcgccggccgttcttgcgacggaggccacagccgaggaaacaaaacgatattatgcagctcccctgaatcgagacccaccgctccgctctgcctcacctcgccgactagggtttttgccgccgctgatctcgccgtccccgccatggacgcctcgcacacgggcttctcctccgccgccggcgaggccccgaccaccggggagcaccggatggggaccaccatcgtcggggtctgctacgacggtggcgtcatcctcggcgccgattccaggaccagcactggaatgtatgtagccaaccgtgcttcagacaagattactcaactgacagacaatgtgtatgtctgtcgctctggatctgctgctgatacacaagtcatttcggactatgtacgttatttcctccaccaacacacgatccagcttggacaaccagctactgttaaagttgcagcaaacttgattaggttgctagcttatcagaacaagaacatgttgcaagctggcatgattgttggaggatgggataagtatgagggaggccaaattttctcggttcctcttggtggaactatcttgaagcaaccatttgcaattggaggttcaggttccagttacctatatgcccttcttgatcatgaatggaaagagggaatgagccaggaagaggcagagaaatttgtggtgaaggtagtttcccttgctatggcccgtgatggtgctagtggaggggttgtccgtacagttactataaatgctgatggcgtgaagaggaacttttaccctggcgacaagctacccctgtggcacgatgagctggagccccatcactctttgcttgatattcttgccgctgggaaccctgatcccatggtgcagtgaatttgccctccacttcctttgtgaacttttcactgtatctgacttgttcaaacgattggaaccaattcctgctgaactatgtcacaccagagtatttacatattgttatcacccctgtttagctgaattgttggtgttttgagttaatggttactggttagcgtgctgttgctgtagttgtatttggtgagtatacagtttcatcagctgccaattcatcatatgcggtgatgcatcagtaatgcatccctcgtagcagccattctatatctgctacaagaggtcgttctgcctgcttaaaaaaaaaaaaaaaaaggccccta

SEQ ID NO: 13705 - DNA, 2066 bp, Sorghum bicolor
  Clone ID: SORBI-28MAY03-CLUS2295_1
gcacgagggagttgtgcagctcctgtctgtcgctggtggtttcatctcccatctcatatccgatcttattaacaagaagctcaaggagaatgaagtggctcgcgcaattgaactgagagagatcgttacgtctctgggtcctgcttacatcaagcttgggcaggcactaagtatacgtccagatattctgtcccctgcagcaatgacagagttgcagaaattatgtgataaggttccttcattcccagatgatatagcaatggctcttctggaagaagagcttggccagccttggcaagcaatctactctgagttatccccctccccaatcgctgcagcatctctgggacaggtttataagggtcgcttgaaagaaacaggagaactagtggctgtaaaagtgcagaggccatttgtacttgcgcctggcaccatcgatttattcatcattagaaacttgggtttggtactcaggagatttccacaggtatccgttgatgttgttggtctggtagatgagtgggctgctagattttttgaagaacttgattatgtaaatgaaggtgaaaatggcacctactttgctgaagtgatgaaagaagatcttccacaggttgttgttccaaagacttaccataaatacacatctagaaaagttcttaccacacaatggatagagggagagaagttgtcacaaagtacagaggacgatgttggatcattggtcagtgtaggagtcatttgctatctgaaacagttgcttgatactgggttcttccatgctgatccacatccaggcaatatgattagaacacctgatggaaagctggctattcttgattttgggcttgttacaaaactgacagatgatcaaaagtatggaatgattgaagcaatagctcaccttattcatcgtgattatgacgcgattgttaaggactttgtgaaacttggttttatccctgaaggggttaacttggatccaatcttgcctgtactggccaaggtttttgatcaggcactagaaggaggcggtgccaagaatattaactttcaagaattggcagcagatctagcacagataacttttgattatccatttaggatacctccatattttgctctgattattagagccattggagtattagaaggcatagctttggtgggagatcctgaatttgctattgtggacgaagcatacccatatattgcacagaggctactaacagacgaatcacctcgactaaggagtgccttgcgttacacaatatatggcaaaactggtgtttttgatgcagaaaggttcattgatgttatgcaagcttttgagaattttattcgcgcagcaaagagcggtggtggggagaacttgaagggaaacatggctgagctggctgatttaggaggtcaacctagcaccagtttggttcctgtatttccaatggccatagcccagcctgagcagccagttaaagctcgtgcagctcttgcttttctactctctgagaggggaaacttctttcgggaattcattcttgatgagattgtgaaagccattgatgcaatttcaagggagcaattaatccagattgctgcatcttttgggataggaagggccaccccagttttcagcatggttcctgttagggccagggcattgcttccaacaatcacagaggaagacagagtcatcttgaacaatgttgagaaggttgtgaagttcctaacatctgggacagcaactccaacagtgggcggggacgtaaacatggtgtctgtagtacaagagcttctacctgtgttgccaggcatctcatcgaagatcctacctgatgtcttgagtcggttgtcatcacgagtatttgcacggctgatccgagaggcatttttgtaaagcgtttttttttcttcccccctttactaacaggaaactacaattagttatatctgccaaaacaacacacaaatgatagaagattgtacagcaatatgatgtatagaaatttatatctatgcaagttaaccaaagcttaaccaacaaaaaaaaaaaaaagggcgggcgc

SEQ ID NO: 13706 - DNA, 1255 bp, Sorghum bicolor
  Clone ID: SORBI-28MAY03-CLUS23602_1
ctgttggcctctgggctgccttttccttttccttccccttcctcccccaccggcggtccggcctccctcgctcgcccgcacgaagaagaggaagccgccgagcgcggagcccagcacgccgccgccggccatgtcggtggagacggagcggagctccaccgagtcctccgcggcctccgggctcgacttcgaggacaccgcgctcacgctcaccctccgcctcccgggctccgcccccgcccccgctgccgtcgcggcctccttgtcctcgtcctcgtcctccgccttccccgacgccgaccgcaagcgcgcctcctccgacgccaaccccgaccgctcctccccgctcgccgcttcctccgacgctgcaccggcacccaaggcgcgggtggtggggtggccgccggtgaggtcgtaccgcaagaacgcgctcgccgacgtcgcgggatccagcaaggcaaaccaggccgccaagttcgtcaaggtggccgtcgacggcgcgccctacctgcggaaagtggacctccaggcgtacgccggctacgaccagctcctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgtttgtggaaacctgccagcgccttcgtctgatgaaaggttcagaggccgttaacttagcaccaagagccgcccgatgaggcgcactccacctgttggtacgcactggcttcttgaaggaaagaggaaactttgctgttttgaggatcttcacgtgagatagaaatgtgtacagttgtcacctactgcttttggtccccttatgctattgagttgatgaaagtttgtagttccgttacttatctgtagtttctacttatagatccgaagcttgaaatacacatggctacagtgtcttttgataaataagaccagacacaccaaaccgaactcgttcttccacatttccacacggttgctattttgtggttatgtggtggtgcttgctataggtgtgcgaggctgatggcatagctgccatttatacatcttaatcgtattgtggtgagctatgggtctcgtgcgcggcgcgtgatggtccttcctccgggtgttgtgtcttggacgctgtaaaaattgtatggtccgcttggcttttcagc

SEQ ID NO: 13707 - DNA, 1486 bp, Sorghum bicolor
  Clone ID: SORBI-28MAY03-CLUS23684_1
gctcggggactcccgtccgcctccggccctctccccctcacctcctctccccccgcgaggtgggacgccatgtctccccccgtctcctccattgcgccgctgctctgccaccagcagcagcagctcctcgacggggagctggtggcacgcggggtagacggtggcgccgccgccctcggtcacctcgttgccggagatgatctgcgggacgacggacttgtcggcaggagcctgcggtgctgacgaggagcggtcgccgggggggccgttccaccgcggcgccaggggcgggcggggcgtgccctgtatcctgctctcgcagtcgcccgggtttacgattacatggtcgcgtacacggtcgcctaccttcgcactcacatacgtaccgaatccccaccacacgtaccctgtatacactggagcgttgttggtctatttatcttagattaggaaatgtaaattcgttgatgcgttcctggcggccttgctcccacgcgcgcagccccacggtgcccttacgtctcatacgcagtaggacgacgcctacggttctgcgtccgtcggtggcggctgtgccgactgtgcgtacaggccatacgtatatcaaatatctagtgacaccaaagccaagacagccccttccttcaagcaggaacagcagcagcaagtcgaagcggcagcgacgaccaataagcagagcgccgtcgtggcgtcgagcaacaacaagcaggggagcagcggcggcgggaacagcagcaacacgaagctggagggacggttacaactggcgcaagtacgggcagaagcaggtgaaagggagcgagaacccgcgcagctactacaagtgcacgtaccacagctgctccatgaagaagaaggtggagcggtccctggccgacggccgcatcacgcagatcgtctacaagggcgcgcacaaccaccccaagccgctgtccacgcgccgcaactcgtcctccggtggggtcgtcgcggcgggggaggagcagcaggccgccgcaaacagcctctccgccgccgccgccgcggcgggtggctgtgggccggagcactccggcgccaccgccgagaactcgtccgtcaccttcggcgacgacgaggcggagaacgcgtcgcaccggagcgacggcgacgagcccgacgccaagcgctggaagcaggaggatggcgagaacgagggcagctctggcggcgccggcggcaagccggtgcgcgagccccggctggtggtgcagacgctgagcgacatcgacatcctggacgacgggttccggtggcgcaagtacgggcagaaagtggtgaaggggaacccgaacccgcggagctactacaagtgcaccacggtgggttgccccgtgcggaagcacgtggagcgcgcgtcccacgacacgcgcgccgtgatcaccacttacgagggcaagcacaaccacgacgtgcccgtgggccgcggcgccgcgagccgcgcggc

SEQ ID NO: 13708 - DNA, 1497 bp, Sorghum bicolor
  Clone ID: SORBI-28MAY03-CLUS23876_1
tactccagtcgtcgatccaatccatccatcacaaagcagcagcagcacacacacaatccatcttgactttttctcgtctccgccgccgatccagacaagaaagaaaaatccatccacccacgatcgcgagctcaccgccggccatggcgacgacgcggacgctggagctgacgctgatctccgccaaggacctcaaggacgtgaacctgatgtccaagatggaggtctacgccgtggtgtcgctctccggcgacccccggtcacggcagcgggtccaggccgaccgcatcggcggccgcaacccgacctggaacgccacggtccgcttcgccgtcccggccaccggcgcgggttccctccacgtcctcctccgcgccgagcgcgccctcggcgaccgcgacgtcggcgaggtccacatcccgctctccgagctcctctccggcgcctccgacggccccgtccccgccaagttcgtcgcctaccaggtccgcaagatctcctctggcaagccccagggagtcctcaacctgtcgtacaagctcggcgaggtcactcggtccgcggccgccgccaacggctacgcccccgcccagtccgcatacacccaggccgccgcgtacccgcctccctctgcgtacccgccgccgtccggtaaggctgacgcgtacgcgcctcccgccgccgcctacccgcctccttcaggaaaggccgacgcgtacccacctcctgccgcatacccgccggcaggcaaggccgacgcgtacccacctcccggcggcgcgtacccgcccaccggcggcaaggccgacgcgccagcgaccgcttacccggcctcatccggctacccgaccgcggcaggcaagccggcgaaggcgggcgagccggtgacggcctaccctgccgccggtcccagcacggcggcgccctacgccgctcctccgccgcagtacggcgggtacgggtacccgccgcagcaggccgctggatacggctacccgcccccgccgccgcaggctgggtacgggtacggctacccgccgcagcaggccgccgggtacgggtaccagcagcaggccgtgaagccgcagaagaagaagaacaacttcggcatggggctcggggccgggctgctcggtggcgccgtcggggggctgctgatcggcgacatgatgtcggacgcgtcggcgtacgatgccggctacgacgccgggttcgacgacggcggtggcttcgatggcggctttgatttctagagcactctgatgatgacaccgagcatctcaagggcagaggtctttcgttttggatttgcgtttgtgatttgtttgtttcgttttgtacgcaatctaattgtcaggatcaaatcaaattatgcatcttatatatctgatgatatatatatggtattgtaaatactcctatgatgctgaaagcgtgacattatgaattgcacgcagttttcttttattcagatctgcgcctagtactttcgaagtt

SEQ ID NO: 13709 - DNA, 1540 bp, Sorghum bicolor
  Clone ID: SORBI-28MAY03-CLUS5381_1
ccgcgagcccggggcgacggcacgcggaggaagcgtgcaagcaagcaagtggcggtaatggcggcggctctgcaagccacgccgctcaaaaccctagccatctcccgccggcgcgtcggcgtcgcgggggtgcggcagcggccgatggtggcgagcttccggtgctccgcggcggcgcggagctacaacatcacgctcctccccggggacggcatcggcccggaggtggtcgccgtcgccaaggacgtgctctccctcgccggcgccctcgaaggcgtcgagctccggttccaggagaagctggtgggcggctccgcgctggacgccaccggcgtgcctctccccgacgagacgctcgacgcggccaagggttccgacgccatcctcctcggtgccattggaggctataagtgggataacaatgagaagcacctcaagcctgagaccggcctgctgcagctccgtgctggactcggggtttttgccaatctgcgaccagctgcagtgttgccgcagttggtagacgcatccactctgaagaaagaggtagctgaaggtgttgacatcatggttgtcagagagcttactggaggcatctacttcggcaaacccaggggttttggaacaaatgacaagggagaggatattggcttcaacacagaagtttattcagcttctgagattgatcgtattgcacgtgttgcatttgaggttgctcgcaagagaagagggaaactatgctcagttgacaaagcaaatgtgctggaggcatccatgctttggaggaaaagggtgactgcactagcttctgaattccctgacattgagctctcacacatgtatgttgataatgctgcgatgcagcttgttaggaatcctaagcagtttgacacaattgtcacaaacaatatttttggtgacatattatctgatgaagcatcaatgattacgggaagcattggaatgcttccatctgccagtgttggtgaatcgggacctggtctttttgaacctattcatggctctgcccctgatattgctggacaggacaaggccaatccattagctacaattcttagtgcagcgatgctattgcgatatggcctaggagaagaaaatgctgcaaagagaattgaagctgcagttacagcaacactgaaccatgggttccgaaccggggacatatattctcctggaacaacattggttggatgcaagcagatgggggaagaagtcttgaagacagttgagtcgctaaaggaagtggctgctgtaaactgatgcatgctggtgcttaatttataaccataccggatgagatggttgggaggaatttacatttataaagttgagcctggtggaagagagcattgcgtctggtttattgttactgttgactttagtggccgaaccaatagccatttttcatttctgttgtttgttggtctccctgtaatttaattttgtacaaggataagcatatgttcgctcaataaaatgggatagttcatgccagttgaataaaaggtggagtttgttc

SEQ ID NO: 13710 - DNA, 555 bp, Sorghum bicolor
  Clone ID: SORBI-28MAY03-CLUS4636_2
agttcacggtgtactacggcacggcggcgagcgcggcgaactacggcgggtacggcgggaacgcgagcaagaaggacacggcggagtacgtgtacgacgtgccggaggggtggaaggagcggctggtgtccaaggtggagaagggcaccaacggcacggactcggagttcttcaacccgcggaagcggacggagaaggagtacctgacgttcctgtccgggatccgcgcgctggcgccgctcagcgccgtgctcgacaacctggcgctctccgacgtcgggctcctggaccagatcgcgaccgccgacgacgtgcgctccgtcgagcgcgccgacggagccggccaggtgtactacgagtacgaggtggcgggcgccggcgcgcacagcctcatctccgtgacgtgcgcgcggaacaagctgtatgcgcacttcgtcaccgcgcccaacgccgagtggagccgcgacgaggccatgctccgacgcctgcacgagtccttcaagaccatccagtccggcgccccgtcgccgttcaccgagacctagctcttatctg

SEQ ID NO: 13711 - DNA, 1455 bp, Sorghum bicolor
  Clone ID: SORBI-28MAY03-CLUS4636_1
tccgcggtgccacttgcggtccggccggccccgaccctctctccctcccggccctcgcgccgggccgccccgcgcctccccgacgggcactgctgccatgggcatggtcctcgcgttcgtggccgtggccgcgctctgttgcgcgccgggcgccgcggagttgccccggctggagcaccaccgggccaacaacgacggcgggtcgctgaagctgctcgtcgtcggggactggggacgcaagggaactcacaaccagtcccgggtcgccgagcagatgggaagggttggggagaatctcggcatcgactttgttatttccgccggggacaacttctacaagaacggcctcaagggtgcgccgggccgcgcgggtggagaatcgttcacggatatctacaccgctaaaagcttacagaaaccatggtacttagttctaggaaatcatgattacaggggcaatgcactcgcacagcttagcccagtcttgagaaagatcgacgaccgattcatttgcatgagatcattcatcgttaacacagaacttgcggattttttctttgtcgacaccactccattccaactggagtattggactcaccgtggcaagcatcattatgactggagaggggtggcacctcgaggcaaatacatagccaatttgctgaaggatctggacgaggctatgaagaaatcaactgcaaggtggaagattgttgttgggcatcacactatgaggagtgtcagtgagcatggtgacaccgaggagcttctgaaactactacttccagtcctcaaggacaatggtgccgacttctacatcaatgggcacgatcactgcctggaacacattagcagcagagacagtccgctccagtatttcacgagcggaggcggttcgaaggcatggagaggaatcttgcgtccaaacaaggacaagctccggttcttctacgatgggcaagggttcatgtccctccagctgaaccaagaccaggctcagttcatcttctacgacgttttcggcaacacactgtaccagtggagctcaagcaaaaccagacatcccaagccctccacctatctcgatgaggaataaattggattggttttgcgctcttgatttgcacaaaacgtcgccgtcatatctttgtcaaaggctgaggctatcgatccgtcatgagattgcagagattgggacggatcatgaaaaggggagcacggagcaggagggaaggaaggcgtccggtttcagacatttctagatgtagtaggtccgatcctaacggatcagatcacttcccgtctgtattgcccaacatcctgttggaagcttgtgccggccttgcaagcaagactttcttgctcctaagcgatttgctttcaatcctgatcgtcagagccttcgtccagaaatgtaaaagttttctgagctaaaacgcaagagaaatttcaggt

SEQ ID NO: 13712 - DNA, 1329 bp, Sorghum bicolor
  Clone ID: SORBI-28MAY03-CLUS5413_1
gcacgacggctcaacaacaccttccacggccgcacctcgacgggcctcgagcttgagctagggtttcctccgtcgctacctaccttttacgcggccggcgcgcagccatggcgctggtacaggcgggcatgggcctcacccgggtcgtggtcctcgtcggcgccggcgtcgccggctccgtcgtcctccgcaacggccgcctcgccgagatcctcggcgagctccaggagatactagacaaggggaacaaggggaaggacggtggagggggagacggggaagccgatctcaaggaggcgcttacctcgcaggtgcgtagcctagccatggagatcaggcaacttgcttcatcacgtccgataactgttctcaacaatggaggttccggacaatcaggagtatcaggcctgatagtacctgcagcaactgtaggagcactgggttatggttatatgtggtggaaagggatctcatttgctgacctaatgtatgtcaccaagcgcaacatggcaaatgcggtttcaagcatgactaaacatttggagcaagtccaaagttctcttgctgctgctaaaaggcatttgacacagcgcattgaaaagttggatgataaattggatcagcaaaaggctctatctggacaaataagagatgatgttactgatgcacgtctgaagcttgagaatattggttcagaaattaagaacatcaaagatttggtttggggtctggatgggaaaattgattcgatggaagctaaacaggacttttcatgtgctggtgtgatgtacctctgccaattcattgagcaaaatggtgggaagcttccggatcgcctggaaggccccaaagtgactacaaagcgttttgcagatcaaaggttcatacagggattgcaactggcaatagaatcagggaattgtggcaaggacaccattgacatgctgttgaaagatgctgattcctctgataagataaacaggacgtcctccatcaaatcttccagctaaattattctctggtcaacaccgagcgtgtgacatctatctatctatcaagatttgatgcccaatcggaatattgtataggattttcattacaagtaaacatgtaaagagctgcagccttttgcttgcaggaagtgctttttatttaatttgtaagcttgcgtaaaaatgctactagttgtactacttaggaacctaggccatgcttcaattttgtggcttcgctttgtgatgtgagaatgcagcacgtaataaataaaaaacactatggtcttggctttaagaaaaaaaaaaaaaaaaaatagtcctataaattaatgat

SEQ ID NO: 13713 - DNA, 1312 bp, Sorghum bicolor
  Clone ID: SORBI-28MAY03-CLUS2558_1
ccaccatccagtacctcatcagcaagggcgccaaggtcatcctctcaagccacttgggtcgccctaagggttttacacccaagtttagcttaggtcccattgtaggacggttgtctgagcttcttggcattcaggtgcaaaaggccgaggatgttattggccctgaagttgagaagctggtggacgccttgcccattggtggggttttgctcctggagaacgtaagattctacaaggaagaggagaagaatgacccagagtttgcacagaagcttgcctccctagcagatctttatgtcaatgatgcatttggaacagcccacagggcacatgcatcgactgagggagttaccaagtttctgaagccttctgttgcagggttccttttgcagaaggaacttgactaccttgtcggagctgtctcaagccctaaacgcccatttgctgccatcgtgggtggttcaaaggtgtcatccaagattggggttattgaatccctgttggaaaagtgtgatatccttctcttgggtggtggtatgatcttcacattttacaaggcacaaggtctctctgttggtgcttcattggttgaggaagacaaacttgatcttgcaacatctctccttgcaaaggctaaggaaaagggtgtctcccttttgttgccaaccgatgttgtcattgctgataagtttgcccctgatgctaacagccagattgttccagcatctgcaattcctgatggttggatggggctggatattggcccagatgctgttacttcattcaacgcagccctggatacatgccagacggtcatctggaacgggcccatgggtgttttcgaatttgacaagtttgctgtaggaactgaggctgtggcaaagaagttggcagaacttagcgccaagggtgtcacaactatcattggaggtggagactctgttgccgctgttgagaaggtgggagttgctgacgttatgagccacatttccacgggaggtggtgccagcttggaattgttggaaggaaaggagcttccaggagttgttgcattggatgaagccatccctgtggctgtatgaagcaagctttcattttgtttcatctccatcttcacgtgccattgtatacttgctacattcttgcttgctcctcgtcagccgctctaaatgtaagagatcaatgtgtttatagagctactggaaatcgtttgaacaacgaaacaaataatatgtgcttaccgagtcatctttccttggtaacgtaactagtgacataaaaaaccttcaagggtaacctatatagcctattc

SEQ ID NO: 13714 - DNA, 1669 bp, Sorghum bicolor
  Clone ID: SORBI-28MAY03-CLUS2575_1
ctactgctgcaatgatgctaagttgctaacctctacaaaattgggacattccttgttggcaagttgctcgttctatgcttatatagaacacaaaaaaaaacacaaaaaaagaactggcgtgttcagaaaaaaagatagggattgtgaaaagtcaagacctcaccattgcaatatgacatgcactgatgactgatgcaatgcacacctgcagtcatgtattattgtactctgccttgcatcaccacctccagcaggcaagcaagtttactaaagcccacgcgtccgttgatatactttcctgcactcctgtctttttcacctcaccttttcttttttgctgcaaccatcagtttaaccttaccttgtaagaaaagattatgcctttctagctcatcctagccaccacagaagcgaagtcttcaaggttttccacccacacccacttctctaatctcacacgcccctcctaatgtaacctgaagctttaacacaacaaagaaaattagtgataacaactcccggaagactccaatcttcagctctccttccccctccccattccaattccaagaacagggcagcgggggggagtcaaccaggtacgatgtgctcaataacgaggctcgcgtttgtgcttgcactggctatagcctcatcaactgaggttgcagagagcagagattttaatatcttggctcagggcagcttgcctgatgcagccaagggaccaggtctaactgcagccagtggaaagctgtgtcaattatgtgagcagtactcaactgaggcacttttctatctcacacaaaacgaaacccagactgaaattcttagcattctacaccatgaatgtgcaagccttgcccctctgaagcagcagtgcatcacgctggtcgactactacataccccttttcttcttcgaggtttccatggttacccctgaaaagttctgtgaatcgatgcatctctgcaagaatgggatgaagattagcctacccactcgggagggtacttgtggtttatgccatcatgttgtcgttgaagttcttgtcatgcttaaagatcccaacacacagctggaagtaatcgacctactcaacaaaacatgcagcaaggcgcagaactatgaacagcagtgcaagcagctggtcctcaagtatatcccactgattctggtgaagggcgagaaattccttgagacaacggatgtctgctctgcgatacatgcttgcaaagcaggcacacaagcatcaatggaaaccatgcctctttctgccactttgtgaagatgatgcgaatcagagtaagggttatctgcctacgagatcaaattggggagaaacgatgaaagtcagatgactgttttaagccatcttcctctattactgaaacactattgactggtgaaaattcagctgtgtaaacatcttcggtgtaaatttggagccatatccagtgtttctgtgaactacagtatatagcaactgagcagctacacctatctcttcggcattggattgaggttgtaatcagttattgcattttactgtatcatctattgtttgtaactactgtttcctagtttctctggtgctctggcaattggtctgtaacattaaagttacaagaaaacttttagtttgcttggagataatgaaacgagactt

SEQ ID NO: 13715 - DNA, 1149 bp, Sorghum bicolor
  Clone ID: SORBI-28MAY03-CLUS26042_1
ggcacgaggaaggaaggaaacccgcaccgcggaccgcaggcgcaggcgactcccgacgcgtctccggcgaccggcgacccctctccctctccgcccgcggcgcctccgtcggctcgcccaaccatgtataataattatgggaaccctccagggatgcagatgcccccacagaactctcaacctgtccagtttgacaatccattatatggtgcaagctcacgtcttatcagatctgggattggagtatatggggagaagttcttgggttctagttcagaattcatgcaaagcaatatcaatagatacctctccaatccacagtattacttccatgtgaatgatcaatatgtccggaacaagttgaaaattatcctgtttccattcttccacagggggcactggactcgaataagtgagccggttggtggccgtttgtcctacaaacctccaatctatgacataaatgccccagatctgtacatccctttcatggcatttggaagcttcatcattctttctgggtttacgctaggtttcatgggaaagtttactccagaagctataaatctgcactttacaagggcactcatcggatggggcttccagctcatgctcctgaagggcctgctctactcaatgggcggcggtgaggtgccactgctcgacttggtagcatatggcggatatttatttgctgggctttcactcgctgtcgttgcgaggctcatatgggcatactcatactacgtcatgatgccatggatgagcctgtgcatgggagtgttcctggtgaggacgatgaagcgggtgctcttcacggagatgagaagcagtgagagacactcgtcacgacagcattacttccttctcttcatggcaatagcacagtttcccctattcttctggcttggcagcataggtgcatgatacggttttgtgctgcttgtactttctcactattaacactgcaaagtggtatttaagtgtttagatgtgttgtaaaaaacagttggaggatggtctcaaacagcttatgatgttttatcatcgttagtaagttcttgaccaggttttgagatgtgctgttgtatagattgtgggttctgcgggttctgatgctgaagttatgtgtgatctttaatcattttt

SEQ ID NO: 13716 - DNA, 982 bp, Sorghum bicolor
  Clone ID: SORBI-28MAY03-CLUS26616_1
tactggatttccctgcgcacgacgcttcttcatcctcatctgccacgatcgaactgccaagcaaataaagccagcggcgaccgacgacccggccggccaccgtatccttcgcactgccctcggcgtagcgtagccgctcgtcagagcagcagctagcagccatggccagcaggaggcagtggtggtggtgcctgctgctgctggcggcgtggtgctgcgcggtggcggcggcgcagtcgtcgccgccggcggcggacccgctgcagagcaagtgccagggggacttcgggaagctgacggactgcatggactacgcgacgggccacgcggcgtcgccgtcctccacctgctgcggcgacgccggcgacacggagaaggcgcggcccgagtgcctctgctacatcatccagcaggtgcacacggggcgcaaccaggtgcagtcgctcggcctgcgcttcgaccgactcatcgcgctccccgctgcctgcaacctccccaactccaacgtctccctctgcatcaacctgctgaacctgaaaccgggctccccggactacgccctcttcgccaacgcctccaagatcacgccatcaactaacccggcgagcgacagcaccgccggaagcggcttcaagcttcaggccggcatccatggcagcgtcgtgctcgccgtgatctctgcgatcgtctcgtcactcttctgatcggtctcgtcaaaggagaagcggcagttttttttaccctgtggattcgttctcttgttccactagtcgatgtttattttgtatccacataaaaaaagaagatccagctgagacctgttttttcccctccctgtaccgtgtttcatgatcactgatgagaatggatggatttgtgattgtgcatcgcaattcacaagttcacaaccctctgttctggagaaacagagtggcagtgcaggaaacaatttcaaataatttagttgttttcctgctgtttc

SEQ ID NO: 13717 - DNA, 2047 bp, Sorghum bicolor
  Clone ID: SORBI-28MAY03-CLUS26046_1
aacccagcacgcatcttccccatggcgtcccgcgacctcgccgagagcccccaccccgccgccgcccccgggcgccccgcgtccgcgccgcgtgcctccgcccccgccgccggggccgccccccccccccccgcctccgacgccgggggcgcccgcgcgccgccgtcgcccccgcccccctcgccgccgcggctcccgcccgccacggccccggcgcgccgccggcgcgccccgctcctggacccgggaaacctggagggggacctgcaggcgggcgccgccgcggggtaccagctgctgtggctgcttatgtgggcgacggtcatgggcgcgctgatgcagctgctctccgcgcggctcggcgtggctacggggaagcacctcgccgagctctgccgcgacgagtacccgacctgggccacgcgcgcgctctgggccatgacggagctcgcgctcgtcggcgccgacatacaggaggtgattggcagcgcgattgccatcaagatcctctcggggggcaccgtgccgctctgggggggcgtcgtcatcaccgcgctcgattgcttcatctttctcttcctggagaattatggtgtgagaaaactggaggcatttttcgctgtattgattgcaactatggctgtttcatttgcggttatgtttggtgaaacaaagcctagtggcaaggaacttctgattggtttggtggtgccaaaattgagttcaaagacaattaagcaagcggttggaattgtgggctgcatcatcatgcctcacaatgttttcttgcattcagcactagtgcagtccaggaagattgacacaaacaagaaatctcgtgttcaagaagcagtttactactacaacattgagtcaattcttgcactcattgtgtccttctttattaacatctgtgtcacaacagtttttgccaaaggattttatgggtctaaacaggctgacagtataggtcttgagaatgctgggcagtacttacaggaaaaatatggaactgcattctttcccatcctctatatctgggctattggtttgttagcatctgggcagagtagcacaattactggcacatatgcaggacaatttgttatgggaggcttccttaatcttcgattgaagaagtggctacgagcaatgattactcgaagttttgccattattccaactatgattgtggctttatttttcgatactgaagatcctactatggatattctgaatgaagcactcaatgttcttcaatccatacagattccatttgctctaattcctctcatcaccctcgtttcaaaggagcaaatcatgggatcgttcgtaattggtcccatcaccaaagtgattagctggattgttacagtatttctgatgcttatcaacgggtatcttatactgtctttctacattactgatgtccggggtgcattgcttcgctcaagcttgtgtattgtgttgattgtttaccttgcattcatcgtctatcttattgtgcgaaatacttcgctgtattctcgcctttgctcatctatgtcaaagagcccatgagcgtttcagcattgtcatctgccgccatgatgggctggaacagtttggattatacctgaagaaaactgtccatccatgcaaagcttgtgctgctgcttatttattggctacagagaagtatatatatgcatatcccttgtatgcttgtatttatgggatattcgttagtaggacttctcctataggatgggctaatgtacctccagtcacatactagggtacacgtagcagatagatttcttatttctgaggattatggtgatgttaaaacactattgacaagaaatggcattgccagataactcaggtgccacgatttcctcctggaactgagcagacgaaatttaccgaatgatctgaagtttgatgttgcaaacctggattccaggagcaatgcatattctaatgagctgtactttgtgatctatcttaaggtcacagccctgttccaaatttaatattagaccataaacttatcttcaagtcc

SEQ ID NO: 13718 - DNA, 1697 bp, Sorghum bicolor
  Clone ID: SORBI-28MAY03-CLUS26809_1
cagtaatccaggcccctcgacttgccgaggctcgcgactcgcgacgccttccccagccccacaccccgcgacccaaaccctagcccccatccaccgtaccgccaccgtcatggccgaaccatccgccgccgccgtcaccgcagctgacgtcggggcgctggcttcgttgcccccgctggtcgccgaggaggccgacgccgccgcgatggaggaggccgcggcggccgcgaagaggtggcccgggtggcccggggacagcgtgttccggctggtggtgccagtgctcaaggtcggaagcataatcgggcggaagggcgagctcatcaagcgcctcgtcgaggagaccaaggccagggtccgcatcctcgagggccccgtcggcgccaccgagcgtatcgttttggtttctggaaaagaagatccaggcttggagctacctccagccatggatgctctcatgagagtttttaagcgtgtaattgggataacagatggagctgctgagggcactcaggccgctgctactcctggtgtatgtgctgctcgattgttggttcctggagctcaggcaattagcccgagggggaagcaaggtgccactatcaaagcaatccaggagagcacgggtgctacaatacgggtaatatcagtagatgaacgggagcgaccattctatgtaactgacgatgaaaggataattgagatacagggcgatacagagaaagttctaaaagcactacaagcagtttctaaccatcttcggaagtttttggttgaccatagtgtacttccattatttgaaaaaactaatactacagtgagccaagatcgcaatggtgatggttggagtgatatgtcacatccttcaattggttctgcacaagtgaatcaaccaccttctgtggtagatgaatatattctcccagtgaagagggaatctttgtatcttgaacgagaacctttggtagatcataacattcatcgctcaggagtatcactttatgggcgggatccagccttgtcaacactacgaccctctggaatacatggtgctggcccgctacttacgcagataacccaaaccatgcaaatcccacttacctatgctgaagacattataggagttaaaggagcaaacattgcgtacatacgagctaatagtggggctgttgttacaattcaggagagtttgggtagtcctgatgatattactgttgaaataaaggggacatcctcacaggtacaagctgcacagcagctcatccaggactcgttggctgcacaccgtgaacctgtcaggagcagttatgtgggagcaggattagattcagtgtataggtccagctactcacaatatggcagttccacctatccttcgtcatctctgccatcttattctagtattgatgatgttagtagatacccgtcttcaggtcttggtggctatgggtcgagttaccggtactagtagtagttcgtccttaggcttcaatgcttgatggaaccttgtatccattcctggtgatcattgtacaagtcatcaagttttctgctttgtatgcttccgggcacccagacttcggggtctgctttgttttgacaaatgattggttttatagatttttccgtctcatggaatcggaaattgtacttgtttactagtgcctgtttttgttagcgcagcaatttatttgtgt

SEQ ID NO: 13719 - DNA, 940 bp, Sorghum bicolor
  Clone ID: SORBI-28MAY03-CLUS28242_1
gagaggtactgctatacttcttcagacattgtgaaggaatttaataaacatgacagggagccatcaaagtacgttaaacactggacgggcatcaaaccaaaaactggtgcgaaatacacatgtgacattggatatgaacgattcctggggcctgagatcttcttcaacccagagatatataacaatgacttcaccactcctttgcaagttgttattgacaagtgcatccaatcatccccaatcgacacaaggagggctctttataagaatattgtcttgtctggaggctcaactatgtttaaagatttccataggaggttacagcgggacctaaaaaagatagtggacgcacgagtccgtgcatctaatagtcggcttattagtggagatactaaggcccagcctatagaagtgaacgtggtcagtcatcctattcagagatatgcggtatggtttggcggctctgtgcttgcttcaactgccgaattctacgaggcttgtcacacaaaagcagagtacgaagagtacggtgcgagcatctgccgatcgaaccctgtgttcaaagggatgtactgaatcagcccatcatataatcccattctcaatggtatgtattaaaccgggagcgattccctgaggttgactgtcgtgaatggcatccactccagcgtaaatggggagaaggagaactgacagtggagacggactgtccagagggatcctggagaagcatagccgtacgagctgtacaaacgaaaagtgcaaatagataggttcatgtttcatcatacaatttagatgctggtaggcctgacaggatgggtttgccacctctgctgaattgggtggcattgtaatttttagcgtcaacattgttgcttctggcgatgcggcattgctccatgtatacatgttgattcggcaacaatttttttctctc

SEQ ID NO: 13720 - DNA, 2286 bp, Sorghum bicolor
  Clone ID: SORBI-28MAY03-CLUS28381_1
gcacgaggccgaagcggaagcggtagagccagccatgtacgccgccctccgccgcgcggcgccactcaggcggcgcgccgtgtccgcactcgcggccgcgctgctccagcaccagccggcggcgctgggcgccgctgtggcaccacgcgcgccgacgcttctccccgcggccgcgtggttccactcctcgccggcgtggctcgggttccgggagacgggggccgcgggggcggcggcgcgcgcggagttcgcggcggaggaagggtcgttctacgaggaggataagagggcgccggctaccgggggcgccgcggcggaggagggactcgagattgccaagctcgggatctctaacaagatcgtcgaaaggctcgccaaaaagggcatcaccaagctgttccccatccagagagctgtccttgagccagcaatgcaaggacgggacatggttggtcgtgccaaaactgggactggtaaaactttggcctttggaatccccatattggatgcaattatccgccacaatgagaagtacaagcctggtaagttccccttggctattgttttggcgccaacaagagaacttgcaaaacaggttgagagggagttccttgattcctccccgtgggaaacactgtgtgtatacggagggactccaattatgcagcaaataaggcaacttaattatggtgttgatgtggtcattggaacacctggacgcgtgattgatctgctgaaaagaggtgctctgagtttggcagagatccgatttgttgttcttgacgaagcagaccagatgttgtctgttgggtttgatcaagatgttgagacaattttggagagagtgcctccgcaacgtcaaacattgatgttctctgcaacaatgccaacatggatacggaagctcacacagaagtaccttaacagtcctgttacagtagaccttgttggtgaggacgaccagaagctggctgaaggaattagtctgctctctgtctcttcagagaaccgtcaaaaaccagctgtccttggggaattgattaaggaacatgcaaagcacgaggaatgcattgtttttacacaaacaaaaagggatgcagatagattgtcacacagtatgagtcgaagtttccaatgtgaagctcttcatggggatatctctcaatcccaaagagagagaacactgggaggatttcgagatgggcggtttaatatattgattgccactgatgttgctgctcgtggattggacattccaaatgtagatctggtgatacattatgaattgccaaactcgtcagagatattcgttcacagatctggccgaactggacgtgctggaaagaagggcactgcaattgtgatgtacaactatgaacaaagtagagctgtacgggtcattgaacgtgacgttggatgcaagtttacagagcttccaaaaattaatgtcgaggggtctgtcttgctggacgctggatttgactccttcgggggtggaggtggagggtatggcggttcaaactatgggcgcgcacggggctttggtggacgtgggggtggtggttttggccgatcaggcggcggcggcggattcggcaattctggatttggccgctcaagtggtggatttggtgactcaggatttgaccgttctggtggtggagggtttggcaggtcaggtggaggtggtggattcggtgactcaggatttggccgctcaggtggcagtggaggattcggtgactcagggtttggtcgttcaagtggtggtgggtctggttttggtcgttctggtggatttggtgaatctggttcaggccggtttggtggtggttttggtagttctggctcaggtagtttcggtggctttggtgacaagaactcacgatagactcttagaagtaatcacaggtataaaattatggatgtcctgagccaggttcatcttggtaatgcgtatcgcagtagaggttgagattgtcttggacccaatccaagaaccctcagggcaaaagtctgggtttgcagtagcaaggtcatctggatatggatccttgggaaggcagaaagaaataatcacgagccttattgttttctgtttgcattttgatcctgcaagttctagctctagataatacctgtaaaatatgcagagggtttctgctgatgatgttcttgtcggttttggtagtagctccgtactgtatgatctgtggtgtcttgtaggccgttttaacctgaatgacggtctctatataagcatatcatatatatcaaaccatagtc

SEQ ID NO: 13721 - DNA, 1424 bp, Sorghum bicolor
  Clone ID: SORBI-28MAY03-CLUS7664_1
gcacggggccccaccggcaggggcggccgcggcgcctcgccgccgcaccgcgccccccgccagcgccgcccccgccccctgccgggcctgcgggtgatccccgcccctgtctccgcccgcccccgctcccgcgcgtcccccggctgcgcggcgccgcctccggccgcgcgcgccgggaacctggattgcatccggaagctgctcgcctggggcgcagatcgtctccagagggactccgcagggaggattccatatgccgttgcgctgaagcgcaaccacgaggcgtgtgcggcgctgctgaacccttcgtcggcagagcccatggtgtggccttccccgctcaagttcatcagcgagctagacccggaggcgaaggctctcctggaagcggcactgatggaagccaacagggagagggagaagaagatcctgaagggcacaaagtactctccgccatcatcgccaccttccacttgcgagcatgagattgatgccgatgccattgatgatgtgtcgtcagagacgagcgacacggagctgtgctgcatctgcttcgaccaggcgtgcacgatcgaggtgcaagactgcggtcaccagatgtgcgcgccatgcacactagccctgtgctgccacagcaagcccaacccgacgacgctgacactgccgtcgccggcctgcccattctgccgcggcaacatctcacggctactggtggcccgagcaagcaccgcgtcgttggacgccgacaccgacaaggctgctgcggcggcggcctcctcacctcagctggtccggcggcggtcccggcggtctcacaacctcagtgacggcgggagcagcagcttcaaggggctgtcgtccgccgtggccgggtccttctccaagatcgggcgcgggtcgagccggatggccgacagcgacaatggcatggacaagcccgagcacgacctgtgatcggcattggatggatcctgtgcaagtggagcagagctctggctgatcggccggctggcttggcttgtggtggtgaagctgaagcagccattgccactggctttccaagatgaggacatccaagcaagcgtgatcgtggtgggtttatatagatatatactactagtaaaataagtagtgtaatgcattctcatcttcctcccccatgtccatgtctgtctgtcctatttttgggcgtgccaggattcacctgggccattgccgtattccattgtcaccggctataagattccattccttcctgttcaatgtccatgcagctgtgcttgtgctatggttgagagttgagccacagacatgtagtagcaccatcggtgatcggtgtactgtatgtaacagtcgcaggcacagcacagtcgggaactgtggccggccggcgaggtcgactggactgggatctctcaattccg

SEQ ID NO: 13722 - DNA, 436 bp, Sorghum bicolor
  Clone ID: SORBI-28MAY03-CLUS6068_2
cccacgcgtccgcccacgcgtccgcgtacatccgcgacggcgccgagaaggaccgcctcttccgcgccatcgagaccgtccccgccgtgcgccgcaaggccgactgggccatgcgctggatcgacggcggggagcgcttcgccgagcgcctcgtcgccttcgcctgcgtggagggcatcttcttctcgggctccttctgcgccatcttctggctcaagaagcgcggcctcatgccgggcctcaccttctccaacgagctcatctcccgcgacgagggtctgcactgcgacttcgcctgcctcctctacgacctcctccgcggcaagctcgacgagtcccgcgtccgcgaggatcgtcgccgacccgtcgacatcgagcgcgagtcgtctgcgacgcgtctcccgtcgcgctcgtcgggatgaacggcgcgcttatg

SEQ ID NO: 13723 - DNA, 1255 bp, Sorghum bicolor
  Clone ID: SORBI-28MAY03-CLUS6068_1
gccggccgccctcggaacccaatccaaaacctcccaattccccactagcaaaatcataccccaatcctccgacgatgcctgccgcgccgacgcttgtgcccccatgcgacgcggaggagccgctgctggccgagtcctccgaccgcttctccatgttcccgatccgcttcccgcagatctgggagttctacaagaaggcggtggcgtccttctggacggcggaggaggttgacctctcctccgacgcccggcactgggacgaggcgctgtcccccgacgagcgccacttcatctcccacgtgctcgccttcttcgccgcctccgacggcatcgtgctcgagaacctcgcctcccgcttcatgtccgacgtgcaggtcgccgaggcgcgggccttctacggcttccagatcgccatcgagaacatccactcggagatgtactcgctgctgctcgagacctacatccgcgacgacgccgagaaggaccgcctgttccgcgccatcgacaccgtgcccgcggtccgccgcaaggccgactgggccatgcgctggatcgacggcggggagcgcttcgccgagcgcctcgtcgccttcgcctgcgtcgagggcatcttcttctcgggctccttctgcgccatcttctggctcaagaagcgcgggctcatgccgggcctcaccttctccaacgagctcatctcccgcgacgagggcctgcactgcgatttcgcctgcctcctctacgagcccctccgcagcaagctcgacgaggcccgcgtccgcgaggttgtcgccgatgccgtcgtcctcgagcgcgagttcgtctgcgacgcgctccccgtcgcgctcgtcggcatgaacggcggcctcatgagccagtacatcgagttcgtggccgaccgcctgctcatggcgctcgggtgcaagaagatgtacaacgcgaccaaccccttcgactggatggagctcatctcgctgcaggggaagaccaacttcttcgagaagcgcgtcggtgactaccagaaggcctccgtcatgaacagcctcaacggcagcgccgccgccaaccacgttttcagcatcgatgaggacttctgagttggtgcgcgtaatctattccgccgataatcgtagtatttgcttatcattagttcttgtaggtgtgatacatgtactccgagccgcgtggtgctgtttcattttctgtgttactggttcttgctcctgatgtaatgtataatcaatcaatttcccggtac

SEQ ID NO: 13724 - DNA, 1403 bp, Sorghum bicolor
  Clone ID: SORBI-28MAY03-CLUS7971_1
gcacgaggcacagtccacagtgcaccaccacttcactcagcaacagaggagtgagcaggatccagcagcagcaatggaggcgcggagatctctcctggcgagcttcgtgctcgccgcgttggccgcgcaggccttggtggccgtggtcgagtccagggccagccccatggagaaggcaagccaaggtgaggacgtgaagaagccggactgcgtgccggggatggacccgcgctcgttcccggggaccggcggcggccacggcatcacgcccgtgacgccgtcgcacggaggctcaggctcccccgggacgacgccgtcccacggcggcggcgggtacgggccaacgccgtcgcacggcgggacgctgccttccccgtcccacggcggctccggctcctctccgacgtcgccctccaccggcggcggtggctccccgtctcacggcggcggcgcgtacggtggttccccgtccacccctggcggcggcgcgtatggtgggtctccgtccacccccggcggcggcgcgtatggtgggtctccgtccacacccggcggcggcggcgcctacggaggcgggtccccatcgcctgcccatggtggcgcctacgggagctcgccgacgcccgcgtacggcggcaactccccctcgcacggcggcatcgggacctcgtcgccgacgtcgttcgtccccatggacccccacagcttcggctcggcacctgcgactactggaggtcgcacccaatggagatctggtcagcgatcggcggccggttcccgagcacgtcgtcatcgatggggacgatgagccacttcttcggcgcggcggcgggcagcgtgggcggcgcgaacatgatgagcatccaggacgcgctgggcaacacccgggcggacggcacgggcgcgctgctgcgcgagggcgccgccgcgctgctcaactccatgacccgcgccgggttcccctacaccacggagcaggtccgcgacgcgttcgcggcggccgccgcgggcgggtccgacggcgcggccgcggcgcaggcggcggcgttcaggaaggccaacgagggcaaggcgtagatcagagagagagagaggagtgctgcatggatcgatcgagcgtgcctgtgcatgtctatttgttggtttgatatgggttgtgtgcgtggttttgtttcagtgagcacaccgacctagctgctcactgcaattgtgtagttgttggatcctgttatttttgctgttttttttttgtcgtgtggatcgatcgaaggaagaatatgaatgaatgaaacgaactgcaactacgcagtatcgtcgtagctgagctgttactggattcagtatttgattggatttcggtgttgagatcctgtttcaggcaaaggcaaggccacaatgcaaag

SEQ ID NO: 13725 - DNA, 1376 bp, Sorghum bicolor
  Clone ID: SORBI-28MAY03-CLUS34451_1
tactggacccatctcctcccgctcgactcgacgcccaccaccgctaccactctccacttgccctttcctcaccgccccgtcccgttcattggaccctcctccccttcccttcccttctcgctcgcacgacgagaagagaagcgaggaggcgccggcatatgcccgtgcctgccgtcgggcttcttcgcctctaggccgggtccgctccgccgtcgtccgccatgggtggactcgaggagatcaagaatgaagccgtcgatctggagaacatccccatcgaggaggtgttcgagcaactgaaatgcacccgcgaggggctgagctccagcgagggccagcagcgtctcgagatctttggccccaacaagctcgaggagaagaaggagagcaagatcctcaagttccttgggttcatgtggaacccgctgtcatgggtcatggagatggctgccatcatggccattgcccttgccaacggtggtggcaagcccccggattgggaggacttcgtcggtatcatcgtgctcctggttatcaactccaccatctcattcattgaggagaacaatgccggcaacgccgctgctgcactcatggccaaccttgctcccaaaaccaaggttctgagagatggccgatggggcgagcaagaggctgcaatcttggttcctggtgacatcatcagcatcaagcttggtgatatcgtccctgccgatgctcgcctcctcgagggtgatcctctcaaggttgaccagtctgcgcttactggagaatccctcccggttaccaggggccctggggacgaagtcttctcggggtccacttgcaagcagggtgagatcgaggccgtggtcattgccacaggagtgcacaccttcttcggcaaggctgctcatcttgtggacagcaccaaccaggtcggacacttccaacaggtcctgacagcaattggtaacttctgcatctgctcgattgcggtcggcatcatcgtcgagatcatcgtcatgttcccgatccagcaccgcaaataccgcagcggaatcgagaacctgttggtcctcttgatcggtggtatcccaattgccatgcctactgtgctttcagtcaccatggccatcggttcgcacaagctgtcacagcagggtgccatcactaagaggatgactgctattgaggagatggctggtatggatgtgctttgcagtgacaagaccggcacactcaccctcaacaagcttagtgtcgacaagaacctcgtcgaggtgttttgcaaatgcgtcgacaaagaccatgtgttgctgttggctgcaagggcttcaaggactgagaaccacgatgccatcgatgctgccatggttggcatgcttgctgatccc

SEQ ID NO: 13726 - DNA, 1360 bp, Sorghum bicolor
  Clone ID: SORBI-28MAY03-CLUS2978_1
gcacgaggggacggtgcccgccgccaacgtccctttggaaagggctgtagacatagggtccctcgaagtggcagcggccgctgctgctgcggccactggaagtgccactgcagctagtgcgggtgcggttggggccatgggcgacgatggactggatgaggaggaagacggatttgattgcgaaattgggacattggagaactttgagaaggctaagggcactgtaaatatctcagcaacttacaacaccaggcacaatgacttcgagagttcagtagttgcacgaggagacctttggaggttagagtcatcgcgtggcaatttaaattctggaaatgatagttcacctcttttccttgttcaactggggcctttactgttcgttcgagactccacgcttcttttgcccgttcatctatcaaagcaacaccttctttggtatggttatgatcgcaagaatggaatgcactccctatgcccagctatctggtcaaagcatagaaaatggatgctgatgtcaatgatgtgcctcaaccctgtagcttgttccttcatggatgtacaatttccaaatggacaattgacgtatgttgctggtgaggggataacagcaagtggtttaatccctttatttggcgggttactccaagcacatggaaagtgtcctggtgatacaagagtgagcttctctttcaagaacaaacaaggtactaggttcactccaacgtttcagtggcctgacaattccgtttcacttggagttgcacaagctgtagcatggaagaggtctggccttatggtgaggcccagcattcaaatcagtgtttgccccactttcggaggaagtgatcctggaatacgcaccgagtttgtccactctttgaaagacgaactcagcgtaatgtgtggtttctcttgctcacgacatccctcagcattcacatctctctctcttgggcgatccaaatggaatggccaggtcggcagttcgggactagtaatcaccttggagacaccccttgacaacatggcaaggccttctttatctgttcaattgaacgggggttttgagttctgacgtcccccgtcgtgagctctggatacaactgtatataccgtatctcatttcgagaagatgataccactgtatatattgtacgatccccgtagacatatagctgtgtttcagtagatatcttcccaacgagtgaagtgtatagtccaaagaaaacagaaaatggcctactgttttggtccactatgaataaatttgaaggctcatatgtcgtgcgttaaaaaaaaaaaaaaaaaaaaaaaactcgagactaaaaaaaaaaaaaaaaaggggcgggccgttttg

SEQ ID NO: 13727 - DNA, 326 bp, Sorghum bicolor
  Clone ID: LIB3481-028-P1-K1-B12
cgtccgctttatttggcgggttactccaagcacatggaaagtgtcctggtgatacaagagtgagcttctctttcaagaacaaacaaggtgctaggttcactccaacgtttcagtggcctgacaattccgtttcacttggagttgcacaagctgtagcatggaagaagtctggccttatggtgaggcccagcattcaaatcaggtagataaatataagcacttgctcagtgttatacttagcttttgcttttcaagataaatgaggttattctgagtagcttaataaaaatgtggcctgctgttagtcacaatacaatgacatcttt

SEQ ID NO: 13728 - DNA, 1608 bp, Sorghum bicolor
  Clone ID: SORBI-28MAY03-CLUS3814_1
gcacgaggatggatcacgaggaattggtgttcctgctaggatatctaaaaagatgcaaaagaaaaaacaagttgtgatactccttgatcctgagagacaaagtataaggagagaaggtgaaatccctgtagctgatttcttatggtactctgctgccaagccatgcagtcggaattgctttgatcgtgctgaaattgctagagttatgaatgctgctggcaggagacgtgaagctttacctcaggatcttcagaaaggaatagatcttggtgtagtttctcctgagatattgcagaacttttttgaccttgagaaataccctgttatggcggaactgattcaccgtttccaaggtttccgtgaaaggttgctagcagatcccaagtttctgcatagattagctattgaagagggtatatcaataactaccactcttctagcacaatatgaaaaacgaaaaggacgttttttcgaggagatcgactatgttctcactgatacaattaggggttccgttgttgacttctttacagtgtggcttcctgcacctactatttcgctcttatcttttgccgatgatggctctggtgagagtgtgcagcttctgaaaggaattttaggatcagtgccggataatgcatttcaaaagggtattgttgggcagaattggaacattaatcagaggtttgcatcggtgcttatgggtggtctaaaacttgcgggcgtcggattcatttctagtattggggctggagttgcttcagatgtcttatatggtgcccgtcagattcttaaaccttctgcaagtatggaagttgcacgcaaaagaactccgatctggaaagcagcaactgtttatagttgcttccttggaacatcagcaaacctgcgatatcaggttatagctggtctgattgagcatcggctaggagaggatctgatgacctactataaccagccacttcttgctagcctggtgtcctttgtttcaaggacagttaactcatactggggaacacagcaatggatcgatcttgcacgagctacaggcgtgcaaagtactaagaaagagctgccttctcctgaggtttcaagcgcaactgaaatgccactgctagaatgtggcacgaccgaagtacagaaggtggacgacagcagtaataaccaatcaaatgacttgacatagtcacctcacagtgtcctaatttgttgcggccatacaaacaaaacacagagcagcttccttccatgacacaccaaacatgatacaactgtacaggcatacagacgagatgtcctcttagagccagactgaagctttagccatcgcgtcatgtggagagacaaatctgaaattctgaagagcaaagctttgaagactttcacatcgttatgatcagaaagccattgttacacccctcatggggtgaatacagcttgtacattatcagacgagatcgatcgaagaatttttgaatcctgtacagcattttacacgcgaaatttgatccaaaacattactggagattgtcatatggcaaggatcaggattgtcatttgtgaactgtgatacgaccttgtatgcacttgaatccagagtgcatgtgt

SEQ ID NO: 13729 - DNA, 1263 bp, Sorghum bicolor
  Clone ID: SORBI-28MAY03-CLUS42776_1
gcacgaggctcactcctccgcgccacccctaaacccagaacccagcccgccgcaaccctagccgccacagcgcgccgccggcaccacaccaccgtcgccgtcacctccatggccgcgccgtcggaggacgcgctgcggcgcgcgctcgcggagcgccaggccgccgcggacgcgcaggccgaggccgtgcgcgcgctcaaggccggcggcggcgcgtccaaggccgacgtggacgccgcggtcgaggcgctcaaggcgctcaaggtcgaggccggagccgccgcgcgccggctgcagcaggcgctcggggccggcgcgggtggcgccgcgagggaggagctgcggcaggcggtggtgaacacgctcgagcggaagctgttctacataccctccttcaagatctaccgcggtgtcgcggggctctatgattatggcccgcccgggtgccgcgtcaaggccaacgtgctttccttctggcgccagcacttcgttttggaagagaacatgttggaggttgactgcccctgtgtgacgcctgaggttgtcttgaaggcatcaggccatgttgagaagtttactgacctcatgcttaaggttgatgctgctgccaaagtaatcgctaaggcattaacaactgccggtatctcccacattattgacactactgcaatttctattgggaggagatatgcgaggacagacgagattggtgttccatttgctgtaacagtggattcagcaacaaacgtgacgatccgagagagggacagcaaggagcagatccgtgtggacatcaacgaggtggcatccgtggtgaagcagctgacagaaggccaaagcacctgggcagatgtttctgcaaagtatcctgcccatgttggtccccaaggtgaccaggagtgataaatcctgccacccttatgtctagccatcgattgagagggcatcaggattgattgtcttcattctccaattggcgagaagatagactagcctaaacataaccgcttttggtattgacacgatccagcaaggcagttttttccccatacatacatgatacgtgctatagcagttggatgttatgaagtctgcagatgtcaccaatgtttttgtttcttttaaatgtctctttcttgatatattctgacccatacaaaacttaccatttgagttacttttgaactggctctccttatgtaaggtcagactgagaattgttcagctatctacagtggaattggaatttcagttacttatctc

SEQ ID NO: 13730 - DNA, 2159 bp, Sorghum bicolor
  Clone ID: SORBI-28MAY03-CLUS49140_1
gcacgaggctgccctcagcccctgactgcgtcttcttgcttcctcctgtgcttcgtttctttgacacaccggcggcggggccggttcttatcgtccctcgctctcttcttgggttgctgcacgcctctattcctattctcgggttgggcggcgccaagaagtggggaagggcaggatgaagtccggcgagcggccgaagctggtgcggggcctccggcaggagtctcggcggttccgcctgctagtcatcgtcgtcggattcttcctcgtctccctgaccttcgtcgtcatctccaagcccgacgccatcctcttcagcctgaacggcaagctgccggtggaccaggcgccgacatccatcctgatccagcagaaggttaactcgcccccagccaccacggttaagacctccaccgacgcactccgtggagaccctagagtggttgatgacgaagctgatccaagaccgcaagggttcaaaggcgaggaggaagagagccgggtcctgagcgagccggacccgaccagcgggatgacggagctgacccctaacaaggacggcagcggccgtaaatccgacgaggataagttaggcggcggcggtgacggcgaggggaaaaggagggaggagcgtgggcacgaggcggacaagcataaagtcacgctcccaaccgtttccaattacactattcatgacaccgaggacacggaaactgccaaaaaagatgatacaagttatgaccagcaggggagcaagcccctgtgtgatttctcaaattttagagcaaatgtgtgcgagatgcgtggtgatgttagagttcacccaaatgctacagaaatcatgttcatggagcctggccattcgcagagagatgagctgtggaaaattaagccataccctcggaaaggagacgagttctgccttagccatatcactgagctgacagtaaaatcaagcaaagtggccccagagtgcaccaagtaccatgacatgcctgctgtgatcttttccgcacgaggctatactggaaatctgttccatgacttcactgacgtgatggtccctcttttcacgacagcaagtgagtttaatggagaagttcagttccttataacggacatggcactttggtggacaatcaagtaccacactgtgcttcagaagctgtccaagtaccctgtcattgatttcagcaaggatgaccaggtgcactgcttcaagcatgtcattgtcggcctccatgcttacatggaattcacgatagactcgtcgaaggctccacacaactattcaatggttgattttaacagattcatgcgcggagcttactcactgggcagggacaccgttaccgtgcttggagagtaccctaaggtcaagccaaggttgctcatcatcaagaggcaccgtacaaggatgttccttaaccttgatgagatcgttgtaatggctgaggagctcggctttgaggtggttatcgatgaggccaatgtgagctctgatatctccaagttcgccaggctggttaacacggtggacgttatgatgggtgtccatggagctgggcttacaaactgcgtgttcttgccacagaatgccacactgattcagattgtgccgtggggagggttggaatgggtatcccgtactgatttcggcaacccggcagagctgatggggctgcactacaagcaatacagcatcggcgtggacgagagcagcctcacggagcaatatccgagggaccatgagatcttcaagaatcctattgctttccataagaacgggtttgacttcatcaggcaaaccttcatggacaagcaaaacgtgaagctggattgcaagaggttcaggcctattctattggaggcactggataacctcaacccataaaggccataaagattgtgatcagttggttgttgagcatagcaatatggattactgtatacaattcattttcccccattcaccattcgttccttttagtgctcttgttcgttctgtccctgcctgagaaggcccgcattgtggaaattttagggaaaaaaagctgtgtttactgtgtacactgtataaattgctgccggtgcaatggtggaacgaaatattactattattaattaggggctctaagtctctaacacagttccccggt

SEQ ID NO: 13731 - DNA, 1081 bp, Sorghum bicolor
  Clone ID: SORBI-28MAY03-CLUS4483_1
ccgggggcgtttgcatctccatccaaccacctgcccctcgcggcctagcgtctctcctccccagatccgccccccctcccgtcgtcgtcccccgtccccgttcgaaggcgcggcagaggcgagcgattccgccggatttgattcgacatgaatcccgagtacgactaccttttcaaacttttgcttattggtgattctggtgttgggaaatcatgcttgcttctcagatttgcggatgattcatatttggacagctacatcagcacaattggggttgattttaaaattcggacagtcgagcaggatgggaagaccataaaacttcaaatctgggatactgctgggcaagagcgcttcaggacaatcaccagcagctactaccgcggagcccatggaatcattattgtatatgacgtgacagaccaagaaagcttcaataatgtgaagcaatggttaaatgaaattgaccgttatgcaagtgacaatgttaacaagctccttgttgggaacaagagcgatctaactgccaacaaagttgttgcaactgagacagcaaaggcgtttgctgatgagatgggcatcccattcatggagacgagtgccaaaaacgccaccaacgtggagcaggccttcatggctatggctgcatccatcaaggataggatggccagccaaccagcagcggccaacgcaaggccagcgacggtgcagatccgtgggcaacccgtcaaccagaagacgtcttgctgctcgtcctaagattgcctgatttcattggttccttgtgactattactaccgtttgtgcgagcacgcaaatgtatttgcattattgctgataggcatctattcgttggccagatgattagagagctgaaaatatgttaagaacatcgtagagagaagtaactcagtgctctctctcgacttaaggagcaaacagctacacttttacttcatttttttctactttactatatcgagttacattacatttgtgaacagctattgtaatattttttttactttatgttaaaagtgagatgaaattaaaatataggcaaaaaatttccctaaaaagg

SEQ ID NO: 13732 - DNA, 341 bp, Sorghum bicolor
  Clone ID: LIB3481-040-P1-K1-D7
cgtccgattgtatatgacgtgacagaccaagaaagcttcaataatgtgaagcaatggttaagtgaaagtgaccgttatgcaagtgacaatgttaacaagctccttgttgggaacaagagcgatctaactgccaacaaagttgttgcaactgagacagcaaaggtaagctatccagtttcatgaatagatcatgacatcgtcaacaatacttcatttttcaccacttccttgtgatttctttggatatctataaatgattaaaaacaccatccaggcgtttgctgatgagatgggcatcccattcatggagacgagtgccaaaaacgccaccaacgtggagc

SEQ ID NO: 13733 - DNA, 833 bp, Sorghum bicolor
  Clone ID: SORBI-28MAY03-CLUS51038_1
gcacgaacaaaaccaaaccaactcgtccacagctcgcgcgcgcagccaatccctctccctctccctctccggctccggcggcctcgagatcgagcccaaaaccacctcggtctctgtctctctctcgtctcgccccctgtttagtttgtgtttgcccatccatcccatcccccatggcgaccgacggcggcgagaagggcagcagcggccacgcggcggcggagtggcggttcgcgcgggcggcggcggccaaggaggagggcgcgctggccgtggccggggacaagatgagcatccgggcggcgcggttcaagatcagcgcgagcgtggacgcgcgcgacccgcggcccgtgctgccgctggcgcacggggacccctcggtgttcccggccttccgcaccgccgccgaggccgaggacgccgtggccgccgcgctccggaccggcaagttcaactgctaccccgccggcgtcggcctccccgacgcccgccgtgctctggcggagcacctgtcaagtgatcttccatacaagctgtcaactgatgacatcttcctcactgctggaggcactcaagcaattgaggttgtcgtctcagtgcttgctcaaccgggcaccaacatattgctcccaagaccaggctatccaaattatgaggcgcgtgcagggctgcacaacttagaagttcgtcgtttcgatctgattcctgaaagaggctgggaaattgatatcgactctctcgagtcgattgctgacaagaacaccactgcaatggtcatcataaaccccaacaatccttgcgggagtgtctatacccatgaacatttagccaca

SEQ ID NO: 13734 - DNA, 1772 bp, Sorghum bicolor
  Clone ID: SORBI-28MAY03-CLUS9392_1
gcacgaggcctctgattttgccaatgatagaattattccctataactacagctacgatccattggcagaatacctaaactttatcagtgatggtggcttctctgttgatggtgtactgtcagactaccctattactgcatcagaggcaattggttgttttgctaatctgaattcaagtaagactgatcatgcggaacccttagttatctcgcataacggtgctagtggagaccacccggattgtacagacctggcctaccatagtgccattgatgatggcgcagatgtaattgattgtcctgttcaagtgacaagtgatggagttcttatgtgcatgagttccattaatctgcttgacaccacgaatgttcagagaacacctttcgccactcctccttctcttgttccagaaattcagtctacaccaggaatcttcacattcaacctcacttgggccaacattagcagtagtgctttaaaacccaggatatcttccccagtgagtgattattatcttgtaaggaacccaaggtatgcaaatcaagggaattttctgaagttatctgactttcttgcaatcgtgatggagagggatttgtctggtgccatgatcattatcgagaatgctgcatatatagcgaagtcattaggaattgacattgttgattctgtaaccactgccttaagtgctgctggcttcgataatcagactgccaaggaagttctgatccagtcaaaagatagtgctgttctagtcaaactgaagcagcagaaaacaaaatgcaagcttgtttacactctcccttcagacatcggggacgcttctaattcctcattgaaagacattaagaagtttgctcatgcggtagttgttgatagaatatctgttttcgctctaagttacaattttatcataagacagaacagacttgtgcacgatctgcagtcagcggggctagctgtgtacgcacaggtgttccggaatgagtttgtagcagtcccgttcgatttcttcggagatgcaactgtgcaaatcaattactatgttcagtcatttaatttatcaggcatcataactgatttcccgaagacagtcagaagatacaaaaaaaacacttgtacagttctgggaaaggatatgcccaactacatgctgcctgttgtgactggcgcccttgatcagaagctccaaaccttccaaacccaaccgccatctgtggcaccaatgccgatactgaattcttcaagcgtcgaggagccgcctcttcctcctgctgcgccaagaaatgtgcctggtggtggtggcccctcaggcggcgccaccgcaactcctggcggcgctcctccttctgatgctcatcacacggctactgtaagtactggtatgctacttgtggtggtttccgcagctctgctgatctgagcagacacatgagactgtatagtagacaaccgaagcaaacacagtcgctattggatttgagcgagctttcaccatcaatatggtggcatggtgctaccatgcacttgttttctcagctattttggtatgtggccgcataatcgtgtgcccacatgtacaaatttgtcagtagaatactatctctagtgagcatggtgtgtggatatatcatacacagtacattgctattgataccacatttcatggtttatgcacgccattgctctgtataggtcctcattctgagctgaacatgcatatatatatatgctctgtgaatttcaaaaaaaaaaaaaaaaaaaaggccaca

SEQ ID NO: 13735 - DNA, 1972 bp, Sorghum bicolor
  unsure (1)..(1972): unsure at all n locations
  Clone ID: SORBI-28MAY03-CLUS9218_1
ccttcaccgcttccgaagtctacttccagcccgccccttcctaaccccgcgtcgcccacgagctcgccgtgccggcagaggagaggacctcgccggagcagaggccatggggccaccgcagccagccagggtcggcgccatcaacatcgaggcgtgcgcgcggccgatcgccgtcgaccaccgcatcaggctcccctactacttccgcatcgcgggcagcctcctccgacaggctaatatatatcggaacgagagtaacttcctcgacctgtatgtcatccttctgagatactcgagcttgctgtgtgagacgattccgaagcatcgtgattaccatgccttcaagttaaaagaaaaggcattttttgataaacttaatgatgttatgaaagagcttgagacattgaagccagttgtgcagcggcaggttgccgagcataacagaggaggtactgtggaatcgaatactaatagtctaaatggaaactatggtataactcgtaggatagagcagcgcactccaacctcttatactccacagccatttgtaggcagcactaatggagcattgcaaaaaaccttccatgctgggagacaagtggcattattaccaagcgtccagaaacaatttatgaatctaccatatccaaaagaagaaacactagctagacactccatattaggacctaatggtcttaatggccgatggaatgggcctgttactgaaattaaggttcagtatccaagcaattttgaattaagcacgagggatataacaagtttagtgccatccatcttgaaccaagatgattcgcatggtcccagtactgcacctgcacctccacctccagatagctcctcaaatgacaatgacgatatgaaatctgttctctctcttgatgatggtcgatggtctgtgccagcagaacgcactccacttccttctgctagcttggaagaagagttgtttcaattggatatcaaacaaccttctcctccaccagttctggcagaggtgcaaagaccaatttctccatctagagttgctgatccaacacccggacttccgacctcaggaactgcccgttttcagaacttgcatgttccgatcaagttgatggagtgttttctaagggttgctgagtcaaacaccaaaagaagcttagaaacctgtggggttcttgctggtaccttgaaaaagagaactttttgcgtgacaaccttaattattccaaagcagaaatcgacatctaatacgtgtgaagctataaatgaagaagagctatttgaagttcaggacacaggctcactgttcactcttggttggattcatacacatccaacacagtcctgcttnctttcttccattgacctccacaatcattattcttatcaggtcatgctacctgaagcaattgcgatagttatggcacctactgacacaacaagaaaacatggtatatttcatctcacggatccaggtggtatgggcgtgatccatgattgtcaagagagaggtttccatcctcataaggcacctcttgatggttcgccaatctatgagcagtgctcccatgtgtacatggacaacgatataaagtttgatatgattgatctccgagaacgatgacaaagctcaacttctttgggtttattttggagcctatacttctcacagttaaatcatattgctgccttattttttcttagttgtgctgaagatttgtgaattcttatgtaagctgttgtacatagctattgcattgtatagagaaaacaattgagttaatgctggtaatctgcaaagccattgatgctttgttgtaattcatcccttcaacctcgcaaagcatgtttgtgtggcaagatgaggaagtggtgtctagattttatgccatgccaattgtacatccttgaatatttgacttaaagagcatcaatatcactgattgttaaagctgtattatttttc

SEQ ID NO: 13736 - DNA, 1092 bp, Sorghum bicolor
  Clone ID: SORBI-28MAY03-CLUS9842_1
ttccgccgggacccagcgcccatccatccatccatccatcagcgacaagtccagcccccttgccgccgcctcgccaaatccaccacaccatgagcgccgccgcctccaagaagctcttccaggccgccaggtccctcatcctctccgcttctcagcgctcctccgccgccgccgtcctcgccgccgagggccgcaccgccgcgctcgccacgctcaccaacttcggcaggaaggccctccccaccgcctactactcctaccacaggcagggatcccaccacgctgcgtcgggatggggagccatcgccgccgcagtcccggctgcagtttacatgctccaggaccaggaggctcatgctgcagagatggagcgcaccttcattgccatcaagcccgacggcgtccaaagaggcctgatttctgagattgtgaaccgatttgagagaaaaggctacaagcttgttgccatcaagctgattgttccatccaaagaattcgctcagaagcactaccatgatctcaaggaaaggcctttcttcaacgggttgtgtgactttctcagctctggccctgtacttgcaatggtttgggaaggagagggtgtcatcaagtatgggagaaaactaattggtgccacagacccacagaaatctgaaccaggaaccatcaggggtgatcttgccgttgttgttggaagaaacatcattcatggaagtgatggcccggagacagcaaaggatgagatcgctttatggtttgaacccaaggagctggtctcttataccagcaatgaggagaagtggatctatggggtgaattaaccggcgagtctttttttttttgctcttttttgctcaattttcacataattgcctgacagaccaaggcaggatgtaataaagtcgctaccgtcactttttggttggattgtgattgtgaccttctggtgcagtaaggcacaaggaaggtgaggaaaggaatataccgtgaaatatagagcgtgcactgagtagtcgtgatgttcaaatcaaactatatatcaccttcactggagtcatgtaatccaagatggcgatgtagatgtttctttgg

SEQ ID NO: 13737 - DNA, 1741 bp, Sorghum bicolor
  Clone ID: SORBI-28MAY03-CLUS1020_1
gctcgtcgcttccggactcctctcttccttcctccccgcgccgccgccgcccccgccctccgaacccgaaaggaaccctaaccctagcggcctccgggagaggcagctaggagagctcggagcaccagcagccatggcggagcacgacctcacggcgctgatggcggcgcagctggaccgccacctggtgttcccgctgctggagttcctccaggagcggcagctctactcggagccggagatcctcgaggccaagatccgcctcctcagcggcacgaatatggtagactatgccatggatatccacaagtccctccacggcaccgacgacgtccccgaggacatggtcaagcgccgcgccgaggtcgtctccaggctcaggtcgctcgaggaggccgccgccccgctcgtcgccttcctccagaacccgcagctcgtgcaggagctcaggcccgacaaacagtacaacatccacatgctccaggagcgataccagattggtcctgaccagattgaagctctgtatcagtatgccaaatttcagttcgagtgtggtaactactcaggggctgctgattacctataccagtatcgtgctttgtgcacaaacagtgagcggagtgtgagtgctctctggggaaagctggcagcagaaatcttgatgcagaactgggatgtggctttggaggaacttaatcgcttgaaggaaataattgattcaaagaacttctcatcacctctgaatcagctccagaacaggatatggctgatgcattgggctctgttcatcttctttaaccatgaaaatggtagaaatgggattattgatctgttcttccaggacaggtacttgaatgctatacagacaaatgcacaccatcttctgagatatctagctactgcagttgttgtcaacaaaaggagaaggaatatgcttaaagagttgattaaggtcattcagcaggagcagcatacctacaaggatcccataactgaatttctggaatgcttatatgtcaactatgattttgatggtgctcaacagaaacttatggagtgtgagcaggttatactgaatgatcctttcctgggcaagcgcatagaagagggcaattttgtcactgttcctttgagagatgagttccttgaaaatgctcgtctgtttattttcgagacatactgccgtattcatcggtgcattgatatcagcatgctttcccagaagctgaacatgagctatgatgaggccgagttgtggataatgaacttggttaggagctcaaaactggatgccaggatcgattcagtgtcaggaactcttatcatgacaaccaatcacgtcaatgtccatgagcagattattgagaacttgaagggcctcaacatgcggacctacatgctggcaaagaacatcgtggagccagctcaagcagctcagcaggcaactcgttgagggtagcagagttcacagttttgaggcgccaaggactagtttagaggcagagcacaaacttttggagctctaatgtgtggcagtgaatttcgtcatcagaatttgaacagctgggagggtgtggcttgccgtttgatacagcttattatgctgacatttccaatattttgtactcggaatttcgtaacagtcgatccttctcaatgttttactgtaatgcaatggatacagtgaatcgattaacaccttatttatgccacagtattcatctttaggcatttgtggttc

SEQ ID NO: 13738 - DNA, 1056 bp, Sorghum bicolor
  Clone ID: SORBI-28MAY03-CLUS5583_1
cggacgcgtgggcttcaggatggcacagtgtttacaaagaaggggcatgacgaagagccatttaaagcacgagccgatgaagaggaagttattgatggtcttgatcgtgctgtattgaacatgaagaagggtgaggttgctcttgtcacgattcctcctgaatatgcatttggttcaactgagtcaaagcaggatcttgctgttgttccacctaacagcacagtggtctacgaagttgaacttgtttcatttgtgaaggacaaggagtcgtgggacttaaacaatgaagagaagattgaggctgctggtaagaagaaagaggaagggaatgcattgttcaaattgggcaaatatgctagagcttccaagcgatatgagaaggccgccaagtacattgagtatgaaagttcattcagtgaagatgagaagaagcaatccaagcaactgaagatcagctgcaacttaaacaatgctgcctgcaaactgaagttgaaggactacaaggaagctgcgaagctttgcaccaaggttctggagctagatagccaaaatgtcaaggctctctacaggagggtgcaagcgtacattcaacttgctgacctagagctagcagaggccgatatcaagaaggcactggaaatcgatcctaacaacagggatgtgaagttggaatacaagaccctgaaggagaagatcaaggagtacaacaagaaggacgcgaaattctacagcaacatgttcgctaagatgacaaagtaactggcactggccaaagacagtatggcttcttgggtggaggatgtagtgaagcaaaggattacaagcaatgccattttctgctgcccaaggacttcgcctgttgcttaacattcaacctttggcatactttgtagtcaattagcgcgcatggatgcttggatatgtgaaactgaggaacaattacttcgaggattattattggctctgaatctctcggtttttttttgttcttgttaggaccactgattctgtcgtttaagaatcttatgcatttcacacacaaaaaaaaaaaaaaaa

SEQ ID NO: 13739 - DNA, 1368 bp, Sorghum bicolor
  Clone ID: SORBI-28MAY03-CLUS5590_1
gcggtcaacgcatcctggtcccgacctggacggacaggacgaggacgagcacagcaagcgtaggcagaggcagagcagccgcccgagcccgattctatccagatccgctgctgcttgggtaacggcggcgaggggagtttgcagcgacaccgccgatatcgcggcatcagatccgatggtgcgtcgccggagcagagaaagtggccgaggccggagcctgagcctgggttggcctgcgtgctgcctcggcttcctgctcaagctgctcgccttcctccaggccttcgccgccgtctccgtcctcctctacgccgcatggatgttctcgcgctgggcgcgccaccaccagctccacctcagcgacctcctaagcccggacctctggttctcgtcgctcgtcatggcggcggggctcttctactgcctcctgctcctcgcgggttacctggcagccgagatcaacaccggatgttgcctctgcttctacaccatcccggccatggctatgatgctgctcgaagccgctctcgccgcccatctcgcgctcaacgagcactgggttcaggacctgccagaggaccgcacaggagagctccacaacttactctccttcatccataataacctcgacctatgcaaatgggctgctcttgccatcttcgccacgcaggcactctcacttctcctggctatgattttacgggccatgctgtctgcccggatcgtggactacgacagcgatgaagactttgtggttatacggaggccactcctggttacccaagctcctgcaccttacctccctaccaccgttgatgccagaggtgcccgtcctgacctctggagctcaacattgagacacaagtatggcttgaacacgagcgactatacctacaacacaatggatgcaaatgcagcacagtctcagtgagtggagcagtcacgagacagatgaaggaagcgctaaatgcaatgataagcagctcttctgtgtattccagaaaaagacagatgaaggaagcatgtgtttattcaaagcacctggtatgtacaggttcctggcctggcgctcctggcatattgcttgtaacaatttccaatttaattgcacttagttgatcttgcgttgcactgtaccgtgtcacccgttgatatatgtgtatatttgtggttatgtgggcgctgtgcatatgtggggttttacgtttttgcatcatcgtgaagaggcttttggccaaaagttgtttgtcgagcctggggctgatgtgcgctgcaggccaatttttgtgtatttttttacccggaagaatactgcagtcaaagttctgtaacctttgtgcataataatatctattaagggtcaaaaaa

SEQ ID NO: 13740 - DNA, 958 bp, Sorghum bicolor
  Clone ID: SORBI-28MAY03-CLUS5509_1
gcacgaggcccccgacgacttctccgtcctccgtcctccccgctcgctcccccactctgcctggccgcccagaagatttgatagatttttccccaaatccggcgatcccattccggttctccacttccccgggaaccttccaagcggcttccagaaggccctagcgaccccgctttgacagctgccggcggcgagatctaggagctcccctgccatggtgaaggacagcgcctactacgatgtcctcggggtcagcgtcgacgcgtcccccgccgagatcaagaaggcttattacatcaaggcgaagctggtgcatccggacaagaatcccgggaaccctgacgcggcactcaagttccaggaacttggagaggcctatcaagttctaagtgatccggggaaaaaggaggcttatgataagtacggaaaggagggtattccccaggataacatggtggatcctgctgctgtctttgggatgctttttggaagtgactattttgaagactacgttggtcagcttgctctagcatctatagcttcagtgctgattggcgagatctcactctctccaaagatgtcctgaagttgcgagccaaagcgttgaaaaagcttggaacgatattccaaggcgcaaagtctatgtaccatcgtgaaaacagcctgcgcgttgaaacggccacaaatcaacaagctactccatcacagtgaagcctatggacccccgtgtaacaagggatttgatgatttttttttgtggctttcacctttgtttgtttgctaacaatagcattcggaagacgcaaatccggtttacagtacccttctattaaatttctgtagattatgtgagcgtttaacatgaggctgtgaactgcgcttgatgcagcattatattataacctgtagctgtgttttcctttctggatagtagcattgtactatcggtatactttta

SEQ ID NO: 13741 - DNA, 529 bp, Sorghum bicolor
  Clone ID: LIB3476-007-P1-K1-C1
gcttgctctagcatctatagcttcagtggagattgacgaaatctcaaacagtcaagaggcaagagcaaaggttcaagaaaagatgaaagagttacgaagagaaagagaagggaagcttactcagagccttaaggaccgacttcaaccatatgtagatgggagaaaagatgaatttgtgagttacgcaagtgcagaagctaggcgtttatccgaagcagcatttggtgaggctatgcttcacactatcgggtatatttatgtgcggcaagcagcaagagaactcgggaaaagtagaatctatatgggtgtaccgtttatagctgagtgggttagagacaaaggacaccacattaaatcacaggttaatgctgcttcaggtgctatctctctaatacaacttcaagaagggatgaaaaagatggagggaagtgagaacagtgaagagcaacttattgagatgtttgaggagaaaaaagatgccatgcttagctcactttgtgaaattatgtggtggtattgatcaacactt

SEQ ID NO: 13742 - DNA, 1299 bp, Sorghum bicolor
  Clone ID: SORBI-28MAY03-CLUS57308_1
ctctccccgcagccagaaaaccctagactctctcggccgccgctctcctttccctcgctccacagctcgcgccgttcctccaagcgcgcacgcatcctcccacctgcgcgccgctgccgccgcccaacaatctacgagcagccatggctaacccagcggcaccgggaggaatgaggtcgttcctgcaggccgtgtctacggtcaccgaggaggcgccgacgccgctccgcgtcgtccagatggagggcctggccgtactgaagatcattaagcactgtgaggagtttgcgcctgctctagttacaggtcaattgcttggtttggatgttggtagtgttctggaagtgaccaactgttttcccttccctatcagagaagaggatgatgaagcagatgcagatggtgcaaattatcagcttgaaatgatgaggtgtttgagggaagttaatgttgacaataatactattggatggtatcagtcttgcttgcttggatcttttcaaactgtggaactgattgaaacatttatgaactatcaggagagcatcaggagatgtgtgtgcattgtctatgacccatctagatctagtcaaggcgtgcctggaacctgagtcacctgttactcagtgtgactttgacagacttaaattgtcaactgctccctttatggaaaggaacttggaatttctgattgggtgcatggatgatctttcatcagagcagaacaagttccaatattattaccgcaacctctcaagacagcagtcacagcagcaggcatggcttcaaaagagaaggcaggagaacatggcgagaaaagcagctggtgaggagccgctgccagaagaagatccatcgaatcctatctttaagcctattcctgagccatcacgattggagggctatcttgtaaccaatcagatctccagttactgcaaccatatcaacggggttgctggtcagaattttaacaggctatacctgatgaaggccttgcacgaggactagaagactgggttatgagtgaaagctgttagatttagctcgtgatactgctggaaatcataattttgcgatgtaccttacatgggcgtgcctgtcttctacttaatgtttccatggacaccagatggttagcatccattgtgacgtgcttcgaaattatagcagcattcttggtattaattaaaaaatgatcagtttgattactattatttaatgtagttgcatctgtatgcgtcgaaatataaaccaatgttctccattagtaattttgggatgaacacttgaagtccaaaa

SEQ ID NO: 13743 - DNA, 1685 bp, Sorghum bicolor
  Clone ID: SORBI-28MAY03-CLUS686_1
gcacgagggcagccgccgccgtcgcggggtcctgctgctactcggaggaggccacgtccacggtgatccaggagcccatggaagacctccccgctgaggctgaggctgaggctgagcctgagcccgaactggagccggagcacgagcaggatcctgtactacaggatccggcaccggcggccgaggaggctgacggcaccgtcatcgaccccgccgtggagtaccacgagcaggacgcggaggtggattcctccggggattcgtcggagcggaaggccccctccacggaagacgacaccgtagcagacggcacgcatcccatctgctctgaccacgaggagtgcattgcccgtcctgagaggatcaagatccagaaacgcgtcgtggccatggcccccccggaggggctcatggcccggtccggcttcgcgcccctcggctccctgtcggggcacatggtctaggtcgtcctgggcgtggtggtagctcttctcgtcttctcaacatcgcagttcgtctgagttcccgctttcttcactgatgttcatgatcttgtgctacaaccaggttaatctcgtcaaaggcttgaagatatatgaagacgtctttacaacatcggagatcgtgaaagttgcagatttcatcaatgaaattcgtcaggctggcagaaatggagaactttcaggtgagactttcatattcttcaacaagcagatcaaaggaaacaagagggagatcatacagctcggtgtcccgttatttcaacctaccacagaggaagctaattgtcacacagaaccaatcccccttgttctgcaggctgtcattgaccaccttgttctttggcgtttaataccagaaagcaggaagccaaacagtgtcatcatcaacttcttcgatgaggatgaacattcgcagccctacttcaagcctccccatctggacaaccccatttgcactcttctgctgtctgaaactacgatggcatttggcaggtcactcgtcactgacagcaacggcaactacaagggacctctcacactctcactaaagcaagggtccctattagtgatgcgtgggaacagtgccgacatggcgcgccatgtggtgtgtccgtcgtccaaccggcgcgtcagcatcacgttcgcaagggtgaggccatccacgccggtggacctgagcccactcccgtcccccaccaaggctatgacgccctggcagccgcagccggccactggctcccaggtggcggcgcccgcgtgcatgacgcagaagcccccggtcagcggtgccatcatcggttatgccccgacaccgcaggccgtgctggcgcccgcggcctggggcatggccatgcgcgcgcccgtcatgatggtggccgcagcgcctgcgaggcccatggtgatggcctcgtcgggcaccggcggcggcaacatcagcaagcggatgggccgcagcggcaccggcgtgttcctgccgtggacggtcgggccgaagcggtacaacaagcaccttccgccgcgcatccagaagcgccggttctcggcgatgatgtcgcccatcgaggcgcagggctgaggacccgcccgacgtcacgtcgccgtcgaaccaagtaggacccgatgcaatgagccaccgtttaattcgtagggttattggagtgttttttctctcgtcgtcgaggc

SEQ ID NO: 13744 - DNA, 2298 bp, Sorghum bicolor
  Clone ID: SORBI-28MAY03-CLUS7225_1
gcacgaggcgcccgcccgcacccggcccgccgcgagacgtgagagcccacacgcaccaccacccgtcctcggtcctcctctctctctattccccccccctccccggagcgctcgtgcggaccacgacgacgaggaggaggaggaggaggaggagagagagagggagggagccctacccctgccctgcgcgccggcgtcgccagccagggttagggtctccccgggggggccccgccttccttgtccgccggctgctcgctctggccgatccgcccgcccgacgcgcgggggcgcccagcggcgtgtctgccttcgttcgccctagacgcgagccaatgccgtgtgcctgaccgtcgcatcgctttgggattgattccagctcggaggtggccagccagccagccaaccgagctcgctgtccttccttgccggctgctacggcgttttctgaggaggttccgtgcgacgcgaggatcctccggagatgcaaacttatcaccgtccgaagagtccctgatattgttgagatcaagcacattatgttacctcaatcgagaaagggattcaggaagtcattggtaaaggaagctacgggggggtgtgctccgctatagatgtcaacactggagagagacttgaccaaggagcattaccagttctttctctaccagttacttcgggccctcgaatacatccatactgctaatgtttatcaccgtgacctgaagcccaagaatattttagcaaactctaactgcaaattgaaaatatgtgactttggactagcccgggttcgcattcaatgataccccaacaacagtctcacggacttattatgttgcaacaagattgtacagaggtccagagctctgtggatccttcttctccaagtatacaccagctattgacatttggagcattggatgcatatttgctgaggtggtgacagggaagcctttctttcccggtctgcatgctgttcatctgcgagtttggacgaccgcgcgtcgcggcccaccatcccccgacaccattcctcgggtccggtttgggtgcgccaggagggtcctgagctccagggctctgtgggtccctcttcccttgtctccgccggcccctggcgctgggcccttggcacgcatccttgctgaaaagctattagcgtttgatccaaaggaccgtccaacagcagaagaggcattgcgtgatccatacttcaaaggtctttccaggattgaaagagaaccatcctgtcagccaatcagaaaagtggaatttgactttgagcacaaaagaatgtcaaaggaagagataagagagttgatattccgtgagatactggaatatcaccctcaattgctgaatagctacattaatggcacagagaggacaacctttctctacccaagcgctgtcgatcaatttaagaagcagttttctcatcttgaagaaagtggtggtaacgtcccatcagttccaacagacaggaaacacgcatccctgcccaggactactgttgttcactcgaatccaattcctgccaaggaacaacctcttgctgcctcatcaaaggttagaccagtctctgatgattcatgtaagaatccttgggagaaaggaagtggtcctggaaatgttcccagggcatctctggctccacaagggctgcaaacacaagcaggatcagtaagagttaatggttcagtgatgaattcagggtatcctcctcatcaacagatcccacaagcatatggttaccgccaaatgcctgcaagattggacagtacgaacccatcacaggccatgggaggttacacacagcagtcgcaggcttatgctttttcaaacagcaaaggctcgcctgatgtggctgtgaacatgagagcacccccgttccatcttccatctggaccgaagaataacccattagataggatagcatctgacactgacatatacacaagatcccttaacggcattgttgctgccgccgcggcatcagtaggcgctggcactcaccgaaacgttggcgttgtgccatctggcatgtcaaggatgtattagctgctgatatgctggccacagcttctccaggactagcctgcaagaagtggcgtatggtataagtagtaattcataagaggtgatcacatagagtcttggactctaaaacatgttgtttttacgccatgtattgaggctaaaatgtgccagtttgcgcacaatgaaggattgatcaattcatttaattcattggaaattacattttgtcaaaaaaaaaaaaaaaaaaggccccta

SEQ ID NO: 13745 - DNA, 1760 bp, Sorghum bicolor
  Clone ID: SORBI-28MAY03-CLUS6292_1
agaattccccctttccctccccctccccccgccgcccgctccccgcgccgagaaggggaaccccagccgccgcagcacgccgcccatggcctcctcgtcggagaacacgggcgcgccgccggaggaggagcagccccaggccccgccgacgccgaacccggagcctaccgaggcggcggcgcctggcgaggcggaggaggagccgcaaaccctagagcgggcgcaggagctcttcgaccggggcgccaaggccatcgaggacgaggacttcgtcgaagccgtcgactgcctcagccaagcgctcgagatcaggacttcacattatggagagctcgcgccagagtgtgccagcacatacttcaaatatggatgcgctctgctatacaaagctcaggaggaaagtgattttttgggaaatgttcccaagagcgtgccaaacgaagaatcagtgaagagtacagcttctaaagatgatagtggaacctcaaaggtctctggtaccaatgcggaggatgccgtgtcttcggagaaagctgatgctgaagaaggtcatgacgccgacggccatgagcaggtgggtggggatggggatgttgagttggatcttgccggggacgtcgtggacgtgaagatgggagatgaagaggataatgatttggatcctcccgggttaatcttgggcattgcgagggctatagttggcctgtcccctggtcactctatggggtcagttcttttagtcgctgcccctgccgcaggcgcaacagtatgtgcgggcatgcacatctcactctcggtcttccggtggcctccctccatctgggtgctgctcgtccttcctgatctgcctcgagccgggcgttgaaacttccgcatatgtttggtttatgagctagtttccaagattggagatgcgattccgtactgtgcaaaagcgatttcgctatgcaagtcgcgcatacagagcctgaaaagttccaaggatgctttgttggctggtaaagatggtgatgcatctgctgctaaggctgaaggaggctcagaaaactctgacgctgaaaaagagctagagcagcttactagcatattgcctgatcttgagaagaagcttgaggacctggagcaagcaaacccaagccctgccatggatgagatgttgaagacaattgcatccagggtaactgacgggatgccaagagctgcatcttttacttcttcccagatggcaacctcgagcaatggattcgactcctcggttctgtctacggcagcaacaactggaagcactggaagcactgtgactgacctcggggttgttggcagaggtgtcaaacgagctagcatcaagccgatatctgctgaacctgctgcgaagaaacctgcacttgattcaccatctctccaaggtgatagcagcatcaactctgaggttgtccctgcaacacagaatggtgatgagtccatacctaagtagagtaccattttgttagccctaccgtaatgttaacttgctggaacatattagctgcgtatgtggttctgtttcctcttaatgttgcctcccagctgggcactctagctaagctatgtaaacgtttgagagaggactaccggagccatagactcatcctgagcgtcgtaccttgtaagattataaattactgagatccgtcatggcggtaagtatctgctatatcaagtaggtttagtgatgtttgccctctgatgtgtgtgcttgtgttttttacgatatataaatg

SEQ ID NO: 13746 - DNA, 491 bp, Sorghum bicolor
  Clone ID: LIB3476-018-P1-K1-E2
gttgagaaggatgatgatgatgacgacgatgatgagaagatgggagatgaagaggataatgatttggatctttcctggaaaatgttggacattgctagggcaatagttgagaagaccccagataacactatggagaaagtaaaaatatattctgctcttgctgaagtcgcaacagaaagagaggacatagacaactcactcactgactacatgaaagctttatccatgttggagcatttggttgaacctgatcatcgtcgagttgtggaattaaacttccgcatatgttggtttatgagctagtttccaagattggagatgcgattccgtatgtgcaaaagcgatttcgctatgcaagtcgcgcatacagagcctgaaaagttccaaggatgctttgttggctggtaaagatggtgatgcatctgctgctaaggctgaaggaggctcagaaaactctgacgctgaaaaagagctagagcagcttactagca

SEQ ID NO: 13747 - DNA, 1053 bp, Sorghum bicolor
  Clone ID: SORBI-28MAY03-CLUS7370_1
gcacgcgccggcacgagccgccgccgccatcctgctcgcggcgtccggctactgggagccctgcccttccttgttccatccgatcgccccaggccgaagaggagtccctttgtggatcggtggcaaggcagaacaagaaggaaagtgcagtcggctcgggaatcgacgatttgttgctgtgtgctggcagcgatagtacggatgactctctcgcgacggtttctcaatctgatcgtggacagccaaatccgtggcgtcaggacgttgcgccgcatcgacctaacgcgccagcaattcttcaacccaggaccaccaccgccattacacggaaacggatcggcggctgccgccgccagtgaggcgtcggagtcaactatggagaggattcggctcccccgcccgatcgtcacgttccgagcttcagctcacgacggccgttgggcgatccagtgcttccctctcggggaaaacaaggtgctttgtgcggaccagtctgggcgcaccttcctcttcgacgccgacacgcgccacgtggtgactatgcccagcctcctatgcccagcctccacaaacccaaagacacgcccttctccatcttcatccccagcgccagtgatgactctaacagtgattgatgatgatgatgtgggcatgatgatgttggcaccctctttgtcatggagggctatcccagtatggagccaacctccgatgaccagagccccaacgaccagccaagtgatgagttcgaggcatacgtatacggtaagcgtaagctggcacacttcaagtcctggaagtgccaaccactgccgccaccgccgtatgtccgtgaccccacgtggatgaagttccggccacagatcaccacctacgcagtggtcggcggcggcgcccagatcttgatatcagcggagagcgccggaacttactgcatggacacggcgacccacaaatggagccaagtcggccggtggatgctggccttgcacgggaagatcgaatatgtgccggagctcgatctgtgggtcggtttctcttgccaggatcagc

SEQ ID NO: 13748 - DNA, 487 bp, Sorghum bicolor
  Clone ID: LIB3476-033-P1-K1-A8
ggcagcgatagtacaggatcgtatcgaggatgactctctcgcgacggtttctcaatctgatcgtggacagccaaatccgtggcgtcaggacgttgcgccgcatcgacctaacgcgccagcaattcttcatccccagcgccagtgatgactctaacagtgatggctttgaagatgatgatgatgatgatgttggcaccctctttgtcatggagggctatcccagtatggagccaacctccgatgaccagagccccaacgaccagccaagtgatgagttcgaggcatacgtatacggtaagcgtaagctggcacacttcaagtcctggaagtgccaaccactgccgccaccgccgtatgtccgtgaccccacgtggatgaagttccggccacagatcaccaccttacgcagtggtcggcggcggcgcccagatcttgatatcagcggagagcgccggaacttactgcatggacacggcgacccacaaat

SEQ ID NO: 13749 - DNA, 812 bp, Sorghum bicolor
  Clone ID: SORBI-28MAY03-CLUS9286_1
gcacgaggcccacctgaggagactaaagttactaccctcaacttgcttaagaccatggatccaaatgatgtacaaaatgagaagtctcgtggccagcgctctatggtgctctcctacaaacctttcaaggaagaagatggcgagatagaagatacagagggtaccaatgtgatagaaaaagctccagatggcactccagctggcggtggattgctttttgttattgttcatgaagccaaagatcttgaggggaagcaccatacaaacccctatgcaaaaataattttcaaaggcgaagagaagaaaacaaaggtcatcaagaagaatagggatccacgatgggtggatgaattcgagtttgtgtgcgaggagcctcctgtaaatgataaactacatgttgaagtcctaagtaaagccccgaagaaagggctgatatatggcaaggaaactttgggctacattgatgtcagccttgcagacgtgatcagtaacaagagaattaatgagaagtaccatctcatagactcaaaaaatggtcagatccaaattgagttgcagtggagaacttcctagacaggaagagcaagaatgcatgatgtggtatacatatgaatgttcgtgtactgagtttgcggatacctgtaattgagctcatgtagatattccttttgtttgcagacatctgttgagatttttttcccccttttaattgctcagatttactagaaatactatgtaggcatgtgatccctggaacggaactgagcttattctggactaaagaaggacaatacaaacacacagcattccgg

SEQ ID NO: 13750 - DNA, 426 bp, Sorghum bicolor
  Clone ID: LIB3480-010-P1-K1-B6
ggagcctcctgtaaatgataaactgcatgttgaagtcctaagtaaagcagggaagaaagggctgatacatggcaaggaaactttgggctacattgatattagccttgcagacgtcatcagcaacaagcggattaatgaaaagtaccatctcatagactcaaaaaatggtcagatccaaatcgagttgcagtggagaacttcctagacaggaaattgacagaatgcttgaatgtagtacatatgaatgttcgtaagaccttatattcagtttgcggatatctgtgattgagattgagctcatgtagatatttcctttgtttatagacatctgctgttcagatctcttaattgctcaaatttccgagaactatgtactcatgttatagaccctggaaatggaactgaactttttctttgactgatgac

SEQ ID NO: 13751 - DNA, 1260 bp, Sorghum bicolor
  Clone ID: SORBI-28MAY03-CLUS12259_1
gcacgagcgtctcgcgctcgccatggcccaccacacttccacgcatactccttccacggcgagtcacctcacttcaccccgttaatccccagcgaagaagcgccttacttagcacacttagcaaaggcggctacttatcacactggctttgtggctgagccataattgctctatactgaccttatcactcagcgcgccacctactttgttccagacgctaacagaaaagatgaattcattggctgcatggatgtgtttgtccaccaggcacgcaatttccacaatgtctgaatatctcactagtatgttgtttattcaatgctttctgaaggggactgtcgagaagctaaatacttaatgctggtgatcaatggtgctggtcacaacatggctttttaggaaggagtattgcttagtcttttaaaggttacttactcgttctactacgagtagtataagttgagccgatttaagttgaaactaaggggaattctatattggtgttttcagttgttagtgtttggacttcttgggggagacatggctaatcttgtggctgtgaacataaagaggaaggatgctgaggtggccagccatggattctccacgttccttgatcctaagaggatcaaactgcaggatgaggcagagatccccgagatgatggaagaagaggaagcacttgcagatgcagacgccggtgcagcaccaattgttctgcagttgcagacaccaatgttgatgccgccctcaccgtcaccactgcagcaaactcagggccaagaagaggcttctgtcctccatgacagcaccatgagcactgaacaacaattttgtgatttgtctacccagaagactgttgatgtgccctcagctaaggactggaggggtggaagggctgctagtttcaacatcattcccagcagcactggagctgctaagccttttagaccacatcacaacctcccaagtgctggatctgcttcttgtgcacagtgagcaaccagagccatgccctgctggagcaagcacaagcagcactccatttttgccatcctgactgtatttatagctcccatgattatagattccatggatctaggttctcctaatctttcatctcagctgttatcttgttcgttgttgcttcttcagagaaattgatttaccagagaaattgattcaaaagattggtgtactaaacttacctgatgaggtatgaatcagacttgtagtgcttgttcttcaaatttccttttc

SEQ ID NO: 13752 - DNA, 523 bp, Sorghum bicolor
  Clone ID: LIB3478-040-P1-K1-F10
gaaaaaaaattgtatccctccttctgaaattatatatattaattgacatcttgttcattaaaaaaaataaacaatttctttttggcttcactggagattctataaaacattattagttcaagaattatgcatttggattcaaattctatttgtagctacacagtttataatgaagcattgtaaattactctcttattgtgctgaatttacattgcatatatgggtgtaatttgcacatgtgcgcattgtaattcggtatacttgcagtataatttttacccatctattcctgtcagtctaatcatttttctgtgagtttctgatttattcctgattttgcactatgctctctgtgcttctagccttttagaccacatcacaacctcccaagtgctggatctgcttcttgtgcacagtgagcaaccagagccatgccctgcttgtgaagcaagcacaagcaacagtctcattttgccatcctgactggtttatagctcccatgattacagattccatggatcta

SEQ ID NO: 13753 - DNA, 1643 bp, Sorghum bicolor
  Clone ID: SORBI-28MAY03-CLUS1355_1
ctactggctctctcgccgtcgtcgtcgtcatcgccaccaccacttggcccgcctcgtcgcctcccctcctcctccgaccaccaccgtccaccggcgacaagggcagcaacgatgcaggcggcggcgtggaggcgtcacctcctcgaccatcacctgtccccttccacctcggctgccatcgccgccttcagatccgcctcccagccggggctcgctccccaagggttgtgcggagcggatggcgcgaggtacatgtcgtccgcgagggcgccggcggtcaaggggtccgggcatctcgtccgcaagggcaccggagggaggtcttctgtgagtggaattgtagccacggtgtttggagctactggttttcttggacgctatcttgtgcaacaacttgccaagatgggatctcaagtgcttgtcccattcagaggttgtgaggattctcatcgccacctgaagattatgggtgacttgggtcagattgtgccgatgaaataccatccaagagatgttgattcaattaaggctgttatggccaagtcaaatgtggttattaacctcataggacgagagtatgaaacaaggaactacagctttgaagaagtgaaccaccatatggctgaacaacttgcaacgattgctaaggagcatggtggtatcatgagatttatccaggtttcttgcctaggggcatcaccgtcttctgaatctagattgttgaggacaaaagctgcaggagagcaatcaatcttgaaagaattccctgaggctacaatcatgaggcctgctaccatgattggcacagaagatcgaattttgaacagatgggcacaatttgcaaagaattggggtttcctcccgcttgttggtggtggatccacaaagattcagcctgtttatgtaatcgatgttgctgctgctattgtcaactccctcaaggatgatggcactagcatgggaaagatatatgaacttgggggccctgaaatttacactgtccatgagctggctgagctgatgtatgagacaatccgtgaatggccaagatatgtcaatgttcctcttcctgttgcaagggctattgcttccccaagggaaatgttgctgaacaaagtgccgttccccctgccaaccccttccattttcaacctagaccagatcaatgcattcgctgtggacaaccttgtctcagaagatgctctcactttcgaagacctcggcatcatgcctcagaagttgaaggggtacccggtggagttcctcgtgtcgtacaggaagggtgggccatcgttcggctcaactgtgagcgagaagatgaggagctccgagatgtaggcctcgcgtcctgtctccaaagacactgtagattcatgatcatttagctgcagatgcattgttgtgtttgttgttcttgccatccgtcgccgcagcggcggcggcggctgcctcaccggtggagagcagcaggacccaaattccatgcgtggctcctgttccttgtttatttacttacgccaataagaacgctcagacgttgttttgtctagttcttgagctgggtgcaagtgaagaaaagaatcgatccaacatgatacggttgagaggcttcacaacatgatatatataactcttgcttctgg

SEQ ID NO: 13754 - DNA, 1540 bp, Sorghum bicolor
  Clone ID: SORBI-28MAY03-CLUS19810_1
ctggaccagaggactagctctcgcgcggctttctttcccgaaggctgagccgggctcgtccgtctccatcgcccaccctctcggcctctccaggccgccgccggctccgtcgtcgtgttccccgacgcccgtagcgttcgaccgcggccagtcccagtccaagaggagaatggggagcctggcgtccgagaggaaggtggtcggctgggccgccagggacgccaccggacacctctccccctacacctacaccctcaggaacacaggccctgaagatgtggtggtgaaggtgctctactgtgggatctgccacacggacatccaccaggccaagaaccacctcggggcttcaaagtaccccatggtccctgggcacgaggtggtcggtgaggtggtggaggtcgggcccgaggtgagcaagtacggcgtcggcgacgtggtaggcgtcggggtgatcgtcgggtgctgccgcgagtgcagcccctgcaaggccaacgttgagcagtactgcaacaagaagatctggtcctacaacgatgtctacactgacggccggcccacgcagggcggcttcgcctccaccatggtcgtcgaccagaagtttgtggtgaagatcccggcgggtctggcgccggagcaagcggcgccgctgctgtgcgcgggcgtaacggtgtacagcccgctaaaggcctttgggctgacggccccgggcctccgcggtggcatcgtgggcctgggcggcgtgggccacatgggcgtgaaggtggcgaaggccatgggccaccacgtgacggtgatcagctcgtcgtccaagaagcgcgcggaggcgatggaccacctgggcgcggacgcgtacctggtgagcacggacgcggcggccatggcggcggccgccgactcgctggactacatcatcgacacggtgcccgtgcaccacccgctggagccctacctgtcgctgctgaggctggacggcaagcacgtgctgctgggcgtcatcggcgagcccctcagcttcgtgtccccgatggtgatgctggggcggaaggccatcacggggagcttcatcggcagcatcgacgagaccgccgaggtgctccagttctgcgtcgacaaggggctcacctcccagatcgaggtggtcaagatggggtacgtgaacgaggcgctggagcggctcgagcgcaacgacgtccgctaccgcttcgtcgtcgacgtcgccggcagcaacgtcgaggaggatgccgctgatgcgccgagcaactgacggcgtgcaacgttcgttcggggctcgaggctgcctgcgcttctgcttcctttagtaattgtgggctttgtgcgttcttgccgtgttctgttctggttctgggctttcagatgagttgaaggatggtctgtttaaatggcatcagactgaataactatatgttgtagtagtacgtgttatactcggagtacgccacgatatggtgtggtgtcagtgtcaccagcattctggatttgcagtttacccgaaaaaaaaaaaaaaaaaaggccccta

SEQ ID NO: 13755 - DNA, 1302 bp, Sorghum bicolor
  Clone ID: SORBI-28MAY03-CLUS208_1
gcacgaggcacagctgcgcccaccgcggcaaaatatctcgccgtccgtcccgatggacatcgacctcttcgccgacatcgacctcgacgccctcctcgcctccttctccggcgaacccgccgccgtctccgacctcatcgtcccgtccccgcctccgccggccccggcggcgcacgatgcggcggaagcggggtcgccggagtcggtgacctcccgggcgaacccggccggggaggtgggtctctcggagatcgagaggttcctgatgcaggaaggggaggcggaggcggagttgggcggggaggtcgaggggatcagcgtggaccagttcttcgacgcgctgtacgacggcggggaggggaaagatgaaggggaggcagaggcgggggcaagcacggatgcggactccggcagggacgaggtggtggaagtcgtgacgccggaggcggagacggtggaggtggatggcgatgatcccgtcagcaagaagaagaagaggcaaatgaggaacagagattcggcaatgaaatccagggagaggaagaagtcgtacataaaggacttggagacgaagagcaagtatttggaggcagagtgccgccgcctcagctacgcacttcagtgctacgcagctgagaacatggtactgcgccagagcttgatgaaggataggcctgttggtgctcccacagccatgcaggagtctgccgtactcacggaaaccctgccgctggtttccctgctgtggctggtgagcatcgtctgcctcttcctgatgcccgttctgcccaaccgaagcccagctgctccaagcagcggcggaagagatctcgtgatggcagccggaaagacaagcagtgaaaccccagagatactggaactcatcctccatggaaggcgttgcaagagcacgagggcgaggattaagctatataatttaccatttcatccagtaattgcttgctagttgctaggctttcagcctcttgcaagcttacctgtagtagtgtacttgcaattgcaaatcgtagcgtgcccgctatgtgcctgtcatgcagagaagcctgtcgatatccatggagtgggtagtaccttttttctctgttcattttttgtttgtttaatagatcctgtgctatccagtaatagtttaaaacctggattttgtgttatttttctatttcgccaccttgttgctggttgctcctgatatgaagttcctttgctcgaaaatcttgggaagtacaatatatggtatgatctgtttatactaaaaaaaaaaaaaaaaaaaaaaaaaaaaaa

SEQ ID NO: 13756 - DNA, 1212 bp, Sorghum bicolor
  Clone ID: SORBI-28MAY03-CLUS21609_1
gcacgaggcatcattcaaatttctgccctatcaactttcgatggtaggatggccgccattcgatccgttcgagccctttgccctagctagacccacccctctgatttcatttccccaaaatcatggcggctgctccgtcggcgacggcggtgtccacggcggcgcttctagccccaatccgagctccaaccagcgcgtttctccggcgcacccagctcacccgtcaccgcgaccactccctaaaatgccgccgcgctggtcccatcgtccccgcggccgctgctgccgcggcgggcagcagcagctccccgtcgtctgccgttttccacggcgagtgctttgtggtgggcgacaacatcgacaccgaccagatcatccccgcggagcacctcactctggtgccctccaagcctgacgagtaccgcaagctcggctcctttgccttcgcggggctcccctccgcggcctacccgacgccgttcgtcgccccgggtgaggagtccacccgctacgccgtcgtcgtcggtggggccaacttcgggtgcggctcctcccgcgagcacgcgcccgtcgcgcttggggcggctggagcccgcgccgtcgtcgcggagggctacgcgcgcatcttcttccgcaactccgtggccactggagaggtgtaccctctggagctcacggacactggagcctggaaggagtgcaagacaggggatgtggtcaccgtggaccttagtaactccgtttttattaaccacacctctggcaaggagtacaagctgaaaccaattggtgatgctggtccggtgattgaggcgggagggatctttgcctatgctcggaagacaggaatgatcgcgtcaaaagctgctgcatgagggaaaggtaagtttcatcttctgtcatctgcgcgaatgaagtaagctggagttagggccaagagttaccgcacctacttttgcataattttgtgctgtcgacggtgtctcaaaataagttgcagcctaccgaattatgatgaatcaatccatccatttggtcttttgtcacagatagtttgccagtcctctttgtacaattgtacctgcctgctactgttcttatcagtttgaataactgcactgttgtcatcttatgtgtactacaactcttgatattcgttgcctgttgatgtatttgaggatttgatatgcaattaaatggttgcattcacat

SEQ ID NO: 13757 - DNA, 1820 bp, Sorghum bicolor
  Clone ID: SORBI-28MAY03-CLUS14610_1
gtctccctccgtcgcacctcacgattgccgctggacccgccgccgcccagccaacgcgctcggctcgcggggcccctgcgcctccccccggcccgcgaccgcccgcgcccgccccgctgcgccgaccggggccaggacttccggcccgcgcggggcgttgacgcccacccgcgccttcatcccaggcggctgcttgagttcccggcggtgcccgcccggcgggatcgccaatctccggggctccccccccgaggcggtcacgccgcaccggtggctcgccgacggcgggcggctcgtccccgaccgcactttgctctccacggctttccgggctggcccccgggtctgcttgagaaacgacttcgcgtacacgcagatgacgatcatcgcggccgtgctcctcaacatcgtcaggtctgagatctggaatgccaacgccgcggtcggtgagcgggccgtgctcactcgcaacgtgaatggcccgctgtacgttcgtgcgtcgcggcggcggcggggggggccgagggcaggctgcatatcgcaggcctcaagtcacacgggcagccgtgtggaaggatacatgcctgtagcgatgtccttcactgtataccggcccggtgcagggaagaggccgcggctgcattcgccacggcgttcgacgacgccagcgagcaggtcctgtaccgcttcttcgacgtgtcttggaagcccaagaggctcctcaacatctcgtcggaggcggccatgaaggggtcgatccgcaccattgacggcttcgtgtacggcgtcatcgacaggaagatcgagcagatgggcagagaccaacaggaattcgccaagaaagaggacatcttgtcgaggttcctgatggagcgggagagcgatcccggctgcttcgacaacaagtacctgcgggacatcatcctcaacttcgtgatcgccggccgcgacaccacggcggggacgctgtcgtggttcctctacatgctctgcaggaaccagcacatccaggacaaggtcgcgcgggaggtccgtgccgccaccacgggcgaccgcgacgtcggcgtccaggagttcgtcgcgttcttaaccgaggacgccatcagcagaatgcagtacctgcacgccgtgctgacggagacgcttcggctgtacccggctgtgcccatcgatgtgaagtattgcttttcggatgacacgttaccggacggctacgctgtcaagaaaggtgacatggtgaactaccagccgtaccaaatgggcaggatgaagttcctgtggggcgcggacgccgaggagttcaggccggagaggtggctcggcgacgacggcgtgttcgtccccgagagccccttcaagttcacggctttccaggcggggcctcgcgtctgcttgggaaaggagttcgcgtacaggcagatgaagatcttcgcggcggtgctgctctacctcttcagatttgagatgtgggaagccaatgctaccgtgggtttccggcccatgctcacgctcaaaatggatggcccgctgtatgttcgtgcaacgctccggcaatgaggtgggcggcggtgtatgcccccatcgttctagcagcagcactttgaaagtagaattgcgctatttccatctgatgccatcttggataacgtcgaggctcagaatgtactactgtgttattttcagagatgtaggaacaagttggtcagagcaaatatggtttgaccgggtaaattattgtactgccctaagtgcttactatacaatctaaataaacactctgattcagttattatctttttaattctcccgagggggggccc

SEQ ID NO: 13758 - DNA, 717 bp, Sorghum bicolor
  Clone ID: LIB5051-011-A1-XP1-D1
gccggccgggccgggaccacacagtactgctaccccacacggccacaaccaaacgcgcacggctcccaggtcccagccgcctcgcaccgagacgcggacgccagcgctctccagtctcaactgaccatggactcgccgccgggccaacccacggtggtcaccctgatacttgctctcctcctagttctatacctcgcgctccggcgccgcgccggcgccggcggcgccaagaaccggagctacccgccggtggccggcaccgtgctccaccagctgttcaacttcggccgcctgatggagtaccacactgagctctcccgcaggtaccgtactttccgcatgctcaccccgagcagcagctacatctacaccgtcgagcccgccaacgtggagtacatcctcaagaccaacttctccaactacggcaaggggagcaaggtgcacgaggtgggcgaggacctcctcggcgacggcatcttcagcgtggacggcgccaagtggcggcaccagcggaaggtcgccagccacgagttctccacgcgggtgctgcgcgactacagcaccggcgtgttccgcgacacggccgcggagctcgcgggcatcgtggccgccgacgccggggagaaggtggacatgcaggaccagctgctgcggtcgacgctggactccatcttcacggtcgggtttggggtcagactgggcgttctctccgggtct

SEQ ID NO: 13759 - DNA, 1179 bp, Sorghum bicolor
  Clone ID: SORBI-28MAY03-CLUS21718_1
gcacgagggaggatcgaaggaacgagtaactgtataatagagagagagaggaggtagcaacagccgttgcttaatcctttccttttcctcctcttatctccagggcatcccaagaggcggaaagggaggagcggggctgcgaattcttgttcttttttccaagacaagatgtcttccccaagcaagcgccgggagatggacctcatgaagctgatgatgagcgactacaaggtggagatggtgaacgatggtatgcaggagttctttgttgaatttcatgggcctaacgagagcatttatcaaggaggtgtatggagggttagagtagagctgccagatgcgtatccttacaaatccccatcgattggtttcatcaataagatatatcacccaaatgtcgatgagatgtctggttcagtctgtttggatgtcatcaaccagacatggagcccaatgtttgatcttgtcaatgtttttgaggtcttccttccacaacttctattatatccgaatccttctgatccattaaatggagatgcagctgcgttgatgatgcgtgatcgccctgcttatgaacaaaaagtgaaagaatactgcgaaaaagatgccaaaccagaggatgctggtgtcatcccagaagacaaatccagggaggtggcgccgggggaagatctaaatgtcgcgggcctggtccttattataggcaggccacagcccaagtagctcatctataccagtatcattcccgacattgtatctagccgcaaactgaaaaactcaataaaactcccgatgtctggtatataagtgccatgtatatatactgcaatttcacgttcgctaactgttatttccatctcccagttgacaattggatttccagcatcgctgctatgtcctcatatcatgaggctagatttgtgcgtgggaattggctggatgtcttcacgtggcctcgctggctgtcgtttgcttgccgctttctgcgtccgctgcgtcttttgggaatatctatcaggcctcaagcacaccgctgtatggttggcattttcttttgtgggcaccacttgattagcactgacgctgatgttgatgtgggttgcttggcttccaacatattagcaaactctggccgattaggactgctccggccgggttcgttttactgcgccaggccag

SEQ ID NO: 13760 - DNA, 896 bp, Sorghum bicolor
  Clone ID: SORBI-28MAY03-CLUS24083_1
tgctggcttgccctactcctcgcgccgccgccgccgccgccaccactgcccccagcgcccagccgccgccgcctccggagaagaggagggagccagcaccagccgccatgggtcgcgtccgcaccaagaccgtgaagaagacctccaggcaggtgatcgagaagtactactcccggatgaccctggacttccacaccaacaagaaggtgctggaggaggtctcgatcctgccctcaaagcgcctccgcaacaaggtggcggggttcaccacccacctgatgcgccgcatccagcgcggccccgtccgcggcatctccctcaagctgcaggaggaggagcgcgagcggcgcatggacttcgtcccggagaagtcggcgctcgaggtcgaggagatccgcgtcgacaaggagaccatggagatgctcgcggccctcggcatggccgacctccccggcgtcgagcgccagcaagaggtctccaacgcccccgcctacggccgcccgcagtacggtggtccccgccgtgaccgcgtctaggcttcacgctgttatcgccgtggttgcctcttgatctgccattcgtagttactatgctactttgttaaacttatctttggttgcttctgaggcggttaagttttgaacttgtgttatgctataaattcttaagtgtttgggtctgcgtgtgatggactatgagcttcacgctctcgcccccgtggtggcctctggttctgcctttcgtagttactatgctactttgttaaacttatctttggttgcttctgaggcggttaagttttgaacttgtgttatgctataaattcttaagtgtttgggtctgcgtgtgatggacatgagatttatattctcgcgccaatgaagtcttaagatttt

SEQ ID NO: 13761 - DNA, 985 bp, Sorghum bicolor
  Clone ID: SORBI-28MAY03-CLUS23514_1
ctctcgtggacagaggcgaagactgcacaagtgcagcaaaacgatcagatctagcagaattctctcgatctcatcggcggcggcggcggagcagcgtgcggatcggagatggcgccgagcgggtggaggaggagcgcgggcgcgcggtccctgtggcgccccgccacggtgtgcctgtggctcgcgctcgccgccgcagctctgacgctcgcccaggctaagaaggacctgacggaggttacccacaaggtctacttcgatatcgagattgacggcaagcccgcaggtcggattgtcatggggctttttgggaagactgttcctaagacagcagagaacttccgagctctttgcacaggagagaaaggagttggcaagagtggcaaagccctccactacaagggaagtgcattccacagaattatccccagcttcatgctccaaggaggtgacttcactcttggggatgggaggggtggtgaatctatctatggcttgaagtttgctgatgagaacttcaagatcaagcacactggaccaggccttctgtccatggccaatgccgggagagatacaaatggatctcagtttttcatcaccactgtgacaacaagctggttggacgggaagcatgttgtgtttggcaaggtgttgtctggaatggatgttgtgtacaaggtcgaagctgaaggccggcagagtgggcaaccaaagagcaaggttgtcataacagatagtggcgagctgcctatgtgatgagctaaactgatgtgttccatcttgaagcataataagaagttgctagtggtcgtttgtcgttatagaactgttattagtggctgaaactggcctgagccagtttgttctgtttactacagtgacttccttatttacttagttggaaagttttaaaaggttgaactaatcaggggtctcacgcatcatcatcttcatcgttatcagtttcatctgccagaataatctt

SEQ ID NO: 13762 - DNA, 1024 bp, Sorghum bicolor
  Clone ID: SORBI-28MAY03-CLUS16446_1
gcacgagggtaatccgttacttccccacacaggcattgaactttgcgttcaaggatcacttcaagcgcatgttcaactttaagaaggacaaggatgggtactggaagtggtttgctggaaatctggcttctggaggagctgctggtgcttgctctctattctttgtctattctctggactacgctcgtacacgtttggccaatgatgccaaggctgcaaagaagggtggtgagaggcagttcaatggacttgttgatgtttaccgcaagacccttgccagtgatggtattcgcggcctctaccgtggattcaatatctcttgtgtgggaatcattgtgtaccgaggtctttactttggtatgtatgactccctgaagccagtgcttcttgttggtaccctgcaggacaacttcttagccagcttcttgctcggctggggtataaccattggtgctggccttgcctcttaccccattgatactgttcgccgtcgcatgatgatgacatctggtgaggccgtcaagtacaacagctccttggatgctttcaagcagattgttgcaaaggagggtaccaagtccctcttcaagggtgctggggcaaacatcctccgtgctgttgctggtgctggtgtccttgctgggtacgacaagctccaggtgatcgtcttcggcaagaagtatgggtctggtggcggctaaggatatattatgatgacgatgacgaacaacaaacatgatgttttaggtgcctttaataacatacgtatggaccctggacaccaattttaagtttagctctcgcagaggttggtgagttgtttgtagtgtggctgtgaccgcatccctttttgcgtcggagattggaaataagtgacgttagaaatcctggcagatgttttggggtagacgatttggctgcatcagttttttatttggttttgcgcatgcaaagggttgctcgaatgttatctatgttggtttcggaatcccagcttactgtgtttggtgggcgtaaaaaaacc

SEQ ID NO: 13763 - DNA, 1374 bp, Sorghum bicolor
  Clone ID: SORBI-28MAY03-CLUS16983_1
cttttcgcttttgttttgtccccagcctcctccggcttctggactggctttggtcctcttcccttccccttggtatcaattcctctgtttcccccgttctccacctacctcctcgccctcgtcgacttgtctcttccgccgccgccgtcgacgagagctgcgctaggtgatttccgctgcttcccttctcccatggcgacggcgctcaaatcgttcctgaacagccccgtcggccccaagaccacccacttctggggccctgtcgccaactggggcttcgtcatcgcgggtttggttgacatgaacaagcctcccgaaatgatatccggcaatatgacagcagccatgtgtgtatattctggactctttatgaggtttgcatggatggtacagccccgaaattatttgcttctggcatgccatgcttccaacgaaagcgttcagctctatcagctatctcgctgggctagggctcaggggtacctggagaagaaagagccagaggcccaacagtaaagagggcatgcaacactgcaatcacttgttcaataaagaaactatgctgtggaaaacattcattctgttgtcaaagcttaaggatttgttcgtgaagtggtgtcgacagtgcctttagtgagcatgcagtttttgtatgtttgcaaaatatgctgaggaaattttatgattcctagtgctgttacaatcttctgcgtacttttctgtgcatttgccaaggcacatttggttttacattgcgttatgcaatgaatttccccaactattcagcttgtcccggccttctttcttgttccaactaaaccaccctaaatttcaattgttaaactttgactctgcaagttcacccttacccgcaaaagttattagatttctaggtaaatccctctgacggacacattaaccatatatttatgtatatagtatacagttagaccctctaagttgtgtgtcctttcattgaactcctttttttaacccaactaaactacatctcttttgacttctgtatttggtttgcagggtttggttgacatgagccagcctcccgaaatgatatccggcaatatgacagcagccatgtgtgtatattctggactctttatgaggtttgcatggatggtacagccccgaaattatttgcttctggcaggccatgcttccaacggaagcgttcagctctatcagctatctcgctgggctagggctcaggggtacctggagaagaaagagccagaggcccaacagtaaagagggcatgcaacactgcaatcacttgttcaataaagaagctatgctgtggaaaacattcattctgttgtcaaagcttaaggatttgttcgtgaagtggtgtcgacc

SEQ ID NO: 13764 - DNA, 819 bp, Sorghum bicolor
  Clone ID: SORBI-28MAY03-CLUS16916_1
ccggaggggcgtttgtctgacgtcaagaacaaagactcacctctctgtcctctccctgtgcaagccgtcgctagcgcctgccgccggcgaagcttctgcgggtcctcgtcgtcggccaggtgctggatccgtggcagcggcggccatggacaagagcatgctcggcgacctggacggcctccccgaggaggacaagatgcggatggccggcatgatcgaccagctccagatccgcgacagtctaagaatgtacaattccctggtggagaggtgcttcacagactgtgtggacacattccgccgcaagaccctggacaagcaagaggagtcatgcgtccgccgctgcgcagagaagttcctgaagcactccatgagggttggcatgagattcgccgagcttaaccagggtgtggccacgcctgactaatagtcccatgctggtttcattgcacctgccaagtttctaaccttggggattttgttagcacagatttgtaatccaaaaatgatttcggcacttcactacctgagatatgtgaccgaccgagttaggttgtgtcttgaaccaaatgctgggtatctgaataaaattgccttgagtcgggttagatgcttcgtatcgtggactcgtggttgatcatgtatcattgatagcttttcagaagtgttgtacttcgattcatacttgaaccagcggtttatttgagccagataagtgcatgttattgcttcataaaaaaaaaaaaaaaaaaaaggtaagccagccctagagaagaccagggcatatagccatatataggtggagtgctgaaactttta

SEQ ID NO: 13765 - DNA, 656 bp, Sorghum bicolor
  unsure (1)..(656): unsure at all n locations
  Clone ID: LIB5047-009-R1-XP1-G10
gccggccgggccgggacctctcccctttcctctccgaggctccaaaccctagcgttcttgttccctgggcggcggcggccatggacaagagcatgctgggcgacctggacggcctccccgaggaggacaagatgcgcatggccgccatggtcgagcagctccagatccgagacagtctaagaatgtacaattccctggtggagaggtgcttcacagactgtgtggacacgttccgccgcaagaccctggacaagcaagaggagtcatgtgtccgccgctgcgccgagaagttcctgaagcactccatgagggttggcatgagattcgctgagcttaaccagggcgtggccacgcctgactaatcgtgacggtttcattgctcctgcaaagtatctanaccttggggattttgtcagcaccaatttgtagtagtcctaaaagtattttagcactttctgagatatgcggccaaagttaggttgctttgctcttatatcgaataattcaccttgaatcattgtatccatgggtacgtgctgcgtatattgttgctaattctgtatccatccattgatcggttggtgagaagtgtttgttccatactcaatccagcagtttttttttagccagaaaaaaaaaaaaaaaaaaggccccta

SEQ ID NO: 13766 - DNA, 650 bp, Sorghum bicolor
  unsure (1)..(650): unsure at all n locations
  Clone ID: LIB5051-003-A1-XP1-E4
gccggccggtctccgctctccgactccctctctgtcctctccctgtgcaagccgtcgctagcgcctgccgccggcagcggcggccatggacaagagcatgctcggcgacctggacggcctccccgaggaggacaagatgcggatggccggcatgatcgaccagctccagatccgcgacagtctaagaatgtacaattccctggtggagaggtgcttcacagactgtgtggacacattccgccgcaagaccctggacaagcaagaggagtcatgcgtccgccgctgcgcagagaagttcctgaagcactccatgagggttggcatgagattcgccgagcttaaccagggtgtggccacgcctgactaatagtcccatgctggtttcattgcacctgccaagtttctaaccttggggattttgttagcacagatttgtaatccaaaaatgatttcggcacttcactacctgagatatgtgaccgaccgagttaggttgtgtcttgaaccaaatgctgggtatctgaataaaattgccttgagtcgggttagatgcttcgtatcgtggactcgtggttgatcatgtatcattgatagcttttcagaagtgttgtacttcgattcataaaaaaaaaaaaaaaaaaggcccctan

SEQ ID NO: 13767 - DNA, 1031 bp, Sorghum bicolor
  Clone ID: SORBI-28MAY03-CLUS1052_1
aacctgctggcataatgttttgcataaggcatcagaaaaatcagcacaggcaaagaaatgggctgaacctcatattgagactgccaagacgaaatggattcctgttaaggaaaaattggttgtcctcaagaaaaatgctgaaccttatgtacaaaaggtatcaacaagatcagtggagttgtatgagtcatcaagggatgctgtgacacctcatgttgtcaaagttaaagagtttgttcatccctactaccaggaagccaagatgttttctaagccttacattgatcaaattgctgagatcactaagccacatgttgagaaagttagaactactctgaagccatacactaagagagcagttcatgcatatgggtcatttcttgagtcggcaaccacataccatagacaggctcaagcaagcatcatggactaccttcaccagcatgacataacaaaatcatttgcaacgaaggagttagtttggtttctggcttctgctttgctagctctgcctgtcttcattatatacaggcttctagttgagacattctgcaccaaaaagaataaaaggcctcgtggtggtaacggtaaccatggccacaagagacagaagcggcgacacgctgacaagtagatcaatttactgaacactttagggttcagtatgctgtgtattgtcgcagatctttgagcaggattggatcgctttccctccctgaggctgtactgatgaaccatggaggaagcagacttgggtcatgagcacccttaccgtgaaagcactgtacaccaccgacatttctctcttcttcttttacattttccgccccaggtgtaatatggcttcagtgcagcagaccttttatctgcactttgctggggttaaggggttatgcctcggcctttgtttgattggtcattgtttattgtaacttgtgaatgtgttttgagttcgtgtgcttgtttttgtcggcgacctacattcgaacttattacttatgtatacagtggttggttgttaagcttcctgg

SEQ ID NO: 13768 - DNA, 889 bp, Sorghum bicolor
  Clone ID: SORBI-28MAY03-CLUS1093_1
aaataccaaaaaaggagtggattggcacgcttctctttcctgtagacaagctgcaaatctttatcttgctggggaaggggtcagggaagaggagacggagaagaagaacagagaaggggacgaggctttgcctagctcgttggggctctatggagatccagcaccacggcggggttggcaattcgaaggttgtgaaggttcagagccaggaggcatgggatctgttcaccgatcaagcaagcaaagaagggcgacctgttgttgctcattttggggcatcatggtgtgtgacgtccctgtccatgaactacaagtttgaagagcttgctcagacccaccctgaggtcttgttcctctacgtagacgttgatgatgtccagagtgtttcatccaagtacggagtgaaggcgatgccgacatttttcctcatcaagaacaaggaggtggtgagtaagatcgttggggcgaacccagatgaggtgaagaagctggtggacgcttctgctgaacccttccaaactcagattgtcgtggaatagccgtttcagtcatgtcttcggaaactgctctgtgagactgtgggcgtgagtgcttcttggtcagggtctggatgtcccagactgtccaatgtcgctcgtgttggccgtgtgtgtgactctgatgggtgtcgctttgtagtagtagcagccttgcttcttctgttgcctgttggtctggtcgtgcaggtgcagctgactgtagtgtgactctgaatgttgcatctgttctgggggttgaaaataaaccaacaaaactagctcgctcacttactggctactgtaatctttgcgccatgcagggcagctttatttgttgtttttttggaaatcaaaacaacttaacactcccc

SEQ ID NO: 13769 - DNA, 1661 bp, Sorghum bicolor
  Clone ID: SORBI-28MAY03-CLUS110_1
gcgcacgcgccgcgccagccccgctgcggctccccgtccccgcgcgggggccgcgccggcgcgatctgggcgaccgcgcgccatgggcagcaacgcgccgcctccgccgacgcctcacgtggtgctggtcccgttcccggggcagggccacgtcgcgccgctgatgcagctggcgcgcctcctccacgcccggggcgcgcgcgtcaccttcgtctacacccagtacaactaccgccgcctcctgcgcgccaagggcgaggccgccgtcaggccccccgccacctcctccgcgaggttccgcatcgaggtcatcgacgacggcctctccctctccgtgccgcagaacgacgtcggggggctcgtcgactccctgcgcaaaaactgcctccacccgttccgcgccctgctgcgccgcctggggcaggaggtggaggggcaagacgcgccgcccgtcacctgcgtcgtcggcgacgtcgtcatgaccttcgccgccgcagctgccagggaggccggcatccccgaggtgcagttcttcacggcctcagcatgcggactcttgggctacttgcactacggcgagctcgtcgaacgaggcctcgtccctttcagagacgccagcctcctcgccgacgacgattacctggacacgccgctggagtgggtgcccgggatgagccacatgcggctcagggacatgccgacgttctgccgcaccacggaccccgacgacgtcatggtgtccgccacgctccagcagatggagagcgccgccggctccaaggccctcatcctcaacaccctgtacgagctcgagaaggacgtggtggacgcgctcgccgccttcttcccgccgatctacaccgtggggccgctcgccgaggtcatcgcgtcctccgactccgcctccgccggcctcgccgccatggacatcagcatctggcaggaggacacgcggtgcctgtcgtggctcgacgggaagccggccggctccgtggtgtacgtcaacttcggcagcatggccgtcatgacggccgcgcaggcgcgggagttcgcgctgggcctggcaagctgcggctccccgttcctgtgggtgaagcgccccgacgtggtggaaggcgaggaggtgctgctgccggaggccctgctggacgaggtggctcgcggcaggggcctcgtggtgccatggtgcccgcaggcagcagtgctcaagcacgccgccgtgggactgttcgtctcgcactgcggatggaactccctgctggaggccacggcggccggccagccggtgctcgcctggccctgccacggggaacagaccaccaactgcaggcagctgtgcgaggtctggggcaacggcgcgcagctgcccagggaagtggagagcggcgcggtggcccgtctggtgagggagatgatggtcggggacctgggcaaggagaagcgggcgaaggcggcggagtggaaggcggcggcggaggccgcggccaggaaaggcggcgcgtcgtggcgtaatgttgaacgcgtggtgaacgacctgctgctggtcgggggcaagcagtgacatgcatgcatgcatggatgccaacccggttggcagatcgagtttgcaataagtggttctgattacacaaatgaaataatttccgtccacttaattcccc

SEQ ID NO: 13770 - DNA, 778 bp, Sorghum bicolor
  Clone ID: SORBI-28MAY03-CLUS10205_1
gtttccacgcacgagggaagaaaggggtataggtcatttgcagaggagctagctttttttgtgctggtagtgttgtgagacgctcctgctgctgctgctgccgccgccgccgccgctcgaccgatcgatggcgatcaagagcatgacggtggcaccgacgacgacgcggtcgctggacgcggacatgacggtggacgagttcaaggagtggctgcggcggttcgacacggaccgggacgggcgcatcagccgcgaggagctgcggcgcgccatgcgcgccatccgcgcccggttctcggggtggaggagcaagcaagggatcagctacgccgacacggacggcgatggctacatcgacgacagcgaggtggacggcctcatcgagttcgcgcagaagaacctcggcctcaagatcgtcgcctactaatcttcgcatccggcatgagcttgctacggcgggcggcgggcgctggctcgccggcgacaactcaccagtcaccatcactctccctgctgccggctaaaataagaacggcttcatctatcgcttgtctgttaaaacttgctttctttgtacttagtcaattcgatcatggcatcatgcatatgcactagctctatgtgtcgttgcgtgatctatgtacggtgtgtatggtactcatgcgtggcagcctgcctgcctcggcttgcatagcctagctcctccggccgtgccatgcatgggtgctgtggatgttaatttgctccagtgaaattgacagtataatgcttgttgacc

SEQ ID NO: 13771 - DNA, 1159 bp, Sorghum bicolor
  Clone ID: SORBI-28MAY03-CLUS10273_1
gctagatttctttatttatgacgactgctcaagtgtcgttcccagctaccctcccctcctcgcctctcgccgtccctcctccatatttatggcaacaacctcgccctccatacaccccaagccacacagccccgtagcccgcagcatcttctgttacgttgcgtccggttccctcgcgccgtgcaaacaaagaaaaaaaatggccgtgccggaggtggtggtcgagggcgtcgtcttcccgccggtggcccgcccgccgggctccgccggctcgcacttcctcggcggcgcaggcgtgcgaggcatcgagatcggaggcaacttcatcaagttcacggccatcggcgtgtacctggaggacgcggccgtgtccgcgctggcgaagaagtgggccggcaagacggccgacgagctcgcgtccgacgccgccttcttccgcgacgtcgtcacgggtgacttcgagaagttcacgagggtgaccatgctccttccgctcacgggcgagcagtacgcggggaaagtgacggagaattgcgtggcgttctggaaggccgtcggcctgtacacggacgccgagggcgtcgccgtggagaagttcaaggaggcgttcaagcccgagacgttcccgccgggcgcctccatccttttcacgcactcgtccaccggagtcctcaccgtcgccttctccaaggactcgtcggtgccggcgtccggcggcgtggcgatcgagaacaagcacctctgcgaggccgtgctggagtccatcatcggggagcacggcgtgtcgccggccgcgaagctgagcctcgcggcgagggtgtcggagctcctcaccaagggaaccgccggggccgccgacgcgccgcaggcggagcccgtctcggtcaccgcctgagcgagcgagccgcgaggagaaagagaaccagccagtcgagcaatcagatcgttagttgggcggcatgccatctcgcatctgccggccttgcgtgctccgaagacatgccgcgccggtgcatgcgcatctgtcgcgtcgcgtctttgtctgtctgtgcgtcgtgtttgtttgtagctttctggatgtgccgttcgctgggtaacatttgaataaaaaacgcggatatatacttcgtacgaaaaaaaaaaaaaaaaaaggccccta

SEQ ID NO: 13772 - DNA, 651 bp, Sorghum bicolor
  Clone ID: LIB3481-058-Q6-K1-B7
cgcagcatcttctgttacgttgcgtccggttccctcgcgccgtgcaaacaaagaaaaaaatggccgtgccggaggtggtggtcgagggcgtcgtcttcccgccggtggcccgcccgccgggctccgccggctcgcacttcctcggcggcgcaggcgttctggaaggccgtcggcctgtacacggacgccgagggcgtcgccgtggagaagttcaaggaggcgttcaagcccgagacgttcccgccgggcgcctccatccttttcacgcactcgtccaccggagtcctcaccgtcgccttctccaaggactcgtcggtgccggcttccggcggcgtggcgatcgagaacaagcacctctgcgaggccgtgctggagtccatcatcggggagcacggcgtgtcgccggccgcgaagctgagcctcgcggcgagggtgtcggagctcctcaccaagggaaccgccggggccgccgacgcgccgcaggcggagcccgtctcggtcaccgcctgagcgagcgagccgcgaggagaaagagaaccagccagtcgagcaatcagatcgttagttgggcggcatgccatctcgcatctgccggccttgcgtgctccgaagaatgccgcgccggtgcatgcgcatctgtcgcgtcgcgtc

SEQ ID NO: 13773 - DNA, 450 bp, Sorghum bicolor
  Clone ID: LIB3478-012-P1-K1-D12
cgacggtcaacactgcagcaccgtgccgctcgtgcgtcgccgccgaccgccgcccgccgcaagcgaccgcccggcccgacagaccgaccgatgtgattgattgattgatggcatggtcttgccgcttttgtggtgtgttttttccttaaaaaaaaaatcaggtgacttcgagaagttcacgagggtgaccatgctccttccgctcacgggcgagcagtacgcggggaaagtgacggagaattgcgtggcgttctggaaggccgtcggcctgtacacggacgccgagggcgtcgccgtggagaagttcaaggaggcgttcaagcccgagacgttcccgccgggcgcctccatccttttcacgcactcgtccaccggagtcctcaccgtcgccttctccaagggactcgtcggtgccggcgtccggcggcgtggcgatcgagaacaagcacc

SEQ ID NO: 13774 - DNA, 862 bp, Sorghum bicolor
  Clone ID: SORBI-28MAY03-CLUS1207_1
gccccggtcgctgcttatggacccgtcccggggtgacctgtccgcgcccgggtccttgctcggcgggaccttggcggtggtccgcccccccggtccatgttcggcgacgaaggagccagcgaggggccggccgggccgggagcagcctcccaaatccccaaagccgcctcctccctcgccgccgcgctcgcaggaaccagcgacatgggcgtctacaccttcgtgtgccgcaacaccggcggcgagtggactgccaagcagcactccggcgagctcgaggcctccgccgccaccccctacgcgctgcagcgcgccctcgtcgctgctgcatccgcggccgactccgcctccggcgtccagtcgtccttctccatggtcacccccacctccgccgtcttccaggtgatcgtcggtgctgttggtggtggtgcaatgatggttagcggcggtggcggtgctgccgccgcatcaggtggcgctgcagctgaggctcccaaggaggagaagaaggaagaggagaaggaagagagcgacgacgacatgggattctccctgtttgattagagctctgtcactgtcatttggctcccataagtggtggtttgatcctatcgcggtagttaattttgctgtcctgtgaacgtgaagaactcttggtaattgttacaagcgacctgttccagtttatgtgagaatttgatatgttctgtttggaatcaaatattgtccttaccaagcggcctgaatcggcattgttctgagcttcaatttgtgtgcatggaactgtctacactatcatgttaaccttagtttgttgcagagtaaaaaaaaaaaaaaaaaagcccctagggccgcggccgct

SEQ ID NO: 13775 - DNA, 849 bp, Sorghum bicolor
  Clone ID: SORBI-28MAY03-CLUS1198_1
gatcgatcgtttgattattggcgagcttcattccattccatcagttcctttggcggaggatgtcgtgctgcggaggcaactgcgggtgcggctccggctgcaagtgcggcagcggctgcggagggtgcaagatgtacccggacatggctgagcagcaggtgaccaccaccgtccgcgcctgcagccctctagtaacactagctagctagcagccgccgccatggaggccagcggcaagaagctccggccgttcctcctcaccctgctgctggtgctctccaccgccgtgacgcccatcctctcgctgccagagccagacaacgaggtagactgcgactgcgacaagcccaaggcgcccaagccgtcgcactcgcacccgcccaagaccaagccctcccacccatcgccgtcgccgtcgccgaagcccaagaaccccaagccacccaaaggccccgcgtacccggcgccggggcaccagcaaccgcccaagagcccctcctacccgccggtcacgcgtccgccagtcgtcggcccgcccaagggccccgtcacgcgcccgccggtcacgcgtccgccggtcgtcggaccaccggtgacctacccgccgatcatcggcccaccggtcacgcgtccgccggtcgtcgggccaccggtgacctacccgccgattaccggccctccgacgacgccgccggtcgtcggcccaccggtcacctacccgccgatcaccggccctccgtcaaccacgcctccgatcaccggcccgccgtcgacgacgcccccagtcaccggtccgcccgtgacctacccgcccggcggaggcggcggcagctcgacgccgagcccgtc

SEQ ID NO: 13776 - DNA, 822 bp, Sorghum bicolor
  Clone ID: SORBI-28MAY03-CLUS26722_1
gaccaggaggttgttaatttatcaggtggagagctccaaagagttgctatatgcctgtgccttggaaagcctgcagatatctatctgattgatgaaccaagtgcttatcttgattcggagcagcgtattgttgcctcaaaggttatcaagagattcattcttcatgcgaagaaaactgcatttattgttgagcatgatttcatcatggcaacatacttggctgacaaggtcattgtttatgaggggcgaccttctattgactgtactgccaatgcaccacagtctttagtatctgggatgaataaattcttatcgcatcttgacattacttttagaagagacccgaccaactataggccacgtataaacaagttggactctaccaaggacagggaacagaagtcagctgggtcttactactacctcgatgactaatgaggaagtacagaatctttttggagagctatacgacgcataatctttccagggcgtggaagtgagaagctacttcgaagctacaaactacatcatggcatgagacttgtttaataattggttgcaggagtagagtgcaccggttacaacttataaagcagagcatgctgtgttgatactgagtttttgtttggcttgacctatatgaagagaaggatcggtgttaaaatgggctttgggaagggagaaccagtttctgtttttaagcaatactgtactgtcaatttgccctcgagtatatttgatcctcaattttatagatcacattaaagtttcgagcaacaatgtgaaatcttatgataaattgctgtgcgtattggttatctg

SEQ ID NO: 13777 - DNA, 655 bp, Sorghum bicolor
  Clone ID: SORBI-28MAY03-CLUS27127_1
tctccaacccccaacactcgcctcctcttcctcactccaccactctctccaaccaaccaaccaacccacactcccacacctccagcaccaccaccaccggcggcggcggcgaagatgacgctgacgatcccggacgacgtccgcgcgaaagccgagatctatctcggcgacgaagctgggcaagagaagacccggctgctgctccacgagacgggcctgccgagcggcctgctcccgctgcaggacatcatcgagtgcgggtacgtggaggagaccgggttcgtgtggctcaagcagcgccgcaaggtcgaccactacttcgccaaggccggccgtcacgtctcctacggcgccgaggtgtcggcggtcgccgacaagggccggctcaagaagatcaccggggtgaaggccaaggagatgctgatctgggtcaccctccacgagatctgcgtcgatgacccgccgcaggggaagctccactgcaaggccattgggggtctctcccggagcttccccgtcgaggcgttcgaggccaacgacggccgcgttgttgttcccaggaacgtcggtggctgtgccggtgccggtgccgctgctgctgctgccggcaacggcaacggcgttgttgtgggtgcggcggaggaggaggggaaga

SEQ ID NO: 13778 - DNA, 1461 bp, Sorghum bicolor
  Clone ID: SORBI-28MAY03-CLUS2767_1
gcacgtggcaccccgcacgacgcggcttcctcctcctccttccactcatccatccatccaccaccaccaccattcctctcacctcagacacgcgcgaaccgcacgaaccctagctggcggcgggaggaggaggcggcggcggcggcggcggcgggatgacgcggcggtgctcgcactgcagccacaacgggcacaactcgcggacgtgccccaaccgcggggtcaagatcttcggggtgcgcctcaccgatggctccgccatccgcaagagcgccagcatggggaacctctccctcctctccgcgggatccaccagcggcggcgcgtcccccgccgacgggcccgacctcgccgacggcggcgccgggggatacgcctccgacgacttcgtccagggctcctcctccgccagccgcgagcgcaagaaaggtgttccttggactgaagaagaacaccggaggtttttgctgggattacaaaagcttgggaaaggtgattggcgaggaatttctcgtaatttcgtggtctcaagaacacctactcaagtagcaagtcatgctcaaaaatattttatacgtcaatcaaatatgagcagaaggaagagaaggtctagcctttttgacatggtgcctgatgagtccatggaccttccaccccttcctggaagtcaagaaccagagacctcagtgttaaatcaagcaccactgccgcctcctgtggaggaggaggtggaatcaatggagtcagatacttctgctgttgcagagagttctacggcttctgctctcatgcccgagagtttacaacctaattatccgatgattgttccagcttatttctcaccgttcttgcaattctcagttcctttctggccaaatcaggaagatggaggcgatctgccccaagaaacacacgagattgtcaagcctgtggcagttcattccaagaatccaattaatgttgatgaacttgtgggcatgtcaaagctaagcataggggagcctggtcaggagacagtttctacttctctgtcgctaaatctgctagggggtcaaaataggcagtcggctttccatgcaaatcctcaaacgagagctcaagcctgatcccccatcagcacagaaactgcatttagatggaatcctgggcaaaaaaagctttgcctctctctctctctctctctctctctctctctctctcttttctatatttaagattaaccgtgctctgtagcttgtatcatgtgctgtaagttatgctacgtatgaatgtacctgttgtttgtctggcacgcatgatatgacactcttatgttaacaaagtcattgatgttagtgctgatctttatggttgtaatgctgtaaacttttcctaagaaaaaaagtattagccagttcttttcaaaaaaaaaaaaaaaaaaaaaaaaaaaaaaaaaaaaaaaaaaaaaaaaaaaaaaaaaaa

SEQ ID NO: 13779 - DNA, 876 bp, Sorghum bicolor
  Clone ID: SORBI-28MAY03-CLUS27665_1
aggcgcgccgcccccccggtccgctacgcggcctgccccgcagcggcgccggctcccgtgccaggagagatgattggaagtgggtcaccgaggaatagagagaatgctgcagctgtgatgttgcacctgtctgtgcataacgggcatttagctcgggcacaggagtgcggcatcatggttccactacgggaactggccctgaatggcacagacaggggtaaaagaaaggcggtgcagctccttgagcgaatgagcagattccttgttatgcaacatgaggatactgtttcccaacaattggacgagattgaacgtcaatttgccgccttaggacctaatgttacagaggctgatcttgaacaattgggtgaacaattgggatatctttaacctccacatgctatggttgcatgatgatgatgaatctatcgtcgccacaatactaccaaatgttttttttggataagttaccaaaaggacgagcaagctgtatccgagtcacttggcttctggatccatggtttatgctgaacgagagttcttgtatggcaatgttcaatcggcactgaaatctgtgatgatccgtctggcttggcttcttccatgcttgtgtgctgaagctcccatcgctccatatctgtttctgggtacgtaagctagcccagaatgttgagatgtgtacagtctacttagtatgccgctccaaacgtcatgtatggctatgttttgactagaatatgtacatttttcactatggtactagataaatgagaagttctagcggcagacttgatcagtaaatcttatttcatgctactggatgttggcgtgagtttcagatttcagaatatgttgacgcgtatgcatttggattcc

SEQ ID NO: 13780 - DNA, 765 bp, Sorghum bicolor
  unsure (1)..(765): unsure at all n locations
  Clone ID: SORBI-28MAY03-CLUS14274_1
tctcgggctacattggacagtgcagtggaaacatccaatacatgcttctcggtaatgttggggaaactgatgatggattgttcagtttcgcattgggatgcgtaaacctgcggaagcttgaactcaggagttgttgcttcagcgagcgagctctggccctcgccatactacgcatgccttccctgaggtacgtatgggttcagggctacaaagcgtctcaaaccggccgagacctcatgctcatggcgaggcccttctggaacatagagtttacacctcccagttccgagaacgcaggtcggttgatggaagatggggaaccttgtgtagatagtcatgctcagatactcgcataccactccctcgccggtaagaggttggactgcccacaatccgtggtccctttgtatcctgcctgagtgtaaatagactaagctggtgtttttctccctcatccctgcttccttagcctcctggtcaacaagaacgatgttgatgacttgatatgtggttattgtatggatctagatggctagctgctacgtactgtaataagctactagtagctgagatgtcctggaataagcccttgctattttcgcctgtactgctatctaatcctaggaagatgtatactactaagtaacggtggaagatgtgagtcttgcttgctcgccctgatttgtactattggaggtataagaatacctgggtttttgccgcctactttgagcnnnnnnnnnnnnnnnnnnnnnnnnnnnnnnn

SEQ ID NO: 13781 - DNA, 1549 bp, Sorghum bicolor
  Clone ID: SORBI-28MAY03-CLUS12678_1
tccggtgcacaaaaagcagcggaggaggcagaccacgccagccagcgcgcccgactcgccgtcgccgcggccacgtctcccctcccatggccaccagctccacagccaccgcctcgctgcacctcctcctcccggcctcccgccgccgccgccacttcgtgcctcgggccgcccactccgagtccaccccgcccggcgccgcctccgtcgaccgccgccgcttcattgcccacactgccgccgcggccgccgtctcgcctctcgtcttgccccgctggactcccgcggcgcgcgcggacggcgcgccggcgctctccgagtgggagcgcgtcttcctgcccattgaccccggcgtcgtcctcctcgacatcgccttcgtccccgacgacccctcccatggttttctccttgggacaaggcagacaatactggagacaaaagacggcggtaacacctggttccctcgctccatcccttccgcagaagacgaagatttcaactacaggttcaactcagtaagcttcaagggcaaagaaggatggattatcggcaagcctgcaattctgctgcacacttcagatgctggcgagagctgggaaagaatacccttgagtgcccaacttcctgggaacatggtttacataaaagctaccggggagcagagcgcagagatggttactgatgagggagcaatctatgttacctctaaccgtggctacaactggaaggctgccgtgcaagagactgtttcagctactctgaacagaacagtttcaagtggcattagcggtgcaagttactacactgggactttcaacacggtgaaccgatcgcctgatggacgctatgtagctgtatccagccgaggaaacttctatttgacctgggagcctgggcagccattttggcaaccccacaacagggcggtggcacggaggattcagaacatggggtggagagcagatggtggactttggctgctggtgcgcggtggtgggctcttcctcagcaaaggaaccgggataagtgaagattttgaggaggtgcaggtgcagagccgagggtttggcatccttgatgtgggctaccgctcacaggaggaggcctgggctgctggtggcagtggcgtgctgctgaagaccacaaacggagggaagaactgggtgcgcgacaaggctgccgacaacatcgccgccaacctgtactccgtcaaattccttgatgacagcaaaggcttcgtgctgggcaatgacggcgtgttgcttcgatatcttggctgaaagggtgctggaagatcggtttcagtgatcgtatgtaacccctttttgtattgtacgtgacgtaacgaaggtatattatggagatacatacaattgttcgatttatacagcatatatatgtgtatgtgtacaacggcatctactgctactcctactgtaaaagactgctgactgtgcttgcattctctcttccggaacgcaaatgagtgtaaagatgtgctgcttgcttggaacttcgaaaccaacccgtgtatatactactactgtat

SEQ ID NO: 13782 - DNA, 792 bp, Sorghum bicolor
  Clone ID: SORBI-28MAY03-CLUS1487_1
gccggccgggccgggactatctgctgaagcgaaaaaagaactgaagctatcgatccaatggcagagggcaagagctccggcgacctgttctccagcggcaagctggtcgcggaggccgccgcgtcggcgttccagcagaagagcgtggagaacgtcgacaagaaggaggtcgccggcgcggcggccgagatcctgcacgcggcgtccacgtacggcaagttcgaggacaagccggccgggcagtacatcgagaaggccgagggctacctcaaggagttcagcgcgggaggacacgccgccgagcctgcggctgcaggcgacgcggcgccgccgaagccagcggaggaggcgcccaaggagaaggagccggtgcctgcgccggcgcccaaggaggaaggcggcaagtcgtcgtcggaagggtttggcctcggcgacgtcgtgaagggcgctgagcaactcgtggagaagcagggcggcgccggggaggaaagcgccgccggtgggctgtttaagatggcgcagggcttcctcaagtagatggaactcgatcaaagctccatccacgcactgctcttgatttgtctgcccaacggcaacgtgtagctgtgtatgtctgttatgtaattattaacttcaaataatgttgccttcgctgtgtgtgttcttcaagatgtttgtgtaataataaccgagaacgttgtagcagtggtggcagagtgcttttcgacctgtcttttgataatttaaaaaacattgtatgttgtataaacactcagtccttgtttagttctt

SEQ ID NO: 13783 - DNA, 1211 bp, Sorghum bicolor
  Clone ID: SORBI-28MAY03-CLUS15039_1
gcacgaggcgcggcggggccggggcgcgccctgacggcgcgcgcccgcggccgcgcgtccctgcgccggccctgcgtcgcgcattgcgtctcggcgtccttgcgtgcgtacgccggggaccggagccgatcccggcccgccttcgcgcgccatggccgagatttgctgcgaggagaccaagtcgaccccgccggcgtcggcttcggccatcacggcgcttgccaggggtcgccccagggtggaaatggccgtggccgaggcagcatgccgctccagctccagctccacgccggccgcggacgaaggtgccggtggcggtggcggtgccagtgccacgcggtgcggcaagcggcggggggtggcgtgcgcggcgcccgtgcgctcgtgccagaggtcccggacgacgtcggggttcggctccacttggtggtggccgaggtacggcgtcacctcggtctgtggcctccgtcgcgagatggaggatgccgtgtccatcaggccggacttcctgcgcggcgccgctgacccttcccccggcctgctccggttctacggcctctttgacggccacggtggcggccatgtggccaggatgtgccaggacaggatgcacgcgctggtcgcggacgagtacaagaaggcgggctccggcaacagtgccacggcagcagcggcggagccggcctgggaagaggtgatgaagaaggtgttcgcgcggatggacggtgaagccgcgacccgggccgcgagccgcagcagcaacggcagcatcgcctgccgctgcgagctgcagaagcccacgcggtgcgaccacgcgggctcaaccgccgtcgtcgcggttgtcagccccaccagcgtagtcgtcgccaacgccggcgactcccgcgccgtcctttctcgcgccggcgtccccgtgcccctgtcggtcgaccacaaacctgaccggcaagacgagctagagcgcatccaggaggcgggtggccgcgtcatctactgggacggcgcaagagtgctgggcgtccttgccatgtctcgagccatcggtgacggctacctgaacccgttcgtgacggcggaggtgctgaactagtgatgctaagggggcacgattacattttacacccaccgaggcaccgacccatcgatgtttcgtctcttgttttcttatgctattgattgaatgtgccgattaataaatagtctaattctct

SEQ ID NO: 13784 - DNA, 1024 bp, Sorghum bicolor
  Clone ID: SORBI-28MAY03-CLUS15140_1
ggtaatagcgcgttttgccactaggattcgcgcgcgactcgcgggccctccgctcgtttgcccgcagccccttggccccgttccctcagcatctcgtcggcggcggagaggaggaggggatggcgcaccggctgctgcgggacgcgcaggcggacgggtgggagcggtcggacttccccatcatctgcgagtcatgcctaggcgacaacccctacgtccggatgttaagagctgaatatgacaaagagtgcaacaatttgtgcacgcccctttactgtcttccggtggcggcctggtcgagatgcaaggtacaagaagactgagatctgccagacatgttgcaagctaaagaatgtctgccaggtctgcctgctggatcttgaatatggactgcctgttcaggtccgggatacagcactcgctatcaattctaatgatgcgattccaaggagtgatgtcaatcgtgaatattttgcagaagagcacgataggagggccagagctggcatagactatgattcttcctatgggaaggctcgtccaaatgataccattctgaagcttcagaggacagcaccatattacaagaggaacagagctcatgtttgtagtttctttgtgcgtggtgaatgtacaagaggagctgagtgcccttatcgtcatgagatgcctgaaactggggagttatctcagcagaacattaaagatcgctactatggagttaatgacccagttgcactgaaacttttgagcaaggcaggtgagatgccatccctgacaccgccagatgatgagactataaggaccctctacattggtggactcgatagcagaataactgaacaggatttgagggatcaattttatgcccatggtgagattgagtccataaggatggtacttcaacgtgcaatcgcgtttgtgacatatactacaagagaaggcgcagagaaggctgcagaagagcttgctaacaagctagtcatcaagggtgtgcgcctgaagctgatgtggggcaagcctc

SEQ ID NO: 13785 - DNA, 692 bp, Sorghum bicolor
  Clone ID: SORBI-28MAY03-CLUS153_1
gccggccgggccggggaacgtccgggcggcaaccgcgtcccgccgccgccgcaaaagacgaggaagaggttcccggcgccgaccaccatgtcgtcgatgatgaacgcgctggcgaactggctggtgaacccgcgccgcaacccgctcgcgcgcctccacatgcacgccgtctcctcgcgcctcaggaaatacgggctcaggtacgacgacctgtacgacccctacttcgacgtggaaatcaaggaggcgctcgggaggctgcctagggaggtgatcgacgcccgcatccagcgcctcaagcgcgccatggacctctccatgaagcaccagtacctccccgagcacgtccaggcacagcaggttccattcagaggatatttgagtgacatgttggctctggtgaaaaaggaaaacgccgagcgtgaagcactgggagcccttccactctaccagagaacacttccctaaagtgctgatagacatggtcgcaagtcttctctttacggcaaaatcagaatgcatgaaataaaatgcagtggatgaaactgtttttcttttgttccaaccaaagttccattttacttgttcatgcaatggtgcattgaccatgggctgtagatgttgtttttcccgtctgattaatgggagcaaatttgccttcgactcaaaaaaaaaaaaaaaaaaggccccta

SEQ ID NO: 13786 - DNA, 1601 bp, Sorghum bicolor
  Clone ID: SORBI-28MAY03-CLUS16070_1
gcagcacgaggagctctcgcgtgtcgcgtgtcggtctctccctctcgccggtgccgcttcgatcgccgccgcgccggcgccgctccggccgcctcttcgtcgtcgcctctccgcccgcctcctcctcgccgccgctccggaagcctcctcgtcgtcgtccccgccgcgtccgcgacatcgtcgtcctcactcagccatccactgcactccggcagacctgttcactttgacattccaacaaagggcaccttgctagtctcccagatcgtttcctaacaatgaggacacatgaacgagctgccaatttggctcttgctggactgagcttggcgccacttgtggtcaacgtaaacccaaatgtgaatgtggtattgacagcatgccttactgtctatgtgggttgctaccgttctgtcaagccaactccaccctctgagaccatgtccaaggagcatgctatgcggttcccctttgttggaagtgctatgcttttatcactgttccttctattcaagtttctctcaaaagacttggtcaatgctgtgctcactgcctactttttcattctaggcattgttgctctctctgcaacactgcttccttctataaaacgttttcttccaaaagagtggaatgataatctcatcgtctggcaggctccacttatccgctgggctccgtttatccactcgctctcagtggagttcacaaagtcccagattgttgcttcaatacctggatttttcttttgcttgtggtatgcgtcaaagaagcattggcttgcaaacaatgttctgggattggctttctgtattcaggggattgagatgctgtcattgggatcatttaaaattggagccattctcttgggtggactttttgtgtatgacattttctgggtgttcttcactccagttatggttagtgtggctaaatcttttgatgctccgataaagcttctgtttccaactgcagacgctgcacgtccattctccatgcttggccttggtgacattgtaatacctggtatatttgttgcacttgccttgcgctttgatgtctcaagaggtatcaagaaccgttacttcaacggtgcatttttgggatacgctgtgggtatgacagtgaccatcattgtaatgaactggtttcaagctgcacagcctgctctactatacctcgttccttgtgtgattggtttcgttgctgttcccagtctgtggtatggagaagtgaaacagctgcttgagtttgatgagtcaaaagttgaggctgaggaaggtggtgtagaagaagagcaagatgataatagttccaaaggcaacaaaaaggtggactagcattctagcaggatttagttccagaggtaaaaggacaggacgacagttttcgtgtatggtcgtctgacagctaaatgggcttgatgacctctaataccgggttggcttacttaaggacttagaaatggttcaacatgacacaagttttttttttcgctccgcggattatttggcctggactggagagtggaagatgaggggggaaatgatgatgttacttgcgatgccctgacgtgctcctgattcattgaggaattcccc

SEQ ID NO: 13787 - DNA, 2159 bp, Sorghum bicolor
  Clone ID: SORBI-28MAY03-CLUS16466_1
gcacgaggacgttggcagaaggatttctggtggaaccgagcgcactggacctgatgcttacgaggttgctttaaaatttgagcaccgaaacagcaagggctgcaattatggccctccatatgagtggcaagtttatagtgctctgaacgggtgttatggtgtaccatgggttcattacaaaggtcggcaaggagattactatgttctggtgatggatattctagggcccagcctttgggatgtctggaattcatttgggcagacgatgacagctaatatggttgcttgcattgctgtagaggcaatttctatacttgagaaacttcatgcaaaagggtttgttcatggagatgttaaacctgagaattttctacttggtcagcctggatcccctgacgagaaaaaactttttctgattgatcttgggttagcatctagatggaaggaagcagggtcatctggacaacatgttgaatatgatcagaaaccagatattttcagaggtacaataagatacgctagtgtccatgcacatttaggacgtactggtagcagaagggatgatctggaatcattagcatatacattgatatttcttcttagaggaaggttgccgtggcaaggttatcagggcgagaacaagagttttcttgtttgcaagaagaaaatggctacctcaccagatctactatgctgtttttgcccacctccattcaaactcttcctggagactgtgacaaacatgaaatttgatgaagaaccaaattactcaaagctcatttcccttttcgatgaattgattgagccccagcatttgagacctattagaattgatggtgcattgaaggctggacaaaagcgtggaagattacttgtaaatctagaagaagatgagcaaccgaagaagaaagttcgacttggaagcccagcaaatcagtggatttcagtttataacgctagaaggcccatgaagcagagataccattacaatgtagcagatgccagacttcatcaacacatagagaagggtaatgaagatggattgttcattagttcagtagcatcttcagcaaatctttgggccctcattatggatgcagggactggtttctcatcccaagtatatgaactttcacccatattccttcataaggattggattatggagcagtgggaaaataactactacatcagtgccatagctggtgcaacgaatgggagttccttggtggttatgtcaaaaggaactccttacactcagcagtcttacaaagttagtgaatcattcccctacaagtggatcaacaagaaatggaaagaaggttttcatgttacatcaatgacaactgcaggcagccgctggggtgtagttatgtcaaggaactctggatactctgaacaggtagtggaattggattttctttatcctagtgaaggtattcaccgacgatgggagaacggatatagaataacttcaacagcagccactggtgatcaagctgctttcatattgagtatacccaaaagaaagttaatggatgagacacaggaaactcttagaacatctgcttttccaagcaaccacgtgaaggagaaatgggccaagaacctttacattgcttcgatatgctatggccggacagtgtcatgaggcttgctcaactgcatccctagttgggaagagcatattctgatgagtagatattggaaaaatcagcaatttttgttgctgctctctattactctctgtatgtgtaggtaaactggtcaagatgaatcacctcacaatggccagagtaggagcttaagaaagaaccgagaggaaggtggaaagcaagcagccaataagcagacgaggaggatgtgatctggctagtagcgggtgcagacgctaatggcgtcaaatgttttgcatcagcatgttttgcttcgctcctgactgctgtgcaagagtagacagcttgtagcctccttcggaggcaagtcatctgagaaccatcgtgtatagcgtatgatgtcattgcattttgtttagtggaagccaagttccatctttccggaactctgaaaatgctaagttattatgcgaggaaaacaagtgtactgataaaattcggtgtatcgattccattattcgataattctcacctgcattaatt

SEQ ID NO: 13788 - DNA, 1669 bp, Sorghum bicolor
  Clone ID: SORBI-28MAY03-CLUS3142_1
ccatggcccgggtcctccgtctgcgccgcgccggactgcgcgcccttccggccccaggccccccccccccccccctttccccgcccgggcccggccccagagctctccgccctagggccctccccggccgggaaggcgagccgggacgcggggatgttgtgggtagacaagtaccggccaaaaaccctagacaaggtcaccgtccacgaccaggtggcgcagaacctcaggaagctcgtgtcggagcaggattgcccgcacctgctgttctatgggccgtcggggtccgggaagaaaaccctaatcctcgcgctcatcaagcagatgtttggcgctggtgcggagaaggttaagctggaaaacaagacatggaaaatcgatactggaacaaggacacttgagatagaattggcaatgttgtcaagtgctcaccatgtggagatgaaccccagtgatgctggctttcaggacaggtatgttgtccaggaggtcatcaaagagatggcgaagaacaggccaattgatgccaaaggcaagagagcgtttaaagtccttgtgttaaatgaagttgacaagctctcacgagaagcccagcattccctccgcagaactatggaaaagtatagctcatcgtgcaggctgatcctatgctgtaacagcccctcaaaagtgacagaggctgtaagatcccgttgcttaaatgtgcgagtaaatgcacccagcgaagatcagattgtccaagttctagagttcattgggaagaaagaaaacctgcgtcttccagctggatttgcagctcgtatcgcagcacaatcaaaccgtaatcttagacgggcaatactgttttttgagacttgcaaagtgcaacaatatccatttacatcaaatcaagcggcgcctcctcttgactgggagcaatatgtgtctgaaatagcaactgatatactgacagaacaaagccctaaaaggctatttgctgtacgtcagaaattctatgaattacttgtcaattgtatcccgcctgaaagtattttgaagaaattgttggcagaattactgaggaagttagatgctgatctgaaacatgaaatctgtcactgggctgcacactatgagcacaagatgcgccttggatcaaaggccatttttcatctagaagctttcgtggccaagttcatgagcatttacaaggagtttctggtggctacatttggttgagcagaaccccttaacttctgcagctttcgtggccaagttcatgagcatttacaagtagttcctggtggctacatttggttgggcagaacctcaagcatagggttggctatcacattgtatcagggagtatctttggcggtgtagtcttgtactaaactcgtgaacgactagactagcttcattctgtctgtttaaaccatcgtcaactctggttaccctcttgtgattccatcgcgttgactgcacgtggacgttggtgaagttattattacatcctatgtgcggcatactcggaagttaggccttggtaatttttttgatactgtagcattttcatttatatttgataaatattatctaatcataaattaactaggtttaaaagattcttctctctcaaacaaaaaaaaaaaaacccacgcgtccgcggacgcgtgggcggacgcgtggg

SEQ ID NO: 13789 - DNA, 852 bp, Sorghum bicolor
  Clone ID: SORBI-28MAY03-CLUS34972_1
tggaacaggaactactgatgctgttgcgaaaatttgggatgtgaagactcagtcaaatgttgcaaagtttgaggggcatgttggaccagtcactgctatgtctttctctgaaaatggttacttcctagcgactgctgctcatgatggtgtcaagctttgggatcttcggaaattgagaaattttaggaccttctctccctatgattcggacacgccaaccaatacggtggaatttgattttagcggaaactatcttgccattggtggttcagatataagggtctaccaagtagctaatgttaagagcgaatggaatcttatcaagacattacctgatttatcaggaacagggaaagtaacttccgtaaagttcggagcagatgctaagtacattgctgtaggttctatggaccgcaatctgcggatatttggcctccctggagatgaccaaatggaggaatcaaacacagcggccgagtgatggaaatccatggtacctaatttgttttttctgctatcctccgcattgtattctgatgatggataagactgagtggacatggatacatcaccatcacaagagggaagggtcctgacggggattactggtttgagcttcggtctttgtaaacaagctgtgacattattgtattgtaggccttactaattcttctgatgaggatacaatttgttttgatgagtacgatgctaaacagcaaagttctctgcgttgattccagtgattcaaaacaaactacttgcttctcaacttctttattataggtcaatggaagcactgtcagacgcgctcatgctgagtgtgccgtgatgtgtgaagattggttatttggc

SEQ ID NO: 13790 - DNA, 1241 bp, Sorghum bicolor
  Clone ID: SORBI-28MAY03-CLUS3517_1
gcacgagcctgtcctctcccggctgctctgcctcgccatagtaggtgagcaagaatccccgagacctggttcgtcgccgactgtgaccgttccagaagatcatcagggccggggcgcccccaattcgaaccgctgctgttctaatcctcgggcggcgggatcgaagatgccggagcattcagagaacgcggcggcggacctgatgggtaacatcatggagaccatcgcggagaaccttccgaagcagaagtcagtccggttcgacgacggcgagggctccatctccgaccaggccaagaagctcttcggcggcgggcaggccggtaacaagaagtctatccaccatgtcctgggtggcgggaaatccgccgacgtgctgctgtggcggaacaagaagatctcgtccagcgtgctgggcgtggcgacgctggtgtgggtcttcttcgagtggctggactaccacttcctcaccatcgtctgcttcctgctcgcgctcggcatggccgtccagttcgcctggtccaccttcgccgccgtgctcaacagagggtccccttccagcgtgcctcgcgtgcagctgccggaggagctgttcgccaacgtgggcgcggccgtcggcgcccaggtgaacagggcgctgggcttcctccaggacgtgtcctgcggacgagacctcaagcagttgctcatcgtgatcgccgggttctttgcggcggcgatcgtcggcagcttctgcaacttcttgacagtcatctacatcgggttcgtgtgcgcgcacacgctgccagtgctgtacgagaggtaccaggaccaagtggacgacttcctgtacaacatgctgggcgtggtgcagagccagtaccagaagctggacaccaagggcatcctcaagggtggcgtctccaagttcaggaagaacgagtagctagccagtggcatcccatccattattattcccctcgctgcttcatcaatcatcagcaggagcagggcgagctagtagtgaggtttctctccttcctctgcctgctgcctgctgtgtaatcagtaatctaatctctatgattgcttcagatttcatctccgtctccaaaactaaaccgatcgaactgccatacattctgtacagagaataataaccgtgttgctgctgctatacatatatactacttgtgtaatgatatgacattttagcttcgcgtgtactgatgaatgcacattgcactaaagcttacgtaaaa

SEQ ID NO: 13791 - DNA, 798 bp, Sorghum bicolor
  Clone ID: SORBI-28MAY03-CLUS17693_1
ccgggaagtctccgggatcaccttcatctaaacaacagttagatctcaccatctgcaggatagtataatcaaataccatggcatcacaaacaaccaaaatgcttgccctggttgctgcgctccttgctctctctacgattgctactgccacagccaattgcctacaaaacatcccacatgtgatgggaatgacagtgatggatccatgcatgcagtcatgcatgatgcaacaaccattagccatggtaatgatgggaatgacagcgatggatccatgcatgcaatcatgcatgatgcaacaaccattagccatggtaataagttcaccctccctgatgatgagaatgaattccatggtctcgtgcgtgcaatcttgcatgacacaacaggcattctccataggaggctcatcattgtcaaaaatggtgatgcagccacaaccattctccatgatgcaacaacagtgctgcatgcaaccaatgatgatgcagggtctgatgtcaccaccgtgccactgtggtgctatgtgccagctgatgatgcacttgcaacagatgcaaatgacgctacaactgccttccatgtatagcactacagccatgccaactctagtggcctatggccaaaagccctttccttgttgtgcattctagatagattgatatatccatgtgctgcattgtattccaagaatatggtcacataccatcgtgtgtgactcaccagaaataaaattctgaatatgatgcatatattatggtaaaaaaaacgaataaaaaaacaaaaaaagccccctaa

SEQ ID NO: 13792 - DNA, 680 bp, Sorghum bicolor
  Clone ID: SORBI-28MAY03-CLUS25480_1
tactggagaagcgcggctagggtttgtacgttcctcacacatttctccccctctcttcatcttcttcggctccaccagctgcctccggtccgccgccgccgaaaccttagcctcctccagctccttgacctcggcagagccatggcgatgcgggcttgcaggaggttcttgtagccagaagggtcagttccccagtccccacctacaagtacgcgagtgtagtgtgaccttcgccgccgccgccgtctccatgacgaccatcaatccctttgaactcctgggcgccgacgacaacgacgaccccacgcagctgctggccgccgccgcggcagccaagcagaaggccgaggcgaagaagcaagcggcggcggcgaccgccggccccgccaagttgccaaccaagcctgtcccccctgctcaggccgtgaaggaggcccgcagtggtagtgccccctcccgtggtggttatgggcgtggcgaacgtggtcgtggcagaggagggcgaggatatggtcagaaccgtgattatggcagcgaagatgctaatgggtttcagggaggatatggtactgggaggaggtgccagagctggaggcgaagaaggagcccaggacagagagaggggccctcgtccaccgtaccgtggtggcggcggaggccggcggggtggataccgtgat

SEQ ID NO: 13793 - DNA, 1589 bp, Sorghum bicolor
  Clone ID: SORBI-28MAY03-CLUS24768_1
gcacgagggaacagtcaacatctaagagggcctccagtccccaaacagatgctgaacaaggcggtggcagcttaaaatcaatgaaagacaaatctggccagcaagataaagacgcaaaagagggatcaaatttgcaggttgctggtcctgctggtgaaattactgcaggttacctcttaaagaaaagcgcaaaaactaatgggtggagcaaaagatggtttgttcttaatgagaagagtggaaagcttgggtacacaaagaaacaagaggagagacattttcgtggtgtcatcactcttgaggagtgcaaccttgaggaggtagaggaggaagaaccttctaaaagttcaaaagactcaaaaaaggcaaatggatcagaaaaaacaccaagtcttgtatttaagattactaacagggttgcatacaaaacagtcctaaaagctcatagtgctgttgtgttaaaggctgagagcatggctgacaaggttgagtgggtaaataagatcaaagctgttattcagagcaaagggggttctttcaagggtccaagtactgagggtggctctatgaggcaaagcaattcggatggcgctttagatactatggcacggagacctgctgatcctgaagaagaacttagatggatgtctcaagaagttcgtggttatgttgaggctgttttgagcagtcttgcagcaaatgttccgaaggctattgtgctttgccaagtggagaaagcaaaggaagatatgcttaaccagctatacagctcgataagcgggcaaagcaatgttaagattgaagagcttcttcaagaggaccataatgctaagcgcagaagggagaagtaccaaaaacaatcatcactcttgtcaaaacttactcgtcaactcagtatccatgacaacagggcatctgtttcctcttattctaatgacaccactgaagctgagagccctcgaacaccgagccgctcaggtgaggactggaggtctgcctttgattctgcatcaaatgggcctgttgctgcaagcaaaaacagtgaatcaaggtcgagaagtgctgatggtcgcagtcggcgctacgagaatggcgatgtgagctcaggtgccaactctggcagccggcgcacaccgaaccggttgccaccagcgccgccgaaatactaatcgtgctgattggtattcatgaacattatgtattcttgcctggcacacgccccttgtttgtcatatgggttattggaggagcgtattccagatcggctgctagggattgtggtgtagtggagtctggggtgattgcgtgaacattgtgttcccaggtcgctgcgactcagatgagttgtttatagaaatatataggtaaccatggtctctactgtttattatctccgcatatttatgccctggtgccgtccctgcctttgggattttgttcggaagatcgatcttgcttttcgcaattggtcgttctaggacgacggctgtcagactaagattttatgttgtcctcccccgcatattgttctttgcccctgatgattcttattaagacatggtacatatatatgactgaagctccacgtt

SEQ ID NO: 13794 - DNA, 1832 bp, Sorghum bicolor
  Clone ID: SORBI-28MAY03-CLUS25602_1
tgttggcctctggagcctcctcgctgtgcagtacaagttgtcctctctttggtttagtttagtttgcgctgctggatttgttcaggcttttggtcttgagttgaggaaaaaagatttggggttcttgaaaggtgagtgaaacaaatgggtattgggaatggatcatcaagcaatgtgtcgcacaaagcgatgcaagatgagaccacgccgcttctcccgatcaaagctgaggaggacgtggttcacgagttcgatggagcttctttctctggtgcagtcttcaatctgtcgacgaccattgtaggggctggaatcatggctctgcctgcgagtatcaagatgctaggccttatccctggtattctaatgatcatccttgtggcgttgctcaccgaggcatccattgacatgctggtcaggtgcagccaccagggcaagattacatcctacgggtggttgatgggtgacacttttggtcagtgggggagaattgccctacaagcatcagtggtgataaacaatgtcggcgtattgattgtatacatgattattattggcgatgtcctatcaggaacatcatcaacaggtgttcatcacagtggtgtatttgaggggtggtttggacctcatatgtggaattctcgtcccattgtactcctcactacaactcttgttgtatttgctccattggtgagctttaagcgtctggattcattgagatacacatctgcactatcagttgctcttgctgtggtttttgttgtaatcactgctggggttgctattgtcagactcatccaaggaactgtggagatccccaaactctttcctgagatagatggagttagttctgtctggaaactgtttacagctgtgcctgttcttgtcactgcctacatctgccactacaatgttcacagcattgataatgagctggaggacaagacccaaattaaaccaattgtacaaacttcactgggactctgctcaagtgtttacattgcaacaagcttctttgcatatctcctcttcggcgaggctaccttggctgatgtgcttgccaatttcgattctgaccttcgcattccattcagctctgtcttcaatgacatagtgagagtgagctatgttgtccatatcatgcttgtctttcctatagtcttctttgcccttaggctcaacctggatggattactctttcccaccgcaaggcacatttcccatgacaacaagaggttcaccattatcaccatctcgctcattgctgtaatttatcttgctgctatcttcgtaccgagcatctgggatgcgttccaattcactggcgccacagctgctgtgcttattggtttcatctttcctgccatgattatactcagggatccatatggtgtttccaccaagcgtgacaaggttttggcggtaacaatgattgtgcttgctgtggtgtccaattctgtggccctgtacagcgatgcgctcaacatcttctacaggaagcaggaggcctagagtccatcatacctcaggggaaaagttctttatacaggtctagagtgattgttgacctttttaagctactactgagcagcagtgccacgagatttcatggtggtcaatattttttgtttggtcacttgaaagaaacctggtttgttgcaaatatttgttagtcttctgaacataaaccgcctccacatctggatggcccacttgtgctatgatcacctgtggaacattttttttttcacgtggttgttcattcagtcatcttgtaatggatgactaaaaatgctgtatatatataacggatagttccctgcttttgtgtt

SEQ ID NO: 13795 - DNA, 724 bp, Sorghum bicolor
  Clone ID: SORBI-28MAY03-CLUS25660_1
tcacccctccagctctcgcagcacagcagcagagcggggaccaacccatgccccctcagaggaagggcgctctgctacaggctgcgcacgctgccgactaacccggcctgcagcaagccgggcaaggtcagccatcaagcagctcagcactgggtggccatcctgcaccaccgctatactaccatgggcagggtccaccctaccatccacctcccccaccgtatgagtggctacctgcctccaccgcgcatgccctacccaccccaatatccacgttaccagcctatggtagcacccccagcacaggcacaggctccacctacttcatgtcaccacccacctccagcaggcgcagcccagcagccgcctcatggccctccacctcagctgcagccacaaccgcaaattcacaactgaagtccttacaagatgccggcgattgctgctgctctaatggctcggcaggagaatgtaacccccgtgggtcgccagcttttgtcatttcttaatttgtggttaacagtaaaactttgttgtattgcttatcaaagatcgaaaaaccgggagatataccggcttttgtaactttttaatttgtggttaacagtaaaactttgttgtattgcttattaaattttgaaaatcaggactcggttgtaattgtaaaaatgacttggatactgacattcgttcaaaagtattgatcgctgatttattattaggg

SEQ ID NO: 13796 - DNA, 1640 bp, Sorghum bicolor
  unsure (1)..(1640): unsure at all n locations
  Clone ID: SORBI-28MAY03-CLUS2656_1
cgcgtccgcgcggcaccacgcccacgtcagcacatccgagtcctcgccgccgccgccgccgccatgcttctcctttcctccgccctcttcaccaccgctcgcttcccactcgccgtctccgcccgcctcccaaaccctaccactaccacccgcctcctcctcttcgccggcctccctgcctcctccccactccgtgccttctgccccagggcgccgccttctccgtccctcgccacctgcgccgccttctcctcctcctcctctaccatggccgccgccgacaaccccctcctcgtcgccgacttcgacttcccgcccttcgaccgcgtcgagcccacccacgtccgacccggcatccgcgaactgctcacgcgactcgagggcgagctcgaggagctcgagaagggcgtccagcccacgtgggggaagcttgtcgagccgctcgagcgcatcaccgacaggctcgaggtcatctggggcatggtcgatcacctcaaggctgttaaggactccgccgatctccgcgccgccgtagaggaagtgcagcccgacaaagtcaagttccaactaaggctggggcagagcaagcctatctatgaagctttcaaggccatcaggaactcttccgactgggacagtctcagtgatgctcgcaagcgtatagttgaagctcaaataaaggaagctgttctcagtggagttgcgcttgaggatgagcaaagggagaagtttaaccaaatcgaacaagagcttgaaaaactgacgcaaaagtttagcgaaaatgttctggacgccacaaagaaatttgagaagttaattaccgataagaaagaaattgagggtttacctgctacagcccttggtttagcagcacagactgccgtgtcaaagggccatgaaaatgctacagctgaaaatggaccttgggttatcacgttggatgcaccaagctatatccctgttatgcaacatgctcagaacagagagctccgggaagaagtttatcgtgcttatcttacccgcgcctctagcggtgaacttgacaacaccaatatcatctcccaaattctaaagctaaggcttgagaaggctaaacttcttggctacaagaactatgctgaggtaagcatggctcagaaaatggcaactgttgagcgagtagaagagcttctcgagaagctgcgtgctgcttcctgggatcatgctgtcaaagatatggaagatctaaaaatctttgcgaaagattctggttctcctgaagctaatgatttgactcactgggaccttaccttctggagtgaacgactgagagagactaaatatgatatcaatgaggaagagctgcgcccttattttgcactacccaaggttatggatggcctcttcactctggcacataagctttttggagttactgttgaacctgcagatgggctggctcctgtctggcacagtgatgtcaaattttattgtgtcaaagactcttccaatagccctgttgcttatttttactttgatccttattcaagaccatctgaaaagcgcggaggggcttggatgaatgtggtcttctctcgaagtcgcgtgctagctcgcaatggtttgtctgctaggcttcctgttncccatatggtgtncaa

SEQ ID NO: 13797 - DNA, 844 bp, Sorghum bicolor
  Clone ID: SORBI-28MAY03-CLUS26653_1
tgaaacagttcagagcaatgaataagctgaaaaaaatggccctaaaggttattgcttcaaaccttaacgaggaagagatcaaggggttaaagcaaatgttcatgaacatggacacagacaatagtggcacaatcacatatgaagaactcaaagtaggattagccaaacttggatcaaagctgtcagaagctgaagtaaaacagttgatggaggctgctgatgttgatgggaatggatccattgactatgttgagttcatcactgccacaatgcatagacacaagctcgaaagagacgagcatttgtttaaggcattccagtacttcgataaagacaacagtggcttcatcacaagagatgaactggaatctgctttgatcgagcatgagatgggcgacacgagtacaataaaggagatcatatcagaagttgacacggacaatgatgggaggattaactatgaggagttttgcgcaatgatgagaggagggatgcagcagccaatgaggctcaagtagcctgttcccttagtagaaatggtgtaccattagttactgttcttcactcttttttcttcatgtttggtacttggtagccggataaagcttacaatgggcgttgcttttgcattgttgacagatgattgtgtatatctttttcttttttgctcgtgtttgttgcattgtagtatcttgaacgtcccttccttttgtaagtttgtttatgtaagtacatctaataaaaactgcatttttgcctctcgttgcattgtagtatcttgaacgtcccttccttttgtaagtttgtttatgtaagtacatctaataaaaactgcatttttgcc

SEQ ID NO: 13798 - DNA, 796 bp, Sorghum bicolor
  Clone ID: SORBI-28MAY03-CLUS44229_1
gcacgccgcgccccccgcctgcgcctccccggccgcggcccccccgtcgccgctcccctggccgaccgcggccaccgggttgccctgccgtggctgaacgccaggccgaccacggagaccggttctccggttcccgccgcgggcgcgctcccggcgaccctgaaccagaccgtgagggtggccgtgacgcggcccaggacctcgaggacccgccaggagaaggacgcggaggaggaggtgctggtcgtcgaggggatcgaggtcgccgaccacttcagcaggttcgtcaagttcgacgtgttcgtgaacgagtgccagggcgggggcggcatgggggcggcggtggcgcagtgcgcggggagcgtggcgatgacgccgcacctggttcggcccgggaagggtaggggctccgtgaagaccgcggcgaggttcggcatctgcgacctgctcgacaacatcggcgctgacggggacaagacgatcgtcgtgtcgctcgtgccgaggtgcgccggagacatggttactgtcggtggcgtccggatcgagtatgttaagtgaggtccttctattacgtcctaccctcctacgagtacatctcacaagtgctagggcctagagacaactgctctacgaccaggagtatatatcaggtatacatgaataactgtgtgatgctgtacgtgtatggacgactcctgttgaactatatatgtagggaactatttgggattgtgtttgcgtacgtgccgccgtgattatataatatgggccaatcgtcaatgcgacatcaataatt

SEQ ID NO: 13799 - DNA, 1721 bp, Sorghum bicolor
  Clone ID: SORBI-28MAY03-CLUS44253_1
gcccgccgcttcgcccccgacacgccggagacgccccgcgccccccccccgctcgctcaggttcagaacaactcgcctgccggggcttctaactgtttcttccttcttgtttgaagggaacagacgccgagatgtacctggtgaaggacattagcggcgccatcgggctgatggcggtggcgttggtgctcctgggcacctggccggttgtcctggcggtgctagagcggcggggccggctgccgcagcacacgttccttgacttctccggcaccaacttcctggccgccgtgctcgtcgcgctcaccttcggccagatcggccccgacacgccggagacgcccaacttcctcacccagctcgctcaggttcagaacaactggccttcggtgttgttcgcgatggcgggcggcgtcaccctcagcctggggacacttgccacgcagtacggctgggcgttcgtcggcctttccgtcactgaagtcatggcctcaagcctcaaggtcgttatagggacgacgctcaactatttcctcgacggccggatcaacaaggcagagatcctcttccccggtgtcggctgcttcctgattgcggccatccttgggtcacttgtcctcgctcccaatgccgccgacaaccaggaaaagctggcaaactccttggcgaagtacagcaaaaatacaagggaagaacactgcagacgatgaggatctcaccaaacacctccttaacaaagagataccaaaggatccagaagctgcaaagccggatgcagcagatcaggctactgaggccccggagaaagtagaggcaggaacggcagagttcctggttaacctggaggagaagagatcgattaaagtgctgggttcgcacacgctgctgggcctcgggatcgtggtgttcgcgggcgtcttctacgcgctgttcgcgccggcgctgaacctgtcgaccaacgaccagtggcacgcgctccccgccggcgtgccgcacctggtggtgtacacggcctacttctacttctccctcgcctgcctcgccgtcagcgcggcgctcaacgtgtggctcctgtaccggcccatcatggccggcgtgccggcgagctccaccgtgtccgcgtacctccgggacggcggcgagggcagggcgcccgcgatgctggcggggatggtgtgcgggctcgggaacgccttcacgttcatggcggggcaggcggccgggtacgccgccgccgactccgtgcaggcgctgccgctcgtcagcaccttctggggcgtcgtgctgttcggcgagtaccgccggtcgtcaagacgcacgtacacgctgctggccagcatgctgctcatgttcaccgtcgccatggtcctcctcatggcttcctccaaccacaggaagccgctctgactgacctccatcatcagcaggcgctcccatcgtccacatcatcagtgagctgggcacgtggatggatatgccgtagtatgcgacgaggagaatgtagatcggcagcatgggtcaggtggtggggcccactagctgaaacagagctcaactgctaacgtccacccattcttccaagaagtgtatgtactgtactctgctgctcaactgctacaggattagatctggtccctttctatcttcttttgtgtatcactgccacatactagactttgtttagttataattatctatccaatcatgaattaattagactc

SEQ ID NO: 13800 - DNA, 863 bp, Sorghum bicolor
  Clone ID: SORBI-28MAY03-CLUS27843_1
gcacgaggacttactgaagcagtttggcaaaagataagtgacccaaaaagtattcaagatatactcaaacaagtatatgctgaccattcaacaaatgtggacaaagtattctctcgtattgtggagataacacaacacccagcagctgcagcatcatttgcctccattatgtttgctccaaggggtcagatatccttccaagaggcaatctctaggtgccaaagccaaggtgtccctctatctctcatgtatggaagagaagacccttggattagacctttttggggcattaaagtcaaacagcaagtacccgaagcaccttattatgaaattagtcctgccggtcattgtcctcatgatgaggtccctgaggttgtaaactacttgctccgagggtggttgaagaacctcgagtctgagggttcaatcgacctgccatttctagaagaacccagctatgctgagcatggtgtatccagggaactggactttgtcagagaaggatcaaggaaatcagttagtgtgcggctctatggtaccaaaatttccttatggagccaactaagctcattcttgaacacacgtgttcccaactctcgggtagtcttgagataatccatccttacaactcctatagatcttactcttagaagctttgattcaaaatattgtatttattactttattaaattggccaggtcatctgtttgtaaacagacaatgtcttcagaatttctagtgcatgtaaatagtggcactacagtgatagtttcaaaattaatcctgattcatatcctgtcgagatacgcttgaagttctgttcataactacaaggaaacatttcatctatgtatgtactcccc

SEQ ID NO: 13801 - DNA, 901 bp, Sorghum bicolor
  Clone ID: SORBI-28MAY03-CLUS2844_1
ggcagcactagtgaagctgactgcttacatgcagcgccttctattttgcatgcgatctattggcgcttgctgtcttggtcgactgctactatccgttcatgtcctgccttgccactatgccctttggcacaaacagaagctgaacgggggatcttacccattcttaaacggattaggacagttttcaacaaggttggtatcaaggattcagagtctgtggttgtgaggataactggctgccctaatggatgtgctagaccatatatggcagagcttggttttgttggtgatggcccaaaaagttaccagatctggctgggtggaacaccaaaccagagtacgctagcagaatcatttatggataaagtgaagcttgatgacattgagaaggttttagaacctctgttttcctattggaatagcacgcgccaggaaggtgaatcttttggaagcttcacaaaccgaacgggattcgacaaattgaaagatgtggtgaacaagtgggcagagtcaccatcagccgcatgaagatctcacttccatcagataaaatcccaggctcccagcacaattttggccacgggattaattaattatatgatgaaggctctccagataaaacgagaaaagaagttgtcaactccgttgacaacagaaaaggaaaggctcgcgttgcaattgctatgtttgttgggtcgagtgatcgaaatttgttgtgtgtactgtcaaggaaacctctgtgaacttgaataaattcttcgcagggttgtgcctgagaataaattggaccgaggcgtctgtgaactttgaatcagttcctcacgatgttgtgcctgagaacaaaaaaaaaaaaaaaaaaggcccctacttaattcaatctcactcacgaagttgtgccctt

SEQ ID NO: 13802 - DNA, 1200 bp, Sorghum bicolor
  Clone ID: SORBI-28MAY03-CLUS29343_1
gcacgagggccgagctcacatcacacagcacccaccttttcagccggctcactgccgcagaaccacacaggcagcaaaagagcccttcacatcaccaccgtacctccactcggtcgacgacgaccaagctccgttccaccgccatgtcgaccaccagcgccagcgagaacaagcaagcccagcaccagcaggcgaggcgcccggcggcggtggtgtcctcggccgcggacgacgcggagatgcagagggtgttcgcccgcatcgacgcggacggcgacggccggatctccccctcggagctggccgcggtgtcgcgcgccatctccccgccgtccagctcctcgcacgggcgccgcgaggtggccgccatgatggacgagctggacacggaccgcgacggcttcgtggacctgggcgagttcaaggcgttccacgcgcgcgcccgcgccggcggcggccgcggcggggacaacggcggcagcgggggggacgagctcgacgccgagctacgcgccgcgttcgacgtgtacgacgtcgacggcgacggccgcatcacggcggccgagctgggcaaggtgctgggccgcatcggtgaagggtgcagcgccgaggagtgccagcggatgatcgccagcgtcgacaccgacggcgatgggtgtgttgggtttgaggagttcaagaagatgatgtgcccccagcagccccaagccggcgccggcgccgacgccggagccgccgggccggacaaggccaagaaggagtaacggcagtgtgttcaggtcttcagggagaaggactggagtgtgtctctgcctctggcattattttcacctaggctggaggaaatactcctgcagtaaaagtgtaaaactactgtacttgggaataaaaattctccatgactgtcatgtagacgtaggagtagttatatataatgtattattacccatttcatctatagtattatactgtggcgtactagatgcatgtactgatttgatttgctgatccagacggccagaccccgtttggtttgacttctccaagccattcccggatcacatgtgtgcgactttgctgcgatttgagggttactggtacaggattagcacggaagcacgtaatcctgcttgagactggatttatcagtttttaataatatttttttttataataaattagtgaataatatttttagtc

SEQ ID NO: 13803 - DNA, 1090 bp, Sorghum bicolor
  Clone ID: SORBI-28MAY03-CLUS30361_1
gcacgaggcacaatccgagtggttgtgccgtggaagctttcgtttacccttcccaacaagcccccccgtcgtcttctctccttccctcccactctccctcgttcccttcctctctcgcggtgatccagccgccgagcacgaggcgtcccacggaccgtgcgtgcccatggcggcggggtcgatccgggtcaccatggaggtgggcgccgacggcgtcgcgctcatcaccatcgccaacccgcccgtcaacgcgctccaccccatcatcatcgccgggctcaaggacaagtacgcggaggccatgcgccgtgacgacgtcaaggccatcgtgctcactggtgctggaggcaagttctgtggaggatttgatatcaacgtcttcacaaaggttcatcagactggggatgtatcacttatgccggacgtatccgtcgagcttgtgtcaaacatgatggaagagggcaaaaaaccttctgttgcagccattcaaggtcttgcgctgggtggtggcctagagttgattatgggttgtcatgctcggatatctactcctgaagctcaacttggattgccagagctaacccttggcatcatccctggatttggaggtacccagcgtctgccgaggcttgtaggtctacccaaagcgattgaaatgatgctgcaaagtaagttcattacggcaaaggaagggaaggaacgtggtttgattgatgctctttgctctcctgatgaattgataaagacatcacgtctttgggctctggaaattgctaattgccgtaaaccttggatgagatctcttggcagaacagataggcttggatcactatctgaagctcgtgctgtattaaatgcagcaagacagcaagcaatgaagattgcaccaaacatgccacagcaccaggcctgccttgatgtaatggaagaaggcatattatatggaggtcaagctggtgttttgaaggaagccaaggttttcaaggagctggtgatagcaccaacatcaaaggctcttgtccatgttttctttgcacaacgttcgacaacaaaggtgccaggtgtaactgatgttcaactgaaaccaagg

SEQ ID NO: 13804 - DNA, 1189 bp, Sorghum bicolor
  Clone ID: SORBI-28MAY03-CLUS30787_1
acctcccaacccacgagcctcagactcaagagagccccaagccaagatctgcgcgggcaagtcaccggcgaagcaccggctcccatggccgtggacctgatgggctgctacgccccgcgccgcgccgacgaccagctcgccatccaggaggcggcggcggaaagtctccgcagcctggagctcctggtgtcgtccctgtccacccaggccggcgcgccgcacagggccgctcatcacctgcagcagcagcagccgttcggcgagatcgccgaccaggccgtctccaagttccgcaaggtcatctccatcctggaccgcaccggccacgcccgcttccgccgcgggcccgtcgagtccccgccgcgggcggccgcggcgcctccggtccccgctcccgctccggctctctccctggctccgttggctcacgtggcgcccgtcagcgcggcgcagccggcgccggcttcccagccgccgcagagcctgacgctggacttcacgaagcctaacctgaccatgtcgggcgccacgtccgtcacctccacgtcgttcttctcctccgtcacggccggcgagggcagcgtctccaagggccggagcctgatgtcctccggcaagccgccgctgtccggccacaagcggaagccctgcgccggcgcgcactccgaggccaccaccaacggcggccgctgccactgctccaagagaaggaaaaaccgcgtgaagaggaccatcagagtgccggcgatcagctcgaagatcgccgacatcccgccggacgagtactcgtggaggaagtacggccagaagcccatcaagggctccccttacccacggggctactacaagtgcagcactgtgcggggatgcccggcgaggaagcacgtggagcgcgccaccgacgacccggccatgctggtggtgacctacgagggcgagcaccgccacacgcccggagcggccgggcccagccccctggcgaccgcgtctccggtggccgccgctgtctccgccggcaacggccatgtctagtcgttccaaagctaggattagcttctctcttcttttttgagctgcttgccccccgatctgatgtccgtgtaaaaaaaggaacaaggttgtagaaagagggagtgcacaccttcgatgccgcaaaaactctcaaacttgatgaatcgcatatctccga

SEQ ID NO: 13805 - DNA, 954 bp, Sorghum bicolor
  Clone ID: SORBI-28MAY03-CLUS2820_1
gaaatattctggccgtcgaaaaccagagagagagggaaagggacaaaaggcgagagataggccggcgtcatcgtcgtctgatctgctgcggagcgcgaagaggagaaagagggagatcgccggagttgcagagatgttcctggtggactggttctacggggtgctggcgtcgcttgggctgtggcagaaggaggcgaagatcctcttcctcggcctcgacaacgccggcaagaccaccctcctccacatgctcaaggacgagcggctcgtgcagcaccagccgacgcagtacccgacgtcagaagagctgagcatcggcaggatcaagttcaaggccttcgacctcgggggccaccagatcgctcgccgcgtctggaaggattactacgcaaaggttgatgctgtagtatacctggtagatgcatatgacaaggagcgatttgcagaatcaaaaaaagagctcgatgctctcctgtctgatgattccttggccaatgttccatttctcatccttggcaacaagattgatatcccatatgctgcctctgaagaggagctacggtatcacctaggccttagcaacttcacaaccgggaagggcaaggtcaaccttggtgactccaatgtccggccacttgaggttttcatgtgcagtgttgttcgcaagatgggctacggtgatggtttcaagtgggtctcccagtacatcaagtagggcccttgccgagccacatgctcagcccagtgatttttttgccttgttatttgttctggttggttgttcgtcacaggaacgatgatcatcatggagggtatgaagaggaaaaaacagtgcttaacattgaggaacatgttgaatctttagtgtcaaaacaatttgttatgtcaatcaaactcctgaaattcttttgcttttccatagggacgtttactaagaacttgcttgcgatgcat

SEQ ID NO: 13806 - DNA, 1289 bp, Sorghum bicolor
  Clone ID: SORBI-28MAY03-CLUS34054_1
cctactggctactggaccgtgccatgcgcgcagcattgcttcgtctcctccacctccctgtcgttgctagtagatcaccatcatcaccactccgaccggctccggcggctcgcgccatggcgtcccagaagcagttcccgccgcagcagcagggatcccagcccggcaaggagcacgccatggacccgcgccctgaggccatcctccagaactacaaggcggcgaacaagctcaagaacaaggtggcgctggtgaccggcggcgactccggcatcggccgcgcggtgtgcctcctcttcgcggcggagggcgcgtcggtagccttcacgtacgtgaagggccacgaggacaaggacgcggaggagacgctccgggcgctgcgcgacatctcctcccgcacgggcgcgcgcccgcccatggcgctcgccgccgacctcgggtacgaggacagctgccggagcgtggtggaggaggtggcgtcggcgcacggcggccgcatcgacgtgctcgtcaacaacgccgccgagcagcacgagcggcggtccatcacggaggtcgccgagcccgacctcgaccgcgtgttccgcaccaacatcttctcctacttcctcacgacgaagcacgcggtggcgcgcatggcgccgcacggcggcgggtccgtcatcaacacggcgtcggtgaacgcgtacaagggacacaagacgctgctggactacacgtccaccaagggcgccatcgtgtccttcacgcgcgcgctggcgctgcagctcgccgacaagggcatccgtgtcaatggcgtcgcgccggggcctatctggacgccgctcatcccggcgtcgttcggcgaggagaaggtggagcagttcggctccgaggtgcccatgaagcgcgccggacagccggctgaggttgcgcctagctacgtcttcctcgccagcgagcaggactcgtcgtacatcaccggacagttcctccacgtcaacggaggcgtcatcgtcaatgggtagagagaagttagctagacgacgacgacgacggggatcgccggcggcggtaggaggtgtggccatggagtccttttggggtgtgcgtcgtcgtgtccaagtcggagggaaggaagtgtcgagtacgtgtacgacgtgcagacagccaagctttgagtttgagttcacagttgtgtaggggtgtgtgtccactgcccagtagtgtggctactgtgagctagcagcacgtgtacaaaagggaggaacgtgtctgaataaacatgtgtgcagtgcattcaactccaa

SEQ ID NO: 13807 - DNA, 967 bp, Sorghum bicolor
  Clone ID: SORBI-28MAY03-CLUS13094_1
ccggagcacgacgcaacaacgcacactactcatccctcaccaacgtgcagattaaggaagcaggtcatggccaggatccacctctacctcgccgcggcctgcgccgtcgccctcgcgctcgccgccccggccctcgccggcgaccccgacatgctccaggacgtctgcgtcgctgactacgcctccccggtcaagctgaatgggttcccgtgcaaggcggacatctcggcggacgacttcttcttctccgggctgaggaaccccggcaacaccagcaacgcggcgggctccctggtgacggcggccaacgtggagaagttcccgggcgtgaacacgctgggcgtctccatcgcgcgcatcgactacgcccccggcggccagaacccgccgcacacgcacccgcgcgccaccgagatcatcttcgtcctcgagggcacgctcgaggtcggcttcatcaccaccgccaacaagctcttcagcaagaccctcatcaagggggacgtcttcgtcttcccgcgcggcctcgtccacttccagcagaacagagggtacggccccgccgccgtcgtcgccgccttcaacagccagctccagggcacgcagcaaatcgccatgacgctcttcggcgccacgccgccagtgcccaccgacatcctcgccaaggcattccggatcggcaacggcgaggtcgagcacatcaaggcaaacttcgcgcccaagaagtagaagaccaggcagcgtcttctcattccaatatatatatatgtgtgtgtctgcattcgttggtttctcaataaatcccgcggtgcttgctgccgttagggatcggagtgtgcagttcgatttcttcatcttcgggtttggttcgagacattgctgaccacgcttgttgctgctaatttgtgtggaacaattgcttgtcctcctattataaatgatgagataatcagttttatttatggcttgg

SEQ ID NO: 13808 - DNA, 1804 bp, Sorghum bicolor
  Clone ID: SORBI-28MAY03-CLUS6022_1
cgccgccccacgcgcgcacctaccattcccggctcccggcacggccgcgcccgagagcgacgcccgccacccacccaccccgccgccgccgccgccgcctcgattcatctggcaatcgaggggactcccagatacagatacaccacgccacgccaaatcgaacaacacctatcataatcacatattcgtccatctcccagtcccaccctcctcctcctccctcgtcgccaacctccaacccccccgcgccgatcgcgtcggagatgctgggcgtcgcgcggaggcggctcggatccggatgcgtgctctcccagctggcgcacgccctccgccccgccgccgccgctcccgccaggacctactccgccgccgccaaggagataactgtacgggaagcattgaataccgcattagatgaagaaatgtcggcagacccttctgttttcttgatgggagaagaggttggtgagtaccaaggcgcatacaagatatctaagggtttgcttgacaagtatggccctgatagggttctcgatactccgatcactgaggctggcttcactggcattggtgttggcgccgcctaccatggtcttcgacctatagtagagttcatgacatttaacttttcgatgcaggcaattgatcacataattaattcagctgccaagtcgaactacatgtcagctggccagatatctgtacctattgtcttcaggggtccaaatggtgctgctgctggagtcggtgcccaacactcgcagtgctatgcagcttggtatgcacatgttcccggattgaaagttctagctccatattctgcagaagatgctcgaggtttgctaaaagcggcaatcagggatccagatcctgttgtgttccttgaaaatgaacttctttatggtgaatcgtttcctgtttctgctgaggtacttgattctagcttctgccttccgattggcaaggctaagatagagcgacagggtaaagatgtcactatcactgcattctccaagatggtcggatatgctcttcaggctgccgatatactggccaaggaaggtatcagtgctgaggtaatcaatcttcgctcgattagaccgctggatagagctgctattaatgcatctgtgaggaaaaccaatagattggtaaccgtagaagaaggtttccctcaacatgggattggtgctgaaatatgcatgtctgttgtagaggacagctttgagtatcttgatgcaccagttgagaggattgctggagctgatgtccccatgccgtacgctgccaaccttgagaggatggctgttccacaggtggatgacatcgtccgggcagccaagcgtgcttgctacagagctgcagtaccgatggcagcaacagcctaattcacacagaaccctgcctgttgcatttctttgtctaatgtccatactccagaaagacaaatgttccataatggtatgacgagtacccactgccgctgcaactcaactagcatgagctgattttgtagagccaccaagaggtgtccagtactccagtcccgttgtcttcgccgccgcagccggatggctgcgcattactctgcgtctgtttatggttcacgaatgattgcagcctctggagatgaagttttttacatgaggcgaggtggtgtgtcaataacatgtagtattcggaagtgggactctcaagaggtccccaaatagtggttctggttgcgccttttcttgataacgtcttttctatgctagtgctagaaactcctttgtctatctatccatggtcctgccagccagcc

SEQ ID NO: 13809 - DNA, 1358 bp, Sorghum bicolor
  Clone ID: SORBI-28MAY03-CLUS6286_1
gccggccgggccggcagtaccctgctcttccattttctgacctccctccccgaccctgcggacaccgagctacctacctcctccgcgccacctctaaaatccccccgcggcccaaccaaacccgcccacggatttgtagtagtggtaccgaggtaggccgcacgcagccatggattttctgcaggggcaaagcgtcgagaccacagtggccgtcgccgtcgccgtcgtcgccatcgccgcgggcggcgccttcctcctcctccgatccaggaagcccaagggctgtttggatcctgagaacttcaggaagttcaaacttgttgaaaagaagcaaataagtcataatgttgccaggttcaaattcgctcttccaactccgacttctgtattgggccttccaatcggtcaacatatcagttgcagaggacaagatgctactggtgaagaagtaatcaagccatatacccctactacattggattctgatcttggatatttcgagcttgtcataaagatgtatcctcaagggagaatgtcccatcatttccgcgagatgaaagttggtgattatttgtctgtgaagggacctaagggccgtttcaagtaccaagttggccaagtgagagcatttggaatgctggctggtggatcaggcattactccaatgttccaagttgccagagcaatccttgagaaccctaatgacaacaccaaggttcacttaatttatgctaatgtcacatatgaagacattcttctgaaggatgagctggacagcatggccaaaacctatcctggtcgctttaagatctactacgtgttgaatcagcctcctgagaactggaatggtggtgttgggtttgtgtcgaaggaaatgatccaatctcattgtccagcgcctgctgaggacattcagatcctgagatgtggtcctcctccgatgaacaaggccatggctgcacaccttgacgagctcaactacacaaaggagatgcagttccagttttaagcaacgctaagtttgcaaataataacaagtgaccagcatggttcttcggtcacagcagtgctgcctgactctgctcgttagctgatatcaggagttcaggattacatgattagtcgtgcgccagcaattttttgctatctctagttttgcggtcaaatgatatctacctcaacagaaatccacattggcagagacaacattgttacttttattgatctgtaatgcgcaacattggatgctataaaaaatttctccccatcaccagttagcaatgcaaccttatacttttgggttcatatataaaccccaattttaaacattttggttatgcaataacctgaattcgtgg

SEQ ID NO: 13810 - DNA, 1636 bp, Sorghum bicolor
  Clone ID: SORBI-28MAY03-CLUS6389_1
gcattccccaatcccgcgcctgccccgactcccccgccgcgaaccctaaccctagtccgcgcgcctccaatggacgaggacgccggcggcgcctcccgctccccaacccccgcctcccttcccccccccccctccgcatgctcccgcccgcgcccccggcgccaccgccacgccggcgctggccgcgcaggcgggccttgccgccccccccaccccgccgcgcccccgggcggacgcgcgcaaggcctcgcggcgtccccggcgccatggctccccgtgccccaagcgctgggccgagcccaacgcctcggcctgcgaggctactccctcgccaggggcatgggcgtcgggaagcacatcgccagcgagaccgtcaccctgggcggactccagtgggcgatctacttctaccccgaccggatgcgacgccaccgacgtccgaactacctttgcgctcacgctcctttagcatcgggcggaaggcaagcacaagggccactcccactccgacccctcgaccagatccgggccgtataccctcaagtaccgcggatccatgtggggttacaagcgattctttcggcgaacttcacttgaagcatcagattttctcaaagatgattgtctgaagataaattgcactttgggctatcagatgtcaactattgattactccagaagatacactacacatggggtgttgtaggatcaactatggattattcaaggccacattcaatagaggttccagagtctgacatatgctatcattttggaacgcttttggacactcaggaaggtgtagatgttatttttagtgtatgtggagagaactttcatgcccaatggttggtattggcgagagaagagcgatttttttgagactgattttttgatcatgaatcgggtgaagagaagagtgaaactgatacgaaggatgatgcctcactgctcctcttgggtgacccgggtccatgataatgagttgggtgcgtcaagctctgatggttctatcttcgatactctggcagctaagctgctggctgcagccgacaagtatcacttaccaaggctaagattgctatgtgagtcttacctgtgcaagggcatatcagtggcctcagttgcgagtactctagcattggctgataggcgccgagccctggagcctccggcgcttcgcctctagctttcgccggtcggcccctcgctgtggagcttaaatctgtttgcctattacttgctgctgaaaacccctcagcgccgatccggaccgaggggttcgactatctcgtagacaactgcatatctctgcagtcagagatactacggacagttgccgggtgtgaggggccatgtagctgcggtgtgaaaagccagagcgtgtgggcgcagctctctgacggcggtgacaccagcgggcgcagggtgaggccaagggtctgagactcgactccaaccccgcaaagcactgacctttgtaatcaaaagctgatgtagtgtaaatggggacagctattttaagttgaatttgagaacacgtttgcaaattgcaataacatgaatctgcttgtttcgtgtactgaatcgatgtgtagacagccctgcaaaagctcacgagtcacaataaacatgg

SEQ ID NO: 13811 - DNA, 1647 bp, Sorghum bicolor
  Clone ID: SORBI-28MAY03-CLUS35219_1
gcacgaggggtaaagcaagctgaagattctgctagtaataagaagccagagaagaaggatatggttggcatgcaggaacaggtgttcgtgtggaaaatcattgagctgcatgacaaatatgtagcttatgtgacagaatgtttccagggacatacactcttccataaggcacttaaagaagcctttgaggtcttctgtaacaaaggtgtctctggcagttcaagtgctgagttgttggctaccttctgcgacaatattctgaagaaaggttgcagtgaaaagctcagtgatgaagccattgaagatgcccttgagaaggtggtgagattgctggcatacatcagtgataaagacctatttgccgagctcgaggggaagaagcttgcaagaagattactttttgacaaaagtgctaatgacgagcatgagagaagtattctgacaaagctcaagcaacagtgtgggggacaatttacttcaaaaatggagggcatggttacagaccttactgtcgctagagatcaccagactaagtttgaagagtttgtagctggacatccagagttgaatcctgggatagacttggctgttactgttttgacaacgggattctggccaagctacaaaacttttgacataaaccttcctgctgagatggtgaaatgtgtagaggttttcaaggagttctatcaaacaagaacaaagcacaggaagctgacatggatttactcattgggtacctgcaacatcaatgctaagtttgacgctaaacccattgagctcattgttacaacatatcaggctgcagcgcgacggctgttcaatggatccgacaggcttagttattctgagattgtaacacaattaaatctgtcagatgatgatgtagtgcgcttgcttcattcgctttcttgtgcgaaatacaagatcctcaccaaggaaccggcaaatagatccatatcgcccaatgatgtttttgagttcaattcaaaatttactgacagaatgagaagaattaagattccactccctcctgttgatgagaagaaaaaggttgttgaagatgttgacaaagacaggaggtatgcaattgatgcatcaattgtgcgcattatgaagagccgcaaagttatgggtcatcaacagctggttgctgaatgtgttgagcagctgagccgcatgtttaagcctgacttcaaagccataaagaagaggattgaggatctcatcacaagggactacttggagcgcgacaaggacaatgcaaatatgtacaaataccttgcctgattggtggttagtggcaaagtccaaaacagctcgataccacgggggtggcaatcttctgcaaggtcgtggtgcgtcgacaacttttaccatgatttgcagtgcgttttggtgatttgggtgcgtatgggtcctgcaacagcacgggctgctcgcattttgtaaagtggtcgttaaataggataatcgtgttgacctacattagatatatgacgatatgaggaataggagaggcactcaagtacttgttcgtgccttctattgccaatgctttatctatatatctgtatcactgtttcagttaactgagatgagatgatgcttggagttgttttgctatatgaaatggtgggtactatg

SEQ ID NO: 13812 - DNA, 1989 bp, Sorghum bicolor
  Clone ID: SORBI-28MAY03-CLUS3696_1
gcacgaggcttttgccttgcttgttgcttcccctcccctgcggtgcggtcgtgcagagccaacagctgcacgaggacaacccgcaccgcaaagccaggcacgcggcttctggaagcttccctctcatctggttggttggtcacccacgacccaaatcgcccgcccgcggctcctccgccgccagccaggcaggtgtcgtctctgccctcggtacgaccgccggattcgggcgctggggtgggttgtttttggtctcccccaccggccacacacccacaccagcctcggccccgccgtctctccaagaccttggtcgactcctccgcccgggcatgcccccccaccgccgatcgcacacggtcgtatgattgcaatgaatcctgagatcgtactaccgtcttggaaacaattttcggcatcggtcaatcctgtgaaacactagaccgctcatcaccttgcaactggaaaggagagagcaaagtgatttgctgtctcctggtgatcgatgctcttgaggcctagtgatggctgatgctagctcaaggactgacacatcaatcgttttagacgacatcgacaagaatcagaggatggagaatggaagtggtgcggttctaccttctaattcttcagataggtccgacaggtctgacaaacctctggaccaaaagacaatgcgacggcttgcccaaaatcgtgaggcagcaagaaaaagtcggctgaggaaaaaggcatatgtgcagcagctggagagcagtaagctgaaacttgcacaactggagcaggaactccagaaagctcgccagcagggaatcttcatttccagctctggagaccaaacccatgccatgagtggaaatggagcattgacttttgacatacaatatgctagatggctagaggaccaaaataagcagataaatgagttgaggactgcagtgaatgctcatgcaagtgacagtgatctacgacttattgtagatggcataatggcacattatgatgaaatattcaaggtcaaaggtgttgctgcgaaggctgatgtatttcatatactttcaggcatgtggaagacacctgctgaaaggtgcttcctgtggcttgggggttttcgtccatctgaacttttaaagctcctagcgaatcacctcgagcccctaaccgagcagcaaatgctgggtttgaacaacctccagcaatcttcccagcaggcagaggatgcactgtcacagggcatggaagcactgcagcaatctttggcagagactttggctggatctcttggtccatcaggttcttcaggaaatgtggcaaactacatgggtcagatggccatggccatgggcaaacttgggacgctcgagaattttcttcgccaggctgacaacctgcgacaacagacattgcatcaaatgcagcgtattctaacgatccgacaggcttctcgtgctcttcttgccatccatgactacttttcacggttgcgtgctctaagttctctgtggcttgctaggccgcgagaataacaactgttttgagctccctgtgctggttgttgggaattccatggcgcactggattgcagcgattgcatcccagatcattcgtggtcctgttttttgttgtaaaattacttttggtctctgcttggtccaaaatgtacttaaatggtgtacaagtaggtcaatcctgtaagttatggtgatttaagggtgtgttagcaataataattagagaaatcagggtcagagcttttgttatttgtactggttagagatttagtcctaaatgtaactcctgggacatgggggcagaatgggaagagagtaataagagtcttctattggttacagtactagttactagtgtaggttggtattgttgcatctcagttgctcacttttgctgttaggagaatgattattctatccatttatgtactctgaatgttgtttctaacctgctagttcatactactacggtatggcg

SEQ ID NO: 13813 - DNA, 1335 bp, Sorghum bicolor
  Clone ID: SORBI-28MAY03-CLUS37369_1
gcatccctgctctgcgatgtcatctgttgagataccgccaccccttcctcagacgcatgccgcctgcgggccgctcacggagactccctgggactgtggacgtcgcaaggcactggtgtcggcacaaacactgctcagcatcaaaactaactccgatgacatgaagaactctgtcctgaaagaaacttctgctgcagtgcaagtccaaaacagttgagcatgctgagataggaggtgattcgattgacatcttaggttgtcatatttattggttcagtgatatgttattgtgttaacttgtgtatgaggtgaggctttggtgttcggcgttccgtggagcactggggaacatttgaggaagcgttaggttcaggaagccatgactggtcgtctgcctgtatagattcccattccctagtgtgtataggtactgtattttacatgaggctcagcaacaaggagaccagataacatgtgtgggacggttctttagaaccttgtgtgctgtattgttctagttcgatttattgcatagctgatatgagatgtgatttatttatatatcggtataacatcgaaatacacattatgcatgctgtctgctcacataaattctctggaactgtgtacaacgcaatggcttgatgtcggctcccgctacttctctgccactgcgtacctcgcagcgggctcatggtccctccccctactcttctccccgtgcgaagctgggagcgggctcttaccccttcaccgcattcttcactgcgttgatgtcgatgtcgatcagcttccccgtggccgacgagatgacggtgcaactgctcttatcctccacgtacggcaggaacagcttcgccttctctgccgacgagaacaaggccacacatgccttgtcgcgggcgttggcgagctgcacggcagcggtgttggtcgcgtcatgaacaggatgtttgcgtcttccccgacctcctcctcgatctcatctctgtgcttctcatgggggatcacgaacagaggcttgagccccttgtcgccggtgctgatctccttggctatctgagcccggcttgagccccttgtcgccggagctgatctccttggctatctgagcccagtgctcgaggggaagaaggcagtcgtcgtcgcctctggacttcatgttggcgacggagtcggaggcgatgccgtggatgacgacgtacttgcccttctccacgccggcgcggctgtacttgtcctccacgtacgcccgcagcttcttggagatggacacccgcagcggcggtgtcggctgctggggcacgtccttcgccggccggccgatcctcgtgc

SEQ ID NO: 13814 - DNA, 1086 bp, Sorghum bicolor
  Clone ID: SORBI-28MAY03-CLUS39799_1
gcacgagttttggatgagttcatgtaccagaacggactcctgctctgcatacttctcttgccagtccctcaccctgttatgtttctgtagttttaagctatagtacattctcacattctgcaacatattgtttgggacacattgggcagatctaaaatgctgctacccttcgatatggttttttataatgtttatagccatctgatcgaaccattgaagttagcacagttcttgtcggctagtgtggctttaaacaacatccttgtagggtttgggcgttaacagatcttctgttggttctgttcacatgcccttattcctcctattactttgtctaatattttgattttccgtcatcgaaatatactctagctttaatggtttttgcacctttcttcattccctgtcaaattctctttatatttttcattatttttttcatccactaactattgtgcttatttgaagaataaaatatcagctgattgttcttattatcttatggactcgttcgactcagcttttagatgttgctacatcccatacattgtgaaacattttgcgctaagtaggtcttttgtgatgcccatagctctacagtttgagtgagactataatagtttctttgtattcctttgctttatttcttttgtgccccatgggatgaatctaatacacactaaaatgtcagcacccatcatgtttgtccatatgtttcccttactatacaacgctatcttggtgtgccgctgctttgcactgtccggcttgacgcccgtcttgggcactcgcgcccgctcgcccccctcttgatgcccctggcttctggtctgtccaacggtctgctgtgttgatgggcgttccactcctgctggtcctctgggtgctggcgcccgacccctgctttgtcgcctgcgttctgcctatctctcccttagcccgctggtctaagtacactgcaatgctccccccgacttttcccttttcttttgttactgtcgcaggcaccaggccgcaacaaaatgagatcttatggccaaaaatttgagaagtcagtgtcatgttaagaatataacatctcaatta

SEQ ID NO: 13815 - DNA, 767 bp, Sorghum bicolor
  Clone ID: SORBI-28MAY03-CLUS4069_1
aatcacacatgccacattctcgtgtgatagtcaactgatctatgcaagctttatggatgctactgttggcatatttaatgcatcaagtttgagacttcaatgtcggattcttcctgcttcatatcttcctccaaatatcagtccgagtgttcatcctgttgtggttgcggcacacccttcggaagcaagccagtttgctctagggctgactgatggtggtgtttttgtgttggaacctttggaatctgagagaaaatggggaaatcctccaccagtagagaatgggtctgctagcaacttgtccacgccgcctcctaatggagcttcaagttctgaccaaccagaaagatgattaagaagttggaactggtagatttttcgtggcatgagtctaaccaagatgggcttcaaagggtggtgcaactaaccttggcagatcggttccaagggagtcagacaatgcgctcaataaaaacaagctcaacagcagtttatccgttgcttatatatatttctaatgactgtatcgagtgaggaggatagtcctagtatttcattttgctttgtttaccgtgctgtgaagagtttttatcagtagataagatgtagtacaactatcagtagataagatgtagtacaactatcagtttgggtgtgcttggtacctatatttattatgacttagtgaaagtatcttgtttcgtttgccaaaaggccctgttccgccgtttttgctatcttaattaaaaaatgctgttctgacttgc

SEQ ID NO: 13816 - DNA, 1010 bp, Sorghum bicolor
  Clone ID: SORBI-28MAY03-CLUS359_1
gccggccgggcccgcacaacctgccacagggcttgctgaccgccacacattcaaacacctcctcgatcgcctcctccaccggccaaaaaacctagccgccgcaaccgccactgcaaccatgggtgcctgcgcaaccaagcccaagacgcttgaggggcaggccccagctgaggccaacatctccacacccaaggttgcacccgagaccactaccgtccccactgaggttgcggctgaacaggtagttgagaaggtggtggaggaggacaaggaggaggagccggcggcaacggcggcggagcaaaagctgccagcgactgccgagcccgagcagaaggctgatgaggtgatcactccagaggcggcggtcgtcgccgagcccgagaacaaggaggaggaggaagaagctgtggagaagactgtcgtcgaggaggagaagccatcagcccctgcagaggaaaagattgccaccggtgaggtgatggccgagcccacggtggaggtgatcaagaaggacgctgaggaggaggagaaggagacggataaagagatagagaagccaacacaaagctgatcgtccatgcatgcatgtcaattggttgatggctgatgatcgttgtgcgagcaaagctaaggggccacttgaattctctagagttggcatgcatatacatgtataggtcgggagagagagtcggccaccatgtaacaaacctttgatgtctcccatttttcctccacggggttcttataaaacaatattcttgggcctagctgcttgactgcagtgctgccgcgaaaatcgactgctcgttccggtcgtgccgccggtgcagttgcagcagtagtgaatagtagttgcgggagctgtgctgcattctgcacttctcgtgcgacagaaacctatatcgtcgtcgatgtgaagaggggttgttttgttggacgtttttttgccatgcccgtgtagctacgtgttcgatgatgaaacaaaaaaaaaagtgaaatgtcag

SEQ ID NO: 13817 - DNA, 509 bp, Sorghum bicolor
  unsure (1)..(509): unsure at all n locations
  Clone ID: LIB3481-052-Q6-K1-G10
gcgttcgcggncgcgtgggcggcaacctgggggtgcgcgcgcgctgggcgtcgagatggacctctccgataagcccgtcgggctcggcgtccggtccaggaggtacgcgctcctggccgaggacggcgtcgtcaaggtgctcaacctcgaggacggcggcgccttcaccaccagcagcgccgaggagatgctcaaggtgctcggctgagatttcagcaattgagctgcttgactgccgtgccgcgtcgatcgtctgctcgttgtggtcgtgccgccggtgcagttgcagcagtagtgaataataatagttgcgggagccgtgctgcattctgcacttctcctgcgacagaaacctatcgtcgttgatgtgaagaggagttgttttgttggacgtttttttgccatgcccgtgtagctatgtgttcgatgatgaaacaaaaaaaaaagtgaaatgtcagttgagacttttnaaaannannnnnnnnnnaanaaaanaaaaaaanggggcg

SEQ ID NO: 13818 - DNA, 608 bp, Sorghum bicolor
  unsure (1)..(608): unsure at all n locations
  Clone ID: LIB5047-005-R1-XP1-E8
gtggcggccgctttcgaggccggcccgggcctgggacctccacacattcaaacacctcctcgatcgcctcctccaccggccaaaaaacctagccgccgcaaccgccactgcaaccatgggtgcctgcgcaaccaagcccaagacgcttgaggggcaggccccagctgaggccaacatctccacacccaaggttgcacccgagaccactaccgtccccactgaggttgcggctgaacaggtagttgagaaggtggtggaggaggacaaggaggagaagccatcagcccctgcagaggaaaagattgccaccggtgaggtgatggccgagcccacggtggaggtgatcaagaaggacgctgaggaggaggagaaggagacggataaagagatagagaagccaacacaaagctgatcgtccatgcatgcatgtcaattggttgatggctgatgatcgttgtgcgagcaaagctaaggggccacttgaattctctagagttggcatgcatatacatgtataggtcgggagagagagtcggccaccatgtaacaaacctttgatgtctcccatttttcctccacggggttcttataaaacaatattcttggng

SEQ ID NO: 13819 - DNA, 550 bp, Sorghum bicolor
  unsure (1)..(550): unsure at all n locations
  Clone ID: LIB3480-052-P1-K1-C7
gtggaaggaggcgctggggctcggcgaggatgtgatgttgctgtcggacggcaacctggagctgacgcgcgcgctgggcgtcgagatggacctctccgataagcccgagcagaaggctgatgaggtgatcactccagaggcggcggtcgtcgccgagcccgagaacaaggaggaggaggaagaagctgtggagaagactgtcgtcgaggaggagaagccatcagcccctgcagaggaaaagattgccaccggtgaggtgatggccgagcccacggtggaggtgatcaagaaggacgctgaggaggaggagaaggagacggataaagagatagagaagccaacacaaagctgatcgtccatgcatgcatgtcaattggttgatggctgatgatcgttgtgcgagcaaagctaaggggccacttgaattctctagagttggcatgcatatacatgtataggtcggnagagagagtcggccaccatgtaaacaaaccttgatgtcttccatttttccttcacggggttcttaataaacaatatttttgggcct

SEQ ID NO: 13820 - DNA, 2329 bp, Sorghum bicolor
  Clone ID: SORBI-28MAY03-CLUS425_1
gctcctggcctccccctccggccgccttcctgctgcggacttgcgccttgcgcgcccgccccgccgcccgccgcccctccccccccccggcctgccccgcgcgcctcgccgcctccggagcgtgcctgctgcgcgcccccggcccgcgccgtcgcccgtgtaccccctccctctgggcctccgcccctcgcgtgcgggtcaagggtgccgccggctccccggctcccgccccaggccggcctagccccgaacccgggatgcacgtgaggacgatggcaattgttgctcatgttgatcatgggaagacaactttggtggattccatgttaaggcaagccaaggttttccgagaaaatcaggttatgcaggaaggactgaggaccacgataaagaagaaacggaagagaaggatgagaacacagacgtggataagcaggatgaatcaaaggagcaagagaaaggtgtttcggcttaggaagaggaaaacaaaggaaaagaaacagatgccgatgggaagcaagaacgaggaggagcagaagaaaagggttctgctgataagaaagatgaagatgaagatgaagatgaaggtgaaggtgacaagatggaagagaataagcaggagacatggaagaacaagaaagcaaggagtgccagggaatgtagccagggaaagagtaagaaacaggatggatccaaatccagggaagcaaaaagtttgctgaacacgccaagcccatatggtaccgatcgccctcaacgtgagaggaaaacagtggagaggttggttgaggtgattgagaaagggccaaacaggaatttcgtggttgacaagggacaagggactcctcttaaggatataccaagtgtggcacacagaatatcaaggaagaaaccttctgatcttaaatttcttcacagtattctttttgggaggaaaggcaaggctgttgattttaaaggacatatactccagttctctggatttgtttggcatgagagtgatgaaaagcagagagccaaggcaaaagagaagcttgacaagtgtgtaaaagacacactgctggacctctgttggacccttggtattccaactccaaaagcaaacattagaaaggaagatattgtgtcaaagctgttggacttcattgctgaacctcactctgcagctgattctgggctctctgatgaccagggatcaaattctaaaaaacgcaagagaggaggtgaaagtgcaagtaagactgatgatagcacacctagtaggtcaaggaagaaatttgtggagcgcggggcttctagtaaaaggcagaagaaagcgctccagtatgatactgatgaggatgaggatgaatccatgaattctgacagtgaggaaaacagagatgaagattcagatgaagctgctgacaaacaggaaggtgactatcgatctggcaaagaaaaggcagggaagaagttatcagaggtaaaagaatcttcaggcaaaaagaaggcaaacacagggagtggccacaaatcaggtcctccaaagaaaattatcaaaagtccagtaaaaaaagtgtcatccaaggttcatgaggaaaaaggaagccccaatgatagtgcaaaggttttttctaggaagaaaaaacccacagcagaaaaggagatcaaagaaaaaaagtcatcaggcaaaaaaaaggtggcaaagggtaaaggagaatcagctgaagcagttcttcccagcaaggacgatctgaggaagaccattactgaaatcctcaagaaagttgacttcaacacggcaactttcagtgacattcttaagaagcttgacgatcactataaaatggatctgaccccaaagaaagaagccatcaaagttatgatccaagatgagctaaccaagctatcagaggaggatgaagaaggagagggagacggagacaagcagcaggagcagcctcaggcgaaggagatcgaggcatgaggaggattcgcagaaccccatagctgtagtaaccgctgttaattatcctgtacttaatgcgtatgcagttgcctgtacaggcatcctttgttgattattatcgccaccagctcgagaacctcaccccctgattgtgtatgttgtgagacatgatgtgtaggcagcctccacaccttttagctgactgatgataggagagttactcctaggcaaggcaacttgtgttttcttctagatttgcaaatggtgtcagaaactctgcatttgctgcggcagagcgtgtacttagttgtttcgtgataggtctgaataacacatggatggatatggtagcaggctgaaaaaaaaaaaaggccccta

SEQ ID NO: 13821 - DNA, 1638 bp, Sorghum bicolor
  Clone ID: SORBI-28MAY03-CLUS4394_1
gcgtcctcctcccggcgcggctctccctcctcccctcccccacgattctcctcttcctcccccctcccgccccgcgcggctggagcggaccggaggcgagggactcggccgcgcgcatggcgctgccgctctgaccctagctgctgcacccacttcgccagacgcgctctcccctcccctcttcctcttcctctcgtaaaatggcgatgatggtggatcctccgaatggaatcggaagcaaaggaaagcattactacactatgtggcagaccttatttgagatagacaccaaatatgtgccgatcaagcccattgggcgaggagcttatgggatagtttgttcatccatcaatcgtgagacaaatgagaaagtagcaataaagaagatacacaatgttttcgacaaccgtgtggatgcactacggaccttgcgggagctgaaactcctacgccatctccgccatgagaatgtcattgctttgaaggacataatgatgccaatacacaggaggagctttaaggatgtatacttggtctacgagcttatggatactgatttgcaccagataatcaaatcgcctcagggcctttctaatgaccattgccagtattttctttttcagttgctccgcgcgcggaaatatctccattcagcagaaatactccacagagacctaaaacctggaaatctgctggtgaatgcaaactgtgatctgaagatatgtgattttggtcttgcacgtacaaacagtagtaaaggccagtttatgactgaatatgtcgtcacccgctggtacagagctcctgagctgctcctctgctgtgacaactatggcacatccatagacgtttggtctgttgggtgcatctttgctgagctccttggccgcaagccaatatttccaggaactgaatgcctaaatcagctcaagctcatagtgaacgttctcggcaccatgagtgaggctgacctagagttcatcgacaacccaaaagctcggagatacattaagtccctcccctacactcctggtgttgctctcgcaagtatgtacccacatgcgcaccctcttgccattgatctattgcagaagatgctcatcttcgaccccaccaaaaggattagtgtcaccgaggctcttgagcacccttacatgtctcctctgtatgacccaagtgcaaatcccccagcccaagtgcccatcgatctcgatatagatgaaaatatcagctcagagatgattcgggaaatgatgtggcaggagatgctccactaccaccctgaagttgtcaccgcaataagcatgtcatgagataccactgccccaggacatcggcaggctctcaactttgctttttctctttgataaaagtctactgcgattagccgattatggcgcctagctgttgtagtacccttaatgtctgcttggaaccaattgcggcccctagctgttgtagtacccttaatgtctgcttggatacttccgcttgtgtaaatatgcgcccaataagagcggcgtatggatagatgtcatcactatggaccattacttgttgtatgtactatatatctgtcgactgttgtgatgttgtatgagttcataaatcatgaagctctgttgtagtaaaatcccc

SEQ ID NO: 13822 - DNA, 775 bp, Sorghum bicolor
  Clone ID: SORBI-28MAY03-CLUS7645_1
accggtgttggccgcaggagccataagcacagaaattaagctccttgaactccaagcagcagctagcagtagcatcatcacatctcgactactagctagtttcagtcaccggccgctcacagctagctagctagctagctgcagctgctggctgctctggctgctgcttaattaaccaccagtccggccgatctgacctgagctagctactacagggctgggcgcgcgccatgattaacctgaacctgaagcagcctctcatgctgcccgcgcaccagagcaatgtcgtcgtcggctcgcgcctggcgtcgtcgccctcagcggcggccgtcagcaggcctcggaggggcggtgctggcgtgtcctcctcctcctcccgctcccggtcctcgtcccggcggcacacgcggctgccgaggatcagctgcagcgccaccgaggaggtcagcggcgccgtggcggccgtcaccgtggagccgccgcagatgctgacggtgacggccacggtggaagcgtcgccggccatcgggcagatgtacttcgagcgcgccctcgacgacgtcggcgacctcctcggcaagacgctgctcttggagctcgtcagctccgagctcgacgcaaagtctggcctggagaagccgcgggtgacggcgttcgcgcacaagacgcttcgccgttggctcgacaccagcacgggcgccacgccacacacgcgtcatctatatgtccgtccccctccgatcctcttccacgatggatgggcgccatgcatgca

SEQ ID NO: 13823 - DNA, 1822 bp, Sorghum bicolor
  Clone ID: SORBI-28MAY03-CLUS7742_1
atccaaagatgttagtgctcgtgagatggcccttggtgcaagggagtcttcaaggcgtttgcagaatttgtcatctgatgagcgcaagaaaatattgttggacgttgcagatgccttggaagagaatgtggatttaattagaactgagaatgaaatagatgtatctgcagcacaagaggcaggatatgaaccatctttggttgcgagattgactttgaagccaggaaagatagcaagccttgcgaaatccattcgcactcttgcatatatggaagacccaatcaatcagataattaaaagaacagaggttgctgaagatctggttctcgaaaaaaacatcttgtcctctaggtgtgctattgatcgtttttgagtccaggcctgatgccttggtccagattgcgtctttagcaatccgaagtggcaacggtcttctcccgcgaggtggaaaagaagccatgaggtcaaacacaatactgcataaggttataactagtgcaattcctagcaacgtgggtgaaaaacttattggccttgttacaagtagagatgaaatcgctgatttactaaagcttgatgatgtgattgatcttgtcattccaagaggcagcaataagctggtgtcgcaaatcaagtcatcaactaagatccctgtccttggtcatgctgatggtatctgtcatgtatacatcgacaaatcagctgacatgaatatggcaaaacgaatagtgctggacgctaaaattgattacccagcagcctgcaatgctatggagacattgcttgttcataaagatcttataaatgctccaggtcttgatgacctactgctagcactcaaaacagaaggagttgctatttatggagggcctgttgcacatgaactattgtgcattccaaaagcagattcattacatcatgaatatagctctatggcctgcacaattgaattcgttgatgatgtacagtcagcaattgaccatatacatcgttacggaagtgcacatacagattgcattgttactacagatgataaagtagcagaaacttttttgcgtcaagttgatagtgctgctgtattttataatgcgagcacacgattctctgatggggctcgttttggattgggtgctgaggttggcataagcacagggcgcatacatgctcgcggacctgtgggtgttgaaggtctcttaacaacacgctggatcatgcgagggagtgggcaagtggtgaacggtgacaaggatattgcatacacccataagaaccttcctttgcaatgaggcagggcatttttgtgcttaatcaggattcgtgtcgatccagtgatgtatgatagtttcatcagataggagcagagaatggtgaatcttttcgattgaggactgtgaatccatggactgcaatgttcagtcagtgtgtagaccatcattctggtggttcattctgtatgagcttggaggccaccctccctaataaagcagtgctgggagtcagggcactgatgtaccgtgtaccgagggtgtctaggttaaacaagataaaccggttatattcttatatttattttctttttttggtgcgatcgaacccatatgtcacaggttttttgtgccgacttgtttcttatgagctatcctaaccgggttgtgattacacgacatcttgataccgggtgtgttagatgctgtagctgtggctttacgccatcttcagatcactgtattgagtattgacagcagaagccagctgcggtagacgcagctttactgctgccgaagtagtagctactaatatatctatcacatattcatactgt

SEQ ID NO: 13824 - DNA, 2037 bp, Sorghum bicolor
  Clone ID: SORBI-28MAY03-CLUS7886_1
caggcgttctagttcagctcgtgcatacgccgcctgccgcggcgcagatgagggcccctccccagtgacgcggtgcggctgcggaagagagggctccaccacgccgcagcaccccttggcacctctgcggtgcggcgtagcggggtgggtatgcatgtcgacgcggcggagtgtgaaggggtcgggagactagtaacgccgaacgcgagcacgcacgtggaggtggaggagaatacgtgaaatcaatcgctgaggaccgctgagtcgggaccagcatgccttacgctgcaacgcccttcgcttgtctatatgcaccccatgtaggagcctaagctatgtgtccttgtggttctgtgacgttgcagagtggtgtttcgtcaggttgtcttcatgcaaaggccgtgaatttgggtggtatgtcatatctttggtatctagagaaaatccttcaactcaaagtattcacctttgctcctatcctgaggaagatctgtaagcctcacgctcttcaactgttactactattgtgagtaggcttacttgtgagatagggatgtgagatttccgatttgtctgagataacgatgtgactaatttcacgtgttgcactagacgttagtgtgcttgttgaatattattgctatattgatgaacaataaatgaacctgttggtttggtcataaatggactatataggagggcctactttttagcctgcattttctttaggatatggagaaattccagcaacctaaggtattcactcatgctcctgacaccaagaagacctagctgccagcacctattgaactattagtgtggtgactaaggtcacttgtgagatagggatgtgagatttccatttgtttaatttatctgagacaactttgtgactaaggtcacttgttgaactatagtttggtgttcgtgatggaatgtaataaatatctatttctttcttgatagaatcgcattgtttcagttaccttgcgcttggacaatcagtattgctgtagattgtatagtgacatcaactaatttgcgagatgacatgccaattcaataaactactgctaatctgctaatattagttgaattcctaaatcctcatgtattaggcattagctgctgaactatatagtcccccctggaattagcggcattattgtgagttctgcctcttaatgctattttgttctagatcagatcattttaggtaaacaacaattgtgaagctagtaaacaattttctgcagccatctttttgtttcacttgatgtagttgtcattgctatgtgtcgtgtctccatgtttcatttcttactgtaaccgtgcttattggttggttccatttatcttgttttaattgtagagagggaccagagagatgtgcagaagctgttgcattgccaacacaggcctgttaggaaacaatagttacttgactcctacttatcatcttttatttgtatggcagcttagttaaattgataaacagagctctgtaataaatttgcaacaatagtgttttagatggcagcttacttacacataactagctgtgaacttaattaattgatttagtctagagtgttgttaaaacaatgcatggtgttggtgtagtgagatcatatatgcatagattattgtaactgttgtttgatttcttccagcttacatatgaaaagttcctttttgactttttcatttgtttcaacaagtgatgtttgtttctaatatcttttctacaggacatggagaaatttcagcaacctaaggtattcactcaagctactgacaccaaaaacacctagctggcagcacctgttgaactattagtttggtgactaaggtcacttgtgagatagggatgtgagatttccatttgtttaaattatctgagataactttatgactaagttcacttgttgaactatagtttggtgttcgtgatggatgtaataaatatattgatgaatgacttgtgaacctgttggtttgatcatgaatggaatatattgttggacatacatttgt

SEQ ID NO: 13825 - DNA, 2217 bp, Sorghum bicolor
  Clone ID: SORBI-28MAY03-CLUS44941_1
gcacgaggcccacccggccagcccacgagcccatccgccgcgcggcgagctgctgctgcgcctgcaggaaccgaaagctgctgccgaaacgcaacgcggcggcgcgagcagctagcggcactgcggcaggcagcagcggggaggccctcggaaacgcggcggaatacacgagggaggctactttcccggcgaatgcgttaggaggagacgaggcgcgcgcgcgcgggcggagatggggaagtacacgcgggggtgctgcggctggctcatcgtcgcgctgattgcggcgctggtggccacggcggcgatgttcgccatcatgaagcgcaagcccggggggcgacacatcaagccgctcccggtgccgggcccccccggggccatcgactccaagtacggcgacgcgctcggggtcgcgctccagttcttccaggtccagaaggcggggaagcttgagaacaaccagatcccgtggcgtggggactcggcgctgaccgacgggaaggaagcggggctggatctttccaagggaatgtatgatgctggggatcatatgaagttcaccttcccgatggcattcacggcgacggtgctctcgtggtcggtgctggagtacggggatcagatgagcgcagcaaagcaactggaccctgccctcgatgcgctgaagtggattacagatttccttatcgctgcacatccgtctgacaatgtgttgtatattcaggttggtgatcctgatctggaccacaattgctgggaaaggccggaaacaatgactgagaagagacctctcacacagattaacaagaagtctcccggatcagatgttgctgctgaggcagcagcagccatggcagctgcttcaatggtcttcaaatccagagatactacgtattctgatgtgcttcttcaacatgcccagaagctatttacttttgccgatacttatagaggcctctcaagtgagagctatcccaagctccaagatttctataattccactagttatgttgatgaacttctgtgggcagcaagttggctctatcatgccacaggcgaccagacatatctcagttatgtaactgtacagaatgggaaaacttatgctgattggggaaggccaacatggttcagttgggatgacaaaaatccaggcacacaggttcttttgtccagactaaatttctttggctccaaacagatatctaatgctgaaaacgaggggttaaaatcgtatagagatactgcagaagcgctcgtgggtggtctgattccagattcccctcaagccactgctagcagaactggaggagggttggtgtggataagcgggtggaattctctccagcatgcgaccaatgctgcattcctagctgttgtgtacagtgactacatgctctccacacggacagcggcagtgcagtgcagtggaaagtactacagccctaccgatatacgcaattttgctgcttcacaggctaattatatcttgggagacaatccaatgaagcttagctaccttgttggatatggaagcagctatccacagcaagtacatcacagaggagcgtcgatcccagcagatgcaaaaacaggctgcaaaggattccagtatctccattcatccgatccaaacccaaatgttgcagtgggtgccctggtgggtgggccattccagaatgacactttcgttgattctcgtgacaatgctgtacagacggagtccagcacctacaacagcggcaccctagtcggtctgctctctggtctcgtcaccacttcctccgtggtacagtcattcacctagagtgctcctatgttttggcggtgcctacacaacctggagcaatgcatgcacaatcgcagttttttgacgaggctgatgctgatgcacgatctgtgagagaagcttggttggccatcgttcagatggatggcatgcagcagtagttagtgctcttctgtgtgtacaatgatggtgcagctcctgcagctgactgtgtgctcctatctggtttgctggtgtacctttaagctgtaactacgagtaatgtattgagtaggacgtatttcatttgttgattctgtggtgaggtagttcagcaaagcttgtaccaatgaattgtagcgcccctcaactgaaatgtgccctgaacatgtgaattcacaattggagatgaatggcaagtattcttgcggtttttgtggctcttc

SEQ ID NO: 13826 - DNA, 1898 bp, Sorghum bicolor
  Clone ID: SORBI-28MAY03-CLUS46299_1
gcacgaggaggaagctcacctcatgccggcgacaccattgttcccactagcagggctccacaagtacatcgcgatcctcctcgttgtcctctcatgggccctggtccataggtggagcctgaggaagcagaaaggcccgagatcatggccggtcattggcgccacgttggagcagctgaggaactaccaccggatgcacgactggcttgttgggtacctgtcacggcacaagacagtgaccgtcgacatgccgttcacttcctacacctacatcgctgacccggtgaatgtcgagcatgtcctcaagactaacttcaccaattaccccaagggggacgtgtacagatcctacatggatgtgctcctcggtgacggcatattcaacgctgacggcgagctgtggaggaagcagaggaagacggcgagtttcgagttcgcctccaagaacctgagggatttcagtgccaatgttttcagagagtactccctgaagctgtcgggcatactgagtcaggcatccaaggcaggcaaagttgttgacatgcaggaactttacatgaggatgacactggactcgatctgcagggttgggttcggggtcgagatcggcaccccgtcgccggatctccccgagaacagcttcgcccaggcgttcgatgccgctaacatcatcgtcacgctgcggttcatcgacccgctgtggcgcgtcaagaggttcttccacgtcggctcagaggccctcctggcgcagagcatcaagctcgtggacgagttcacctacagcgtgatccgccggaggaaggccgagatcgtcgaggcccgggccagcggcaaacaggagaagatgaagcacgacatcctgtcacggttcatcgagctgggcgaggccggcgacgacggcggcttcggggacgacaagagcctccgagacgtggtgctcaacttcgtgatcgccgggcgggacacgacggcgacgacgctgtcgtggttcacgcacatggccatgtcccacccggacgtggccgagaagctgcggcgcgagctgtgcgcgttcgaggcggagcgcgcgcgcgaggagggcgtcgcggtgccctgctgcggccctgacgacgacaaggcgttcgccgcccgcgtggcgcagttcgcggggctcctcacctacgacagcctcggcaagctggtctacctccacgcctgcgtcaccgagacgctccgcttgtaccccgccgtccctcaggaccccaaggggatcctggaggacgacgtgctgccggacgggacgaaggtgagggccggcgggatggtgacgtacgtgccctactcgatggggcggatggagtacaactggggacccgacgcggcgagcttccggccggagcggtggatcaacgaggagggcgcgttccgcaacgcgtcgccgttcaagttcacggcgttccaggcggggccgaggatctgcctgggcaaggactcggcgtacctgcagatgaagatggcgctcgccatcctcttccgcttctacagcttccagctgctggaggggcacccggtccagtaccgcatgatgaccatcctctccatggcgcacggcctcaaggtccgcgtctccagggccgtttgatgccatatatgatgactcgcttaatgccttaatccacgccaaataatgttcatgttacatatttccatgcatgtaaggggaaatgatgggtttcattggtggtttggtcttaaaattgcgtcggatcatgcatgagaacgatcgaccaccaccagtgttttgtacttcattctcagtggaagtgtggaacgagcatggtaagtgcatggtgggtagatgccaagttatgcatacaagttcatcatataagaatacacctactaagaaattttcattc

SEQ ID NO: 13827 - DNA, 1172 bp, Sorghum bicolor
  Clone ID: SORBI-28MAY03-CLUS55380_1
gcacgaggcaaaccttctctctttattccctgtacggataaggtgccaggcctaagggcacgaggctcaatcgtcctctcgcccaaaccatggagaagagccgggtgctggtggtgggcggcaccgggttcatcggccggcggatcgtgcgggcgagcctggcggaggggcacccgacgctggtcctgatgcggccggagatcggcctggacatcgacaagctccagatgctgctctctttcaaggcgcagggcgcgcggctggtggaggcgtcgctggaggaccacgcggcgctcgtcgccgccgtggcgcaggccgacgtggtgatctcggccatgtccggcgtgcacttccgcagccacaacctctccctgcagcataggctcgtcgaggctatcaaggaggccggcaacatcaagcgttttataccatcagaattcggcatggatccatccaagatgacgcatgctcttgaaccaggaagggttacatttgaagaaaagatggacctaagacgggcaatagaagaggccaacattccccacacctatgtttctgccaattgctttgctgcttacttttgcccaaacctatgtcaaatgcgtacccttttgccacccaaagagaaagttcatgtatatggagacggcaatgtcaaagttatattttgtgatgaagacgatgttgcaacatatacaatgaagtctgttgatgatcctcgcacattgaacaagacaatatacctgagaccaccagaaaacatcttgactcaaaatgatgttatctcaacatgggaaaacctttctggaaatgttctggagaaaatccacattcctgcggatgaattcttggcttcaatgaaagatactgacttcgccaatcaagttggagtgggacactattaccacattttctatgaaggttgcttgacaaactttgaaattggtgatgatggagcagagggtactctattgtacccagaggttcagtatacccgcatggacgagtatatgaaaagatatgtataactactaaagtaaacttgtctgaactaaacagttgttgtatgtgacctttagttgcatggacgagtacatgaaaacatatctgtaactgcaaaagtaaactcattgttggcttctgtgagtgaatcaccttgttgtatgggatct

SEQ ID NO: 13828 - DNA, 1106 bp, Sorghum bicolor
  Clone ID: SORBI-28MAY03-CLUS5560_1
gcacgatccccacctatccctctcgccttcccacccttcatccacccgccgctcctcgagcccaccgtcccgcgccgcctccggctccggcgagatgtctcgcttcggtcgatccggtccgccgccgatccgcgacacgtactcactcctcgtcctcaacatcaccttccgcacgactgctgatgacctcttcccactcttcgacaagtacggcgagattgtcgacatctacatcccaagggaccgcagaactggtgactcgcgcggattcgcgttcgtgaggtacaagtacgaggacgaggcacagaaggcagttgataggctcgatgggagattggtagatgggagggagatcatggtgcagtttgccacgtacggcccaaatgctgagcggattaataaagggaggatagtggagccagttccaaggccaaggggccgttctagaggccgcagtccaagacggaggtaccgtgatgactatcgagatgactaccaggatagagattatagatggcgtagctgtagcctgagtagagatagatatgcccgtgacagttacagagatggggattctccccctgctagcccgagttgctgcttgtgtcctcaaggttgcaagaagcgtggtaaagacagtttctcttctgcacgtagtagccctagtcgtagccgcagtccaagctactgtcctgatgattacaagaggcgtggcagagacagcgcatcaccggcaagtaggagccctagtcgctcccctcctcgcaagatgtcaccttctcctgagagatctcctgccaagcacaatgatgaccggtctccacgttctcggagcccttcgacataagcacaatacacttgcagagcatcttgaacaatgaacaactcaggatgaatggacttgccctgatcctatgtatggctacacatttgctcgatggtgggctcttctcagttaaagttgtgtagtgttgtctgccagttgctgcttcaaccttggaatactactttcgtttggcacctgaactgcttatcaaaaactttatgtacaccatttccattccacttttaaccttcatattagtactatcctattatcaaaaaaa

SEQ ID NO: 13829 - DNA, 1312 bp, Sorghum bicolor
  Clone ID: SORBI-28MAY03-CLUS5535_1
gcacgaggagccgatcccgcacgggggaacgacgaaggcagccacgatctgcgcgggcgggcgggccacgggtggcggcgatgcggatgcgctccgccgcgtcgagcgcgcccgccgggagttcaaccgcctccacatccagccgcacggcacgactctactgcccgacccctgtgacttgcagcctcatgctgtgcccccgccgttaggcaaggataggggcatagatagagaaaaagacaaggacagagatcgtcgcacgcaccgggacagagatagcgggcgaggcagggatcgtgatagcgatagacacagggatagggacagggatcgggacagagacttggatcgccacagtacgcttcaccgtgaaagacgggaaccgcgagaccgtcctgatgatcgcagaggcctggaccctgaacggagatgagaacgtgacagagacggacatcgtaggcatcgttctcggtctcgtgctcggggtagcaatcgaagatctaggtcacgttcaagaagcaagcgagttagtggattcgatgcaccacccccacaagccatgggttcaccatttccagttattccaaccccaagtcagttaccaggcacttcccttcccaccattggcggcatgtttccaaacatgctcccttttggtgttgctgggcagttcaacccccttgtcatccagccacaagcaatgactcaacaggctactcgtcatgctcggcgtgtttatgtcggcggccttcctccatctgctaacgaacagacagtggcagtttactttaatcaagtcatggctgctattggtggaaacactgctggtccaggtgacgctgttctcaatgtatacataaatcatgacaagaaatttgcttttgtggagatgagatcagttgaggaagcaagcaatgcaatggccctggatggcattatgtttgaaggggcgcctgtgaaggtcagaaggccaacagattacaacccttcccttgcagctgcactgggcccaagccagccaagccccaatctgaatcttgcagcagttggcctaacagcaggatctactggagggctagaaggtccagaccggatttttgtgggtggtctaccatattacttcactgaggctcaagtgcgggagttgctggagtcctttggacctcttcgtggatttgatcttgtgaaggatagagaaaccggtaattcgaagggatatgccttctggtgtaccaggatcttaatgcaccgacattgtgggctgactaaatggcatcaagatgggagacaagactcttactgttaggcgggc

SEQ ID NO: 13830 - DNA, 1220 bp, Sorghum bicolor
  Clone ID: SORBI-28MAY03-CLUS57_1
aaaaaaaattctattcccactcccccccgtctcctctgctcctcgcgctcccctcgctgccgccacaccaacaccgcactccaccgccacagtccccgtccctcggtcgctgtcgttcgtcagcggcgccttcgcgtccccagcacggtaccctagcatcatcagcgcacagcgctcgctataaggcaccgcggccatggcgcccccaccggcatcgctctccgcgcacaacgccctctccctgctcgcgcccgctaccgctagagtctcctctgggaggtggagcagcctgtccgtatctgtctcggcccggcccgtgacccgggtggtgtctgtcgcgctcgcgcccgcggcggcggtgacggcgcagaggaggctggtcgcggcggcggcagcgacggagatggcgcccgcggcgagcggcgaggaagggagcaagccgttcgtggaggagatgcgggcggtcgccatgaagctccacactaaggaccaggcccgcgagggggagaaggagcccgaggcgccccccgtcgccaagtgggagccctctgtcgagggctacctccgattccttgtcgacagcaagctcgtcttccagacgctcgaagacatcgtcgaacgcgccgccgtcccgtggtatgcagagttccggaacactgggctggagagatcagaggcactcaaaaaggatctggaatggttcaggcaacagggccacacaattccagaaccatcgccccctggcactacatatgcttctctactggaagagctgtctgagaaggatccccaggcatttatctgccatttctataacgtgtactttgctcatactgctggaggccgaatgattggcaaaaaggtttctgagaagattctgaacaagaaagagctggagttctacaagtgggagggcaatctctcccagctgctgcagaacgtccgcaacaagcttaacgaagtcgcttcaagctggtctcgggaggagaaggaccactgcctggaggagacggagaagtcgttcgcctactcaggaggcctcctccgccatatattcacctgatctgacattgttccctgatcctgtctcaaacgctgtaaatacataatccttcgactgttaaaactttattactggtgagggggagctcctcccccaggtacgatttacctgcaatcaagttgccaagtgttatataaaaaaaaaaaaaaggccccta

SEQ ID NO: 13831 - DNA, 2947 bp, Sorghum bicolor
  Clone ID: SORBI-28MAY03-CLUS36_1
ccggagcgtaacaagtactccgcgccgcgggcggtggtggtggtggtgttggagccgcaacagcaggcctgggtgctcgcagaaatgagggatccccactccttccaccgctgtgtcgccctcacggcatccctcgcccgtggccgcaccccccccgcccttgtcgcgagatccctggccccctcccagtgcctcccctccggagatcactttcgcatctgcggaggtgtgtctcgcatgatgccttgccccaataagaccttgccggtcgcggtgaagtgcagtgcgcgtggcgccgacgaggctgctgcatatttctgcaccgacccgtagctgccggggctggtgtcctcgagtaactcattggcgaggagaggagagcgtgtagtgcgccagcccgctccccccaaggggcgccttggcgggctgctgctggagagacgcgccggccgggcgagcccaatcattcaggctgacgcgacgaacgtcgccacaaccctcgttgattgtatgctgtgctgtgttggacgggggttttactgccccctctcgtccaggtaactcgccgaagtgtcgccactgcgctggatcttgcagttcatctccgcgttcccgcttttcatcatcatcggctacctggtcgccaacctcatcaactacggcacctcgcggatccccgactggggctggcgcctgtcgctgggcctggccgccgtccccgccgccgtcatggtggcgggcgctgcgttcatcccggacacacccagcagcctcgtcctccgcgggaagcacgacgacgcgcgcgccgcgctgcagcgggtgcgcggcaagggcgtggacatcggcgccgagttcgcggacatcctcgccgcggcggagagcgaccggcggaacgaggagggcgcgttccgccggatcctgcgccgcgagtaccggccgtacctggtgatggccgtggcgttcccggtgttcctgaacctcacgggggtcgccgtcaccgccttcttctcgccgatcctgttccggaccgtcgggttcgagagcgacgccgcgctcatgggcgccgtcatcctgggcctcatgaacatcggcggcatcctcgcgtcgggcttcgccatggaccgctacggccggaagctgctcttcgtcatcggtggcgcgctcatgttcacttgccaggtggccatggcgagcatcatcggatcacagctgggcaacgggagcaagatgcccaaggggtacgcagtaaccaacaggcgagcagagcagatcgtggactgcagcagccggctccctcgactcggccccttggcggtcgatggcggtcgactctcgccggcggccagcaaccaagcattgaaggtaaccagacacaagtctcctcaacacgcaatgattttgttttctcctctgatttacagagtgtttagttccccttctattccagaaaaattttaaatttagctctattattttgcataataaaactaaacatcatgtaaaaattttaacaaaagatggttattctctattttagattttgatctttcaaagtagttggcattttgcattttgcattttgtattttatggagaactaaacaaccccttaaactaaatcacaatctaattgatgaaatttatagggaagcgctatgcaaagtgcctatgtgcttactgcaatttaaacaaatttatttgtatatgctactgtgtgctactttatttagtgccatcataaaaattctataaataatttcttttgacattttgtttctaaattgcaatgtacatggaaaatacgtgtgctagcactagcatattttattgtggcaggaagctagcacttatatatttgcattgtatttttttctacatggaataccctgcggcgaaatcctggctccgccactgctcgccgaccggatgagccccgtcaccgccccaagcactagcagacatgcctccatcggttgcatctcaagctccgccccatccccagctgatgccacccagattgagctgctgttctcgtgaagtgggagctagaagagctcgtgacgtggatctaaagtttgcgatgccagagctgcttgtggatccctgctcactctctctctatctatctatctatctcgctctcgctctctctatcctatttttgtttccctcagatttcccaattaatttggttcctcaactagggtttggatagtggttgctgatgattgcatttcccggcatggcaggttcgttcctggcaccaacgttgcggaagaaaatgatctatccatgaactgataaagctttgaatgttggtgaatggtgaccttctggaattggagcgatctgtttatgttcattgtgtgcagttcagatgcaactactgaaaagcgtcacatagatccagagtcacgagctgctaatgcttggaatgagtccttgaaccattcacaaaatatctatatttgcaggcaagtcaaagaaaaatccctattttgattgatgccgcaagaaagagggagcagctggatgagcttctcaattttgcatcttacattgtatggtctgcaaagtttcctcaatcttgcggtagttctgaacctgcatgctaccatatgggagtaggaggctaagggcaattctgacattggagcatcggttggtgagtaaaacgccactcaatttctcagggcacaggctgagtagatgaaagcctaggcaaagaaagagctggcgaagaaggttgtcggccctaaacagactggtgccatttttttttgaaacaacaactatcaatatagaatggacagttactaaaagattttcaacatgtatattgaatggatctgagttgctgtacagtatagatagattcagctaatagagttggaaatttaaacattcataatctatcttgataatggtagcttccttcaaaatctcct

SEQ ID NO: 13832 - DNA, 520 bp, Sorghum bicolor
  Clone ID: LIB3476-023-P1-K1-E12
ggaataccctgcggcgaaatcctggctccgccactgctcgccgaccggatgagccccgtcaccgccccaagcactagcagacatgcctccatcggttgcatctcaagctccgccccatccccagctgatgccacccagattgagctgctgttctcgtgaagtgggagctagaagagctcgtgacgtggatctaaagtttgcgatgccagagctgcttgttcgttcctggcaccaacgttgcggaagaaaatgatctatccatgaactgataaagctttgaatgttggtgaatggtgaccttctggaattggagcgatctgtttatgttcattgtgtgcagttcagatgcaactactgaaaagcgtcacatagatccagagtcacgagctgctaatgcttggaatgagtccttgaaccattcacaaaatatctatatttgcaggcaagtcaaagaaaaatccctattttgattgatgccgcaagaaagagggagcagctggatgagcttctcaattttgca

SEQ ID NO: 13833 - DNA, 427 bp, Sorghum bicolor
  unsure (1)..(427): unsure at all n locations
  Clone ID: LIB3480-034-P1-K1-H10
ctagaagagctcgtgacgtggatctaaagtttgcgatgccagagctcatggcaggttcgttcctggcaccaacgttgcggaagaaaatgatctatccatgaactgataaagctttgcatgtcggtgatcttctggaattggagagatctgtttatgttcattgtgtgcagttcagatgcaactactgaaaagcgtcacatagatccagagtcacgagctgctaatgcttagaatgagtccttgaaccattcacaaaatatccatatttgcaggcaagtcaaagaaaaatccctattttgattgatgccgcaagaaagagggagcagctggatgagcttctcaattntgcatcttacattgtatggtctgcaaagtttcctcaagcacaggctgagcagatgaaagcctangcgaagaaagagctggc

SEQ ID NO: 13834 - DNA, 1434 bp, Sorghum bicolor
  Clone ID: SORBI-28MAY03-CLUS5844_1
gcacgagggtcccacatcgcacgccccgccaggcctcctcgacatccactgccccccgtccgtctcaattccctcgtcgcattccgcaacacctgctcctcctcgccccccttctctcagcggcgacgcctcggggcgctcctaccctgccccctctccggtctcccccgccgtcggcgaagcagccgtcgcaaaagcccgatccggacccccgcgaggtcagaaatccttgatatacctgatggctatgattgatgaacctctgtatccaattgctgtactgattgacgagctgaagaatgaggacattcagttgcgtctaaactccattagaagactttcgacaattgcacgggctcttggagaagaaagaaccaggaaggaactgattccctttctcagtgaaaacaatgacgatgaagatgaggttcttcttgcaatggctgaggaattgggtgtcttcattccttatgttgggggcgtagaacatgctcatgttttgcttccacctttggagacattgtgtacagtggaggaaacttgtgtccgcgataaggcagttgaatctctgtgccgtattggtgcacaaatgaaggaatctgacattgtcgactggttcattccagtagtaaagaggctagcagctggcgagtggtttacagctcgtgtatcatcctgtggtctgttccacatagcctatccaagtgcgtcggaccaattgaaaacagaattgaggactatctatggtcagttatgtcaggatgacatgcctatggtcagaagagcagctgcatcaaatcttggaaaatttgcagccacagttgaacagaatcatttgaagacagaaataatgtcaatatttgatgacttaacccaagatgatcaagattcagtgcgtttgttggctgttgaaggctgtgctgctcttggtaaattgttggaaccacaagattgtgtagcacacattcttcctgtcattgtcaatttctcccaggataaatcatggcgtgttcgttatatggttgccaatcaattatatgagctctgtgaggctgttggccctgagcctacaagagctgatttggtgcctgcatatgttcgactccttcgtgataatgaggctgaagtgcggatagcagctgctggaaaagtaactaagttctgtcgcatattaaatccacagatttcaatccaacatattcttccgtgcgttaaggaattgtcatcagattcatcccagcatgttcgttcagctttagcctcagtcattatgggaatggcccctgtactgggcaaggatgctaccattgagcagcttcttgcaattttcctctctttgctgaaggatgaatttcctgatgttcgacttaacataatcagcaaacttgatcaagttaatcaagttattggaattgacctgctatcccaatcact

SEQ ID NO: 13835 - DNA, 937 bp, Sorghum bicolor
  Clone ID: SORBI-28MAY03-CLUS10423_1
cggacgcgtggggcaaacttgtcagtacacatagtcaccactaacgtcagaaacagtagtactgtcagtagaggctgtagagctctcccctggccaagaactctgaacgaaaatgtcagaggccgacgtgcgtgtgatcgggctatggccgagcccgttcgtgatccgcgtcctgatcgcgctgaagctgaagggcgtcgagtacgagctcgtggaggaggtggtgggcaagaagagcgagctgctgctgaggtcgaacccggtgcacaagaagatccccgtcctgctccaccacggcaagcccatctccgagtctctcatcatcgtccagtacatcgacgaggtctggtcctccgacacgccggccttcctcctccccgccgacccctacacccgtgccgtccatcggttctgggcacagtacgtcgatgacaagctgcctccggcgatccgcatactgaggggaacggacggcggtggcaaggacgaagcggcggagcagctgtccgccgccctgcagctcttggaggaggctttcacgaagctcagccaggggaagcactacttcggcggtgacagcgtcgggtacctggacatcgctctggtgtcgtatgtcggctgggtgaaggcggtggagaagatggccggggtcactctcctggacaaggcgaaggttccgaacctggtggcatgggctgatcggctctgcaaccacccggccgtggtggaatcgatccctgacgcggacaaattcgttgagttcagcgtcacctatgggtcgttctcaaagcctatcaatggtcccaagtgaggaaaagggtctgcttgtgtttggtgatttcactgcgtgtgtgccatgccagtgcgtgtcactgtcaataaggtgtagtttgtacgtgtcgttcctctggaaataaagctttctttaactttaaaa

SEQ ID NO: 13836 - DNA, 1140 bp, Sorghum bicolor
  Clone ID: SORBI-28MAY03-CLUS1044_1
gcgcggccacagcacaaatcacaaccagctccctgacaagaacccaaccatggcttctcccaagatgctccccctcctcctgctggccacctcgctcctcctgagctgcggcctcctggtgtccgccgactacgctcccatgaccctgaccgtggtgaacaactgcccctacccggtgtggccgggcatccaggccaactccggccacgacgtcctggagggcggcggcttcttcctcccggcgctctcccacaagtcgttcccggcgccggcgcacccctggtcgggccgcatctgggcgcgcacgggctgcaccggcgccggcgcgcagctccactgcgccacgggcgactgcggcgggcggctgcagtgcggcgggctcggcggcgcggcgcccgcgacgctggcgcaggtgaacctccaccacggcaacgaccagacctcgtacggggtgagcgtggtggacggcttcaacgtgggcctgtccgtgaccccgcacgagggccggggcaactgccccgtcctggcctgccgcaggaacctcaccgagacctgccccggcgagctgcagctgcggtccccggcggggagcgtcctcgcgtgcaagagcggctgcgaggcgttccgcaccgacgagctgtgctgccgcaacatgtacaacagcccgcgcacctgccgcgcgtccaagtactcggagttcttcaagcgcgagtgcccgcaggccttcacctacgcgcacgacagcccctcgctcacccacgagtgcgccgcgccgcgcgagctcaaggtcatcttctgccactagagctcggagcttgccagctcggtgggcgcgcgccgtcgccgtcgacaagtgtcgctaggagtcgtagtagggatttgcggtgtgcgtggtgtctagtgtgtgtgcgcttctgtgctggaatagctgtgctgtgttcttctgtaggctgtaggtaaccgggctactggccgttggatgtatgcgttgcgttctggctgcaaaactgatgtggtgctgttgctgcttactacagtttgcagtctaaaataaacttgttcgatgtgcaatgatcgttcgcgcaggggccccggtcgaatcactctctgtaaatcatgcagtagaacaaagaactccga

SEQ ID NO: 13837 - DNA, 847 bp, Sorghum bicolor
  Clone ID: SORBI-28MAY03-CLUS642_1
accgggggccaccagcaaaaccagctacatcgatccatccgtgtgccacagaccacagctactagctagccgccagcactcctcttctccgaacgacgacgaccggccggccggccacctatactagttcacccaccctacgtacgtgcacctccgatggcgaccacggtgatggccaccacgaccgcgagctccctcgccttcttcggccccggcgcgcgcgccagcgccggcagcttccccagtaccactaccacccatcttcccgcggcggccgggcgtgtcgtcgcgccgcgccgccgcgcgctgctcgtcagggccgcccagcagaccgaggacggtaagcccgcggctgctgctcctgctccgaaggcgccggggctctgggacgcgctggcgttcagcgggccggcgccggagcggatcaacgggcggctggcgatggtgggcttcgtgtcggcgctcgccgtcgaggcgacacgcggcgacggcctcctctcgcaggccgggaacggcgcggggctcgcctggttcgcgtacaccgccgtcgtcctgtccgccgcgtcgctggcgccggtgctccagggggagagcgccgagagcaggagcggcgggttcatgaccgccgacgccgagctctggaacggccgactcgccatgctagggctcgtcgcgcttcgccgtcaccgagtaccttaccggcgcgcccttcgtcaacgtgtagataagccgcccgtacagttgtagtagtacgtttgtaaaaggaactagtgtacgcgtatgtatatgtatacaactatatatacatgcatgcaattacagtagcttggaaattactactgttttt

SEQ ID NO: 13838 - DNA, 1456 bp, Sorghum bicolor
  Clone ID: SORBI-28MAY03-CLUS6454_1
tcgagccagagcccagctacacgacagtcgacaccaccaccacagcgcgcacacgcaccgagccgtgcgcacacgcacctcgcggcgggagcgatggggagcagcgggggcagcagcgagcacgccccgcggcccccgagctcgagcctgaatctggaaaatccacgaatggagcgtgccgtgacggagagggcaggggtgggcctcgattcgcgaaaccgcgtaggaagtccagtccccagacacccccagcggaggaagagcagccgccgccgccgccgccgccgcagcagcagctatgtcggggggaattgcccgcggccgcctcgccgaggagcgcaaggcctggcgcaagaaccacccgcacggtttcgtcgcgaagccggagacgctgcccgacgggacggtgaacctgatgatctggcactgtaccatccccggcaagcaagggactgattgggaaggtggatacttccctctgacccttcatttcagtgaggattaccctagcaagcctcccaagtgcaagttcccccagggtttcttccacccaaatgtctatccttctggaacagtctgcctttcgatccttaatgaggatagcggctggagaccagctattactgttaagcagattctcgtcgggatccaggacttgcttgatcagccaaatcctgctgaccctgctcaaacagatggctatcacctttttatccaggatcctacagaatataagaggcgtgttagactgcaggcgaagcagtatcctgcgttggtatgagaacttcaccctactagggatccatgctgcacattcgcatagttgttgctagtgtcttgaatggaagaccagatgtaacatggtgctttgagaagtaactatcgttcttgtggaccatgtctcaagctgaggaatctactggtagccacgacgtagaaatgcaggaggacaagcctgatcaggttgataatgttaattctgatgctaatcctggtgctgcagctgctcctgaagcagttaatgccagtgaatccacatcgcagccacaaagttgagcttgctagaaaagaaagccatagagccaagtttccagtacagcggtccatttaacaatctgcgtcttgctcaccaactcttgggattcgcttcctcgcctcctcaaacaaccagaaagggaatgtggattcagaagcttacagaagtttgctgatcatactagacggtggtcatgcctgaaacactttaaactttccaggaaatgccttactcacaaaggtcatggtatgttttgatcaattgtacctttgtttctgaggcaccacatcggttagaaagtctctgtacggcttttgcgaaaatccatgaaagatgagtaaaacgaatatcttcactcagtctctactagtctactgaacttatgatgtatcatgattcatgagaaagtgaatttcgtgc

SEQ ID NO: 13839 - DNA, 1367 bp, Sorghum bicolor
  Clone ID: SORBI-28MAY03-CLUS6502_1
gccggccgggaaaaatcaaacctaaaaaaagagggccagcaccccaaccccaccccaaaacccttgcgtcgtcgcactcacactagcaaccaaccccaggaccatactctccggcggcggccggcgcgcgcgcgagggagatggaccgccctgtcggcgcatcgtaccagcgcttcccccgcgttcggatccgcgacctcaaggacgactacgccaagttcgagctccgcgacaccgacgccagcatggccaacgccctccgccgcgtcatgatcgccgaggtcccaaccgtcgccatcgatctcgtcgagatcgaggttaactcctccgtcctcaacgacgagttcatcgcccaccgcctggggctcatcccgctcacctccgccgccgccatgcaaatgcgcttctctcgggactgcgacgcttgcgacggcgacggctcctgcgagtactgctccgtcgagtttcacctcgccgcgcgcgccaccgactccgaccagacgctcgaggtcacatccaacgacctgaggtccatggatcctaaggtctgcccagtcgaccaagcacgcgcctaccagcaggcgctcggtggcaccgacccctttggagccaatacctcaaacgaaaataggggcatacttattgtaaagctgcgtcgggggcaagaactaaggcttcgtgccattgctaggaaaggaattggcaaggaccatgccaaatggtcaccagctgctaccgtgactttcatgtatgagcctgacatacgtatcaatgaagaactaatggaaacattgacagtggaagagagaagaaggttgattgaaagcagccctacaaaagtatttaagcttgattctgctaatcaggtggtggtggacaatgctgaggcatacacctatgatgatgaggtgatcaagcacgctgaggccttgggaaagccaggcttagttgaaatcaacgcgaaggaggacagcttcatcttcactgtagaaacaactggcgccatcacggcctacgagctgatcatgaacgcaatcacggtcctgaggcagaagctggatgctgtccgcctccaggacgatgatggtgaccttggcgagctcggtgcccaccttggcgggccttaggatctttgcaacaagaattgcccttggtgtcttcctccaccgcctatgtagtaggcctatctaactgccatgctagtcgaacattctgataaccctacggtgtctaagccccagattatggatttccaagtatccagtactgaattccagtctccgcgtccaccttgctttgtatcatcgatttagttatgctcgttatcgaacctgttgtttaattataggaggtggtactgttggccg

SEQ ID NO: 13840 - DNA, 769 bp, Sorghum bicolor
  Clone ID: SORBI-28MAY03-CLUS5696_1
gccggccgggccgggccctctcttgataaatcctccgccgccacccttcctcttcccctcgcgcaccgctcctccccaccccgccgccgccgccgccaccgcaactgccaccgtcgccatggcccggatcaaggtgcacgagctccgggggaagagcaagacggacctgcaggcgcagctcaaggagctcaagtctgagctctccctcctccgcgtagccaaggtcaccggcggcgcacccaacaagctctccaagattaaggtggtgcgcacctcgatcgcgcgcgtgctcacggtgatctcgcagaagcagaagtcggcgctgcgggaggcgtacaagaagaagaagctgctccccctcgacctccgccccaagaagacccgtgccatccgccgccgcctgaccaagcaccagctttctctgaagacggagagggaaaagaagcgtgagaagtacttccccatgaggaagtatgctatcaaggcctaggtcagaactgtgagatgctgtgcttagcatatcatcggctgttcctttccctaggaagtgtcttaagttttgatttgtatggacatttgctgtggtcgaaagtacgatgtttttgctctgtaaccacaaatgcctagattggtatgactggcaattcgtatcggctctcataattggtgttaatttctcttggtcacaatcttatcgcaagatgtttaacgtcatctgtttgactgacccacatgtactcatgctgtaatgtttttgccctactgtgac

SEQ ID NO: 13841 - DNA, 1453 bp, Sorghum bicolor
  Clone ID: SORBI-28MAY03-CLUS6425_1
gccggccgggccggcattcacgcccccgtctgtctcgtggccttccgcacgaggctttcctggcggccacaactgggcgagcggcgccgcccttcaccaggtcttcgtcgggcccttcgccggcgacgagcacccaccagaaacgtggagctcagagcattggtgcctctttcctctttcatcagggattctggtgcctcgtttcacaagccggttgctaagcctggtctagctactagattatgaactctctgctgatctaatagcatttctacaagaattctttgctgtaaggtttattagttatttgcaacaatgaaggaacatctaatgctcaatattgatgacctaagcattcctgagcctaatgaggtcatgggagcagtcaagaataaatcatctggggaaaccattgcacgtctaccctccaaggctcatgccattgtagcaatgggagaaagcatggtttctgaagaggaacctcttctgcaagtggtggagtgtcgcatttgtcaggaggaagatagtataaaaaatctagagagcccatgtgcttgcactggcagtctaaagtatgctcatcgggtttgtgtgcaacgatggtgcaatgagaaaggagatgtaatatgtgagatatgtcatgagccttatgaacatgggtacactgcacctcccagagctcatcctgatgaaactaccattgatataagtggtgggtggaccattactggtaccgcatttgacttgcgtgatcctaggatacttgcagtggcacaaaaccacatcatggaagctgaatatgatgattattctgccacaaatgccagcactgctgccttctgccgttctgctgctcttgttttaatggctctcttattgttgagacacgcactgactctaactgatgaagatgacgacgacacttcagcgatgttttcactttttctactgcgtgctgctggtttcctccttcctttctacattatggcttgggcaattagtatcttgcagcgccgcagacagagacaggaggcagctgctcttgctgcaacggaggtggcattcatcctgcagtcggggcaaggaaggggagtgcacttcaccatcgcaccggactcccctgccacaccacagcatgaaccaccgcaaccataattatatctatctatgttgtggctggctgcggcagcaggccacagatcgcttatttcgataggttccccaaggatttctttatggctgccgtctagtgcagaaccagataatttctgcccaagtttcatgtcatcaatgtacttgagtgtgaagatgcgtgttctgcgagttggctagtgcattttgcatgtcggccagggagtaacggggtgtgtgtgtatatatatcgtaacagagacatctcggttgtatgatctacacaattgtcaaaaaaatcaattatgatagcccgattttc

SEQ ID NO: 13842 - DNA, 482 bp, Sorghum bicolor
  Clone ID: SORBI-28MAY03-CLUS6519_2
gccggccgggccgggctctcccatccagccaagggtttcctccgccgccgccgccgctgcttccgtcgtctccgcccgccgaagccatgccgtcccacaagacgttccggatcaagaagaagctggccaagaagatgcgccagaaccgccccatcccctactggatccgcatgcgcaccgacaacaccatcaggtacaacgccaagcgcaggcactggcgccgcaccaagctcggcttctgagcggtcggagagatgctagccaacgatgcttggggaggattagggctctgcaagctaggaagctcttgtttaagattttgcttgtgttattaaagggatcttatcagttgtgcttgtagtagcattctgagaatatcatgtttgtctgatggttaaagaacagcctttatgttatgctgaatttatttaacctgcagtgccttaattaattgatctcgagctaaaaaaaaaaaaaaaaaa

SEQ ID NO: 13843 - DNA, 593 bp, Sorghum bicolor
  Clone ID: SORBI-28MAY03-CLUS6519_1
ggccgggctcgaggaccgggccggcggcgctcgagccggccgggccggcacgctcctagggttttcgcgccgccgccgctgccgctgccgctgctgcttcttcgtctcagccgcaacgatgccgtcgcacaagaccttccggatcaagaagaagctggcgaagaagatgcgccagaaccgccccatcccctactggatccgcatgcgcaccgacaacaccattaggtacaacgccaagcgcaggcactggcgccgcaccaagctcggcttctgagcgaggagattggccggctgcttcgtcggaactctagggtctaagagctatcttccttttgttttatcattgccacagtgtttctgtaagctagcaagtgatgccatgatgcttttgttaagattttgctgatgtcaagagaattggtactactgtggtgtactcaggattacatgctgcattgctatgctaagtaaagaacccttgttaccttatcattatatatatgtttttgcagcaaaaaaaaaaaaaaaaaaaaaacctaaaaaaaaaaaaaaaaaaaaaaaaaaacccaaaaaaaaaaaaaaaaaggccccta

SEQ ID NO: 13844 - DNA, 807 bp, Sorghum bicolor
  Clone ID: SORBI-28MAY03-CLUS67337_1
acctgcccctcatggcctccgcggtggacaggctcaaagagctcgtcggcttcgtcacccaggcggaccatctccggctgacgacgctgcagcagatgcacaagatcctgacgacgcggcaggcggccaggggcctcctggcgctgggcgactacttccagcgcctccgcacgctgagctcgctgtgggcggcgcgcccgcgggaggcggcgattagctagatgcctgcggtggccgccagccaaaagctcactggtgaggtgaccgcaccaaagaacacgacgacgacgacgaagagtagtagcagttcgctgtatactttcccaagtggagaacgaagaaatcgacctcgctgggtttggatgaagaatgcaaggcttctcactcaatcagcggcggtggccgcgtttctcagcaacagcaagtcagcaagtggtgtgcgtttgtcaggcgattagagaataaacggaaatcgattgaggcctctttttatttggcgggcggaaagacgtgtacatatcctgtttcggtacccggccggggcctcctagaggcgtatgattgatgatgatgctggccttttataactactacagttgagggtatatatatacttatcatatatgtaattacctgtaactagtgttggtcaaattctcatgagtacggagcatccagggtattgtacgtatggaacgccttcgcccaccggccccaggcgagcccgaggaagctggcccagttagagctggagcttcaacgggctcgacagcagggtgcatatgcaaatgggaacatgggagactc

SEQ ID NO: 13845 - DNA, 2112 bp, Sorghum bicolor
  Clone ID: SORBI-28MAY03-CLUS72390_1
cctactggaacagaccacaccattcaccaggcagcgagcggggagagcggggcagcggcgggccgcgggcgccgtgcctgccacgcctcctcctcctcctcctccctgcatccaatccacgccacacgagcgaccgagcagggcgaggaagggaagatgtcaagcgccccaagccgccgcgccgcctcgggctcgcttggtgcagatcgggacctgccgccgtgctcggacgggacagatcccgccttgcaccaagtgaatccgagccggagcagccgaccgaccgaccgccgccgcctgcgctgcgctgctctgctctgattgcgatgccgtagcctgcttgttgcgtgttttttaatttttctgataaggatcgtgcggattgctgtgatgattctgtgtcgccatgcggattgctgtgatgattctgtgtcgccgtgggaattattgccagccatacggcgaccgaccgccgccgcctgcgctgctctggtcttgattgcgatgccatggtgtttttattttttctgataaggatcgtgtgcggattgctgtcgtcctgtgtcggcgcgcggattgctgtcgttctgtgtcgccgttcggaattatttggcgccgtgcggatctctgctctcgattaagcaatccggatctggatctgacgcgtaatttcggtagtttgatctgatggagtgatgggttgtgtgatgacgtcctgatttagcaggatccatccttatactaggctgtgccacgcggctctgattttcagtggcgattttctgttcataaatgaagtttctgtggtgacatcttttgtggtgccagggaggcttggattaacgtgtggggttgcaaaattggccggtcatgatgcccagtcctgccctggatcacggggaaaccatgccttctggattcaacttaagagagattaattgatttgactgcttttactgcctgggatgtgctttcgctgccagggatgtacaagagctctgtaaggtagaaattatggagctgcgagcatgctcacatgatacttctgaattgtgatcagctttggtgtagtgtatggcactgcaagcacccgcacatgatacttgtgaattgtgatgtgatcagctttggtgtagtgtgtagaatggtttctgtgacaaatgctaatcatgaaaagttgggtcgacctgattgattgattctcagatgcatcattgctgttagtggctgtgtgcaggcgacatcaattgtaggtttgtcttaactaaactagtatatgctcgaattgctgattaccaaattaagcctaattctgggtcaaataggctactggtagtatggggctcgctttttctgaatgcttatggatctactctgttaaagagaatctgatccacatggtataattattaggcgggaagagattggcatgaagttcaaatgcaatgtagtccagctgtaaaaggaaaagggagtaacaaggatcctatcctcctgagagggggttgtaatttttaagtttctgagctttgtaatgctctgactagtcttgtgtacctttcttcttcttttttttttggcttagtgttgctggattagttaaccttttaaatttccagcgacacataaacacggattatagtcatcgatgtttaataggtcacgacaaactactagtgtttcttgtatcatcaaggagattgaaattttggccctatgtgactaagctgttgaataatgtaatcaatgcatatgttgtttctaatggcaggcaccttctcgctcaattcaattggaaggttactattttttggctaggtagtttcggaaaggtcatggaatcatgggttcatttgataataccaactctgttctggtggctggtgtccatttcagaacatcccgttctctccaagaagttccagtgttatgctaaagaatacttgaaaagcaattatgttgtatgtattgtaccagtgataaaatgaatctgtatgatgcttgatcttttttagcacgtttgatgcttgatgtctatgcataagtatcgatttctgtatatggacaatgtacagagttattttgggatggatgttgtgacccgctttgttg

SEQ ID NO: 13846 - DNA, 1678 bp, Sorghum bicolor
  Clone ID: SORBI-28MAY03-CLUS1130_1
gccccagaacagcagaagcagcaggtggtcgcgtcgcctcgtgctctccgcctcccccgcctcgcttcctcctccgcgctcccttcgccgaggcgacagcgagggcgtataaagcgctacccccctccgcgcgcgtccgcatcgtcgccatcgccaccgcctccccaccccgctccactcctcgacgagacagaccaatggcggccgctgcgtcctccgcgctgcacgccgtcggcgccgtcgcctccgccaagcccagatccgccgccccagcggtggcgaggaggaggagcgtgcgcgtggccgcggcggcggccaagggaggagcgggctcttcgggaagaggcaggctggtggctcgcaacgccgttgcagccaaggcggatgaggcggccgcggcggcgggatccaagtcgggcggccatgagttgctgttgtttgaggcccttcgcgaagccttgatagaagagatgaatttggatccaacagtgtgtgtcatgggtgaagatgttggtcactatggaggttcatacaaggtgaccaaagggttggctgagatgtttggagatcttcgggttcttgatacccctattgctgagaactccttcactggcatgggagttggagcagcaatgaaagggctcaggcctgttgtggaaggcatgaacatgggtttccttctccttgcctacaaccagatctcaaacaactgtggcatgcttcactacacctcaggtggtcagttcaagatcccgattgtgatccgaggtcccggtggtgttggtcgtcaacttggtgctgagcactcacagcggctggagtcatacttccagtcaatccctggccttcaaatggttgcttgctccactccttacaacgccaagggcctgatgaaggcagccataaggagcgagaacccagtggtgctgtttgagcacgtcctcctatacaacctgaaggagaaaatccccgatgaggaatacatctgttgccttgaggaggcagagatggtgcgcccaggtgagcacgtgaccatcctcacgtactcccgcatgaggtaccatgtgatgcaggccgccaagacgctggtgaacaaagggtacgaccccgaggtcatcgacatcaggtcgctcaagccgttcgacctgcacaccatcgggaactcgatcaagaagacccaccgtgtgctgattgtggaggagtgcatgcggacgggtggcattggcgccagcctcaggtcggccatcatcgacaacttctgggactacctggatgcccccatcatgtgcctgtcgtcgcaggacgtgccgaccccgtacgccgcaacgctggaggacgcgactgtcgtgcagcctgcgcagatcgtggccgctgttgagcagatctgccaataatcgtgatatgacggcttttgttgagttacctgatttgtggattcatgtatccgtgttttgttcgttgtcacatagtgactgccattgtgccgtagacattctattttgcaacgcagaagccatattcatacgaatgccttttgtggcctggcccgtttgttcactgtgcagagttcgatgccctttgtttgttcttgtgtatcactattattagcattggtttgtagcagcgcctgtgttggttctatttatttatatatgataatctgttgggtattggagtg

SEQ ID NO: 13847 - DNA, 709 bp, Sorghum bicolor
  Clone ID: SORBI-28MAY03-CLUS1154_2
ctagttttatctacacatccatatgcaccactctgctggcacacatatcatcatcttgtgctcatgtgcagggagaagatgattcaactcctgctccccctagagctagtgagtcatcttcacaagctattcctattggacatgctggaaaccaaagtccgggcatgcttacctacaatgctgaacaggatgctgttttatcttccggaaatagcactcctgaatcgagtcctcggctctttaacaggagacactccactggacagtcaactacagacagggctggaccatctgatattcagtcttcgtccgactccccgtgggctcgcttaaatgctgtctctatgaagtacaaagaatctattacaaagagtactcgagggtggaaggagagactcttttcacgcaattcgtccgtggcggatcttggttctgaagtgagaagagaagttaatgctggaatcgcgtccgtgtcacggatgatggagcgtctggaaactagaggaaatagcagaacaggtgatagcccgacagcatccacttctgaagttcctcctgctacagaatcaagcaatgaaagggttacagagagcaactctgctgctgctgctgctggtactactaccactacaagtcccagtgctagcaacgcctcagccccttgtgttgcgacatccggatcaaactaggacaagttggtcagtctggc

SEQ ID NO: 13848 - DNA, 1095 bp, Sorghum bicolor
  unsure (1)..(1095): unsure at all n locations
  Clone ID: SORBI-28MAY03-CLUS1154_1
gcacgaggaagggctcagaggacgatacgacgctgatgctagtgcggatgttgagactatttccacgcaacgcatctgtgctggctactgggacgcaagtgttaagcggagttcctgctggaatcacgtccgggtcacggttgagggagcgtcgggaaactcgaggcaattgcagaacaggtgatagcccgacaggatcttcttctggagtccctcccgctacagaatcaagcaatgaaagggttacagagagcaactctgctgctgctgcggctgctgctggtactactaccactacaagtcccagtgctagcaacacctcagccccttgtgttgcgacatccggatcaatctgggacaaggtggtcagtctggcggcagtgcagaattgccgatgctgaaagtttgcctcattcactgcagagacggcgggctgcaagtaaaactttaattgtgcttcggtgtattggctcgataaaaaatgtagctgtgagtgtggtctaaggtaattccgatataaacatgtctgtgttgtgtgtgtttgtggaaaagtttcttctgagcgcagctgtttatcggctcatagaacggatgtgtcatcttcatgctgctcggttccggtataaataacggttgagccacattcattgttcccgtattactgataattatgattggaccagcaaagtttactgctgttatacagttattatactgtggcgcaatttcttgtttgactaggacaagtatggtcagtctggcggcagagcaaagtgcagatgctgtcatttttcctcatccactgcataaacggccggctgcaagtaaaactggaatggtgatttgatgtattggctcgataaaaagggtggcggtgcgtgtggcctagggaaagtccgatttcatcttctctgttttttgtctctttgtaaaaaagtttcttctgagggcagacgtctaccggtataaataacggatatgtcaacttcatagtacgcggatcagttataaatatgattggaacatcaaaaaaaaaaaaaaagggcggcgctcgcgatctagaanctagactagttctagatcgcgatctagaac

SEQ ID NO: 13849 - DNA, 1036 bp, Sorghum bicolor
  Clone ID: SORBI-28MAY03-CLUS2704_1
ccgggggagcgagcggtagaaaaattttggccgagcgagagaggccccgccccccgcggaaaaaggcgtgcgctgcgcacaccacggccgcgagagaatccaattccaattccagccccacgtcccctcctctgctcgctttgttttacattccattccatcccatcccattttgcagctccttccgtgctcgctgcgtcctcctgcttcccacccttccgtgcccggcaccggcagccggcaggggcaggaggagagggtcgccagttcgccgccgtcccggcaccggcggatgtcggatcgggagctccgtcctctgcgctccatcagaatcacaggggacggtcgatgcctgttcaggtccgtcgcttatggtgcctgcttgaggagagaaaagcatgcaccgagcgacagcgcccagaaggaactggctgacgagcttcgagccaaagtagctgacgagtttgtcaagagaagaggagacactgaatggttccttgaaggcaactttgagaattatgtgagacagatgagaaagcctcatgcttggggaggagaacctgagctgttcatgtgttcccatgttctcaggatgcccattaccgtctacatgtatacaagcagctctgatggccctaggatcatagcagaatatggccaggaatatggaatggacgatccagtccgcgttctctatgatggttatgggcactacgacgcccttcagccatctgttgtaaggacacaatcaagactgcgaggtgtgtagataaccggggactgcgttacctaagcttcttctataggacagctgcataactgtgaacagctcaagatttaacgatgctattttgctccaattcgacacaaccatagagcaaatacgaaattatacctggcttgactgtaccaacctgttctgttcttcaatgtttgatgtataaataaataaaaaaaaactcgagaacgagtcagaaaatcagttgagctgcatcaagtggtcgtgtaaagtttcttcaaaaaaaaaaaaaaaaaa

SEQ ID NO: 13850 - DNA, 1096 bp, Sorghum bicolor
  Clone ID: SORBI-28MAY03-CLUS51489_1
gcacgaggctcatccagtcgccccacacgccgattggattcggatcccaatggccaagctcgccgtcttcctcctcctcctcgccgtggccgcatccgccaccgtgccggcgcacggccgcgatcccccgactgagatcaagctcatccgaggcgcggacgccagcggcgtgggcggcgacagcatggagtgcgtgtacacggtgttcatccggacggggtcgatctggaaggccgggacggacgcgaacatcacgctgcagctggccggcgcggacggcaacggcgtggggatctcggacctgccctcctggggcgggctcatggggcagggccacgcctacttcgagcgcggcaacctggacatcttcagcggccgcgggccctgcatggcgaagccgccgtgctggatgcggctcatctccgacggcaccggcgagcaccatggctggtactgcaactacgtcgaggtcaccgtcacgggcccgcacaaggggtgcacgcagcagctcttcaccgtcgagcagtggctcgccaccgacgccgcgccctacaagctcgaggccgttcgcgacctctgcagcgccgatggcaagagcgtcgcggcggcgtgacgtggccggcggccggcagaggagagagagtacacgcgcctggatcgacctgggtggcttggttggttggtggcaagtcgtaataagttgtgggccgcgacacgacgcgctcgtgattagagtgcggcacgatgcatgtatgatgatgatgacgatgatgaactggagtcgtgcgcggcgagtcgaataatcgggagccacctcgcgtgatgtggtcatgtggagcgtgcaggtttggttgtttttgtagatgaacgtgttggatcttgatccatgtgtttgggaaatggtaatccgcgttatcatccctgcttcttgcagctgccaatgcttggatttggatactagctgaagtttcttctccaagatccatgtctttatcattgacagctccgaccttgattttcatcctagttgaagaattattaagcacatcgatggtacaaggatttggatggcaaaaatgcgaggttttgcaagtaa

SEQ ID NO: 13851 - DNA, 1687 bp, Sorghum bicolor
  Clone ID: SORBI-28MAY03-CLUS4916_1
ctgctgggcgcactccgcactcccagccatcgtcctcgctcctcgccgtcgcccccggccaccccgtcggccgtcgccccccaccctgatccgacctcgcctagggcttccggccggggacccccgcccaccctcctcgcgatgtctgacgtcacccctgccggctcggcgccgaaccgcccctcgccgccgccgccgtcgccgtcgccgtcgatgccgcgcttccagcagcagccgagcgggcgccagccgcccccgcccggcgccgaccccttcgccttccgcgtcggcgccttcctcggcctctgcttcgtgctcatttcactctcagccccatcgactgtattacatcaagttcctggaggacgtgctggggtcttccggcgaggcggtgctctgcagtcgtcattccccccacgacgccaacaacctccatcaagaaacagagcagccacgcagaggacgcgaggaggaaggcaggagagccgagagcagagggacatggcgccccaccagcgggtgctgctcccgttcccactcgtcttcctcctcctcctcctcctcgtcgtcccaccccgcgccgacgcgtggggcaaggagggccacatcatggtctgcaagatcgccgagaagtacctgtcggagaaggcggcggcggcggtgcaggcgctgctgccggagtcggcgggcggggagctgtcgacggtgtgcccgtgggcggacacggtgcgctggcactaccactgggccagcccgctccactacgtcaacacccctcaagtctgcaacttcaagtactctcgggattgccacaattctcgtggccagcaagggatgtgcgtcgtcggggctatcaacaactacactgaccagctctacagctatggccagaagacttcgtataacctgacggagagcctgatgttcctggcacattttgtcggcgacgtccaccagccactgcatgtaggctttgaagatgacgaaggcgggaacacgatcaccgtccactggtaccggaggaaagcaaacctccatcacgtgtgggatgtcagcattatagatacggcaatcaaggacttctacaataagagcatggatactatggtagagactctcaagatgaaccttacagatggatggtctgatgatattactcactgggaaaattgcgagaacaaacatgccacctgtgcaaatgactatgcaattgagagcattcattattcctgcaactatgcctacaaagatgtggagcaaggcattactctaggagatgattattttttcactagatacccgattgtggagaagagattagcacaggctggaatcagactggcgttgatacttaatcggatctttgatggggataaagcagatgatataccactacgagtacagtaacagttgtaatgaaaaagaagcatagctattacaaggattggtccattcctatacttcaataaatttagcatgaatttgtaatgatgaagcacagaatccagagaggttattcatttctctctgcgtttgtaattataaacctctttgttttatcattttaatttgtacaggtaggtgttacacacttacactagtaaactagtgctgctcctcgaagttaaagtgcagttttatgtaatcttttcctcacttgttggtgcctgaatatttggcttgtctg

SEQ ID NO: 13852 - DNA, 440 bp, Sorghum bicolor
  Clone ID: LIB3476-001-Q6-K2-H1
agagcctgatgttcctggcacattttgtcggcgacgtccaccagccactgcatgtaggctttgaagatgacgaaggcgggaacacgatcaccgtccactggtaccggaggaaagcaaacctccatcacgtgtgggatgtcagcattatagatacggcaatcaaggacttctacaataagagcatggatactatggtagagactctcaagatgaaccttacagatggatggtctgatgatattactcactgggaaaattgcgagaacaaacatgccacctgtgcaaatgagtagaatccatattcaatttagaaacttcaatttcgttcgtgtgttaaagtcatacagaattgacattatatgaccttgaccatatgacttgcagctatgcaattgagagcattcattattcctgcaactatgcctacaaagatgtggagc

SEQ ID NO: 13853 - DNA, 1717 bp, Sorghum bicolor
  Clone ID: SORBI-28MAY03-CLUS552_1
cctccccggcccacccgcccgtgggcctcggcctcgccggcgcccgcggcccccccgtcgtccgccgcccggtgccgcgccccccggccgacctggcctgggcctgcgtccgcatccccgtgcccgccgcccccccgcccgcgggcccccccccccccttcggcgccgcgcgcccccccggcccgcccccggcccgcctgcccgcgggggccgtcgcgaggcagtgcaaggcgccggtcgaggacatggcagccgcggagggggccaacccccccgacgcgcacgcgggcccgctgctcgtcgccccgtctgccggcccggaccgcgacgactggccgctgtaccgtaggattgtcgtcagcttctcttggcgccggcagatgccacggctcgcgcttacactcggcctcgaggaagaaatggctgatatcattgaggaactaattgctaagaggcagcagcttgatgctgtgaatttcgcttacgaggctgggcttcaggagaagttccctccagttcctcttttgaagtcctacctggaagactctaagaagacatcaaccgctgcttcagataattcaagcactagcagtggccaatcagggagcaatgcgaacaagaaagagcagtctgcactgcgagctgtcattaagtgtgttgaggaccataacctagaagctgagttttcactggaggatcttcggaagcaacttgaagagctggagaaagccaagactgagaagaaaaaggcagcatcaagcgctaccagtggcagcagcagcggccctgcaaccaagcgcatccgtgcaagcaatggaggcccaatgcctcctgccaaggcaggtcgtctcactaacaatgtttgtgtgtcttctttcccagctcccaccacatttacccagtctccctcccatgcctcatatgccacgacctccccttcccatacctcatatgccacgacctccccttcccacaccgcatatgccacgacctccccttcccacaccgcatacgccatgacctccccttcccacaccgcatatgccacagcctccccttcccacccaacatacgccacagcctccccgtcccacccatcatacaccacagcctccccttacccctatgacaggccggttggacatggcctctactgcaaccggagcccaccggtgatcagggagccatatgtttacccagctgaggaggtagccagtgtcaacgtcggcattcccatgccatactccaccccacccatgagctaccctgccccctatggcggttatggcaatgggatggcagcttacaccaatggaatggctcctgccttccaccaggcttactaccggtaggttcagtcaggaaacaaaacaagtcgctgatgaatgacatgacaacaactgatgatgccaacgactcagaatcgcacaatggccctattttgtagtgactgactacaacggtaggttgggtatctcatcttatatgtccttaccactactactagatgtgttgtgtttagctctcgtctcatcttagaccactacctttttttactactaaggaacctggatgtaaattatgtatggtatcagcgagactgtcgtcgcatccttatgtaattctattcagaactttggaaaactaaaaaaaaaatcagcatgtaatccttaagtaccggatgtaccatgaacttaattaaaagtgtttttagttt

SEQ ID NO: 13854 - DNA, 1985 bp, Sorghum bicolor
  Clone ID: SORBI-28MAY03-CLUS57911_1
gcaccgcgcctccaaaggcgcctctctttccgcgcggcgccctttggctaacctgactgttgagtctgcagaggaatcgcatctccagtttcttctcaattctcatgcgccgcgctcctctacccaatcttacctgaatctttctgaagacgagacctgaattgggagagacgtcttccgcttcgcacggatcgccgggatcagtactgctgaaaatatcaagggatgcagcaaaatgtggttgcatgatagagttccttccttgggagttggcaggatacccaaacataattgtactttgcttgatcttgatgacactggagtacaaatatatgcacaacaatttcctcatgagcacactcataatggggctacgagtggaagctcaaccatcatctcaggttactttctaggtggagaaggctgaaattgttggtcacttataattacaagcatcctctacatcgttattgcttatcaccaacttatcaagtttcaaaatcattgcttttattgtggatataacacaccgagaagatgtctgagaaagagaatattctaatgcatagatatgagatgggaaagttacttggaatagggagttttgccaaagtttatcatgctcgcaatgttaagacttcacaaagtgttgctatcaaggtgattgacaaagataagatcttgaaatgtggtcttatggatcaaataactcgagagatttcagtgatgaagttggtaaagcatccaaacattgtccaattgtatgaggtgatggctaccaaaacaaagatatattttgtgatagagtatgtcaagggaggagagttattcaacaaggttcaacgtggaaggtttaaagaagatgtagcccgtgcatatttccaacaattgattagtgctgttgacttttgccacagtagacaagtttatcatcgtgatctaaaacccgaaaatcttcttcttgatggaagtcacaacttaaagatctcagactttggtttgagtgcacttccggactgcaagagaaaagacgggttactccacactgtatgtgggactcctgcatatgttgctccagaaataattagtaggaaaggttatgatggtgcaaaagctgacatatgggcttgtggagtgatcctctatgtgttgttggcaggctatcttccttttcaagacaagaacttgatggacatgtataagaaaatttgcaaagcagaactgaaatggccaagttggttttcttcagatgtccgaaagcttttgcggcgtatccttcatccaaaccctaatagaagaatctctattgaagaaataatgaagcatccttggtttaaaatcggtcttgatgcaagaatgtttgattctactataaatacaaaaagagatgatgtgcctattgaaatgggtttgactttggattctttaaaaagcaatatagttgagtgcaattcagcaacagagaaagttactaatttgaatgcttttgatatcatctctctttccaatgggtttgacctctcaggtatttttgagaataactcaaacaaggaggagtctaaatttacatctaccaacacaactttgacaattgtcacgaagctcatggaagttgcaaagaatttaggactgagggttataaagaaaaatggtggattgttgaagatggaagtttcccaaccaagaataaaaggtgtgatgtccataaatgttgagatatttcgaatcacaccaaattttcatttagtggagattaagagaatcaatggtgatagccttgagtatcaaaattttatgaaccaaggtatgagaccagcactaaaagacattgtatgggcttggttaggtgaatagtctgatgagaagtagaacctttgatatcgtgacaagtgtaatgcccgtagcaattatcaaatgtaatttttattattgtactttgtgttttattctcgtgttcatgcaatgaaatttttctttttatgccc

SEQ ID NO: 13855 - DNA, 2215 bp, Sorghum bicolor
  Clone ID: SORBI-28MAY03-CLUS6328_1
gcacgagggccccgccccgcccctttctagtctagggatagggattacccacacccaggatcatcctcttcctccgcgagaaggcgccgatccaggtagacgtaggctcgccaccatgctggaggagctgctcatcttcacccggggcggcctcatcctctggtcgtcctgccgggctctcggcgccgctgccctcaagggctcccccatcgacgccctcatccgctcctgcctcctcgaggagcgctctgccgacgccagcttctcccaggacaactacgccctcaagtggaccttccacaacgaccttggccttgtcttcgtcgccgtctaccagaagatactccacctactctacgtcgacgacctcctcgccgctgtccgcagggagttctcccagatttacgaccccaaacgcacctcctacgatgactttggggacatctttcgccagctccatcgtgaggctgaggcgcgcgccgaggagatgaagaagtccaagcaggccctctcgtcccgtccacagcctgccctctcccagaagaaggttggtcccaagggccgccgtggcgattcccacggtgctgctgccaacaagggtggctctggtgccaaggatgactctgatggcgacgactctggaaacaaggaccagaacactctggtgaatggtgccttcaagggccaagagaatggtgtccgtaaggagaattctctcgcccgccctgttgttgttaagggaaaggagaatggaggtcccaaggataatggggccttcgatgtaagtaaactacagaagctacggaccaacaaaaagaatgttgccgctgacaatggaaccaagaagctgactaaacctgacacaaagaagaaagggaagcaagacagggtgtgggacgacaaaccttccaacaagaagctggattttacagacccagctgatgagagaggggacgaggtgacagacaatgtggcggtcattgagggagaaagcatgatggataaggatgaggatctgagcagcgacagtgaggacgaagaggtggaagatggacccaaaaagaaaggatggttctcatcaatgtttcagagtattgctggtaacaatgtattggagaagtctgatctgcagcctgcgctcaaagctctcaaagataggctgatggcaaagaatgtggcagaggaaattgcagagaagctttgtgaatctgttgcagctagccttgagggcaaaaagctagggtctttcaccagaatatcatctacagtccagacagctatggaggatgctcttcttcggattttgaccccaaggcgctctattgacatactgagggatgtgcacgctgccaaggagcgtgggaggccatatgtcattgttttcgttggggtgaatggagttggcaaatccaccaatcttgcaaaggttgcttattggcttcttcagcataacctcagtgtaacacttgcagcatgtgacaccttcagatctggtgctgttgagcagctgagaactcatgctaggaggcttcagatacctatatttgagaagggttatgagaaagatccagcagttgtagcgagggaggctattcaggaagcaacccggaacaaatcagatgttgttttggttgacactgctggacgtatgcaggacaatgaaccactcatgagggcactctccaagctaatcaatctcaatagcccagatctagttttatttgttggagaagcattggttggaaatgatgctgtggatcagctcactaaatttaaccagaaattagcagacctatctgctgttcctacagctagattgattgatggtatcctgctcactaagtttgacaccatcgatgacaaggttggagcagcactttccatggtctacatatctggagctccagtcatgttcgtcggctgtggtcagtcctacacggacctgaagaagctgaacgtgaaatccatcgtgaagaccctcctgaagtgaagtgagtgaagtgtgttgaactatactctgctcaagtctgttatctttgtatccccagtgaccttgtcatcttcatgttggacgttgtggttgtaactgtcggagtcgcaaacaaacccagtgccatgggtaactgtggtcatgtgtgctcgtgtcaatgtgtctcctttcgaccgtcttgctgaaataatacatcatcttcattggaatgaatgggtaaaaatg

SEQ ID NO: 13856 - DNA, 1630 bp, Sorghum bicolor
  Clone ID: SORBI-28MAY03-CLUS6586_1
gcacgagggtggtctcaatttgggtgatgagtactgcttcagtacgaaggagttatggtccatcatcttcccttctgattctgaaaggattgccatctctgaaacgcgaaagatgaatgaggttgttcatacccaagctaagataattggtgatcatgatgtgatgtacaagtacttgtcaaagaatttagtttttgttgctactttgtctccaaaagctgctggtgatattggatctgcgctacctgaagaagcttcagttgttgcatatcttattgatgcagtcactggacgcatactccatcgcgtgactcatcatggtgctcaaggccctgtacatgcagttttgagcgagaactgggttgtctatcattattttaatctgcgagctcacagatttgaaatggcggtgattgagatatatgatcaatctagggcggacaataaagatgtcatgaagctcatacttgggaagcataatctttcagcaccaattacatcttatgcgcgccctgaggtggcagtaaaatcccagtcattctttttcacccattcagtaaaagcaatggctgttacacaaacggctaaggggatcacttccaagcagcttctgattggtactataggtgaccaggttttggcacttgataagcgctatcttgatccacgccgttcagtgaacccgacacaacaagaaaaagaagagggcattataccattaacagattctttgcctataataccccagtcttttgtgacgcactcccatcaagtggaggccctgcgaggaattgtttctattcctgcaaagttggaatccactacacttgttttcacatatggcgttgatctattctacacccagcttgctccgtcaagaacctatgattccctcactgatgaattcagctacgcactgcttctaatcacaattgcagtcctggttggtgctattattgctacttggatttggtcagagaaaaaggagttgagagacaagtggaggtgaatgaggcctcaatgttctgatgcggacgaaattttgggccctagtcagatatgcgctgcttccccttttcattttagtgctagagtttgtttcacttttgaccaggcctttattcatgtaaccatttgacaacaaagcctatctgctgtgaattgacactgccgaagcttatagaaagccacttatgcagttaaaagttctggaaatgacatgaaaggattagcagagcgcagatggcgtgaatggattgcttataaattgtaccactgcaaccgaactctagcagattgtagctattgttgttgatatagggtttccgcttctcttgtaacttaatgagctcgtcttgtttcaatcattacacctttcttgacagaaactgtatttctcttcctctgtactgtcattactcattacttttagcctgtgataggctgggctacaagatgctctttgttgtggtggttctgaagggatgtagcaacctcatcattgaaccaatgatgcatattgctacttcctgatcagatcgttcttgtgtgtatgttaacgataacagtgatcaagtcaggtaccgttgaaagatttgcagtattctgttaacatggttatctttctttg

SEQ ID NO: 13857 - DNA, 1206 bp, Sorghum bicolor
  Clone ID: SORBI-28MAY03-CLUS599_1
gctttgcgcgcgttgccgtgctgatttttttaggtggttactggcctgcctgtctcgagcgggaagctccggattacgtgaggcctgagagctgggttgggtggggactcagggtgtgccgcctgaggccgaggagtaggagaggggcgggggcggcatgaggatccagtgcgacgcgtgcgaggccgcggcagccacggtggtgtgctgcgccgacgaggcggcgctgtgcgcgcgctgcgacgtcgagatccacgccgccaacaagctcgccagcaagcaccagcggctcccgctcgcgctcggcgacgccaccgccgccagcgccagcagcctcccgcgctgcgacgtctgccaggagaagccggccttcatcttctgcgtcgaggacagggcgctcttctgccgcgactgcgacgagcccatccacgtccccggcacgctctccggcaaccaccagcgctacctcgccaccggcatccgcgtcggcttcagctccgtctgcggcgccggcgccggccctgagggcctcccggcgccggcgccgcccaagggcagctccaagcccgcggccgtcgtcagcgcgccagctgccggggccacccagacaacgacgccaggacctgaccagccaccccccgctctgcttccgtcccccttgttgttgcttgacagtaggactttgaaatcaaccagtttttcatctgtcttgtatttcctggtccagaaagactcgcctcttgggttcaaggagctggagtggttcggggacatcgacctgttccacgcccattcgcccgctaaaaccactacggcggaggtccccgagttgttcgcctcgccgcagccagcgagcaacgccgggttctacaagacgaacggagtagcgcgccagagcaagaagccacggatggaggtgcctgaggacgacgaggactacttcatcgttcctgatcttggctgagatgagagatctttgcatgattctcctgtcatgtgatgtgtgtatgtatgcaaaatatgtatgtatgccatcatgagatgcactgacgcttactggacatatgtactgtaattataaggcagggccatactttcagcctgataaatgagaccggtttgatgtatgagataaattcacttggtacagatgttcttcaaaaaacgtaccattctatcagatgcttaccattttcttcagcatgg

SEQ ID NO: 13858 - DNA, 1882 bp, Sorghum bicolor
  unsure (1)..(1882): unsure at all n locations
  Clone ID: SORBI-28MAY03-CLUS6713_1
gcacgaggatcgatcccaccgagagaagaagatgccggtgaaggtgttcgggtcgcccacgtcggcggaggtcgctcgcgtcctcgcctgcctcttccagaaggacgtcgagttccagctcatccgcgtcgactccttccgcggccccaagcgcctcccgcagtacctcacactccaggtactctaacaggtcccgcaagaacgtcagcaggtggtggcatgacgtctccaaccgcgaaacctggaagtacgtcaagagcctgcagcgcccgccgtccacgtccaccgacgccagcgccatgaacgcccagggccagcagcagcacctgccgggatccaccgacggccacggcgtgaagaacgagcggcccttctagttctagcagctgccgtcccttcccgccgaatgaatgaactacctgcgccgccggcggccgccgccgtccatggacaaggttcctacagctgttcgtctcgctttcatacgtcgtacgtgtctgctgtttttcatgttcctcgggtgcaggggcctactgagtccgttccgccttttgctgattcactacagcatgtgtttttgttcgtcgtgtaataagatgtaagccccacccccttttgaatgaaattcagatttcagtgtcgtgtgaaatgtactcctgtgtactatgaattttgatcttgctgttttccatgctcgaaaaaaaaaaaaaaaaaagcacacatcgacacttgcattacattacacccttcagtttcagctgtgtgctctgaccgagtgagatggcgagcgtgaaggttttcgggtcacccacctcggcggaggtcgcccgcgtgctcatgtgcctgttagagaaggaggtggagttccagctgatccgcgtcgacgcctaccgcggcaccaagcgcatgccccagtacctcaagctccagccgcacggcgaggcgctcaccttcgaggacgagagcctcaccctctccgattccagggggatcctgcgccacatctcgcacaagtacgcgaagcagggcaacccggacctgatcggcacgggcgctctggagcgcgcgtccatcgagcagtggctgcagacggaggcacagagcttcgactcgcccagcgccgagatggtctacagcctcgccatcctgccgcccaccctgcccaggctgcagaacgacaacaacggcaccggcagcgggttcaacgccagggacgtggccgtgggcagcaacgccgacgcgtccagcggcaagcgcggtgtggccggatcagagcagccggcggcgagccagaaccagctgagcccgcagaaggaggaggagatgctgaagctgttcgggcagaggaagaaggacctggagaagctgctggacatctacgagcagcggctggaggaggccaggttcctggccggcgacaacttcaccatcgccgacctgtcgcacctgcccaacgccgaccgcctcgtctccgacccgcgctcccgccgcctgttcgagtcccgcaagaacgtcagcaggtggtggcatgacgtctccaaccgcgaaacctggaagtacgtcaagagcctgcagcgcccgccgtccacgtccaccgacgccagcgccatgaacgcccagggccagcagcagcacctgccgggatccaccgacggccacggcgtgaagaacgagcggcacttctagttctagcagctgccgtcccttcccgccgaatgaatgaactacctgcgccgccgccgtccatcgacaaggttcctacagctgttcgtgtcgctaatttcatacgtcgtacgtgtctgctgtttttcaagttccccgggtgtgtgcaggggcctatgagtccgttccgcctttgctnttcactacagcatgtgtttgt

SEQ ID NO: 13859 - DNA, 2788 bp, Sorghum bicolor
  Clone ID: SORBI-28MAY03-CLUS15_1
aagcccccaccacgccagcaaggaagatcggcgtgtcaggaaacaaagcaagcaagcaagcatcgcacgaacgatccatccattcatcgcctctctctgtctctctttcagcaacaagaaagtctcgtaggtagagatcagagcaagcacaagcagaagcagggcaatcaatcatggcgtctgcggacgtgcacatggccggcggcggcgcggagacggagaccttcgcgttccaggccgagatcaaccagctgctctccctcatcatcaacactttctactccaacaaggagatcttcctcagggagctcatctccaacgcatcagatgcgcttgacaagatccggttcgagagcctgacggacaagtcgaagctggacgcgcagccggagctcttcatccggctggtcccagacaaggcaaccaagacgctgtccatcatcgactccggcgtggggatgaccaaatccgacctcgtcaacaacctgggcaccatcgcgcggtcaggcaccaaggagttcatggaggcgctggcggcgggcgccaccgacgtgtccatgatcggccagttcggggtcggcttctactccgcctacctcgtcgccgacaaggtcgtcgtcaccaccaagcacaacgacgacgaccagtacgtctgggagtctcaggccggtggctccttcaccgtcacgctcgacaccaccggggaacggcttggtcgcggcaccaagatcacgctgtttctcaaggacgatcagctcgagtacctcgaggagcgacgcctcaaggatctcgtcaagaagcactcggagttcatcagctaccccatctacctctggaccgagaagaccaccgagaaggagatcagcgacgacgaggatgacgaggacaagaaggagggcgacgtcgaggaggttgacgacgacgacggcgacaaggacgacaaggactccaagacgacgaagaagaagaagaaggtgaaggaggtgacgcacgagtgggtgcagatcaacaagcagaagcccatctggctgcgaaagcccgaggagatcacgcgcgaggagtacgcctccttctacaagtcgctgaccaacgactgggaggaccacctcgccgtgaagcacttcgccgtggaagggcagctggagttcaaggccatcctgttcgtgccccgccgcgcgccattcgacctcttcgacacccgcaagaagctcaacaacatcaagctctacgtccgccgcgtcttcatcatggacaactgcgaggagctcatcccggagtggctgggcttcgtcaagggcgtcgtcgactccgacgacctgccgctcaacatctcccgcgagacgctgcagcagaacaagatcctcaaggtgatccgcaagaacctcgtcaagaagtgcatcgagatgttcttcgagatcgccgagaacaaggacgactacgccaagttctacgacgccttctccaagaacatcaagctgggcatccatgaggactcgcagaaccgcgccaagctcgccgacctgctccgctaccactccaccaagagcggcgacgagatgacgagcctcaaggactacgtcacgcgcatgaaggaagggcagaaggacatctactacatcaccggcgagagcaagaaagccgtcgagaactcgccgttcctggagcggctcaagaagaaaggatacgaggtgctcttcatggtggacgccatcgacgagtacgccgtcgggcagctcaaggagtacgacggcaagaagctggtgtcggccaccaaggagggtctcaagctcgacgacgacgacgaggaggccaagaagcgccgggaggagcgcaagaagcagttcgaggatctctgcaaggtgatcaaggacatccttggtgaccgcgtcgagaaggtggtggtgtcggaccgcatcgtcgactcgccgtgctgcctcgtcaccggcgagtacggctggacggccaacatggagcggatcatgaaggcgcaggcgctgcgggacagcagcatgagcgcctacatgtcctccaagaagaccatggagatcaacccggacaacggcatcatggaggagctccggaaacgcgccgaggccgaccggaacgacaagtccgtcaaggacctcgtgctgctgctcttcgagacggcgctgctcacctccgggttcagcctcgacgaccccaacacgttcgccgcgaggatccataggatgctcaagctcggcctcaacattgacgaggatgctgctgccgacgaggacgctgacatgcctgcgcttgaagagggcgccgccgaggagagcaagatggaggaggtcgactgatgaggggtctgtccgtttgaggtagatccttcatccatcctgccaaaatcgatcgatcgatgagggtgatgcctctgctttgtgtgtctctgcgtgtgggtccatcaagtgtcactgttggtacagcaggtcacagtattcagtagtagtagcttaccatgtcttgtgtcttgttcgtgtcacatttcggatccgctgtgtcatgccaatgctgtggaacataatataataataatatactcctggagttctctgctcaaaaaaaactcgagactagttctcgaaacacgacggacgagcacacaagcacagctctagcttagcttagggagaatcttggtcttgagagaaattattaactaaccaccaaattaaagccgtgcagcatggagtacggtcagcagggacagcacggccacggcaccaccggccgtgtcgaccagtacggcaaccctgtcggcgcc

SEQ ID NO: 13860 - DNA, 1681 bp, Sorghum bicolor
  Clone ID: SORBI-28MAY03-CLUS1776_1
gcacggggccaccgtcaccgccaccgacatcgcctcgtaacccgacccgaccagcccccattccccgaaccccgcgccggggagccagccgcgtgcattccccgatccccactgccccgccccgccgcgccaccggaccaggggaaggaggatatgtcgtcgtcgtctccctctccggcggcggcggccgcgcgcctggatctggacggcaaccccatcgcgcccctcaccatctgcatgattggcgccggcggcttcatcgggtcccacctctgcgagaagctcatggccgagacgcgccacgtcgtcctcgccgtcgacgtctactgcgacaagatccgccacctcgtcgaccccgcgccgccgcacctcgccggccgcatctctttccaccgcctcaacatcaagaacgactccaggctcgagggcctcatcaagatggccgatctgaccatcaacctggcggccatctgcacgccggcggactacaacacgcgccccctcgacaccatctacagcaacttcatcgacgcactcccagtggtcaaatactgctccgagaacagcaagcgtctcatccacttctccacctgcgaggtctatggcaagaccatcggcagcttcctccccaaagaccacccgctccgcaaggaacctgaattttatgttctgaaagaagatgagtcaccctgtatttttggtccaattgtgaaacaacgatggtcctatgcatgcgcaaagcaacttattgagaggcttatatttgctgaaggcgcagaaaatggccttgaattcacgattgtgagacctttcaattggattggcccaagaatggacttcattcctggtgttgatggtcctagtgagggtgtaccccgggttttggcttgcttcagtaacaatctgctccgccgagagcccttgaagcttgttgatgggggccagtctcagagaacttttgtttacattaaggatgccatcgaagctgttgtgctaatgattgaaaatcctgctcgagccaatggtcacatcttcaatgttgggaatcctgacaatgaggttactgttagggagttggcccaaatgatgacagaggtctatgcaaacgtctcaggagaggcaccactggatgagcccatgattgatgtaagttcgagtcagttctatggtgaaggatatgatgacagtgataagagaattcccgacatgactataatcaacaagcagctaggttggaacccaaagactcctctcaaggatctgctggagacaacgttgacatatcagcacaagacatacaaagaagctgtgaagaggcaaatgtcgcaggcttcatcaacgagttagatggcatgtcaccggacctcaaggtggtggtggctgggacggctctcgtttcgagccctagtcgcagctgttatgatgtttcggaagtcagaatacatatacgctagtaatcgttttgaggccctagatgtccatgttgttagattccatgctgctaccaagggatgttatccgtatgtgatatgtgtgggttgggccatcctttgtacttgtgttggttgctcctcctgctgtgtgaagtcattctttggaatcatttcattggcgagagctgttattgtccgttgagtatactgctgctgatgctactactaggaccttttttgttggttca

SEQ ID NO: 13861 - DNA, 961 bp, Sorghum bicolor
  Clone ID: SORBI-28MAY03-CLUS1055_1
gcacgaggagcaaaagaaaagaactcgctccgaaccctgcgatcagaagaatccagactccagaggcgactccaggtttgtgggagatgctgcgcgcaggaggcaggctgctcctcgccccggggctccggcggttcggcctgggcaccggcgccgccgccggcgaggcgggccctgccgccgcggcggcgggggtgagggcgtaccacgagcgggtggtggaccactacaacaacccgcggaacgtcggttccttcgacaaggaggaccccaacgtcggcactgggctggtcggcgcgccggcctgcggggacgtcatgaagctgcagatccgcgtcgacgaggactccggcaagatcgtcgacgcctgcttcaagacctttggctgcggctccgccatcgcgtcctcgtccgtcgctactgaatgggtcaagggaaaaccaatggatgaagttttgacaatcaagaacactgagattgcaaaacacttgtcccttccaccagtaaagctccattgcagcatgcttgctgaggatgcgattaaagctgctgtgaaagactacgaagccaagaaggtgaagatggggcaaaagggtgtagacagtccttcagagaaggctgctgaagcatgaaagtttctgccatgaagtatactgagctgatatgtttctcagtccatgactccctgccacttattgttgccaaagataaatgcttctgtttgtgaggcgagggattgtgtgtaatgttcacaaactctggtagtacggcttgtggcttaactcttttaaggatggtgacgaccaatttcaaataaatttgctaccatcttagaattagaagaaagtacttctatgtgcatgtacaagagctgtttctagaagtgttatctgtcaacatacgtaatggaattacggtcaccgttgcaaaaaaaaaataaaaaaaaaaaaaagggcgggcc

SEQ ID NO: 13862 - DNA, 1059 bp, Sorghum bicolor
  unsure (1)..(1059): unsure at all n locations
  Clone ID: SORBI-28MAY03-CLUS10637_1
gccggccgggttccagaaaaaaaaaactagagaaaaaagaatcacgcttgactgcncaattggaggtcaaaccagagcagcatccctgcctataaatacactctctccactggcccgaaactgacaccaccaccaccaaggcaggagcggcggcgatccatttcacacaaccacccccgctcgccgcaggagtttccagatcttcctccggtcacaggagctccgagccctctccaatggcggtcaaggtctacgtcgtgtactactccacgtatggacatgttggcaaactagctgaagagatcaagaaaggtgcctcatctattgaaggtgttgaggctaaaatatggcaggtccctgaaactctccctgaggaagtgcttggaaagatgggcgcaccccctaagcctgatgtgccagtcatcacaccgcaagaacttgcagaagctgatggaatcctcttcgggtttccaacaaggtttggaatgatggcagcgcaaatgaaggcgttcttcgatgctactggtgggctctggagggagcagagccttgctggcaagcctgccggcatcttcttcagcactggaacccagggtggtggccaagagactacaccgttgaccgcgattacccagttgacacaccacggcatggtgtttgtgcctgtgggctacaccttcggcgccaagctgttcggcatggaccaggttcagggtggcagcccctatggtgctggcacgttcgctgccgacggctcgaggtggccgagtgaggtggagctcgagcacgcctttcaccaggggaagtacttcgcaggcatcgccaagaagctcaagggttctgcttgatctgcacatacccttctcagataccgtaaaacatttacagattcgtcatacccatcaatagatcggtctgttcttatgtggctcattggaactcctgccgtatgatatggtttttcatgctctggtgacttggttgtaatctggagttggactattgtgtttctgtcgcttaaatttcgatgattgctcatctaaacgacttgccgctggt

SEQ ID NO: 13863 - DNA, 1428 bp, Sorghum bicolor
  Clone ID: SORBI-28MAY03-CLUS10648_1
gcacgaggggcagtttcagaattaagactccccaggtctttttcccacgcccgtttcttttctcaaaaagagggggcatggccgcccccgcgtcgccgcactgttcccagtaaagacgcccactccttcccttccccctcccatcgacctctcccctccgtcgtctcccccaggagcatccgtgtcttcaccttttgttcccccacgttgatccttgatcctcgtgctccctttcttgattctttctcccgaaggatctcttgctaggagtagcctgccccgtgtgcgcgctcgcacggacatgcttcttgccgcgtcttgaaaggggagaaaaagtggagatgggtacttgcgcttcggttcacaaggacccggagtaccccaagaagcagtttcttgactcgcccaccaaggcgaagacagccaacgggaagggcggcggcggcggcgttgctccggttggtgatggctttggtgatctcaagtccaaggtcgacgctgagcagcagcgggcagagtttaaccccaagagcccggattctggtagcaaggatgaagtgttcttcgagtctcgagcttggttagattctgactgcgaggatgacttttacagcgtgaatggagatttcacaccatctcgtggcagcacacccatctaccagcccagagcacagacggtgatgagcaacatctttcaaccagacacgcacagctccaaatcaccagagccttctccaactggacggaggaagctagctgagctcctgcaggaggcaatgcaagacggccctgaagaaagcaccgacgagcagcagcagttgcaatctgttgtcgcagatgggaagccggtgtctgaatccacatccagctccgcttgcagcactgtaccgacgccgacggcagtcgacaagagcaggaaggagaaggcatggtatactggacgctgttgcctgccgagctttgttcatagcctgaccttagatgagagtgagagggggcagaagatgagctctaggcaatgtgctgtttgacagtggggctcaagtgccctcctgccctgagctgtatttaccggattgggacgctgaagagtactatatatgcatatccttagtaatcaagtggataatatagcagtactcgttaaatgctgtgcacaccatgttaatcaattgtgagggcagcgaatggtccttacctgtgcatatatcttatcgaatctttatggatatataaatatatatacttttcagatgtcaacagccagctgagctaaggcatgtggcatgtaggataatacctttttacagttcctacaatgttattgatctgagatgtcctcttggcacttgcatgattgacgcccagacaaaatgtgttgttcattgctctattctattccaaagtggacctttttgtttcctcctc

SEQ ID NO: 13864 - DNA, 872 bp, Sorghum bicolor
  Clone ID: SORBI-28MAY03-CLUS10708_1
agactagttctagatcgcgatctagaactagtgttctagatcgcgagcggcgccctttttttttttttttttttttttttttttttttttttttttttttttttttttttttttatggcactactgtaccagtaactagcacaagtttacgacaactagtgcgatagtagattcatgggtcattagtagcggctactgcagcttgttaccagtagtatacaaattatacatggctagtttacgcaagggcttgctcaaaaagagagtacatgggattactactcctccctatacattgatacaagtacaaggcgcgcgcgcgcgcgcggcgttccgtggcggccatgcatgcatgcgcgcgcgttgggaccgccggccggggtgggccgatcgagatcatcagaagctcggcacgacgccgtagccgaagtcgagcacgtacgacgacggcacggcggcctcggcctcggcgtcgtcggcgtcgccgtcgccgtcgtggtcggcgcgcttggcaaacctccccttgatccgcggccgcgtctcggcgtaggccttccgggacgcgtaccggatggtcttctcgaaccgccggttcttcctcttctcacggtaccgcatcagccgcgcctcccggctctcccccatcagcggcaccggcctcaccgccggcaagtctccccgctccggcaccacctccacgtccacggacgacacgctgtggctctggggagtcgccgtgtatggcatgtaggcctgaggctttggccttgtgaagtcgagctcaaagctcccgccgccctcgtgctcttcttctatatccttttctgtttttctttatctttggtagtaattttcattttcttttatctcta

SEQ ID NO: 13865 - DNA, 746 bp, Sorghum bicolor
  Clone ID: SORBI-28MAY03-CLUS107872_1
gcacggggccgcaaacaaaagccactgagtagagcagcagtatggcgtactactcggagtccggctactgcgcggaggaggcgaggaggccgtacgccgagccggggttctgccacggtgagggcggcggcgagcgctacgccgtcgtccgcaaggagtacgaggaggtagacgagttggcgcgcgccggcagaggacatcactacggccacggccacagcggcagcggccaccagcaccgccacgtcgtccatgccgagcacgagggatcatgccatggtggctacctcgggctcggggaagaacaccgtgagcagcaccaggtgcacgggcatggccacggtgggcgccgcctgtacgacgcctgcgagagcaagcgctacgactcgtgcaccggccagtactacgcttgagcacgcatcatcacgtattgccatcatcgtcagggctctctctgcgcccctgcctgacacactgggcgctatatatacgtaaggctgaatgcatgcatcatctcacgtagtatgtgtacgtgtgtgagtgtgtgcacgtacgactgcacggtcctactactatgtatgcattgtacacgtacgcatgtacttgtggtagcgtgtgcatgcatgccatgctgatgcaccccttattatgtagtaaagaataagaccgtgaagtaaataaaggaaagggcccgcatgtttattgttacttttaaaaaaaaaaaacgcaatccgagggggggcccg

SEQ ID NO: 13866 - DNA, 571 bp, Sorghum bicolor
  Clone ID: SORBI-28MAY03-CLUS108525_1
gcacggcacgccgggcggttcttccccttcagagaaagaaggcgcatcgtgagacacagaggcaatggcgtcggcgacgttcctggaggtgctcctcgccatcttcctcccgccggtcggcgtcttcctgcgctacggctgcggcgtggagttctggatcgacctcttgctgaccgtactggggtacattccggggatcatctacgccttgtacgtgctggtggcttaagtgagccgacggcgaggactccgcggcggggacgatggccgttgtgcttggaggacatgtatgtatgcaagagaagagtgagcagaggattctgctgtgtccaaaactagtggtgtgtgacttgtcccagcgtgcctctgtgtctcgattatgtgaattaggagtgacgatcggtggatggtgttgaatgtgtgttggtactgcgagcaaagttgtgtaattcgggggtgtaatttgtatccgagcattgtttgtttgttgtttctttctttgatcagaagatagcactgcaatttgctcgaaagtaattagagcgagtatgtcctaaccgagcattgtttg

SEQ ID NO: 13867 - DNA, 1254 bp, Sorghum bicolor
  Clone ID: SORBI-28MAY03-CLUS11096_1
gccacaaatacctacaagaaaacacagtaacacacactgccgtttccgaatggccacggccgtcctccgccgcccactcctcgccgcgctactcccggccggcgccggggagtccgggccctcccggctccgtctccggagacgcatgtcgccgcctcctgcgcgcgcggtgtcttccgactcccccaagcccgtcgcatccacttcctctcccgctggcggcgacagccccgaggaggagccgccggtcctgccgctcctccaggagctcgcggattgcttggttcttccgcccaagttcctcgctcagctcccgcgcgaccttcgtcttgacctcaatgatgccgcttttgatctctccaatgggccagttctcgatgagtgtggccaagaagtgggtgatctgctcctgaacctggcgaaagcatgggagttggctgatacatcagcatcgaatagcatcgccaagcagctgccatcgatggagccctacttgacgcacagcgccaaaccagcatttggcaagcggctggtgtcagctggaaggaggtttcagtcaatggggcagtatggtcagggagaactcaagaagattgctgaaacaatgatcaagaatggtaagctactttcgacacgcccagtggttcaatctgatgttcaggctatgaaagaaaaaaggagacttaagtttggagaactggagttcgaagtgactgctgaaagtgccaatatcggtgctgcagtagcggcaatttttggattcatctcatggcaactagcacaaggtgtgcaaaatgttcctgacagtacaatgcaatacgcaaatgacaatgcattgcagctggccaagtcgctcaagaccgcactgcttgttcttggctacacatctaccggcctatccttattcacggcttttgggctgctgttgctagcccagcggattaactctgagaacaaatcggagtaactgacagagacttgctgaagttgtggacctcatgccatgcctttctatgctccaataaggcaaacgttcatagcgaactgctgtaatgctatacttttgacactggaaccatgcgtgtatcagtgtatgcaatgttctgtacaaaaacaaagagccaattgtctgtgattacgaataatcggtgaagatgctgaagcaaacatggaagtcgtcagcttgggactgactgaagaacaaattgttaatgaacacaacaggtcaacagggaactgcttatactcaaaatt

SEQ ID NO: 13868 - DNA, 736 bp, Sorghum bicolor
  Clone ID: SORBI-28MAY03-CLUS79_2
gcggccgctcaggcggccggccgggatcgcctaacactgagagcaatcagaaacataccaagggaaacaaacatcaacgtcctcacaacaatggctaccaagatatttgtcctccttgcgctccttgctctttcagtgagcacaacaactgcagtcattattccgcagtgctcacttgctcctaatgctattatttcacagttcctcccaccacttactcttgtgggattcgaacacccggctctgcaggcttacagactacagcaggcgcttgcgaatagcatcttacaacaaccatttgcccaattgcaacaacaatccttggctcatctaaccggacagaccatcgcagcgcagcagcagcagcagcaacagttcctaccagcactcagtcaactagccctggcaaaccctgtggcctacttgcaacaacttgcatacaacccactggttgcggccaatgctgctgcatacttgcaacaacagcagctgcaacaaatcctaccagcactcagtcaactagccttggtgaacccggccgcctacttgcaacaacaacagctgcttccattcaaccaactcgctgtgacgaacaccgccgcatacctgcaacaacaacagctgcttcgtgttaatccagtggtagctgctaacccatggctgccgccttcctgcagcagcaacaattgttgccatttcaacagatatctttgatgaaccctgccctttcatggca

SEQ ID NO: 13869 - DNA, 1032 bp, Sorghum bicolor
  unsure (1)..(1032): unsure at all n locations
  Clone ID: SORBI-28MAY03-CLUS79_1
aaaaaaaanaaaaaccccccccccaccccccccccccccaaaaagatagcccttaaggcgcccggccgggatcgcccataacactgagagcaatcagaaacataccaagggaaacaaacatcaacgtcctcacaacaatggctaccaagatatttgtcctccttgcgctccttgctctttcagtgagcacaacaactgcagtcattattccgcagtgctcacttgctcctaatgctattatttcacagttcctcccaccacttactcttgtgggattcgaacacccggctctgcaggcttacagactacagcaggcgcttgcgaatagcatcttacaacaaccatttgcccaattgcaacaacaatcctcggctcatctaaccgtacagaccatcgcagcgcagcagcagcagcaacagttcctaccagcactcagtcaactagccctggcaaaccctgtggcctacttgcaacaacaactacttgcatccaacccactggctctggtgaacaatgctgcataccagcaacaacaactacaacaggtcctgccagtgatcagtcaggtagccatggcaaaccctgccgcctacctgcaacaacaacaacttgcatacaacccactggttgcggccaatgctgctgcatacttgcaacaacagcagctgcaacaaatcctaccagcactcagtcaactagccttggtgaacccggccgcctacttgcaacaacaacagctgcttccattcaaccaactcgctgtgacgaacaccgccgcatacctgcaacaacaacagctgcttcgtgttaatccagtggtagctgctaacccattggctgccgccttcctgcagcagcaacaattgttgccattcaaccagatatctttgatgaaccctgccttttcatggcagcaacccatcgttggaagtgccatcttctagattacatatgagttgtacttcataacaaaggtctcatatatcggcgtgtgcaacttccaataaataatcaatatattgtctgagaatt

SEQ ID NO: 13870 - DNA, 2153 bp, Sorghum bicolor
  Clone ID: SORBI-28MAY03-CLUS2232_1
gctcgtcgccctcgcctccgcctcctcgtccccgggcgcccccccgccgcgggcaagctgggcacccccgcccggcgccccctccgccccggcctgcctcgcggcgacgtgttctgcttctggtgtcactgcagcgcatgcaccgggcgcgggcctgaaaggccccctcggggtcgtcgggcagcctctctcgcccctggctctccttgtggcgagctgcgattttcgtggaggtggacaagcaagttaaagagatgctgaagctcatagaggatgaaggtgattcttttgcaaacgaggctgagatgtatttccaaagaaggcctcttcttgtaaatcatgtcgagaacttctatcgcatgtaccgtgctcttgctgagcgttatgacaacgtgactggggaattgcgcaagggtcttgcaccgcagtctcctcgctctcgggtatccgtcccggatgcggcgactccttcacttcctccagctcccgtgccttgcagggcacccaactcaccggtaccgtagcgctcctcacgggccgcccgctgccaggccttcctggggcctggtgccagctcagtgggtcccttcctggggagcggtggatcatcatcttcttcttcagattctgattcagaggctgctgcggcccgtgaagaaaatggcaatgggatttcttacataatggatggacggattactgagctagaagatgagctacaggaagcaaggcaacaaattgaggcacttgaggcaaagaacttgcactgccaatgtgaaaaacttgaagagaatctcaaacaagttagcaatgaaaaggaagacttggtagctgcaattctggcaagcaagaatgagatcgaggatctaaaaggagagatggcctcgacagcaaagcattttgaagcacaattagtgcaccgtgaccatgagattgagaagcgcaagcaggaggttgagcaagtttctgaaaagtatttccatgggaaatccgctcttgtgtctgaaatcgaaagactccaggaagttgttaagaattttgaacggaacctaacagaagttacaggagaaaaattgcagcttgaggcccaggtaaaggatcttgaacaagtttctaataacttagatgattcttctgcagagattataaagctacaaggaataatcaaggatctgcaagcaagattggaaaatgactcaaatgagaagggtgtacttgaggaacgtgctatggagttggagcaagttcgtaggcagttggaggattcaagggctgaggctagggagctacaagctacaattaaggacctgaaagatgacctagaaaaagctcttcaagagaaagcagaacttcagaatcgtatgaaggatgtggaacaggtaaccagtgacctaaattccttaattgcttcacttgagagcaagttgacagccacagaggcacagcttgaacaacttcacgtggagaaagcagaagcatcccttgagagtgagaaacatttatctcatctgattcaaaccatcgcccatcttaagacggagatcgagctgctgtcttcagagaaggctgcagttgaaaacaaggtgtccgttctgctgattgatgtcactactcgtgatgaaaagctgaaggagatggacaatcacttgcatcagctgcacctggagcatgtcaagctgatcgaagaggcggatattgcatggaaagacatgtcaggcctgcgttcacgcgtgtgtgagctcgaggaagagattgagaagcagaagcttattatatctgacagcgcagaggggaagcgtgaggcgatcaggcagctgtgcttctcgcttgatcactaccgccatgggtaccagcagcttcggcagctcctgcaggaccacaggaggcccgtggtgatggcaacatgagtgagtagcgtacccttcctggatgttgaaaggatgtcgaatctctgaagttggcttctcagtggtatgctgtctgacgatgtaatttgagctgtctccttcccctcttcctacacaatttgagtaaagcttgtgctctgtagttacttgaactgtcgagttactcgtaatctgtggcgtgtaatgtaatgagctatatggccaatgggtaaaaaaaaaaaaaaaaaaggcccctatgttgtgttc

SEQ ID NO: 13871 - DNA, 758 bp, Sorghum bicolor
  Clone ID: SORBI-28MAY03-CLUS23652_1
ccgcccgtcctcccccgcccctccccccccccctccccccgctcctgggtgctagttaagaccatccccttcgtcgtctccaccacactccccttccgccgcctcagctatggcggcgccgagcttgatccggctccggccgccgcgtgcatccctcctcatcctgctgctcctcgccctcaacatctccctctccttcgccgccaacttcgagggcttcgactccgacgaccttccctccgcggccggtggcctcgatgctgacgatgacgaggaggggctggacggcgtcgacctcccgccccctccgcccatctccctctccacctccgcgccttcacctcccgtcacgacgacatccgcgccgaaccctaacaaccccgctacgcctgcgcctcgggaccccaccccggcgctcgacctctgggacgaggacgagttcgagggcatccccgtgcctgaagcgatctcctccgacgactccgccgcgccggccgaggccgacccgtcagatccctccgcggaggcaccggccgaggcggcgcctgccgcgaagaggaccccggctgagctcctccgcgcgttctccgtcgagatcgcgtgcgtcagcttcctgatctgcttcgtgctcaactacttcactgggaagcggcaaaacgagaacatcgcgctggcctgggccaccaagttcgccaccagggactccatcttcgacaagaacttcagccttctaggcactggcgatggcaaggacacgc

SEQ ID NO: 13872 - DNA, 1481 bp, Sorghum bicolor
  Clone ID: SORBI-28MAY03-CLUS24397_1
gcacgaggctccgcacgaggcttccgttacccagcgtgcgcgctgcactctccctcctccccacttctctctcgtggcgacggcggcgacgacgacgactgggcggccgtcgctgcctcgctactcgccaggttcccaggtcttcttcggcctctttgctgtcggcgagcaccaccagggaaccaggatacttcagtggttttgcaaggatgtcctggtgcactattgagtctgatcctggtgtgttcaccgagctgattcagcaaatgcaagtgaaaggtgtacaggtggaagagctttattctcttgatgtggattctcttagtcaactgcggccagtatatgggctaatttttctcttcaagtggatacctggggagaaggatgaacggcttgttgtcagagatcctaatccaaaccttttctttgcacaccaagtcatcactaacgcatgtgctactcaagctattctctcagttctcatgaatcgccctgaaattgacatcggtccagaattatctcaattgaaggaattcacaggagctttcacacctgatctgaagggcttagctatcagcaacagcgaatccatccggacagctcataacagctttgcaaggccagagccatttatttctgatgagcagagagccgcgactaaggatgatgatgtttaccatttcataagctatttaccttttgaaggtgtcctgtatgagctggatgggctgaaggaagggcctgtaaatcttgggcagtgcggtggtgctgatgaccttgattggctacggatggtgcagccagttattcaagaaaggattgagcgctactcacagagtgagatcaggttcaatcttatggccatcataaagaacaggaaagaggtgtacagtgctgagctggaggagctggagaagagaagggagcagattttgcaggagatgaacaagactgccgccacagaatccttgaacaactcgcttacagaggtgatatcggcaatcgaaaccgtcagagagaagatggtcatggaagaagagaagttcaagaagtggaagacggagaacattcggaggaagcataactacatccctttcctcttcaacttgctgaagatgcttgcagagaagcagcaactaaaacctctggtcgagaaagccaaacagcaaaagtcatcaagccctagcacaagatgatggtgaaatgtcatagactggtagcttttgcgatgtcctctgtgagcgcgttatcttatcgaacacattgtctagttggcagcttagagaaattattaccaaggttattgaccattgtgcacgctgtgttgtgtcagcagctacgccatttttgctgagtacgtacgttgttgaagtggtcaattttagtcgtttatttattttgtgtcaggttaattgtgccagtggattataaaacgcgttgaaggctgtggatcgtttttggtaaaaaaaaaaaaaaaaaaa

SEQ ID NO: 13873 - DNA, 1740 bp, Sorghum bicolor
  Clone ID: SORBI-28MAY03-CLUS1307_1
tgcttctttcccggccggtccggttgcccccatcccatcctcggaagccagcctcgcctcgatctccccgttccctcgtgtgccgactgagggcggcggggcgactaatggggacgggggagcgcgcgggcgatggccgccgcgctcgccgtcttgcttctcgcctgctctggcgccgtcgctgtcgccagggcgcaggacaccgagcggatcgaaggaagtgctggtgatgtgctcgaagatgatcccgttgggaggctcaaggtgtatgtctacgagttgccaaccaagtacaacaagaagatggtggctaaagattctcggtgtctcagccacatgtttgctgcagagatcttcatgcaccgcttcctgttgtctagtgcgatccgaactttaaatccagaagaagctgattggttctatactccagtatacacaacatgtgatctcacaccatggggtcatcccttgccctttaagtctccacgaataatgagaagcgcaattcagttcatttccaaccgttggccatactggaacaggacagagggagcagatcacttctttgttgtgccacatgactttggtgcatgcttccattatcaggaagagaaggctatcgagcgaggagtccttccattgcttcgccgtgctacactagtccagacttttgggcagaaggatcatgtctgcctaaaggaaggctccatcaccatcccaccatatgctcctcctcagaagatgaaaacccaccttgttcccccagggacccctaggtcaatctttgtctatttccgtgggttgttttatgacactgcaaatgatcctgagggtggttactatgcaaggggcgcccgtgcatcagtatgggagaacttcaagaacaacccgcttttcgacatctcaactgaccacccaccaacctactatgaggacatgcagcgtgccgtcttctgcctgtgcccactgggctgggccccatggagcccccgtttggtggaggcggtggtgttcggctgcatcccagtgatcatcgccgacgacatcgtccttccctttgcggacgcaatcccatgggaggagattggtgtctttgtggctgaggacgacgtcccgaagctggacaccatcctgacatccataccgatggaggtgatcctccggaagcagaggctcctcgcgaatccatccatgaagcaggccatgctgttcccgcagcccgcccagcctggggatgccttccaccagatcctgaacgggttggcacggaagctgccgcacggcgaggacgtgttcctgaagcccgggctgaaggtgctgaactggaccgagggcccccgtggcgacctgaagccatggtaggtgtagtggcatggcatggcaccgtcagcatggatgctgttcttgtgtacacggcacaacacaaccagatgcgaggctgatcgacaacgacgattatgagtactcccatgtaactgatgtaaatgtaaagcccagcaggacctttgcttctttttgaggcgatgtgttgtctgctttgcctgtgtctgtgtgacagtgtctgttttgactttattttagtgttagcctattatagattgcagatcatgtgatgtatggctgttgtattatattaagttatacagttgatgggggagaaaataaggttaacagttaaccccaatccatgtgactgccaatgatgacgtgtttccgttctgaatgttaaaattagaattt

SEQ ID NO: 13874 - DNA, 1336 bp, Sorghum bicolor
  Clone ID: SORBI-28MAY03-CLUS12533_1
agtatcgattagttagagtcgttaactcgttatccaccaaccacgtcgcttcaccgtcacatccacttcctcgtcgaaagcctccggtccaccaactatgccggcggccatggcggctgcggcggcgcagaggctcctcgcggcgagcacgaaaatcatcggcgttgggcgcaactacgtagcccacgccaaggagctcggcaacccggtcccaaaggagcccgtcctgttcccaaagccttcctcgtcgaaagcctccggtccaccaactatgccggcggccatggcggctgcggcggcgcagaggctcctcgcggcgagcacgaaaatcatcggcgttgggcgcaactacgtagcccacgccaaggagctcggcaacccggtcccaaaggagcccgtcctgttcctgaagccgacctcgtcgttcctccatgctggagttgccaccgccgccgtggagatcccggagccgctcgagtcgctgcaccacgaggtagagctcgccgtcgtcatctcccagcgcgggcgcgacgttcctgaggcgtccgccatggacttcgtcggaggttatgcacttgctttggacatgacagcaagggaccttcaatctgttgctaagtctgcaggccttccatggactttggctaaaggacaagacaccttcactccaattagtgcagtagttccaaaatcggctgtcactaatcccgatgatctcgagctctggctaaaggtagatgatgaactaaggcagaaaggaccgacaagtgacatgctattcaagattccttttctgatcagctatatcagttccttcatgacattaatggagggtgatgtgatactaacaggtacccctgagggtgtgggtcctgtccgagtaggtcagaagatcacagctggtgtaactgacctaattgatgtcgagtttgatgttcagaggcgcaatcggtcattttccacatgatgcaataagcaagaaagtaatggtgaatacaaagcgcagtcctccaccgtgaatcgctttcctggacctggagcaattgcagatagctgttgagccttattcttgatttagtttacccgggtccggggagactatctatgaatatgctaactcgttcctgaagtatcttttctcccagatgattgatggagctttaagctcgctttctgcatgcaacaaaaaaatatatatatcccattttttctctaccctgctttgagaatactgcagcagcgatttgaaacagctgtgctgtgcactgccgatgaaatacactgaaacgagtgcgtgtcttgcagcgcagaacaaataaggttttacttttacaag

SEQ ID NO: 13875 - DNA, 450 bp, Sorghum bicolor
  Clone ID: LIB3478-044-P1-K1-D8
gcgctccaattagtgcagtagtaagcaatggtttttcttcatgtgcttggagttggttggtggtggctcaggacagtatgtttgggttatgtgtattcgcttgttataattacacctcaatgaatcaatgccatattcaagttagtcagtgcagaagtgttgttagatggagacatctttgttgccttccatgctctccgcaggcatctagtgacatgaaatttgtagacacaccatgtttttacttcagttaatgataatttctccatcaatcaggttccaaaatcggctgtcactaatcccgatgatctcgagctctggctaaaggtagatgatgaactaaggcattaagtaccgacaagtgacatgctattcaagattccttttctgatcagctatatcagttcctttatgacattaatggagggtgatgtgatactaacaagtacc

SEQ ID NO: 13876 - DNA, 781 bp, Sorghum bicolor
  Clone ID: SORBI-28MAY03-CLUS12588_1
gcacgaggctggattcacttgcaaggaatttgagcgcccggaggactggcaggaatcgcaggagccacagtttgtcagcctgggttcgggcaagttctgcattgcaaggttcttccatactacggtaactgttagcaatggctactacactgatgatgaagttactaaccggtcatttggtgtcttaactggtgtggaggtgttgccacgcgtctatgtgcgcaatggggatggcagtgccaatgacagcaaaggggatggcagtgccaatggcagcaatgggaatgggaatggcaatggcaatgcaagcagcaatggcaattcaaccagcatttgcaacggtggcagtggccgtggcaatggcaacggtggcaaaaggaaactccggatggtcaagcataagtcgagatgtcacgtatctgccaacggtactgtcatcgagtcagtgttctgaattattttgggacttgctttgctttgaacaaaggttggctcatttggctcttaactaatatcgctagtatcatcatagtagaccaggaggtatgcttgtattattaacgccgttaagttggacttctgttctgtcttatccactgtttaggggctcagtaaccctatttgtgtatcaatgacgttgggattgagtctcagagactagtcaacatgtttttgtaattcccaggatttgacatgataacgggtcagagatctagtcaatcgtgtttttgtaattccaagatctgtcgtggtagagtctacgtgtcctgcccatttattt

SEQ ID NO: 13877 - DNA, 1069 bp, Sorghum bicolor
  Clone ID: SORBI-28MAY03-CLUS14166_1
gcccgagggccccggggccggggggaaggccaacccgaccgtcccaccgcgtcgtctccctcctcgtctcctctcctctcctctcgcgtccgcagcttcccttgcaggctagggtttgcagatgacgacggcggcgcgccccacctgggcgccggccaagggcggcaacgagcaggggggcacccgcatcttcggcccctcccagaagtactcctcccgcgacctcgccgcgcacacctccctcaagcccagaaaagatggtcaacagacccaagaggagttacagaagaggaacctcagggaggaacttgaggaacgcgagcgcaagcactactcttccaaggataagtcctattctgaagaaagagaccggcggaaaagctcaagccagctactcttagaaggttcaaagagagaggcagaggataagatagttccacgagaaatcgatgcagatgactctgatgtggagcctaaaagtgatgatgagagtgatgaagatgatgacgacgacgacgacactgaagctctaatggcagagcttgagaggattaagaaagaaagagctgaggagaagcttagaaaggagcggcaacaagcagaagaggaggccaagatgaaggaggctgaactgatgcggggaaaccctttgattaatatcaacaatcctggctccttcagtgttaagagaaggtgggacgatgatgtggttttcaagaaccaagcacgtggagagaccaagacaccgaaacggttcatcaatgataccatcaggagtgatttccaccgtaaatttcttcagaggtacatgaagtgatggtaccgctgtgtacaacttacatgtctccgctccttgtatgggagagcattggttcagttgggagctcttatcgttgttatgtttgtgtacgagtgaaagaccagcatagcattggttcagttgagagctctcatcgtgttaagtttgtgtacgagtgaaaggccattattgtgttgctgtatgaaacaaaagtataaacatctgtcggcatcttaacaaagctgtactgagcaatacatatcttatctg

SEQ ID NO: 13878 - DNA, 486 bp, Sorghum bicolor
  Clone ID: SORBI-28MAY03-CLUS13678_2
ggttttcccttcccttcctatactatttggatccgacaaagttcgacaatctaattaagtcggatccaaatagtacttccatatctcagtgcatggtttgaacatctttgttgctgaaaagatttttgaaggttcaagccatgtgaacgtcagtcatgttatccatgagctgtcatttggcccaaagtatccaggaattcataacccactggatgaaacttcaaggatacttcatgacacaagcggaaccttcaaatactatatcaaggttgttccgactgagtacaaatatctatcaaagaaagtattgccaacaaatcagttttctgtcacagagtattttcttcccattcgcccaagtgacagggcctggccagcggtttacttcctgtatgatctctcaccaattacagtcaccatcaaagaggaaagaaggaacttccttcattttataactcgtctatgtgcagttcttggtggcacatt

SEQ ID NO: 13879 - DNA, 1556 bp, Sorghum bicolor
  Clone ID: SORBI-28MAY03-CLUS13678_1
gcacgaggctcggcggcggccgcgccgggcttccatttgcgcaggtggtctcccctctctctcttggcgacgactgggcgaccggcgctgccgccccacgccaggtgcataggtgttcttggggcccttcgccggcgacgagcacccccagctgaaagatggcgaggataccgtctctgaagagcctcaatgcgtttccacatgcggaggaacacttgttgaagaagacttactctggcgctgttgtgacaattcttgggctccttgtaatgattacactgttcgtgcatgagctgcagttttatcttaccacctacaccgtgcatcagatgtctgtagatctgaaacgaggagaaactctgccaattcatatcaatatgtcatttccttctttgccatgtgaagtattgagtgtggatgcaattgacatgtctgggaaacatgaagttgatttgcatacaaatatttggaagcttcgcttggataagtatggccatatcatcggtacagagtacttgtctgacctagttgaaaaggggcatggggcacatcatgatcatgaccatgggcaagagcatcatgatgaacaaaagaagcctgaacaaaccttcaatgaagaagcagagaaaatgataaagagtgtcaaacaagcactgggaaatggtgaagggtgtcgagtctatgggatgttggatgtgcagagggtggctggtaacttccatatctcagtgcatggtttgaacatctttgttgctgaaaagatttttgaaggttcaagccatgtgaacgtcagtcatgttatccatgagctgtcatttggcccaaagtatccaggaattcataacccactggatgaaacttcaaggatacttcatgacacaagcggaaccttcaaatactatatcaaggttgttccgactgagtacaaatatctatcaaagaaagtattgccaacaaatcagttttctgtcacagagtattttcttcccattcgcccaagtgacagggcctggccagcggtttacttcctgtatgatctctcaccaattacagtcaccatcaaagaggaaagaaggaacttccttcattttataactcgtctatgtgcagttcttggtggcacatttgccatgacaggaatgcttgaccgatggatgtaccggcttatcgagtcagtcaccaactcaaagaccagaagtgtactgcggtaactgtgcagttcatgatagatcgagaacagttggtaccgtggctaatgaagccaatagatctttgccccaagctgactggtcaagccatgttgattggcatgttttattttctcacatggctaacttataatacgtcgttttttttatcatcaattatattagattgacaccaagtccacggactacagttttgtcaacaactgacatttatcgactatcgtggaactaaaccattgaagacgtggtttgggggaaaaaacgacttgtgatgacgaatatgtatgcaagaaaaacatggctccagattagtttttactgtgaaaatcaatacaaatatttagcttc

SEQ ID NO: 13880 - DNA, 1802 bp, Sorghum bicolor
  Clone ID: SORBI-28MAY03-CLUS1450_1
gcacgaggctggaacgtcgactggggggacgacgctgcccttatggttgggtttcgagcggccgagggaccccaaacttcattttggcgttggccgtcccggattactccaaactttcatttagcactggttgttatttgttcatgatatattgtaccaatttccagttttgaaatcttaatctcatttaagctggtaattacttaattctctccttccttatggtggggcctccgtaatcaactgatcgtgtaatcttttataaaattgtccgtaatcagctaatggagttgtctgtattattcagacttctggttccgctatgtgctacgtacggtggataaagggagtctagacctagcaaacaatgccctggctcgtgctactcatgtgtttgtcaagaagcagccagagatccatctgtttagggcgcgctttaaggagcttaatggggatatttctggagcacgtgcagaatatcagcatctttactcagatttatgtcctggctttctagaggccattgtcaaacattctaatatggaacaccgactgggagagaaagaattatcttgcacagtctacgaaaaggccattgctgctgagaagggaaaggaacagagccagctcttgccaacgttgcttattcagtactcccgtttcttatttttggccgtccgagactcggagaaggcaagagagatattaaatgtgctgcatgagcagttaaatgtaacaaagccagtgcttgaggctgtcatccatctggagtcgatttttccatgtgaaaagcgtattgaatttttagactcacttgtggagaagtttgttacacctgaatcatctcagggagaggtggcaagtctagttgacaaagaagaaatatcttccatatttttagagtttttggatctctttggggatgcaaagtcaatcaagaaggctttaactcggcatacaactcttttttcatgtaagagaagcattctgccatcaaagaaacggaaagcagatgatgttgttgtgtcagagagggacaaatttgctaaaactggggctgtgcagtcagccacgggaactgatccaaatgcttccaatcctcctgtttggcctgcaacttctgaagcatctgggcaacaatggggagcttcttatgcacagcaggctgcatatcctgcatatggaacttatgactacagccatcaaatgcctcagcctgctcctcaagcagctgcctatggtgcttatcctccaacatactctgctcaggcctatacacaacaaaactacgcacaacctgcagcaattccagcagctccagtgccagcagtggtaccagcagctacacccgcgtcagcttaccctcagcaacctgcggcagctcctcaaccttattatggcacaacctactactgatcagcctgttaatcttggatgtgtggtccagcgagcctgttaatcggccttttcgcatgtgtggttcttgcagtctaatcagcaggcttgtcaatacgagaggccaaaggcatcccaagaccttcggtaccaccattatttagctcccctttagacggatgctatcgacgagatgatcgcttgagaacaaatttgagatttgtatagtcagcatttttgttgctagcatctgtcgctaggaattgacattgtttccttgcagtagcgtaatttttactgtagacgagatagcagtgttaaccatgcgtatcagcatatgaacatataatcgacattattcactgttcgtgccccctttcggagtgcaaaaaaaaaaaaaaaaaaaa

SEQ ID NO: 13881 - DNA, 2536 bp, Sorghum bicolor
  Clone ID: SORBI-28MAY03-CLUS1477_1
gcacgaggctcttcgccccggcttgcggctcccctcccttccggcctttcggcgtggcctccggggtatgcctgggcccgtgctagggttcgggtagctgcaccccgcactctgtcgcatgcttggttcgcccctctcccagcggctgccgccagtgctgtctcttccccggtggcggctaccgtgcctgctgtctctccgccgactcttggggctgctcgcgctgctgagatccccatgcttgcccctgttttggctcctcttgccggtcgtgtcgaaagactcattaccctagcaacgggctctaggctccctccacctctggcgccagccctcttcagaggtacattaagcacaaatgattctgatctgtctggaccatcagatgctgaagtggatgctgtaggatctatttgtgcttttcttcatgtcacattcaatacattccctctagagcgaattatgactgtactggcctaccggactgaaattgttcctgcactatggaacttcataaagcggtgcaatgctgtccgaagatggccatttttttctaagtttgcatcttcattacctgctgatgttcctggttggctcctgcccgtggctgtattctgtcccatatacaggcacatgttgaagataattgataatggggagttctatgaacaggagaaacccctttcccttacagatttgaagtccttggttctcattttaaagcaggcgttatggcaacttctttgggttattccatcctcttctcctcagaaagtgtcacccaacccttcaggccttaaaaagttgtcagtggagaatgtcaagaccagagctagggttgggttatctgaactactcacacagttgcaagattggaacaaccgactcccatttacttctgcaagtgatttctattctcaagaagcaacaagcgaaaattttgtgtctcaggtatgaatgcctatgctgttttggattaattgaaatgtattccatgtgttcattcttctatgactatgcatgtgttttttcaggcgatacttggtaatactcgagcatcagagatcataaagcttactccttttttggctccatttaccagtcgagtcaaaatattcaataaccaattaacgagctctagacaatcaacatcacattctgcattgacaagacaacggttcaaaataagaagaaatcgacttctggaagatgcttttgatcagctaagtttgctttctgaggaagatctcaaaggaccgattcgagtttcgtttattaatgagcatggtgaagaagaggctggaatcgatggtggtggaattttcaaggatttcatggaaaatattactcgcgctgcttttgatgtgcagtacggtctcttcaaggagacggctgatcatcttttgtacccaaacccaggatctggattggttcatgaactacatctgcaatatttccattttcttggaagtctacttgggaaggcaatgtatgaaggcatacttgttgatttgccatttgcaacgttcttcttgagcaagttgaaacaaaagtacaattttttaaatgatcttccttcattggatccggaattgtaccgtcatcttctatttttaaagcattacaatggtgatatctcagagttggaactatactttgttattgtaaataatgaatatggtgaacaatgtgaagaagaacttctccctggtgggagggaaatgcgtgttacgaatgataatgttattacttttatccatcttgtcgccaatcatcggttaaactaccagatccgtgcacaaagtacacacttcttgagaggttttcaacagcttataccaaaagactggattgatatgttcaatgaacatgaaattcaggttcttatatctggctctttagaaagcttggatatcgatgacttgcggtcgaacaccaactattctgcaggatatcatccggatcatgagcttattgagatgttttgggaggtcttgaagagcttaagttcagacaaccagaaaaaatttctcaagtttgtgaccggatgttctcgtggtcccctcctcggatttcagtacctcgaaccaaaattttgcattcagagagctggtgttccaggactggaggagcatgcagatcgcttgcctacatcagctacctgcatgaaccttctgaagcttcccccttataaaagcaaggagcagatgcaaaccaaactgttgtacgcgataaattcagaagctggttttgatctaagttgatcatgatcgggattcagtatttgtgcagtgtagatagttgctagagaacagcttaaaggcacccagggccgaaccatcaaccatcggccccatttgaagccccatgaagttaaaaagaaaaggcggttgtttatcagagtagttgtatgtctggagggaggctgctaactagggctccccaagagaaataggcagacgccgtctaatcaatcatgacatgtacatatgtatttttatgagagatgttaaacaacacatggttgtttctctcc

SEQ ID NO: 13882 - DNA, 785 bp, Sorghum bicolor
  Clone ID: SORBI-28MAY03-CLUS13948_1
gcacggggatcagtacccgtggcccctcgtcgcagtgtgaatccagggtgacggggtaaatcggccgtgtgggggtggcgcgccgatgctctggtgtccttgctcccagtctcacactgtctcacagctgacctgccactgccaggaaggtagggagaggccaggatgccccgcggcggcttctcggggtcactcaggtcgcccaagatcgacgtcgtcatcgacatggggaaccccttcctcaaccgcaccgtcgacggcttcctcaagatcggcgccgtcggcgcctgcaaggtggccgccgaggagaccttcgattgcctccacaggggggatgtttcaaagcacaaggttaagcatgccctgaagaagatgtgccaggagggtgcatattggggtactgttgctggagtttatgtgggcatggtgtatggcgtggaaagggtccgtggtcgcaatgactggaagaatgcgatgataggaggcgccttatctggtgctctgatctctggtgccagcaacaaccacaaagacaagatcatcaaggatgccattaccgctggcgcggtcgcaacagctgtcgagttcatcaactgccttacctagttgagcaagagcaactgcatttgcagtgccattgtcgtacaataagaataaagtacttcttcagtggatccatgtccagttcaataaaccacccatcttcagtcttccaaaaaaaaaaaaaaaaaggcccctagggggatatcctgagcaacctttttcgttaccttttgcggtttgca

SEQ ID NO: 13883 - DNA, 249 bp, Sorghum bicolor
  Clone ID: LIB5050-005-R1-XP1-E1
ccgcggaaaaaaaaaaaaaaaaaaaaaaaaaaaaaaaaaatcgacatgggggaacccctctcctctaaccagcaccgtcgacggctttcctcaagatccggcgccgtacggcgcctgcaaggtgggccgccgaggagaccttcgattgcctccacaggggggatgcttcaaagcacaaggttaagcatgccctgaacaacatctcccaagacggtgcatattggcggcactgtttctggaatttatgtg

SEQ ID NO: 13884 - DNA, 1670 bp, Sorghum bicolor
  Clone ID: SORBI-28MAY03-CLUS14357_1
ggaaaaagaaagtgaagctatgggactgtcttcccacgagaaatgttcaatgactgggaaaaaggttctaagacacatttatgttgaggcccctggtgctaaggcattagagacccctccttgtctatttttttttttttatctcggagggtattttcttttcttgtgttgtgtcttttttttttcttctcttgttcttcctattacactgctgagattttgcgaagcagtatgcgctgtggtccaaagaagccagtttgctttatggctgggtgtgcttaacggagtgtttgttgctttgtgggttgtcctctaggatgtgttatgtgttgactgtttccttttagaatatgtgcaattgttctagaaactgaaaaaaaaaaaaaaaaaaaaaaaggccggccggtgcgacggcggcacggctcaagtgcaggtggtgccggtggtgcccggcgccatccagcgcgcctctatataaacccggcctgcgggttcagtgtcccagtgcacactcgcttcgttcagcatctgccggtgctcttctctttcgttctcttccagttattggtagtctttttcgatctgaaaaacatacaggaggagatcaggagagcgagaggtacctagcaagatgagcggcaaggttctccttgtcgccgtcctcttggtgggcgtagccgcctctcggtgctcaggcagtaggggcctgcagggcggcgatcacgttgctgaacagaagtacggtggcggtgggtacggaggaggtggcagcggcggcgggtatggtggcggcggtagcggtggtgggtatggcgggtacggaggtggcggcggtggcagcgggtacggaggcggcggcggtggctacacgcccgcctactctggcaccgggacctgcgactactggaagagccacccggacgcgatcatctcgtgcatcgggtcgctgggcagcatcctggggtccctgggcgacgtgtgcagcgccttcttcgggagcaaggtgcagacgctgcaggacgcgctgtgcaacacccgcagcgactgctacggcgacctcctccgcgagggcgccgccgcctacctcaactccgtcgccgccaagaagcagcagttcgcctacagcacgcagcaggtcaaggactgcatcgccgtcggcctcacatccaaggccgccgccgtcgcgcaggccgccatgttcaagaaggccaactacgcctgccactactagcagaccggccgggccggcctcttatcatgcatgcatcaccgtttaacgtacgtagtgtttcttataaataattaagtctgctgtatatgcatggtgtggaggtccagacgagtatgtcctcagcggtgccttcgtttctgcgtcgtcgtcttcccaagatgatgcactccgtgatgccatgccgtcgtctcgttgtctggctcagtagtgatatgcttgctttcttgtcgttgttgctgatgtaataagagatgatgcgttcattgctaattactatactttgctagtgaaatactgaaatggtcgttggacggtcttactaaatgcacgggcaatctcgcgcttgtttctgtcagcgctactggttgggtgttgagatttaatcatgtactacatggctacaaactagtacgtatatatctacgtatgcttttccttt

SEQ ID NO: 13885 - DNA, 1726 bp, Sorghum bicolor
  Clone ID: SORBI-28MAY03-CLUS30749_1
cgacgccggatgcaaagctattgagattgcacggccctggagtccctgacgacctcgttcccctcctctgtctcgcctctctttcgtttcctcgcggcgacgactgggcgagcgccgcctcccctccctccctccctccctccgtgaggtcctcgccgacgacgagggccgccgcccgttgccacgtctcctctgtcgtagagtgtacaccagatccagtgaaggctgacaacttgacgcagggtgttcaagaaatttaagccgtgcactagattgctgagagttttccttgatacaggggaataagggacaaagaatcttttgacattgatctgtagccagtgctgcaatggctacgaagcttgtggttctcggtatcccctgggatgttgacactgaagggttacgggagtacatggccaagtttggacccctagacgattgtgtcgtcatgaaggagcggtcttctgggcgatctcgcgggtttggctatgtaacattcgcctcagccgacgatgcaaagaatgttcttgattgcaaccatgttcttggcagccgtacgttagaagtgaagatagctactccaaaggaagaaatgaaatcacaaggaacaaagaaagctacaaggatattcgttgctcgaattccacaatcagttgacgaatcgatgtttcgtaggcattttgaagcttttggggaaattcttgatctttcctggccttggggacatggttcaaaagggcatcgtggaattgggtttatcacgtttcagagtgcagagtctgtggacagcatcatgcaagagtcacatgagcttgatggtacaacagtagttgttgatcgtgcgactccgaaggatgaagatgtcagataccccccaagtaggccatctcagggtggctatggtgcatataacgcatatatttcagctgctacaaggtatgcagctttgggtgcaccaacgctgtatgaccatcctggatcagcttatggaagaggatactatggatcctcccaagcagtgggcaagaagatatttgttggtagacttccacaagaagcaaacacagatgacctaaggcattactttggcagatttggtcgaatcgtagatgcatacattccgaaggaccccaaaagaagtggccaccgaggtttcggttttgtcaccttcgctgatgagggtgtggcagaacgggtagctcgtagaagccatgaaattctaggccatgaggttgcaatagacccagctgcaccacttgagaatgattcagctgctggtggttacattgatcccatggatctttacggagcttatggttcaatgcgatccttcggcaggttctgcggcggtctagattataattatggctatggccccagcagtggaagcagcagatcaagatcagattggcgataccgaccttactgaacgttttagtttacatctagggaaggaaactgaggagatggagaaagaaatacaagttgtttaagaatgcaagtggtaccttaagtggcatgttaatcttaaagagggccgtgtggaatctggaatctatctatttgttcatgttgtaattttggacatggaaatggttccctgcaatttctttgtcgtgattcacattattgatacaagatgaaggcagccttgtagttatcgtgtggaagtgctgtatgtaataaaaaggatcaattgcaaagcgattgacgtgcgccctgg

SEQ ID NO: 13886 - DNA, 2146 bp, Sorghum bicolor
  Clone ID: SORBI-28MAY03-CLUS3573_1
aaagatgcctggggaagccggcgagctggacccgggcggcaacttggaaccggtcgtcctcctccctccccgtcgctcccgacctcctcctcctcctaatttaaccccacccggcctccccggttcaccccgaccgcatccccccttaacctcccctccgcctcctcctgcggtcccaactcccatccttcggttcaggaggcaggcaggcaggaaggcaggttcgaggggggattggctccgctcctgcttgctccattgcgcgtgatccggctctttctcttgattgattgatctaggcgtttcttggattactcctggaagaaggtcaaacggttgttggaagccttgctgggtgcttcaacgaacgcgaaggtggtgctgtcatttagcgcgtcttgcattggttggatttgacccgttggcctggtggcgtgctgtctttgattgagcttcgaggatgatgaagtgggggctcagcagcggcacgcccgcggattcctactacgaggtccggtcagactgcacggacggtgtgcccaagagcaagttcaagatcaaggctggcaaaacattaagtgctcggaaatggcaggctgcatttagtcccgatggatgtcttgatattgcctcagtcctcggccggatacaaagaggaggtgtccatccaacagtcagaggagaggtctgggaattcttacttggctgtttcgatcccagaagtacctttgatgaaagggaagagatcaggcaaatacggaggatacagtatgccagatggaaggaagattgtcgactgatggattcgcatgttggtagtggtaaagttatcacagcaccacttatcactgaggatggcagacctattaaggatcctctggttttacttgaggctacttccgacaacaacagatcagaaggtgctccaactaccagcataaatagaactgaaattgatgaatctgcagaacccattaccgataagcaaattatcgagtggaagctgacattgcatcaaattgggcttgacgtcctacgcactgatcgcaccatggtattctatgagaacaaagaaaatctttcaaaattgtgggatattctagccgtgtatgcatggattgacaaagatgttggttactgccaaggaatgagtgatttatgctcaccaatgatagttctactaaatgatgaagcagatgcattttggtgctttgagaaattgatgcgtagattgcgaggaaatttcaagtgcacagatcaatctgtgggagttgccaaccaacttcaacaccttgcgtctattattcaggttcttgacccgaagctacatgaccacctagaaactcttggtggaggtgactacctttttgcgttccgtatgttcatggttctatttaggcgtgaagtatcatttggagactccttatacctctgggagatgatgtgggctctggaatacgatcctgacattttcttcgcagcgtgtgaagaacaaggtgcagtacataaaaataaagtttctaaatccaaattgaaaggactgcgccattttggcaagtgggaaaatagtaaggataaggacaaggataaggataaggacaaggataaaaatggggctgaggatggtgaagatgggccggttccaatttcagttttcatggttgcaagtgtccttaaggaaaagagagaaaagctcttacaggaagctagaggactggatgatcttatcaggattttgaacgatgtaaatgggaacttagatgccaagaaagcttgcgccggagcattgaaacttcacaaaaaatacctgaaaaaggtacaacaagcaaagaaaccttgaacgtgctatggaacacaccttcccaatggattatccttaccatttgaacatacacgaccattttctacacacaactttgagtgaagatttacaggacacgggtggtaatcgtctgacgtgtcctcagatacactgactctgatggtgccaggctagtgcgttgagtacaggatgagtgtgcaaccggtagtatgtatctcacgttttttgcactcaagaattttgtacagacagaaggcagtgcgggtagcatgccttatacatacataattatttcaatacaagttgaaatgaacaacacctgcg

SEQ ID NO: 13887 - DNA, 2145 bp, Sorghum bicolor
  Clone ID: SORBI-28MAY03-CLUS1808_1
gcacgaggctgcagcttgcagtagctattgcccaggctatttcagatctgccggaaggtcctcggacaatggttggaattgcaacatttgattctgctattcacttctacagtcttaaacgtgctcagcagcagcctttgatgctcatcgttcccgatgttcaagatgtatatacgccacttcagacagatcttattctcccagtttccgagtgccgggagaatctggagcaggtgctagaaagtatcccaaacatgtttgagaataatagggtcgctgattctgcttttggagcagcaatgaaggctggcttcctggcggcgcgagctactggtggaaaacttctggtttttcaatcagtgctcccatcacttgggattggttctttatctgcaagggaagccgaaggcagagcaaacattacaactggtgacaaggaagcccataaacttttgcagcctgttgacaacactctcaagacaatggcactagaatttgctgagtatcaggtctgtgtagacgtattcctcaccacacaatcgtacgttgatattgcttctatatccgttgtgcctcagactacaggtggccgggtctactactactatccattttctgctctttcagatccagccaagctcttcaatgatctcagatggaatatcagtagaccccagggttttgaggctgttatgcgtgtaaggtgcagtcagggtctccaagttcaggaatattttggcaatttttgcaagcgtgttcccactgacattgatcttccagcgattgattctgacaaaactgtgatggtcacgtttaaacatgatgacaagttaccagaaaatgtggaatgtggcttccagtgtgcacttctgtatactactgtatatggacaaaggaggatccgagtcataaacctctcactttcatgcacaagtttgcttgctaatctttttcggtgtgctgatttggagacacagtttgcatgcttcctgaagcaagctgctaatggcatcccgacatctccattacctcgtattcgggatgaagcaacaaatacatgcataaatattcttcaatcttaccgcaaacactgtgcatctgtaacctcatcggggcagttgattctcccagaggctctaaaactgctgcccttatatactttggcactggtcaaaagtgtaggcttgagaaccgatgggcgattggatgatcgttcctattggatatctctagtctcatcaatttctgtagtactagctgttcctttggtgttccctagattgattcctatccatgatctcacatcaagggatgatgatgattcccttgtacccagtccccttatgctcaatagtgaaaatgtacaagaggatggggtctatttattggagaatggtgaggatggtctaatttatgtaggaaatatggtaaatccaggtaccctggaacaaatatttggtgtctcttctttggctgcattaccagtccagttggcattggatcaatttgacaatgaactctcgaggaaggttaacgaagttgtaaatgaaataagacgccagaggtgctcatacttgaggttaagactatgcagaaggggtgaaccatctggtgattttttccggtcatttttaatagaggacaaggcgcctggcgtcttctcctacgtggagttccttgtgcatgtccacaggcaaatccaaagcaagatgacctgagtcctgaggatccaggcaaaatccaaagcaagatgacctgagggcccagatcctggttgtaacatttcggtcagtagatggattgtaggtaccaaaaggagtttgatttctgcataaggagacagcaaagtggcgattccatatcaatgtggagcataaagtttgctcggataatggaactcaggaatagaggcttgtggtgttcatagcaccgtttttggagtgggtggtatatgtgttgtatacagagatgagaagcgtggagctttagttttttttttttgtctttatcattgtgcatccttcttgtttatcccttgtgcaaaaagggacggattatgttgaaaggaaggttatagaggtttggcaataaaatgcacctagctaattgatagtatgatatataatttaaatattatgtttgcct

SEQ ID NO: 13888 - DNA, 871 bp, Sorghum bicolor
  Clone ID: SORBI-28MAY03-CLUS17498_1
ccgggccggccgggccgggaaaggaacagcaagcagtcagcaacctacgatcggtagatctactagcgactgagtcgcgatcaggtaggcattagctagcactagcagcagcagcagccagcagaccgtcggcatggccaggtcgtcgtcgtcgtcgtcagctctggtcgtcgtcctcgtggttctggccgcggcagtggcgtgctccgcgacgcgccccgtccccgcgcagcaggaggcggtgtcgtcgtcggcggcggaagacgtgatgcggccggacacgctgcaggaggggacggtgctgatcccggggttgggccgcatcgagatcggcagccactacatcccggacatcggcgggctggaccacagcatccccgccgccacccacgcgcagtacatgcccggcgccgacgacacctgggtgcccaaccccggcttcgaggtccccaaccccttcctccccggcgcggccactccctgaacacgtacccgcgcgcgccgccggcgagaaggtggctctctctcggctctccatcgatcgtctcgcgccgccctgaataataccactagctagctactctactcgatctgctacgtatagctagctagcttagctagccgtgtttgcctgctgcatgcacgcatgtatttgtgtggtccgtcgcacgcatctgctgtccgtcgtcgtatttgtgcagtttgtgctagctccagtgtgaagtgtgtgcacgcgcgaagagtaggaagcatcagatctttggcccagctggttcttgggagtacttagcagcttgtttcacggtcactattattattattattattattatttacaaataaagttttgctggaggtagttatcatatct

SEQ ID NO: 13889 - DNA, 795 bp, Sorghum bicolor
  Clone ID: SORBI-28MAY03-CLUS14804_1
gcacgagggtccatgcgtcccccggccggccgggccgggaccacatacatcacccacacccatttatccctctccatcaatcaagaaataaacaagaaggttctgccaacttgctacttgctagctcaccacaatggcctcctcatcctccttctgcttcctactcgcggcggtggcattgacggcattgtttgccattggctcatgcggcactacgctcaccatcgaggtcggtaaggactccacctccaccaaactatccctcatcaccaacgtcgccatctccgaggtgtcggtcaagcccaagggagccacggatttcacggacgacctcaaggagtcagaacccaagacttttacgcttgacagcaaggagccgatcgagggacctatcgccttccgctttcttgcaaagggtggtggctaccgtgttgtcgataatgcgatccctgctgacttcaaggccggctcagtttacaagaccaccgaacaagtctaagcaatggacacatgtgatcatctgccgcattgagattatattgaccttaaataaattttctagagagaccaagggtacacaatgagcatgccgaaaattcattttctatgattattttgaggtaggctaccacgaaataaagtatactatgttctcccagagctatatgcacacactttaaaaaattgtttatgtatggtaaaatagtggccgtgtactttggttttctaaacttctaataactatatgtatgtaagaatcgatgaagcatgtttaccttggtagcaggaagaaat

SEQ ID NO: 13890 - DNA, 1302 bp, Sorghum bicolor
  Clone ID: SORBI-28MAY03-CLUS1914_1
ctgttgccggagccatcgatccaccgcaaacaagctcgacgacacaaagcagctagcatcgtagccagccagccgccctaaaaaccagccagctaaacccatggccgggatcgtggtggtgttcgacttcgacaagacgatcatcgacgtggacagcgacaactgggtggtcgacaacctgggcttcaccgagctgttcgagcgcctcctccccaccatgccctggaacacgctcatggacaccatgatgggtgagctccacgcggccggcaagaccctgggcgacgtcgccgaggtgctgagggcggcgcccatcgacccgcgcgtgcccgccgccatcaaggccgcgtacgcgctgggctgcgacctgcgcgtgctcagcgacgccaacgccttcttcatcgagaccgtcctggagcaccacggcatccgtggctgcttctcccagatcaacaccaaccccagccacgtcgacgccgacggccgcctccgcatcgggccctaccacgccgccccgcacggctgcggcgtcggcacctgcccgcccaacatgtgcaagggcctggtgctcgaccgcatcctccgcgaggcggccgccgggacgaccgggaggtcgacgaagcgcgtcatctacctcggcgacggccgcggcgactactgcccgtcgctgcggctggcccgggaggacttcatgatgccgcgcaggggttaccccgtgtgggacctcatccgcgaggaccccgcgcgggtgcaggcggaggtgcacccgtgggccgacggcgccgacctggaggagacgctgctgcgcctcgtcgggagggcgctcgtggaggaggccgcgctgccgccgccgctcgactgcaagctcgagtccaccatgcccgttgccgcgcaggacggcggcatgcccatcatgccgctcggcgtcaagaactgatgccgtcttgtctctggttgagaatctgatattattgccggttcgggttcgttgtgagagctcgagcaagtgcgggcgaggcacggcgtacgatacgatggattaatagtagcgtttgttaactgtattattgactaattttgtgtgcgtgtggtgtattccctccggatcgagcctgtcactgctgaattggctatggctcgttgtatcttctttgctaccgacaaaagataaaattaatggatgaaatcccttacgatttacgacaagcaaaaaaaaaaaaaaaaaagggcggctagcgcgggcatagaactctgtagccacaattacgcaattagcggcgaaattcattcaaatttagtgcg

SEQ ID NO: 13891 - DNA, 1571 bp, Sorghum bicolor
  Clone ID: SORBI-28MAY03-CLUS20727_1
cgcctccctccccgccggcccggacatcgcatcgcatccatcctcttcttccattcaccagttggtttggttggggaggagaggtagtgaggaggacccgaccgccgacctcccgatccatccatccgccatggacgcctcctacgaccgcgagttctggaacttcagcgaccagctgcgcctgcacaacaacttctccaacctctccatcgccgactccatctggtcctccaccacctcgccaccggatccctcctcctccttccccggcggcaataccaactccccgggcctcatcggatccgccaagctcgccttcggcaacgccacaaccaccagcgccgaccgctacaacgccaacgccgccggtgcaggtgcaggtgttggttccaacaacgccgccgctatcagcgtgaccgactactacctcaacaagaacaccaccaacgccaacgccggcaagaccatcagcgtgaccgactactacctcaacaagaacaacgccaacgccgccgccggcaagaccatgagcgtgaccgactactacctcaacaagaacaacgccaacgccaacaacgacgccgtcaagagctacttcaacaagtccgtcggcaggccagccaacaacaacaacaacaacaccgtcgtcggtggcaagaagaactccaccgccgccgcccaccacgacaagaagcacaagaactccggcaacggcaacggcgccggcgtcgacaagaggttcaagagccttccggcgtcggaggcgctgcccaggggcgaggccatcggcggatacatcttcgtctgcaacaacgacaccatggaggagaacctcaagaggcagctcttcgggctgccgtccaggtacagggattcggtgagggccatcaggccgggcctgcccctcttcctctacaactactccacccaccagctccacggcatctttgaggctgcaagcttcgggggatccaacatcgatccaaaagcttgggaggacaagaagtgccctggcgagtcccgcttccctgctcaggtgagggttgcaacgcgcaagatctgtgatccgctggaggaggacgctttccgccccatcctccaccactacgacggccccaaattcaggctggagctcagtgtccctgaggcgctctccctccttgatatatttgcggagaagatttttgcctgagtttggatgagttgacaggcagttaatatacatgttacataatatgtgcgtgtatgtatgtacgtgcttccttccagaggactagagagggaaggaataagagtataaggctgcatgtataatgttaacaatatgctggttagcagcatctgattatctatctagtatataagttatactggaactttgccgttttgtatcagatcagaagcaggcagcagcagaatgcccttttgtacccaagtttaggtgcggtgatgatggtgttatgccgccttcatcctattgtaacaaactacatacataaaaataccataccttcataaataaattagaggagtcggcctctgttcgaaaaaaaaaaaaaaaaaaggcccta

SEQ ID NO: 13892 - DNA, 1616 bp, Sorghum bicolor
  unsure (1)..(1616): unsure at all n locations
  Clone ID: SORBI-28MAY03-CLUS2043_1
nnctaagcgcagtagaatgtagaatagagcatggtttgtagaccaatgtcgaatgcgactaagagcggtcgccgttagcctattctcgtagaaaaaatgcaggagctctgccttcccattaccgaataatgtacggcatggctgatgagtactcatcagttctgtggccatctactctgcagngggatatgtagcacataaagccacgcattccttcgtcactaaagatgaaaaccagcttaggccttgtttggatactcttgtattcacttcattccacatgtgttggagtggattagggtggaacttaaactaatttacaccccaatccatcttaacacaagtggattgacatagatacaatggtatccaaacaatgccttactgagttagcgcaaagtgcacactaatcttgtaacaaacaatgccgggccccccccatccccgcagccgcaggagcaggtgccgagcagatagcgtggcgccaaaccagtgccgtccaactgaaccagtggacaggaggcaccccctgcaacgggctgcactcgactactcgaggggaggaccccgtctggccgtctccagttaaaccagtcgcctcatcctctatcccgatctcttcttttgtcgcctccgtgcgtgccccgggggccttcgcgcgcaacgatcagctcagtccggctgatgcgcatgctgccaacacccctccgccaatcgtgaaacacgacccgtcgtcgggtggtttgcttgtttggtcgtcgtcgccgatcctcgcggacgctcatggtcatggcgcctcagcctttgcgcgctctgaggccgagcgcccccgccgcaggccacgcggcgtgcaggtgctcggcggccgcgccgctcttcgggaagcgggcgcccctcgtcgtagcgttcccccgcgccggtagcggcggcggcgccgtcgtcgtctcgtgctcggccgtgcaggagtcgtccacctccaccaccgttagcaagaagaaggatgctgcggacggtgccaaggaggccacagcagcggcggcgaagccggccgcggctgccaagccaaagaaggccgcagcactgccgctgccggagatgatgcagcaggagatcatcccaccgctgaaggccgccttggaggcggaggatgacgtgtcccaggtcgagcttgcgttccaaaacaacacgctggaggggtccttcataaagaatgacgtcccttattatttttgggctttctttccaaaaggagatctcacaggaccgaagggctttgcgctatcgtcttacagcaacgaagtgagcaccatcgagccattcctgatcgacgagaagaggataacggccaagtacgtggtgttctgggtttacaagaggctggctgggcaaggcatccttccggtctggaaggaagaggagggggaggaggaggacgcgaagtagtaggttgcgcaggcacatacgcatacacacagggtgctgctgtgaacatacacacatgtaacgctgtaaagttaatctgctatctagtaaagttcatctgctgtgaacatacacatgtaacaaagatacttcagtttcagcagttaaaaaactttcttccgctgtgagataag

SEQ ID NO: 13893 - DNA, 1805 bp, Sorghum bicolor
  Clone ID: SORBI-28MAY03-CLUS221_1
actcgcctcctcccatggctcgcccccgcggcctcgtctgaccccccgccacgcctccccggagagcggcgcccgcgatctcgccggagatgtcgccgcctactactgcttctactcggacgtggccgtgcagttcctggggatggagcaggaggaggcgcagaaggacaggaacgagaccaggtccttcctgctgccgctctaccccagcgcgcgcccgggccgcgccctgcgggagttcggggacgtcaagctcgccgccaggaggatcgacgacggctggaggaaggctaggaacaagatggaggtcgcgaaggcggccgcggcggggaccaattccacggcgttgctcccgatcaagggcaatgtcttccccgatggccagtactatacatctatctttgttggcaaccctccaagaccatactttcttgacgtcgatactgggagcgacttgacgtggatccagtgtgatgcaccatgtacaaattgcgcaaagggaccgcatcctctatataagccaacaaaagaaaagattgtccctcctagagatttgttatgccaagaactgcaaggcaaccagaactactgtgaaacctgcaagcagtgtgactatgaaattgaatatgcagaccaaagctcctctatgggtgtccttgcaagggatgatatgcatctgattgcaaccaatggtggaagggaaaaactagattttgtctttgggtgtgcatatgatcagcaaggccagcttttgtcctcaccagcaaagaccgatgggatccttggacttagcaacgcagcgataagccttcccagtcagctggctagtcacgggattatttccaacatttttggccattgtatcacgagagagcaaggtggtggaggatatatgtttctgggagatgattatgtacctagatggggaataacatggacttctattcgaagtggtccagataacttatatcacacagaagcccaccatgtaaaatatggagatcagcaactccggatgcgtgaacaggcaggaaacactgttcaagtaatttttgacagtggaagctcctatacgtacctcccagatgaaatatatgaaaaccttgttgcagcaatcaaatatgcgtctccgggctttgtccaagacagctcagatcggacattacctttatgctggaaagctgatttccctgtgaggtatctggaagatgtcaagcagttcttcaagcccttgaaccttcactttgggaagaaatggcttttcatgtctaaaacattcactatttctcctgaggattacttgattattagtgataaaggaaacgtctgtcttgggcttctcaatggaacggagattaatcatgggtcaactatcatagtgggagatgtttctctgcgcggcaagttagttgtgtatgacaatcaacggaggcagattggatggacaaattcagactgcaccaaaccacaatcacaaaagggcttccccttcttcctctgacaagcatcgctagcaataatacatgtgtaaagcttaaatagtgaatgccactggtattctagaatttgctattaagtagaacctgcccttgtgtacggtatatcgttccatgggaactgtcagaaatcccccactctgtgttgtactcgtctgtaatgtgtatactgtgttgtacacttgtagtattatgtataatatacactgtctcctctacatggagtttttgtaaattagttacattatgaacattttcgacctaagttgactactgtacatatttgaccagggttttctttttcttttt

SEQ ID NO: 13894 - DNA, 979 bp, Sorghum bicolor
  unsure (1)..(979): unsure at all n locations
  Clone ID: SORBI-28MAY03-CLUS2136_1
ttggggacgggctcgcatcgcaccgcaccctctcgtcctcggggcgccgacgcggctcttcttccccaatcctccttccccgatccagtcccgcagcgacgccgaggcagagcgagaagagacagacacagatcgcgcgcggagatgtcgtcggactcctcgtcgtgggcgcgcgccctggttcagatctcgccctacaccttctccgccatcggcatcgccgtctccatcggcgtctccgtcctcggcgccgcatggggtatcttcattacggggagcagcctcatcggggccgccatcaaggcccccaggatcacatctaagaacctcatcagtgtcatcttctgtgaggctgttgcaatttatggtgtaatcgtggcaatcatcctccagacaaagcttgaaagtgtgccaacatctcaaatgtatgctccggagtctcttcgagctggctatgcaatctttgcatctggccttatcgtcggctttgctaatcttgtttgcggggtatgcgtggggataattggaagcagctgcgcactgtctgatgctcagaactcatcactctttgtaaagatcttggtgattgagatctttggcagtgctctgggactgttcggagtaattgtgggtatcattatgtcagctcaagcgacatggccagcaaaagcttgatttttcaacattagtagctctgtaaattactcggatggaatgtatcggaatgtgcatgtggtccaactgccttttcctgttctttttcttttgcatctttttggcagaacacgaaatctggcgcgcgtagcgttaccgattgtagagttgctattcctactgccggagtactccatgtgtgttggatatcttgtaggtgctgttgccgttgcaagacacacttggcattggcatattgaataaatgctttgaactgaataagagggaagttattanagaaaaaaaaaaaaaaaaaaggccccta

SEQ ID NO: 13895 - DNA, 1912 bp, Sorghum bicolor
  Clone ID: SORBI-28MAY03-CLUS4974_1
agtccaatccaatccctcgggcaatccatccatccatccagtgagcggagcgcgcggctcgaggggcgtccccccggccgccccccccccgccgcccccccccccccccccgcccggtccccccccgcctgcccccccccccctcgcctccttcttcttctactagttgctctgctccgctgttaccgaggcccggagggaggaaggagaggatggcggaggagacggtgcgggagctgcgcgcgagcttcgcggcggggcggacgcggtcgcccgagtggcgcgcggagcagctcaggggactcatccggatgatcgacgagaaggaggccgagatcagcgccgcgctccatgaagacctcgccaagccgcacatggagtcctatctccacgagatctcactgacaaagtcgtcgtgcaagtttgcgatcaacgggctcaagaactggatgaagcccgaaaaggtacctgcgtccataactacattcccgtcctccgctcaaatcgtgccggagcccctcggtgtcgtgctcatcatctcagcttggaactaccctttcatactctctattgacccggtcattggagcaatcgccgctggaaatgccgttgttctgaagccatcagaaatagcgccagctacctcgtcagtgttagcaaatctgctacccaagtatgttgataactcctgcattaaagttgtggagggaggcgttccagaaacaaccgcactgttggaacagagatgggataagatcttctacacaggtagtggaactgtagcacgcatagtgatggcagcagccgcaaagcatttaaccccggtggctttggagcttggtgggaaatcccctgttgttgtggattcgaatgttgatcttcatgttgccgttaagaggattgttgttggcaaatggggatgcaacaatggccaagcgtgcattgctccagattacatcataacgacgaaatcattcgcaccagagctggtggcctctttgaaaagagtcttggtaaggttctatggggaggatcctctgcaatcagcagacttgtctcgtattgtgaattcgaagcaattcaagagattgcaagatttgatagaggaaaaaagagttgctgacaagattgtgttcggcggcgaggctgatgaggagcaattaaaaattgctcctacagtattgttagatgttccccaagattcagcaattatgacaggggaaatatttgggcccttgcttccgattgtgacggtcgaaaagattgaggaaagcttcaacctgatcaacgccaagccaaagccactcgctgcctaccttttcaccaagaacaagaagctgcaagaggagtttgtagccaacgtccctgcaggagggatgcttgtgaacgataccgcgctacatctcgccaacccatacttgccctttggcggcgtgggcgacagcgggatggggtgctaccacggcaagttcggcttcgactgcttcagccacaagaaggcggtgctgatccgcggctttggtggcgaggcgaacgccaggtacccgccctacacgacggagaagcagaagatcctgagaggactcatcaacggcagcttcatcgccctcatccttgctctcctcggcttccccagggagaagcgttagatctatgatctatgatccgtcctcttgtcggatccggtacagcattttgttcgtgttcgtcgtcaggtgcacagtatacaccatcatatgctgtcaaatagatgcaacaactgcgtgccgtgtgctttgtgttacacggttgtataatgcatatatgttgtcacattgacatgtacgtaagggagtttgcataaataagtgttatgtgtctgtcaattattcagtgtgcagaatggatattggataggatgcgtggctgtggt

SEQ ID NO: 13896 - DNA, 767 bp, Sorghum bicolor
  Clone ID: SORBI-28MAY03-CLUS55925_1
agaaacgaataccacagcaggaaggcagaagctagcacacacacacacaccacacctgaacctcgatcacttgggtagctagtattagcaaccatgagtcgcctggaggaagtggcataccaactctcttcaccattagttcaggtacaatggctcttattgctcctcgttcctctcctgctccggctgcactactactacgcctcccgtcgacggtcaagccgccgtcatggcagcaactgcagcgacgacaagcagccgcagctgcagcttccgccgtcgcctccagggctgctgcccatcatcggccaccttcacctcatcggcgacctcccgcacgtctccctctgtgacctcgccgccaagcatgccgccggcggcgacggcctcatgctcctccacctcggcgccgtccccactctcatcgtgtcatccccgcaggctgcaaacgcaatcatgcgtacgcacgaccatgtgttcgcgtcgcgtcctgcgtccacggccaccgacgacctcatgtacggctccaccgacatcgccttctccccctacggcgagcactggcggcaggccagaaagctggtcacctcgcacctattcaccgtcaagaaagtgcaatcgtaccgcagcgcccgcaaagaagaggtgcgcctggtgctggccaagctacacacggcggcggcggcgaccgcggcccgcgccgtggcgggcgtgttcttccggttcgccaacgatgtcgtgagccacgccgtgacaggcaagttctt

SEQ ID NO: 13897 - DNA, 2746 bp, Sorghum bicolor
  Clone ID: SORBI-28MAY03-CLUS2514_1
gcacgaggccgcgccgcagctccatcacctccgagttctgatcaccgccgccggaaccggtacacggaaagtcggaagccaatggcgctcctcgcgccgagcccgcgcgcgctctgcgtgcgggaggccgcggcggcggcggcggcgccgcacccgcactcgctggcggccgccgcctgctcgaccgtcggcggcggcggggtggccggacgggcgctgtggctgtggaacggcggcgggacggggaggaggcgaagggagcgcgaggggaaggtccgggtggaggcgtacttctgggacgtgtccaagccggtggagatggaggagattgatagcatggagaagctcgacgacgcgctcaggtggtccgtcgagaacaaccagcccatcatcatcgactggatggctagctggtgtcggaaatgcatctacctgatgcccagaatggagaagatagcaggagaatatcctggagtgaggttttacttcattgatgtcaataaagttccacaagcggtggtgaaaagagggaatgtaactaaaatgcccactattcagctatggaaggatggggagtggaaagcagaagtaataggaggccacaaagcttggcttgtgatggatgaggttagagaaatgatccagcagaacaagtgactaacacccaagttatgcaatgggtattgtacttcgtttaatgtaaatagagacatcagacgatctcttcatatactaagctgaaatcaaatcaataaaaccatatttcagctccttatcatacccttaagaccctccaccgctcactctcccctttctttttcctctctttctctccccttcctttcttcgtggcgacgactgggcgagtgccgccgcccttcgccaggtcttcgccggcgacgagcacctacctaccaggtgaccctattcctgttcttctatccgtgtataatctccctttgcttcaatcaagcttttcaaacataataagcaaatagtctctgcacgtgattgccaaaattagtcaagacgggtgctctttgctgcgtggccgctaggccacatgggacaaagtctgaccctgcaagcagagatcgttctatggatcctactgagcctcgttggcgtataaactcgagcttctctcctccaacgtcaaggagatgggactgccgttattcatcagatggattgccccacagagttcatgatgctcctcatgatcacccaccttatgtttcatccctatcgtcccatagcaaaggaagcagaagtgcatttggcagtgatcagtacctcaatcaccatcattccgtgtctgatggagcactttcttactttgggagtccagctgacagccttcaggctccacgctggacaccctctcttcaaagatttgatctcggtgaattctctacccctgcaggaggatcaagaccagaaacttctgactatcctcagtcaagtgagaggccactgactgcaacaagcagtttcagttctgcatccccattttcagaatcaagccagctagcatcatcatctagtaaacaaccagccccatatctacctcgcaaccatatgggcaggcggtctttcatgtctaaaccagtctacccacttgtcttccggaatcctgtgtcagaatcagaagcgtgcaggatgcttgaggttactaatggcacgagggcgacaccaagtgatgacagtcaggcttctcctctgtggcgtcgcagcttggcgagtccagaactcaagttccataatgcactgaatgaacttgggaagatggaggcttcacctgggagccgaacacaagctcaagacgggtccggttcagatggagcaatgccagtagttatgattttggatatgatggagatgccattgacatttcagatcatatcagtattgagtcccagagatctcccacaagctcagtgaggttcctgaagtgtgggctgtgcgagagattcctgcgccagaaatcgccctggacctcgaaccggattgttcgaaacgccgacatgccagtagcagcggttcttccttgccgacatgccttccacgcggattgcttggaggaaagcactcccaagacagaagtccatgatccaccctgcccgctgtgcacgcgagccactgaagacgaagggcatgtgtcgttctcagaacctctgcatgttgccctccggtccgctcgcagcaggaacctttccttgggcagtggtgctggtgggagtagcagcagcgccaaccctccttgcagtgatcgtggcttgaagaggaaccattctgctatcgtgccgagacgcggcagtggtagctcattgttccgcaaccgcttcaagaagcagttccccttcaaagcgaggatcgggaaggagctttttggcggcagggttttcaacagggttggatcatcttcgtcttcaggtcagcagggtgaccatcgacagcaagctccaaagcatgaccgacccatgaagtagctagttaacttaatggcacagagtatatgttgtgtgccctcctgatattctatccatgtcatcagttatcatatttagtaagtataacctaaacctataatagcatgcgaaaaacttggcatccgtgcgcactagccagtcgtccaagatgaggctctgtatggaggctgcttgcattgcatgttgcacccaccattggctaactatgaggtgtattttggatccttacagtaagaatctatgctgcatgttct

SEQ ID NO: 13898 - DNA, 2277 bp, Sorghum bicolor
  Clone ID: SORBI-28MAY03-CLUS25269_1
agccagcggaggcggagaggagaaggagaagcagcagtagcagcagggccgccaacgcccaacgccatggcggtgggcgcgaccgccacgaagctgcacctctcgtcggcggccgcggccgcgcgccgcccctcgctgctccacctcgcggccgtcgccgtcctctgctcggtgtcctacctcctcggcatctggcaccacggcggcttctccgcgggccccgccgccgccggcggcggcgtctcctcctcggtctccatcgccaccgccgtctcgtgcgccaccccagccctgacgaccgcctcctcgtctccccccgcggggccgctcgacttcgccgcgcaccacacggcggaggggacggaggcggaggccgcgctccgccaccgcagctacgaggcgtgccccgccaagtactccgagtacacgccctgcgaggacgtggagcgctccctgcggttcccgcgcgaccgcctcgtctaccgggagcgccactgccccgcggacggcgagcgcctccggtgcctcgtgccggcgcccaagggctaccgcaacccgttcccgtggccggccagccgcgacgtcgcctggttcgccaacgtgccgcacaaggagctcagcgtcgagaaggcggtgcagaattggatccgcgtcgacggcgacaggttccgcttccccggcacgaggaccatgttccctcgcggcgccggcgcctacatcgacgacatcggcaagcttatccccctccacgacggatccatccgcaccgcccttgacaccggctgcggggtggcgagctggggagcctacttgctgtcacgcaacatccttgccatgtccttcgctccgcgagactcccacgaggcgcaggttcagtttgcactagagcgtgggcacgaggcgatgattggtgtccttgcctccaatcggctcacctatccggcacgttcctttgacatggcgcactgctctcgctgcctcatcccatggcaactttacgatgggctatacttgatagaggttgatcgtatcctaaggcctggaggttattggattttgtctggaccaccaatcaactggaagaaacactggaaggggtgggacaggactaaagaagacctggatgcagagcagaaagccattgagtcagttgccaagagcctctgctggaagaagatcaaggaggagggcgacattgcaatctggcagaagcctactaaccacattcattgcaaggccatccacaaagttatcaagtccccgcccttctgttctaaccaaaacccagatgctgcctggtatgacaagatggaagcgtgtataactccactcccagaggtcagtgacttgaaggaggttgccggcggtgcgttgaagaaatggccggagaggctaactgcagtgccgccccggattgccagtggcagcatcgagggggtcacggaagagatgtttgtggaagatactgagttatggaagaagagagttgggcactacaagtccgtgattgctcaactcggccagaaaggccggtaccgcaacttactggatatgaatgcaaagtttggcggcttcgctgcggcattggtaaatgaccccttgtgggtcatgaacatggtccctactgtggggaactcaacaacccttggggttatatacgagcgtggcctcattgggagctaccaggactggtgtgagggcatgtccacttacccccggacctacgacctcattcatgcagattcagtgttcacactgtacaatggcagatgtgaggcggagaacattctgctcgaaatggacagaattctgaggcctgagggcacggtcatcatcagagatgacgtggatctgttagtgaagataaagagcatcacggacgggatgagatggaatagccagatcgtggatcacgaagatggtccgctcgtccgcgagaagctcctccttgttgtgaagacatactggactctcgatgacaacaaacaatagcaataacgtggaataaaagagttagaatgattattgacatgatcggcaaatcttgtgactgcctcaccgtttgccctgtgaatctggtggagtttgttttctattttcattttgggtattcattttggggggatagttcacataatggagatataatctccttgtgttaagatataagagggaaacccggcacagattttgacataaaaaacagacattgggcaaagtggggtaaatagaaagtacaatattgggatcattttcgtctccgggtgcacatgtttg

SEQ ID NO: 13899 - DNA, 1418 bp, Sorghum bicolor
  Clone ID: SORBI-28MAY03-CLUS27039_1
aattcgacccgcgggatctttagctccggaccccgtgtggattagcccctggcacgatcgaggcggggcgccaattgcggtggccaccacctccaatccactccccgtggtcgcctggccgagctgttcttgctctgtcctctctccaactccaagatttgtctcacacccgattccttagcctccgcagcgcctcttcctgaaaaggaaacgcgagttcttcagctctagatcggtagagaggcggttgctttgcgggctctgaggttcagttcttgttcttgatttgtctcaccaacccatcagtcgggttgcaggcttagagctggaaggaataatttgactagagaaatggggcagtgttgcagcagagcgacggccccggactctggacggggaggcaccaatggttatggctactctaaccaggcaaagccagcgcaagcacctccgagttacaaccttcctcagcaggcggccgaggtgaggtacacgccgccggcgatgaacgcaccggtagtcccacctgtgactgtgccaccgaagccaacggcggacacgattcttggcaagcagtacgaggacgtgcgctctgtctactccctcgggaaggagcttggccggggccagtttggggtgacatacctctgtacagagattgccactggtaggcagtacgcctgcaagtccatctccaagcgcaagctcaccagcaaggcagacagggaggacattcgaagggagatccagatcatgcagcatctgtctggacagccaaacattgtcgagttccggggagcatacgaggacaagagcaatgtccatgtggtgatggagctctgtgcaggcggggagctcttcgatcgcatcattgcaaaggggcactacacagaacgtgcagctgcgacaatctgcagagcagttgtgaatgttgtcaacatttgccacttcatgggtgtgatgcatcgtgatctgaaacctgaaaacttcttgcttgcgaccaaggaggagaatgcaatgctcaaggccactgattttgggctttctgtcttcattgaagaaggaaagatgtacagggacattgttgggagtgcttattatgttgctcctgaagtccttaggcgcagctatggaaaagagatagatgtttggagtgcaggtgttattttgtacattcttctcagtggcgtgcctccattttgggctgaaactgaaaaggggatatttgatgctattctgcgtgaggagattgactttgaaagtcaaccttggccatcaatttctgagagtgctaaagacttggttagaaagatgttgacacgagatccaaagaaaagactgacttcagctcaagttcttcaacatccatggctcagagaaggtggggacgcatctgataagcctatcgacagtgctgt

SEQ ID NO: 13900 - DNA, 1614 bp, Sorghum bicolor
  Clone ID: SORBI-28MAY03-CLUS27873_1
ctgctcggggccgcactgctgccctgccatctcccataactcactcgcctccgcacgcgcacccgcctgtcccccagctcgctcgtgtcgtgcatccgtcccgccccccacccgccaagaactcgcattgccgccgccgagcccagccaggcaggggacggaggagctagcggccgcgtcggcgcgggaggaggaggaggagagcaggcggcggcaggatgttcgggagggacccctggggcgggccgctggagatctccaacgccgactcggcgacggatgacgaccggagccgggacctggacagggcggcgctgatgcggcagctggacgagacgcagcagagctggctcctggcggggcccggcgaccaggccggcaagaagaagaagaagtacgtcgacctgggatgcgtcgtcgtcgaccgcaagatcttcatgtggaccgtcggcaccatcctcggcctcggcgtcttcatcggattcatcatgatgatcgtcaagctcgtcccgcacaagcggcccccgccgccgccccccgaccagtacacgcaggcgctgcacaaggcgctcatgttcttcaacgcgcagcgatccggtccgttgccaaagcacaatggcgtcagctggaggggcaattcctgcatgaaggatggcctctccgacagcaccgtccgccggagcttggttgggggctactacgatgcaggggacgccatcaagttcaactatcccatggcctggtccatgaccatgctcagctggagtgtgatcgagtacagggctaagtatgaggccatcggtgagctcgaccatatcaaggagctgatcaagtggggaacagactacatcctcaaaacattcaattcatctgccgacacgatagacaggattgtcgctcaggtgggtgtaggtgacacctctaaaggtggcagtcagcctaatgaccattactgctggatgagaccagaggacatcgattacaaaaggccagtcactgagtgtcactcttgctcagatctagcatctgaaatggctgccgccctggctgcagcttccatagtgttcaaggacagcaaaacctactctgacaagctcgtcaaaggtgcaaaagctctgtacaaatttggcaggctgcagcgcgggcgatacagccccaatggatccgatcaggcaattttctacaattccaccagctactgggatgagtttgtgtggggtggtgcgtggatgtacttcgccacagggaacaattcatatctcacagtcgccacagccccaggaatggcaaagcatgctggagcctattggtttggaagtccaaactatggagtatttacctgggatgacaaacttccaggagctcaggtccttctcagcaggctgcgactcttcctaagtccagggtacccttacgaagaaatactgaggacattccacaaccaaactgacaacgttatgtgctcgtatttacctctattcaattcattcaacttcactaaaggaggattaatacaactcaaccatggaaggcctcaaccacttcagtatgctgtcaatgcagctttccttgcttctttatacagtgattatcttgaagctgcagacacgcctg

SEQ ID NO: 13901 - DNA, 1607 bp, Sorghum bicolor
  Clone ID: SORBI-28MAY03-CLUS2645_1
gagcccctcaccacgcttctcgaaccttctcctttctccacccgcaacctcacttccctcccccttcgcatccgcacgaacgaagccgcgcgagcgaggagcagacgcgccttcccgacctcgaagcgtctcctctccctcttcgagcggcagccatggcgaccgtcatgcagaagatcaaggacatcgaggacgagatggcaaggacacagaagaataaagccactgctcaccatcttggtcttctgaaggctaaacttgcaaaactgcggcgtgagttgctcactccgacatccaaaggtggtggtggtggtgctggtgaaggatttgatgtgacgaagagtggagatgcacgtgttggtttagttggctttccttcggtcggaaaatcaacattgttgaacaagctgacggggacattttcagaggttgctgcctacgagtttacaactttaacatgtatccctggagttatcatgtataagggtgctaaaatccagcttctagatctcccagggatcattgaaggtgctaaagatggaaagggcagaggaagacaggtcatcagcacagctaggacatgcaatgttattttgattgttcttgatgctataaaaccaataactcacaagcgtcttatcgagaaggagcttgaaggatttggcattaggttgaacaagacaccacccaatttgactttcagaagaaaggacaagggcggaatcaacttcacatcaacagttacaaacacacatttggaccttgatacagtaaaagcaatatgcagcgagtacaggatacataatgctgatgtctctctgagatatgatgctacagcagatgatctcatagatgttattgaaggaagccggatttacactccttgcatatatgttgttaacaagattgatcagataacacttgaagagctggaaatcttggacaaacttccccattactgcccggttagtgctcatcttgaatggaatcttgatggacttctggagaaggtatgggaatacttggatttggttaggatatacacaaaacctaaagggctgaacccagattatgaggatcctgttatcgtatcatctaagaagaaaactgtggaagatttctgcaacagaatccacaaggacatggtcaaacaatttaaatacgctctagtatggggttccagcgtcaagcataagccacagagagttggcaaggagcatgaacttgaggatgaggacgttgtccagatcattaagaaaatataggcatatcatatggtggaacaaaacctgcttttctgcaaaactggaaggagcaatgaggattttgagtagtagcctcgtcagaagagcttgaactcggcctttgcttgttggtgatgctcatatgtaatgttccttgttcgcagaaaatttgctttgatataaagacaatgttagttgacatttccttatacaagtcatgtagctgtgatattcttctctctaacttggtgccatatggactggagtcaccgatgtaccaagtgtctgcaacaaccgttgaacacatggagagatgctctccatatctttagaagataatgataagaagattcggtgatccgt

SEQ ID NO: 13902 - DNA, 352 bp, Sorghum bicolor
  unsure (1)..(352): unsure at all n locations
  Clone ID: LIB3481-012-Q6-K1-E7
cgtccgaaatccggtcgaccacgcgtccgcaaactggaaggagcaatgaggattttgagttcaagctcttctgacgaggctactactcaaaagagcttgaactcggcctttgcttgttggtgatgctcatatgtaatgttccttgttcgcagaaaatttgctttgatataaagacaatgttagttgacatttccttatacaagtcatgtagctgtgatattcttctctctaacttggtgccatatggactggagtcaccgatgtaccaagtgtctgcaacaaccgttgaacacatggagagatgctctccatatctttagaagattatgataagaagattcngtgattcctg

SEQ ID NO: 13903 - DNA, 1961 bp, Sorghum bicolor
  Clone ID: SORBI-28MAY03-CLUS2780_1
gcacgaggcaaaaaagcacgcgccgaaagctcccatcccggacgggaagacgactttggtgctcgtgctgccgcgagatctaaccaaaccccgcgccctcctcaccgtccggcgagctacggactcagcagaccaccggagctcgagtggtacctgaaggcgcgccgtggaaccggccacgagataagggcggcggccggacgctcgggcggcgggaaggcgggcgacgatgccggtggcagcgtcggccatctacttcctcaacctccgcggggacgtcctcatcaaccgcctctaccgtgacgatgtcgggggaaatatggttgatgcattcagaatgcatatcatgcaaacaaaagaacttggcacgtgtcctgttcgccagataggaggctgctccttcctttatatgaggatcagtaatgtttacattgtgattgttgttagcagcaatgctaatgttgcttgtgctttcaaatttgttgtcgaggcagtggctctcttcaagtcctacttcggtggagcttttgatgaagacgctatcaggaataattttgttttgatatatgaacttcttgatgagatcatggattttggttatcctcaaaatctgtcacctgaaatcttgaagttgtatataactcaagaaggtgttcggtcaccattttcctcaaagccctcagacaagcctgttccaaatgcaactcttcaagtcactggtgctgttggttggagaagagagggacttgtgtacaagaagaatgaggttttcttggacatagttgagagtgtaaaccttcttatgtcttcgaaagggagtgttctaagatgtgatgtgacgggaaagattcttatgaaatgcttcctttctggaatgcctgatctgaagctgggactaaatgacaagattggacttgaaaaagaggcccaactaaagtccagaccagcaaagagtgggaagaccattgaacttgatgatgtcacattccaccagtgtgtcaacttaacaagatttaactcagaaaagacagtcagttttgtaccaccagatggtgaatttgaattgatcaagtatcgaatcacagagggtgtaaacctcccattccgtgttctaccaacaatcaaggaattgggccgaacacgcatggagatcaatgtgaaagtcaagagtgttttcggtgctaagatgtttgcacttggtgtcgtcgttaaagttccggttccaaagcagacggctaagactagtttccaaacaacgtcaggcaaagcaaaatacaatgcttcgattgattcactggtgtggaagatcaggaaattccctggacagactgaggcaactatgagcgcagaggtggagttgatctctaccatgggtgaaaagaagtcttggaacagaccacctatccagatggaattccaggttccaatgttcactgcttctggtttacgtgttcggttccttaaggtctgggagaagagtggttacaacactgttgagtgggttcgctacatcacgagagctggttcatatgagataaggtgttagcaacaaattcatacaagattaaggtattagtgacaaccgatatttgtcggtctgctttgagcagctatccacagagatcactctgtggcatcatgcatgatcataaagcgcgtatattgtgacacaaatatctgaaactttgtacttcaacagagggtggggcagggcagaccagacaattttctttgtgtttctaatttccattgtagtctgggatctctgttctcccctccatgccctgtttgtagtagggagttttttttgcctgtatatttggctgtagctttccttgtttgttgatcaatacacccgttcagtttgtattgttttctccttcaaatggatcaatggattcacttgcataacagtgtacaaacattcgctgccaaagatctggtaaatcgtagtgtttgcc

SEQ ID NO: 13904 - DNA, 680 bp, Sorghum bicolor
  Clone ID: SORBI-28MAY03-CLUS280_1
gccggccggccgggggctcaagccatcccatccaccaccaccaccaccaccaccccgccggccacactccgtctttctcacgagccacagcgcaggggatggcgtcgttcgccgtggcaacgatcccgtcgctggcggccccggcggcggccaagaagcggtccagcggcggcgtcacgtacgtggagggcatgaacgcctacagcggcctcaaggggctcaacaaggtgaacatgctcggggtgcgcaagaccgccgactactccttcgccaagatcgtggcgtcgctcagccccgcgggcaagaaccggcgcggcagcgcgttcggcgcccagatgaacgtcgccggggagatcttcaggatcgccgccaccatgaacggcctcgtgctcgtcggcgtcgccgtcgggttcgtgctgctccgggtggaggccgccgtcgaggaggccgagtaggatgcgcgcgcctctgcccgcgtaacagccgctcactcggctgtcgcctctcgccctcctctgcttcataagccgtgatatatataaaacgtgatgtatgctttcgattcaattacttttggtatgtaatcaatgacaattgatcgatactgtggaaacatgtttttggagtcgaggtctgcaattgatcaccaaaagcaaaaaaaaaaaaaaaaaaggccccta

SEQ ID NO: 13905 - DNA, 1560 bp, Sorghum bicolor
  Clone ID: SORBI-28MAY03-CLUS28045_1
gcacgacacagcaaagaacccctcactctctctcctctctcctctctcttaccgcacatgcgcgtcggtccgggaagctgcctgctgctgccgacaaccgcaaccacaatggccgtcgcccacgcgccgcagcgccgccggggcgtgctcctcctcgtgctcgtcgccgcgctcgtggcggcgctgccggccacctgcgccgcggccaggagcaagagcaagaagtcgtacacggccatcttcagcttcggggactcgctctccgacgccggcaacctcatcgtcaacggcacgcccaaggcgctcaccaccgcgcgcccgccctacgggatgaccttcttccgcaagcccaccggccgctgctccaacggccgcctcgtcgtcgacttcctcgccgagcatttcgggctaccgctgccacagccgtcacaggccaagggcaaggacttcaagaagggcgccaacttcgccatcaccggggcaacggcgctggagtactccttcttcaaggcacacggcatcgaccagcgcatctggaacaccggctccatcaacacccagatcggctggctccaggacatgaagccgtctctctgcaaatcggaccaagactgcaaggattacttcagcaagtccctgtttgtggtcggggagtttgggggcaatgactacaatgcgcctctgttttctggtgtcaaattttctgaaatcaagacttatgtgccccttgttacaaaggccatcgccaacggcgttgagaaattgatcgagcttggggcaacagacttattggtgccgggcgttctcccaattggttgctttccattgtacctgacgttgtacaacaccagcagcaaatcagactacaacgcccgcaccggatgccttcggaggtacaaccgcctcgccttccaccacaacagggagctgaagcagcagcttgatgagcttcagaagaagtaccccaagacaaaaatcatgtatggggattacttcaaggctgcaatgcagtttgtcgtctaccctggaaaatttggtttcagcacggctttgcaagcatgctgcggcgcaggagggcagggcaactacaacttcaacctgaagaagaagtgtggcgagcagggcgcaagcgtgtgctccaacccgtcgtcgtatgtgagctgggacggcatccacatgactgaagctgcatacaagaaggtcgccgatggctggttgaatggcccgtatgctgaacctccgattctcaagtcataattgagatagctaaactgtatgtaacaccgccgcagcagctgcaaacggctagagatatgaggagtgtttcaggcaatagataagatatgttccggttctcgagtcacagttaagttatgggtaaggtaaagctgttttagtctggtcattgaaagatttgttgtataaactgtgccggtatagatatgttcccagctgaaatggctgaagtacagatgcaccgtggatgacatgtttcctgattcttttcatttttcaaatattaaggcaacaatgagataataaaagtaactaagtttctgc

SEQ ID NO: 13906 - DNA, 1564 bp, Sorghum bicolor
  Clone ID: SORBI-28MAY03-CLUS9647_1
gcctcgagtcgatcaccaaggctccggtgatccaccacttctctgagacggttcaaggtgtcatgaccatcaggtgcttcaggaagcacgagagcttcttgcaggagaacctgaaccgggtgaactcaagcctgaggatggacttccacaacaatggtgccaacgagtggctcggattccgactcgagctgattgggagctttgttctctgcttcacagccgtgatgatggtcacattgccaagcagcatcgtcaagccagaatatgttggtctatcactatcatatggtctatctctcaaccaggtgttgttctgggccatctggatcagttgcttcattgaaaacaaaatggtctcagttgagaggataaagcaattcacaaatattccttcggaggccgcatggaggatcaaagactgcctaccagattctaactggccaacaaaaggtgacatcgatgtcattgatcttaagtttaggtataggcacaacactcctctagtgttgaagggcatcacaataagcatacatggaggagagaagattggagttgtcggtagaactggtagtgggaaatcaacactgatccaggcattgttcagaatagtggagccttctgaggggagaatagtcatcgatggtgttgacatctgcactttaggactccatgaccttaggtcacggtttggtatcatccctcaggaacctgttctctttgaagggaccattaggagcaatattgatccacttgagcagtattctgatgatgaaatctggcaggctttggaccgttgtcagttgaaagaagccgtggcttcaaaacccgaaaagcttgatgcttcagttgtcgacaatggtgagaactggagtgttggacaacggcaactgctatgcctgggccgggtgatgctaaagcgcagcagaatactgttcatggatgaggccactgcttccgttgattcccagaccgatgctgtgattcagaagatcatccgggaagactttgcagcttgtaccattatcagcattgcgcacagaataccaacggtgatggactgcgaccgggtcctggttatagatgcaggactagcaaaggagtttgaccgccctgcaaatctgatcgagaggccatctctctttggagccttggttcaagagtacgcaaaccgttcgtccgacgtttagtacttcggggtggcataatttttgactcaagacctgcgaggaaatagtgattggaaaattctcggtgtggtgaacgaggaagctgcattcatgctccaaataaaactgcgagccctcaaaattttgcgagacgtaactaggtcatgtggaaggccagagaaggagaaaccacgatgtgatgaaggcatcaagatgactaagataagtagatctcacatgtatttcagccggttgagccgaaattttaagactgagctgaagacgatgtattaatatatgtactgttcagctagaatattattgcgcacgcaaattttctgccgactgttcttctatatggaactgacaatcacgaaaattgcaagaaatattacgcc

SEQ ID NO: 13907 - DNA, 1135 bp, Sorghum bicolor
  Clone ID: SORBI-28MAY03-CLUS1260_1
gcacggcccctgccctaactctcctctcctagcatagggtttatcttctcccatactctgccccccgactcgcttctcgcacacggcagccggattccgaagcacccccagccataagcttctaatcgtttagagagcactcgagaatgtcgtccgtgcagctctctggtgccggagtcgcggctgtggccttcacgaacaagagcctcgtctctcagcccgcagctctccgggtctgctcgtcaaggcgctcggtccgtagcctggtcgtgaaggctgccaccgtcgtcaccccaaagtacacttcactgaaacctctgggagatagggtgcttgtgaagcttggtgccgcagaggagaagacagttggtggcatcttgcttccatctaccgcccagaccaaaccacaaggaggtgaggttgttgctgttggagagggaaggaccattggagacaagaaagtagcggttgatataaagactggagcacaagtagtatactcaaagtatgctggcactgaggttgaattcaatgactcaaagcatcttattctcaaggaagacgatgtcatcggtattcttgagacagatgatgcgaaggatatgaagcctctcaatgaccgtgttctcatcaaggttgcagaagctgaagagaaaactcctgggggccttatcctcactgaaacagctaaagagaagccgtccatcggaacggttgtagctgttggcccgggtcctctggacgaggaaggcaagaggcagccactgtcagtgccggcgggcagcacggtactgtactccaagtatgcagggagcgagttcaagggcgctgatggcacgggctacattgtgttgagagcgtcggatgtgatggctgtcctgtcttaagccttgcgtttccagctctttctgtagtttgcagccaatagttgtgaagtggtatgaaacgatcgctttgtggtgatcatcacaaaatgctgatactgttccggacaatcggctagaatttgggtcgacacgagttacgggctacctgtgagcttataaacatcagcatctgatagtgaattcactcggttgtttttacaaaggatcaaaaaaaaaaaaaaaaaaaaaaaatctttgcttcttcttac

SEQ ID NO: 13908 - DNA, 2398 bp, Sorghum bicolor
  Clone ID: SORBI-28MAY03-CLUS31192_1
gcacgaggcttcgacgtgtccttctatggcgcggacttcgtctacggtctcccggagcacgggtccacttcgctcgccctcctccccacccgcggcccgggggtcgaggagtccgagccctaccgcctcttcaaccttgatgtcttcgagtacctccatgaatcgcccttcggtttgtatggctcgatccccttcatgattgggcacggtgatcgggcgtcgtctggcttcttctggctcaacgcagcggagatgcagatcgacgtgcttgcgccaggttgggatggggccactgcccaggagaatgggcagatcgacacactgtggatggctgaggctggcgtggtcgatgcattcttctttgttggttctgagccgaaagatgtgatcaagcagtacataagtgtgacaggcacaccttcaatgccacagcagtttgctacagcgtatcaccaatgccggtggaactaccgggatgaggcagatgttgatggagtagatgctggttttgatgagcatgatattccatatgatgtcctctggcttgacattgagcatacggatggcaagcggtactttacatgggatcgttctgccttccccaatccagaggagatgcagcgaaagatagctgataaggggaggaagatggtcaccatcgtggatccccatatcaagcgggacagttcattccacctccatcaggaggcaacagacaaggggtactatgtgaaagatgccaatgggaatgactttgatgggtggtgctggcctggatcatccgcccgccccccctcgtgctcccccgagctacgtgagtggtgggctgacaagttctcctatgaaaactacaagggatcaactccaacactgtacatttggaatgatatgaatgagccatcagtcttcaatggccctgaggtcaccatgcccagggatgcaatgcattatggagatgctgaacaccgagaattgcacaatgcatatgggtactacttccatatggctactgcagatggacttctcaagcgaggcgaggggaaagatagaccctttgttttgtcaagggccttctttgctggaagtcaacggtatggtgcagtttggacaggcgacaactccgcagactgggatcacctgaaatcttctatcccaatggtcttaactcttggtcttactggcttgcctttctctggcgcggatgttggtggattctttggaaacccagaaccagacctattggtgcgttggtaccaagtaggagccttttatcctttctttaggggtcacgcccatcatgacacaaagagacgtgagccatggttatttggagagcgaagaactgccatcataagggaggcgatacatatgcggtattcattgttgccctacttctacacgctgttcagagaggctagtgtaaatggcattcctgtcatgcgtcctttatggctagaatttcctgatgataaagaaacatataacaatggggaggcgtttatggtggggccaagccttttagctcaaggaatatacgaagagggccagaaatcagtgtctgtctaccttcctgggaaggagtcatggtatgacttgagaaatggatctccatacaagggaagtgtgacacataagctacaggttttagaagatagcattcccagcttccaaagggctggtacaattgtgccaagaaaggacagattcagacgcagttctactcagatggtgaatgatccatacactctggtgatagctctcaacagttcaggtgctgcagaaggcgaactttatgtggatgacgggaaaagttatgattaccagcaaggggcattcatccatcgccgatttgtctttgcagacaataagctaacttcgttcaatattgcacctgacaatttgggcaagaaatttgcaagtgattgcgtgattgaaagaattatagtcctcggtttacgatctggagcaaagaaggctattattgagcctggaaaccaagaagtagaaattgaatcaggaccgattagtttaaggagtggttccagcccggttgcaccaacaatccggaggcccaatgttcgcattgcggacagttggacaataaggatagcataagaggtaggccattcacatctggagcctgatgtctcttctgttcactgtcaggttgcaaaattaggccaacatttagaggtttagttgcggccttgatcattgcgcaaatcatcatggtcttgtggccacaaaatatttacatgtaactggtactcatgctgttcccaactgccaattttgacataaatattgagacagtgctgatgtatatttgtagctttgatacattagaacttgagtttattatcttgctaaagtaatatacaaattctcagagaacatt

SEQ ID NO: 13909 - DNA, 1424 bp, Sorghum bicolor
  Clone ID: SORBI-28MAY03-CLUS37208_1
gcacgagggcagctcgtcatcttctccgccatcgacgacctcgtccgacgcacggggctcaagcccaaggacatcgacatactcgtcgtcaactgcagcctcttctcgcccacgccgtcgctgtccgccatgatcatcaacaagtacaagctccgtagccacgtccggagcttcaacctgtcggggatgggatgcagtgccgggctcatctccatcgacctcgcgcgggacatgctccaggtgcacccgaactcgaacgcgctggtggtgtcgaccgagatcatcacccccaacttctaccaggggagccggcgcgacatgctgctccccaactgcctgttccggatgggcgcggcggcgatcctgctgtccaaccggcggcgcgaggcccggcgcgccaagtaccggctggtgcacgtggtgaggacgcacaagggcgcggacgaccgcgcgtaccggtgcgtgtaccaggaggaggacgaccagggcttctcgggcatctcgctgtccaaggagctgatggccatcgccggcgacgcgctcaagtccaacatcaccaccatcgggcccgctggtgctccccatgtcggagcagctgctcttcttcttccgcctggtggggcgcaagctcttcaacaaggcctggaagccctacatcccggcacgagggctggcgttcgagcacttctgcatccacgcgggcggccgcgccgtcatcgacgagctgcagaagaacctgcagctgtcgccgcgccacgtggaggcgtcccgcatgacgctgcaccgcttcggcaacacctccagcagctccctctggtacgagctcgcctacatcgaggccaagggccggatgcgccgcggcgaccgcgtctggcagatcggattcggcagcgggttcaagtgcaacagcgccgtgtggaagtgcctccgcagcatcaagacgcccaccaacgggccctgggacgactgcatccaccgctaccccgtcgacgtcccggaggtcgtcaagctgtgaccgacgggctacggctacgagagagctcgaccgccgccgccatactgtcccccctgtacgtcccgcgaagcatttcgcttaaaatttggagttttttttttctgttccttcttctctgctgtcctcttctcttccttttttctttgctattaaaaatggtaaaaagaagaagaaagatccatatatactctgattgttgcaagctagtatcacacgacgaatgatcatcacagggagattaattaaattagctcttgctggatgtgtagcgttggcgtgctgtcagaattgtcatctcccaggggactgggtgattggaatttacttgaatgaggagtcgagcacttgtaaagtgtaatccatgttgtaaccggtgaaagggatacatgcattctcctgatagtgaccc

SEQ ID NO: 13910 - DNA, 851 bp, Sorghum bicolor
  Clone ID: SORBI-28MAY03-CLUS37323_1
gcacggcgcgaggggtagctcggatatcttcaaagagagacaagagggggaaccgaaggaagagcagggcaggggaagctgagcagcggcgtggggacgcaggcgcgggcgttcgcggacgaggtgcgcggcggcctggagcagaagaactggatgctggacctcggccacccgctcctcaaccgcatcgccgagagcttcgtcaaggccgcggggatcggcgcggtgcaggcggtcgcgagggaatcgtacttcatggcaatcgaaggcgagggaggatctgtgtcaggcgccaccggctcaaggaaacgctcgttcccggagctcaatgggacgaacagtagtagcaagtcggcagaggccatggtgaaaaacgtgagcaaagagtcgttacagtgggggctcgcggctggggtgcactctggcctgacctacggcctcacggaggtgcgcggggcgcacgactggaggaacagcgccgtggccggcgccatcacgggcgccgcggtcgcgctcacgtcggagcacgcgtcgcacgagcaggtcgtgcagtgcgccatcaccggcgccgcgctctccacggccgccaacgtgctctccggcatactctgagccgcccggaagccgcagccgtgctgtgccggcgctcgattcagaggatcgccgactagtcctgtcccctaaaatcgtttgggggcaccgtcaccctcgcatgtcgcgcattgttatgcttcactaggcccttgtgtacgataacttgggacgttgtattcatgctttgagctgctggtactatcgtgtaattgaacttcagttacaaattatgttctaagtttgctgctaaaaaaaaa

SEQ ID NO: 13911 - DNA, 766 bp, Sorghum bicolor
  Clone ID: SORBI-28MAY03-CLUS38578_1
gcacgaggaaacattgcgtccagaaccttgcgtggaagggtattctacacctgggggttattctgcaagagctgtgcaccctatagcgcttgctaaagtcatgcagatagcgaggatgatgaaagaagaatttgctgatggacagtctctctcagccattggtggtgtggagactggcaatgatgctgctgagtttattcttcttggtgctgatacagtacaggtatgtaccggtgtgatgatgcatggttatccccttgtgaagaagctttgtgcagagttacaggatttcatgagagagcacaacttttcatcgatcgaagagtttcgaggggcctcgcttccatacttcacgactcacacagatttggttcaccggcaacaagaggcgatcaagcaaaggaaggccatcaagaagggtcttcaatcagacaaggactggacaggcgatgggtttgtcaaggagaccgaaagcatggtatccaactgatgcatctctgctatcccccccatcccttccaccatgcttcaacttgtgactaaatcatgttcgaggagagacagtgtgaaacatttgcttcatcctttaaaataagcgcgctgcaccagaatgccatacaccaagcatgtaaacctcatctgtacatggttctgaaccttggaccttcagtctatagaacaagtcatgaatccacaacaagtcgtttccagcatcctgatatttcgtgaaaagcgggtaacattgtgcaatacatttgtcatgtgg

SEQ ID NO: 13912 - DNA, 1274 bp, Sorghum bicolor
  Clone ID: SORBI-28MAY03-CLUS4415_1
gtccgcgccggccccccgtccccccctccccgcccggccctccccccctcccggcccgtcctgtgggcgtgctagacccccgtcccgtcctcgtcgcgcggcccaaaagccccgcacccaacccccagcccggcgagcgatggaggggtccgcggccgacgcggagcaggagcaggagcagaagcgggcggcggcggcggcggcgtacgactacgagggcgacgcgcgctgggccgactactggtccaacgtcctcctcccgccgaacctcgcctcccgccccgacgtcgtcgaccacttcaagcgcaagttctaccagcgctacatcgaccatgatttggtcgttgagccgaggtcattcactggttccactcagcccagcaggccagatgtaaggtcttcgtcttcgtcatccagcgagaacgtcagggcacgtaattcaggatctacttcgaggtcagcgccttcaccgccgccaacaacacaaacagacagtgctgccaatcctttacggttcgatgcacggactatacatttctccatcaacgcatggatacttgtggtttctggtctgggaatgcttcctattttgccaaaacaccttgctgaccgagcttgcaaactttcactgctgggaacaatactttcgtcaggatattctctatacagcacttatgggaaaccaagacttagttcaaatgctgaaattgccttgggttttcttctgatcatatcgctgctctcgtggcgccggagcataattcagacattcatgtactggcaggtattgaagctgatgtaccatgctcctgtgacatccagctatcaccagagtgcctgggcgaaaatcggcagaattgtgaatccgtacatccaccgctacgccccattcctccagacgcccatttctgcaatccaaagatggtggttcaggtaaagagacaggcgggtaaaaaaacatgtatctgttgctgaatcactgaaccgcctgggtggtttaagatgggctacacagaacatagcacagcctccgcgttcgtatgtaatgctgcagcagtgcactgtataatataacatttgcgggatgactgatatcccagaattctggagggccttatcgtaacaagaaggtttgctgtatgtctgtaaactatgaggttgcagggatgaccattgaccaacaatgctgaattgcaatccgtgggctaacgtaactatgttccatgcttttcagtcacacaatccactggcagtatatgtacattagttgttgg

SEQ ID NO: 13913 - DNA, 947 bp, Sorghum bicolor
  Clone ID: SORBI-28MAY03-CLUS43207_1
accaggcacgctttgcacttgaattccctcatctccaatccaagtgcgtgcgtgccccccggccggccggccctccttctccgctaccagccatgccgtcgccgttctccgtcccctcgctgatcatggaggaggaagggcggttcgaggcggaggtggcggaagtggagtcatggtggacgacggagcggttccggctcaccaagcgcccctacaccgcccgcgacgtggtcctcctccggggcacgctccgccagagctacgcgtcgggggagatggccaagaagctgtggcgcacgctcaaggcgcaccaggccgggggcacggcgtcccgcaccttcggcgcgctggaccccgtccaggtcaccatgatggccaagcacctggacaccatctacgtctccggctggcagtgctcctccacgcacacctccaccaacgagcccggcccggacctcgccgactacccctacgacaccgtgcccaacaaggtggagcacctcttcttcgcgcagctctaccacgaccgcaagcagcgggaggcgcgcatgtcgctgccccgcgccgaccgggccagggcgccctacgtcgacttcctcaagcccatcatcgccgacggcgacaccgggttcggcggcgccacggccaccgtcaagctctgcaagctcttcgtcgagcgcggggcggcgggcgtccacctcgaggaccagtcgtcggtcaccaagaagtgcgggcacatggccgggaaggtgctcgtcgcggtgtcggagcacgtcaaccgcctcgtcgccgcgcggctccagttcgacgtcatgggcgtcgagaccgtcctcgtcgcgcgcaccgacgccgtcgccgccacgctgatccagaccaacgtcgacgcgcgcgaccaccagttcatcctcggcgccaccaacccgcgcctgaggggacagagcctggcg

SEQ ID NO: 13914 - DNA, 1810 bp, Sorghum bicolor
  Clone ID: SORBI-28MAY03-CLUS46270_1
tgattttgtagtagcccagtgtactctaaccgttcccatcccctcgccgttccgccgcgattcacccccgccacgcccgccgccgtcgacgcaaagccgcgcgcgaggcctctccccttcgccagcagcgatgaagctcgtccaccgcaacctcgtccgcaacgggcctggctccgtcaagttggtgccggaggaagaggacgacttgtggcacgcgtacaacctcattgctgtcggtgacaacctccaggccgtcaccgttcggaaagtgctgagagaggtggcatctggaggacgtgatgccgagcgtgtgaagcttaagttagaaattgtagttgagtctgtagactatgacaaggagggatctgtcttacgtgtgcgtggaaaaaatatcactgagaatgatcatgtgaagattggccagttccacacattagagcttgagctgaaaagaccttttgttctacgaaaggaaatttgggattggttggcacttgagaccatccagcaagcatgtgatcctgctgcaagtgctgatctagcagttattctcatgcaagaaggacttgcccacttattcctcattggcagaagcataacagcaacccgggcacgtattgaaacatcaattccgaggaagcatggccctgcaattgctggctacgagacggccctcaagaagttctttgagcatgttttgcaagtaagctattcacacgaagttatgcaaatgtgaacatgcatacagacaacaattgaccgatgcattacattacttggttgaaggcattgctgaaacacattgattttgaagtagtccagtgtgttgtaattgcaagcccaggttttacgaaggatcagttccgtgattatttgtttcttgaagctgcacggcgagatttaagagtaataattgagaacaagcaacgccttgttctggcacatgcaacatcaggttacaagcatagtttgaaggaagttttggatacccctggtgtgatggcactgataaaagatacaaaagcagcacaagaggtccgagctctgcaggatttcttcaatatgcttactaatgacccagctcgtgcttgttatggaccaaagcatgttgagattgcacatgaacaatatgctgctgtccagactcttttaataactgatactttgtttcggaacactgacattgctacgaggcaaaagtatgtgaacttggttgaaaatgtcaagaaaagtaatagcacagtgcacatattttcctcaatgcatgtctccggcgaacagttagcgcaactgacaggaatagcagctatacttcgttttccccttcctcaactagaggacatcgagatgtgatgacaccaacctttttgctgcttgtttaacattctttttggttgtgatctgttaacatattaccgatatcatgtgtaaccttatgcagctgatttgatatggtataggcaaccctggaaaggaattctgctacttttaagatatcctactagttgtaaatggtctgttgtgccttgtttgctggtcccttctctcatttaaagcctggttatttttcacaacttaaactgagtgcttgtactacatgttcttgatttcaagtcataaccaagtgcttgaactccagacatcaaaactaattttcatggggctcttagttagcaataggatacggcgttaatgctgtttcgttgtgcccctttccctttattttatttctttagtttgatgacaagggcatcatttaatgactttatatggaatcacctttaatatatgctcagctggaactctccgg

SEQ ID NO: 13915 - DNA, 692 bp, Sorghum bicolor
  Clone ID: SORBI-28MAY03-CLUS45084_1
tcagacaccattgacaatgtcaaggccaagatccaggacaaggagggcattcccccagaccagcagcgtttgatctttgccggcaagcagctggaggatgggcgcaccctcgccgactacaatatccagaaggaatccacccttcaccttgtcctccgccttaggggaggcatgcagatcttcgtgaagaccctcaccggcaagaccatcacccttgaggtggagtcctcggacaccattgacaatgtcaaggccaagatccaggacaaggagggcattcccccggaccagcagcgtctgatcttcgctggcaagcagctggaggatgggcgcacccttgccgactacaatatccagaaggagagcaccctccacctggtgctccgtctccgtggtgggcagtaagccattggtcgtcgaagctgctgctgtgtacctgcgttgtctttgtgcctgtggtctctgccatggagggtgtcctcttttaagtatctgtggtttctcttgtaattcagtttagtttcgtggacgggttgtgtcccaagtattttaccaggaacagttggtgcagcagtatgctttatcaaataagtggtgtttgaactttaaaaatctgcgtgcatggtgcagcagtatgctttatcatgaataagtgatgttgaacttaaaaatatgcgtgctcggtttcttgc

SEQ ID NO: 13916 - DNA, 1976 bp, Sorghum bicolor
  Clone ID: SORBI-28MAY03-CLUS1884_1
gcacgaggagaagactggcgtgacagcacctgggcgttggatcacagttcggccccgttgggcttgggaatgcggtgtgcacctgcctgatgctcagagttcttgcacgcggtcagagctggaggctgaaagtaagcaaactaacaacattttggagtataagcaatctactgaaaggcatttgtctattcctagccacaagaatgttgagctaaatggacagaccaaaatacgaagtaaggataataacttgattccaacaagagaagatgatttatcaccaaagaaaagaacatgtttgaatgacaataattctgagagagcttccaaagatatggacctagtccacattatggataatcagcagaagcataacacacagagggaggtggatactatgagaacaacatctaggggaaatgatgagaagggctccatcccagcacaccagttggaactttctcttagaagaactgactacggaaaattggagaaccatgataaaaatgatagaagaacactgaaccattcaacttcatctgcattttccttgtataattgcagggctgtgtccacctcaggaaatgctggtgatggtcaattatgcagcacctcagaaacactaatggatgttgaaaataaaaatggagattcggcagctccctctcaagacatgactgaaacaaatcgtcctcctattagagttgtaccatttcctgtccctgttcaaggtctcacatttgatgggcagccattctggaatggtacaccgatggcatccctattctacccacagtcagctcctcccatttggaatagcaaaacatccatgtggcaagaatcaactcaagcaacttcactgccacaaaaatcgcaacagaatgagccaaatgaaatgggtgctaaaccagttgaaaatgcagaggaacaatttgtcacaggtcctccgagtgccagtgggaagcagctgtgtgttgaagttcctaaagatgatccacggcatatttctcctatgactggtgaaagtggaattagtaccatgctagacagcactagaaatactctgagcagcagtggctgtgatagcacttccaaccagttcactgcccctactgaatcatccaatgtatataagggcgttcctgaaaccccaagcaccgaaggttcacgacacctgagccagcgagaggctgcactgaacaaattccggctaaagaggaaggacaggtgctttgagaagaaggttcggtaccagagccggaaattacttgcagagcagcgtccacgggtcaagggccagtttgttcgtcaagatcatagcatccaaggaagctagggtgcgatcactgagcttgaactctttcccactatctaaaaaaggtcactgcaagtgactccactgcgggtatcctgatgtctggctttgttgaagagttggaagcaatcacgcttagtttgctctgtatatttcctagagcttgtaatatatgtatgcataggctaacactgttctttcctaggttagtcacaggacctggcacgttttagtagagggtttgtcagtaggcgttagaaaatacaggcatactttgtttcaggtcaagatgagatgtgacctccagcagcacatgtgtgctttatttaagcctttgcattacgtaactagccaaggtgtttgatgtttcggattagattttcactctgtgcatggatggtgtaaaggatctccaccaaaacatgctcgtttctgtgcagcttgttgcaatgaacactgttggcctggtttctgttaatgctgtcctgcagtgagtactactgtgaaattttctccagacgatatggagtgctactctgaatttgagtgttttttttttgagggggagtgatggattttgtgagcagaccatgtctcaagagctgcttggttgttaaatctgcaaagttatattcaggcttgtttggcaccgctcaacttc

SEQ ID NO: 13917 - DNA, 836 bp, Sorghum bicolor
  Clone ID: SORBI-28MAY03-CLUS14720_2
gccggccgggccgggcgccgcctcacgtagaactgccgcctgctggctgctgctcgccggccattgctgacctcactctcgccagccagcctccattacccgttgcttgcaagcctcgcgcggtcgcgccccgcattattgccacctgccggctgccgctctatatatacatacaagcgcgcgccgcgcacacgcaagaagaacagtggttgttggattggagagtgcgcgatccagctagcgggccgagggagccagcagccaggaggagcgagcgggcgagcgatggtgttcttctgcttcctggtggaccagcggcggaaggtgcggagcagcaagccggcggcggggatctgctcgcgctgcggcgggtgcgctagcgtggcggacatggagaccgccaccagggtctgctacctgctcaccgtgcaccgccgcacctggcgcgccatcatctgcaccttctgcggcgccatgctcaagtcctaccgccactacaggctctactgatcagtcccgatcgatcgtgcatcgagatcgagcgctggtaattgtgctattaccggtagatcgagtcggtcagtggatgacgcgcctgctttgcgaggtgtagtgatgagcttgagtgatctgttcttctttgactgggtgatcttgctcgcgactattagttctttttcctgcttcattgtgctggggtttgcagagtattgtaatggcagcttgccggttcatgcgtgtaaatatggggatgggagtcatgcatggacatgaagtgaattaattctgtgtcatccatctgatctgatgaaaaaaaaaaaaaaaaaaggccccta

SEQ ID NO: 13918 - DNA, 3054 bp, Sorghum bicolor
  Clone ID: SORBI-28MAY03-CLUS14720_1
gccggccgggttgcgccgactcgaagctccgcaccctcacctagcgcctcgaccccgacctcgccccgcgcacctgcaccaccgagctcggtcacgccgtgacgccgtcgatcgccaccacgatgtcgcccgcaactgcgtcgcccgagcgtctcgtcctcggcaccacctcggcactcgcaccgcgccctcgccgagcagcagcagagccgcggccatggcctcgccctgccgacgccgccaagcaccactgcgcccgcctcggccgtgcccctacctctgtgtcaagcttcatcaccacgcgggggtcagccgcggtgccgtcctcgctgcgcagcggcctcgcccggcgacgtcgagcccgctgccctcgccgcgtcgagcttcgaccacggccggccgcgtggacgccacagcccggccgagcctctgcctcgccaccgtgggagtcgccgcggccacgacgccttcagccccggcgcccctccgcgtctacgacggtgtcgaccgcgagcccccgtgctgtcatggagcttacctcgtcgagccgacacgccgtcgacagagccaccgatgccgcgcgccgggcaccagagcaagccccttcgccgagcacccggcccgatgcgcccaggaccccccgcaggcacaccatgcgccgcgccaggtcttggatgagtacaactacaagtgaactgaggatcttggaaatgtcactcgacagttctgccggggcctcgtcacctgctatgcaaactaatgttgcaagcctcgattggttgggtggcacgcaagcttcccgagttcacgcggcaccataggttttggattggagagtgcgtgcttccgctagcgggcagagggagccagcagccaggaggagcgcgccggcgtgcgatggtgttcttctgcttcctggtggacccgcggcggaaggtgcggagcagcaagccggcggcggggatctgctcgcgctgcggcgggtgcgctagggtcgcggacatggagaccgcgaccaggggctgcaacctgctcaccgcgcaccgccgcccctggtgcgctatcatctgctcctaccgcggcgccatgctcaagtctcacctgctctacagtctctactgatccgtcccgatcgatcgtgcatcgagattgagcgctggacacgcgtctattaccgctagatcgaggccgtaattcgattaccagacaaagctcctagagcaagtaatatatgagcctgtttcccacggtctctcccggccatcgccgcggtcaccgcgtcagccccggccgcggtgttcgcgtccccgccctcgacgccgtgcccgtcgtgcctccccgtccgcgaacttcccggtcgctgcccgccggtcgccgcgcctcctgcgccagcggcagcgccgccccgcgcggagctcttctccgccgccggggtgcccccgctccccacgtgccctccttgctcccgctccgttgtgccttgctgaaaccgggcacgaggccgtgttcttcactgtacagggatgctgcacccatgtcgtgccacttgccggagccgttggacttaacatcgctgctgttggagcaccgaacctcgaggcgttgccgaaccccaagacttctctttcagatgcaccccggccacttgcagcaagccgcgaccaagctgtagaagccctctgccatcctcgcccgcaaggtggaactgctatggattctgcaccatcatgtaggccatgggaacatggagacttgcttcgccgactggcaacatttaagccttcaacttgggcttctaaaccgaaggctgctagttcattgtcctgtgctcagagaggttgggtgaacgttgacctggacaaaattgaatgtgagtcatgtggtgcacatctaatcttcaatgcattgacatcctggtcccctgttgaagttgcaaatgctggagaatcctttgccgagcagcttgatgcaacacaccataatagttgtccctggagaggcaataactgtgctgacagcttggtccaacttcatcttacacaatcagctcttattggagggtttaaagatcgctgcgatgggcttttacagtttacctcacttcctgtgattgcaccatctgcaattgagaacatgaagctttccaggagcgcacaaattgatcgtctgttgtcccagtcaattacctttttatctggtattctgggctgcagagcagagagtacagcaggaattgatatccaccaagatttctcttgtagctactctcaagcacagaagctcataagcctgtgtggatgggagcctcgggggcttccaaatgttcaagactgtgaagaaaattcaacgcattcagctaaaaatgcaccgtcagttggacctgatgaacggttctatccccattttgttgaacataacaaaaattcattttctgcatcagccaagagcacgagggggaaaggcaaattgcctgttggagattctggatgcagcatgaggtcaccgttattagattgtaacctgtgtggagctacagtcaggatgcgggactttagacctgtattacgtccttctcgttttagtccgaataacattgatgtgcctgaaacaggcagaaagctaacactgacacgtggagttagtgccaccagtggtatcaatgagtgggttactgatggggtcgacagaggtcaagatgaagggcgtgatgaagcagcaacagatgagggaaaaccactgtcacttgttggagtagacctaaacctatcaatggctggaggattaccgtcacctcaatctgccatgcctgctatgtcagagcggttcaataatggaggaatgggaagggacctgatgattggagagcctacaggcagtgaagtaggtgattgtgaaacctcatatgagtctcgtggtccgagttcaaggaagcgtaaccttgagggaggtgggagcacagctgacaatccacaagataggctgcagcatgctgatagcatagaaggaaatttcattgatcgtgatggtgaggaagttgatgatgatgctgaacaa

SEQ ID NO: 13919 - DNA, 1355 bp, Sorghum bicolor
  Clone ID: SORBI-28MAY03-CLUS18948_1
gcacgaggccacgattaattgcaatactcgtacataaatcgacacggcacgggctctcctgtccttgttccgcaccgagacgtgtaaccgcagcgcaccactctgacctgcaggcgcatcatgagcatggcagcatccacggcggcggcggtggcggtgccggaggtgtccctgcggtcgggcgacgcgaggccgatgccgatggtcggcatgggcacggcgcagttccccgtggtgaacgaggccaccaggaacgccgtgctggcggccatcgaggtgggtttccgccacttcgacacggccttcttgtacggcaccgaggagccgctcggcgaggccgcggccgaggccatccgccgcggcctcgtccggtcccgggaggacctgttcgtgacgtccaagctgtggtgcacgcagaaccacccgcacctcgtcctgccgtccctccgggaaactctcaagaacctgcagatggagtacgtggacctgtatctgatccactggccggtgtgcatcaagcccgggccgcccaagttcccgaacaagaaggaggacgcggtgccggtggacttcgagggcgtgtggcgcgccatggaggagtgccagcggctggggctcgcgagagccatcggcgtcagcaacttcaccaccaagcacctcgacagggtcctggccgtcgccacgatcccgccggcggtgaaccaggtggagctgaacccggcgtggcagcagcggacgctgagggcgtactgcgccgacaggggcatccacgtcgccgcctactcgccgctgggcgggcagaactgggacggccagggcaacgccgtgctggactccgaggtgctcgccgagatagccaaggccagagggaaaaccgtcgcgcaggtggcgttgcgatggatacatgagcagggagtgacgtccatcgccaagagctacaacaaggagaggctgaagcagaaccttgagatattcgactgggagctgaccgaggaggacaggctcaagatcagccagatcccgcagaggaaggttgtccaggctaccagcttgttctcggaagagggtgagttcacgtctgttgatcctgaagaaatgaatattgcagaggaatagcaactgaaaaaaatgttcggcctcgatcggtgttgctgcgtagtagaggagtacttcgtactagtccagatatgaataaggcaatgtttcatcctcagtgtgtttctgtgtgttgatgatgttttccatccccgttcagttcagtaaatattgtaatcataacattcagattgttgcatactccaagtccaattcgaggttatctgagctccgctaccaaactattggagatttttttc

SEQ ID NO: 13920 - DNA, 542 bp, Sorghum bicolor
  Clone ID: SORBI-28MAY03-CLUS5592_2
gccggccgggttctggctatatccaccgccgccgccgtcgtctcaggctcacctctcatcttcgggttcgcatcgcagcgtcttccgcccaggctaccaccatgccgaagcagatccacgagatcaaggacttcctgctgacggcgcggcggaaggacgcgcggtcggtgcggatcaagcgtgccaaggacgccgtcaagttcaaggtgcgctgctccaagtacctctacaccctctgcgtccacgacgccgacaaggccaacaagctcaagcagtcgctcccgccaggtctgactgttcaggagatttaagtatcaagccacagattgtgctgtttgtggtatcgaggacatgtttgctccagtattactctagtatgtaggtgatttcatgctatgtttgaatggattatgaagttgtgtttgggagatgtaatattggaagtgatgtgttgaacctatgagcctgtggtgtaatgttactccccaccaaaaagatggctgtctatcataagttaaactgaattctgctatatttgctgc

SEQ ID NO: 13921 - DNA, 1114 bp, Sorghum bicolor
  Clone ID: SORBI-28MAY03-CLUS5592_1
gccggccggtcatcttcccgctataaatccgcccaaccccggccgggccccgaccaaagaagaaagaaagaatttcttgggcgttcttcggtttcgttctcacgcagttctgttcgagttcggcgccgcgccgtcaagtcccctgaccggccttgcgcgagggaggaagaggcgaggagaagatgcagatcttcgtgaagaccctgacggggaagaccatcaccctcgaggtggagagcagcgacaccatcgacaacgtcaaggccaaaatccaggacaaggaagggattcccccagatcaacagcgactgatattcgctggcaagcagctggaggatggccgcacactggctgactacaacatccaaaaggagtcaactcttcatttggtcctcaggcttcggggtggaaccatgatcaaggtcaaaactctcactgggaaagagatcgagatcgacatagaacccactgacacgattgataggatcaaggagcgtgttgaagagaaagaaggcattcctcccgtgcagcaaaggctcatctatgctggtaagcagcttgccgatgacaagaccgcaaaggactacaacatcgagggtggttctgtcctccatcttgtccttgctctgaggggtggttactagtctaaacctgatgagccagacagataaactgttatgttggctgcgaattgtgcagacctggtgatgtggaacttgcaaagagataataacatatatcagctttgcgcctgtgcccagtggaaggggatgtcttccatgttattatctgatatctgattcaacggaattgttccagagtaaaatgtcttggctgttcaggagatttaagtatctagcctcacattgtgctgtttgtggtatcgagcatgtttgctccagtattactctagtatgtaggtgagtacatgctatgtttgaatggagtatgaaggtgtgtttgggacatgtgatattggaagtgatgtgttgaacctatgagcatgtggtgtaatgccactcgccaccaaaaagatggctgtcaatcataagttaaactgaattcggatataaaaaacaaaaaaaaagggcgccgctcgcgatctagagctagt

SEQ ID NO: 13922 - DNA, 1608 bp, Sorghum bicolor
  Clone ID: SORBI-28MAY03-CLUS5745_1
gcacgaggatcaagcttgctagggatgttgatccttcaggtgacaggacttttggagtcttaacaaagcttgatttgatggacaagggtaccaatgccgttgatgtacttgaagggaggcaatatcgcttacaacacccctgggttggaattgtcaaccgctcacaagctgatatcaacaagaatgttgatatgctctcagcaagacgcaaagaaaaagagtactttgagagtagtcctgaatatggtcacttggcacataaaatgggtgcagagtatcttgccaagcttctgtcacagcatttagaggctgtgatcagggccaaaattccaagtattatagccatgattaacaaaacaattgatgaaatagaagcccagttggatcgacttggtaggccaatcggaggtgatgctggggctcagttgtacactatcttggatatgtgtcgtgcatttgaccgtgtctttaaagagcacttagatggcgggcggccaggtggagatcggatttatggagtctttgacaaccagttacctgcagcactgaaaaagcttccatttgaccgacatctgtcaatgcaaaatgttcgtaaagttatttcagaggctgatggttaccagccccacttgattgcccctgagcaaggatacagaatgcttatagatagttctctaagctactttatgggtccagctgcacgaggcctcgtgccggtccatttggtcttgaaggagcttgttcggagatcgattgcagcaacagaggagttgaagcgattcccaacacttcaatcggatatagctgctgctgcaaacgatagcctggaaagattccgtgaggacggacgaaagactgttcttcgtctagtagagatggaagccagctacctaacagtagagtttttccgcaaacttcctactgaaccagagaaagcagctgataagaacactccagtgagtgatagatatcaggacaatcatctcagaagaatcggatcgaatgtgtcatcttacatcaacatggtctgtgagactctgaggaacacaattccgaaagccattgtacattgtcaagtgaaagaggcaaaaagaaatttgcttaaccgtttctatgctcatgtgggaagcaaggagaagaaacagctgagcgcgatgttggacgaggaccctgctttgatggagaagagggatgccttggtcaagaggctagagctgtacaaatcggcaaggaatgagatcgactcggtcgcatggaaatgattggcttgtgacagccacagctggaatgtagaatgtacaagcgcagcagcacacgtgtgattgcagtagaatgttcaattcttttttacatttgaatttatcctggaggccttgtacgcagttttcactcgagtctttttccagacatgcttatttggcggtcttggccttaaacacgattgtgttgtgcgtggacgatctggtctccggttgatataagagtatagatgtattcttttgttgattttactgaccttgatgatctcattagttttgccccgttttgcccccgtgagaatcatgtttttgacttaggtgcttgcttgatagcactgagtcagtggca

SEQ ID NO: 13923 - DNA, 1781 bp, Sorghum bicolor
  Clone ID: SORBI-28MAY03-CLUS5880_1
gcacgaggggcacgaggcagcggcgcatcgcaacactcaccaaggtgccgtgtgccagggtgactgttccgaggaggagcgtggagtggcgccatggggaagaagggcaagtggttcggcgccgtcaagaaggtcttcagccctgaatccaaggagaagaaagaggagagactaaggaggaaatcagcagctagcaacccagcaccgctagatctgaccccatctacctccttggaagtcaatgtttcggtgccaccccctccagctccggcacctcctccagttctccaccaggccgaggaggtcagggtccctgaacccgagcaggagcagagcaagcatgtcaccgtggaggagccccctgctgttccagcacagccgtcggtgctgccacctggtgtgccaaccgaagagcttgctgcggtcaagatccagaccgccttccgaggttacctggcaaggagggcactaagagcactgcgaggtcttgttcgattgaagtcattggttgagggtaattcagtcaagcgtcaatctgcaagcactctgcgctgtatgcaaactctatcgcgggtgcagtcacaaatacgttctaggagagcaaagatgtccgaggagaaccaggccctccaacgccagctcctacttaaacaggaattggagaatttcagaatgggtgagaactgggatgacagcactcaatccaaggagcaaatcgaggcaagcctgataagcaggcaagaagcagcgataagaagagaaagagcgcttgcatatgcattttcacatcagtggaagagtacttcaagatctgtcaacccaatgtttgtagacccaaacaacttgcagtggggctggagctggttggagcgctggatggcagcaaaaccttgggagggccgtaatggggctgacaaggagagcaactttgaccgcggatcagttaagagtatgagcttgaaccttggagagggtgaaatcacaaaagctttcaaccgccgggactcaaagccagaaaagccatcaccaccaactccaaaaccaacccgtccagcctggcaatccccttcgacaccatctgctaaagtggcaccaatacctgccaggaggaaatccgccacgccaaagaatgggctttcacaggtggacgatgacgctaggagtgtgctcagcgtgcagtctgagcgaccaaggaggcacagtatagccacctcgactgtgcgggatgatgaaagcctcgcaagctccccatcactccccagctacatggttcccacggaatctgcaagagccaaatctcgtctccagggctcatcaatgaccaatggtgcagagacaccagagaaaggaggctctactggaccagtcaagaagaggttgtccttccaaggtggaactgcagctgcctcaccaatgcggcggcattctggtcctcccaaggtggagagtgcagtgaaggacattgttgcaccaccacagccagaggccttggtagtcaatggtggaagcaagtgacaagtaccaggaggggaagcggattatgaagatatgtttcatccatggacagaagtttaaaagtgatatcagatctatgaatgatttgaattgttttcctgttacgacaccattgtttgctatataagattcacagtacctgccagttgattccatttgttgtttctgtaaaacaaatatcaatttgtcactagaatatgtggtgtttgtatgtaaacatgtcctttatttatgtgagccaatatacttctttttcagaagatccc

SEQ ID NO: 13924 - DNA, 2218 bp, Sorghum bicolor
  Clone ID: SORBI-28MAY03-CLUS58817_1
aaaaaaaagctcgacgactcaaaaacctccacttcactcgctctccgcccgccgcgccatgagcgccgccgcctgcctcttcgccgccgccaccgcatccctttccctcccctcgacctccgcccccacttcttcggggcgacgctccgtccggagccccactgcgctcctccgctgctccctgactcgccgccgtgggcagccggtccgggtccgggcactcgacgagcggctgctcgaggccgcgccggcggagaccgaagaggttcaaaccggcgttgatgtaggggatggaggcggggtcgctgagggtgatggagttggagcagaggaggagctggagctggagcagcagcggccgtcgccgagggctttcgtgaagagcaggcggcagcggcaggaagaggaggaggccgcggcggggcaagaccggttcaggctcatcaacggcaaagagatatttcaagagaaggcttatctggttggtgttgagtgcaaacggacaggagggaacctcttcggcatagtggagtctcttaaggagctggagcagttggctgataccgcgggccttgtggtagtcggctcaacctatcagaagctttctaccccaaatccaaggacttacattggttcaggaaaggtttctgaaatcaggagtgcaattcaagcccttgatgttgagactgtaattttcgatgatgagttatcccctggacaactacgtaacttggaaaagtcatttggtgggagtgtccgagtctgtgatcgaactgctcttattcttgatatttttaatcaaagggcagcaacacatgaagctgctttacaggtcaccttggcacagatggaatatcaacttcctaggttgacaaaaatgtggagtcaccttgaacggcaggctggaggtcaagttaagggtatgggtgagaagcaaattgaagttgacaagcgcatcttgagaactcaaataggtgccttgaggaaagaattggaatctgttcggaaacaccgaaagctgtaccgcaaccgtcgccaatcagttcctattcctgttgtttctctggtagggtatacaaatgctggaaaaagtacactcctgaaccgcttaactggagctgatgtacttgcagaggataagttatttgccacgttagacccaactacaagaagggcccgggggaagaatgggactgagttccttctaactgacactgccggattcattcagaagctacccactatgctggtacctgccctcagagcatattcctcttgtttacatgtcatgctcctggacaataaaacttcaaatattgagagtttttcctatctttatgatgtcaactttgcatattccgtctgctgttaccccctatcctggtagcagcatttagagcaacactagaagagatatcagaatcatcagtcatagttcatcttgtggacattagccatccattagctcaacaacagatagatgctgttgaaagagtattgaaggagttggatgtagagtcaatccccaaattaattgtgtggaataagattgacaatacggatgaaccattgagagtaaaagaagaagctcagaaacaaggaataatctgcatatcagccatgaatggtgatggtttggaagaattctgcaatgcagttcaagcaaagttgaaagactcgatggttcccatagaagctattgttccatatgacaaaggagatctcctaaatgacatacataaggttggaatggtcgaaaaaatggagtacaaggaaaatgggacatttgtaaaagctcatgtgcctctgccccttgcaagacttctcacacctctacgacagcaggtggtggccacagtgtgatgtgcatgtcctccattccttgatgccattggcactcacataattagcacgtcttgtagattcacaaaaagatagctttgttgtagaaaatttaatcatagattatcttcattgtcttctatcagcgtaggacatcaacacgtgcacaggattagatagctgtatatacgcacaacagaattgtaaatattctcagctgaattttactctcttttcccagtctgagaatcattcactctacaagattgtgtaactatgccatctgctatacacatccccatgaacattgaacaggaactgtgaatcctctggtcacagatttgcagatttagtcaatctgggtcagtattcctgc

SEQ ID NO: 13925 - DNA, 1453 bp, Sorghum bicolor
  Clone ID: SORBI-28MAY03-CLUS5962_1
tgcgcttggccttctatatcttggaaaacaggatagtgtggaggctactgcagaggtctctaaaacatttgatgagaagattgggaagtactgtgatgtaacacttatgtcactggcatatgctgggacaggaaatgtgcttaaggttcagaaacttcttggcatatgctcacagcatcttgagaaaggcgaaacacaccaagggccagctgtccttggaattgctcttattgctatggctgaagaattaggagctgaaatggctgtacgttcgcttgagcgtcttctgcagtacggcgagcagaatataagacgagcagttcctcttgctcttggtatactctgcatatctaaccccaaggtaaatgttatggacacactgagcagattgagtcatgatgcagatgccgatgtgtcgatggctgcaattatctcattgggtttgattggtgctggcacaaacaatgccagaatagctggcatgcttcgcaatctttcaagttattactacaaagaagctgctcatctgttttgtgtaagaattgctcagggccttgttcaccttggaaagggcttgctgaccctttctccataccattctgaccgatttcttctttccccaatggctcttggagggcttgtaactgtcctgcatgcgtgtcttgatatgaagtccaccatcctagggaaataccactacatcctttacattattgtcctggcgatgcagcccaggatgcttttaactgtggatgaggatctgaagcctctctcagtacctgtccgcgttgggcaagctgtcgacgtggttggtcaggcaggaaggccgaagacaattactggcttccagacacactccacaccggtcttgcttgcagcaggggagagagctgagctagcaactgaaaaatacattccattgacgccggtattagagggctttgtgattctgaagaagaacccggagtaccatgaagagtaaaagacttcagtatgctagatagcatggtgcttttgtgtctcgtccacatggcagtcttcaagccttggcaacctttgtcgaggaatcgatcgcccctggatatcttgctcaatcctcggtccgttcatgtttgattcttaccagagttgcggctaactgaaagctgtctttggttatgcatgctgatataccacttgtaggtgttttgagtctgtttacttcacctccagtgtatctgtacgattgtatttattactagagacgtatttagagcttactctgtacggtgaggtgataacatggcatagcattttttgcgttcgtctcggtcaatctataatccttgttttgacatgttgcatcatcattatctgttttttttgtattgtggttacgttctgtatttacagcttactctgtactggaaacactgtacacatgatatgcgagttctgtgtacgtttttctggg

SEQ ID NO: 13926 - DNA, 1615 bp, Sorghum bicolor
  Clone ID: SORBI-28MAY03-CLUS5786_1
gcacgaggctaatcactgccctaaacatgtgtgccgggccgaggtcataatcgatgcacggaggaggatgccgccgcagctgaggcgattgataatataaaagcaggcggagaccgccggccccctctggcctcgctgctcccccgttcctcccccacatgccctgccctcgcccggccctgccctgctgcgcccaaagctgaatctccccgtaatcaattagcgtagctgcattggcgggggagaaagcgcgagaagcgcagcagcaatggcggagcaggcgagcgccggaaggtactggtgccacatgtgcgccgcggtcgtgagccccgcggagggcgaggcggagatgaagtgcccgctctgccacagcggcttcctcgaggagatggagaccgcccgcggcgcgaccgtggccgcggtcgcgactgacgacggcgacggtgacggcacggtggctcaagtgtaccccggcggcgccgaccgcccgagctccatctgggcgcacgctatcctcagcacggtcgacagctccgtccgccgccgccgcaaccggcggcagcaggaggccgccggcgacgtctacgactggaacgaccccgagttctcgctgcgccggcggcgcgtcaccgcgttcctgcggctcctgcacgagctccgtgaccgccagctgcagcgcctggaggctgctgccggcgtcgccctcgaaggcgaccagctcacccctttcggccggagcctcttcatcggcgcagctggcggtggcggcggcagcgagcatggcgtggcgctgggcgactacttcctcggccctagcctcgacgcactggtgcagcagcttgccgagaacgacgcggggcggcaggggacgccgccggccaagaaggaggccgtggaggcaatgccgatcgtggaaatccccagtggcaacgatgacgacacggccagctgcccagtctgcctggaggactacgccgccggcgagcgcgcccgcgagatgccctgcaggcacaggttccacgccaattgcatcgtgccgtggctcgagatgcacagctcctgccctgtctgccggttccagctgccggccaccgatgacaagagctcatgcagcagtggcaacggcggtggttttgtcagtgtcgatgcagatcgtgaaggcaatgacgacggcggtggtgatggtactggtagggcaacctctcctccaggcaatgccgagccagctgaagccgaagagagcggcaggcggttgccgccatccttgcagtggctcaacagcctgttctcgccgtcggcgcagtcctccggtagcggcagcagcagttcgcatcattgggagaattgagcaacaatgcaatgccaatatataacgatggatggttgctgctgcttgacaccttgagcccattggtgccaatgtacataggaaggagcaggagcatgccgggttgctgccatgaaaatttggagcctttttttcagtgtttagtttggctcatgtaatgttctctctgatacagttatcatggttgtaaaaagaacagaaattggcaagtgtatgaacttgcttcttaaaaaaaaaaaaaaaaaaaaaaaagggaaaaaaaaaaaa

SEQ ID NO: 13927 - DNA, 1006 bp, Sorghum bicolor
  Clone ID: SORBI-28MAY03-CLUS671_1
aaaaaaaaaaaaaaaaaaaaaccacggcaccagaccccatcccactccaagaccctccatcctgccatccatcagcagcagcagcagcagcgcaggcaaagcaagcaagagcatggcgcgccgtggcagcctgctcgccgtcgccgcggcgctgctggtcgccgtcgttgccgcggcggtgccgccgacgtgcgagcgcatcgagtgcccggcgtacgaggtggtggacagcgcgaacgggttcgagatccggcggtacacggacgccatgtggatcaccacggcgcccatcgaggacatctccttcgtcgccgccacgcgcaccggcttcctccagctgttcaactacatccagggcaagaacttgtacaacgagacgatcgagatgactgcgccggtgctgacgcaggtatcgcccagcgacgggcccttctgcgcctcctccttcaccgtcagcttctacgtgccggccaagaaccaggcggacccgccgccggccgaggggctacgcgtggaccgctgggctggggccaggtacgcggccgtgcgccgcttcgggggcttcgtggcggacgccgacgtcggggagcaggcggcgcagctcgacgccagcctccagggcaccaggtgggccgccgccgtcaacgacgcgcgcagggctgacccggcatcgccctacaccgtcgcgcagtacaactcgcccttcgagttcagcggcagggtcaacgagatttggatgctcttcgacgacgccgctgccgccgccaccagtatgtgatgtgattttcaaacgtgctttaaggcactgagcgaggcggttaggaaaggacgtgcataaagcacctatgctagcattaatatttcgtactcttttgcgctagctacgtttacttttgagtaacaatgaggtgcctcttgtgtaagcaataatgataaaactaatcctacttgtaatcacatttcatggcacaactgtatatgcaattttgaaagttttggccctcct

SEQ ID NO: 13928 - DNA, 1306 bp, Sorghum bicolor
  Clone ID: SORBI-28MAY03-CLUS6943_1
tctggctgcgctggcgcgcgcgaggggaaggaagaggaagggacgccgaaccgagcacgagcagcgagagatggcgcgcgtctccaatgccaagaagcggcacggcgccaagcccgccgccgcctccgcgggcctcagcggcaccaacaacagctccgccaccgccaccaccaagaggaaggccgaggacgaccgccccgtgcgcgtctacgccgacggcatcttcgatctcttccacttcggccacgcccgcgccctcgagcaggccaagttgctgttccccaacacctatctcctcgtcggatgctgcaacgacgagctaaccaaccgctacaagggcaagaccgtcatgacacaggaagagcgatacgagtccctgcgacactgcaagtgggttgatgaggtcattcctgatgcaccgtgggttctcacacaggagtttattgataagcatcagattgactatgttgctcatgatgcgctgccttatgctgatactagcggagcagcaaatgatgtctatgaatttgttaaaaagattggaaaattcaaggaaacaaaaaggacagacggggtttctacttcagatctcataatgaggatcttgaaggactataatcagtatgtcatgaggaatttagcacggggctactcgaggaaggatcttggtgtgagctacgtcaaggagaaacaattgcaagttaatatgaagatcaataaactgcgggagactgtgaaggcgcatcaggagaagttgcaaacagtggcaaagactgctggtttgaatcatgaagaatggcttgctaatgcggaccgctgggttgctggtttcctggagaagtttgagcaacactgccacaacatggagactgccatcaaggatcagatacaagtgaggctggggagacagttgagcaaaggaataatcgctggtcttgtgcaggaatcggtgacagcctaaaacaggtcatgctgtcagtgaaacgcacgggtgcttatcagatcatccttccgaggtggttttgggggggatcaaatgcaatgcgatgcttgtaagagtgcaacgcagttgctgaggcgttttagttttgtggtgcatgtgaagtcttcccgtatacaaatgtctataggagaggcgtttggtgttttgggcattgtcgtgggcgtgcttcttttgtatctaacgggttagattaaccttttcttgtcgagattgatgttctttcgtggctatatatcatattccatccataataacatggtaaaggcacaatagttatgaatatatacacatatgtgatctgat

SEQ ID NO: 13929 - DNA, 1115 bp, Sorghum bicolor
  Clone ID: SORBI-28MAY03-CLUS8100_1
ctgtgcggcgctcaggcggcggacgctgctttctactctcgtcgatctccacactccactacgcccacccaccacccacaaatccacaacacaatggcgaggcgcatcgccgtggcggcggccgcgttcctagcgctgtcggccgtggttccggcggcgctggcgcaggctccaggccccgcggcgacgccgagcgggccgccgaacgtgacggcggtcctggagaaaggcgggcagtacacgatgttcatgcggctgatgaaggagacgcagcaggacacgcagctcaacagccagctcaacagctcgttcgccagcaacggcggcgggtacacggtgttcgcgcccaccgacaacgccttcaacagcctcaagcccgggacgctcaactcgctgacgcagcagcagcaggtggcgctggtgcagggccacgtcctgccccagttctacagcatggactcgttccagaccgccagcaaccccgtccgcacccaggcctccggccgcgacgggccctacacgctcaacgtcacctccaccaccaacaaccagctcaacgtctccacgggcgtcgtcgaggtcaccgtcaacaacgcgctcagcgccgtcaagccgctcgccgtctactccgtcgacaaggtgctcctgcccttggagctgttcggggccaaggcgccagccgccgcgcctaccgcgtccaagcccaagaagggtgggtccgacgatgccgcctctggccccgcagggtctgacgacgccgcgcccacgggcgccgccagcgccagggccgtcggctggagcgtcgctggcctcgccgcccttcttggctacctgttgtgagagtgagaccgtacgccatttctatctatagggacggacgacgagctagttgaagatgagaatgccatgtccggagttgattcgggcggcttcttccatctttgtctgagattgtctggtggtgttcccttcctcttctttctctctgtttatttaaatttcttccatttgatctcgctagcttcttatttgtaatattggtggtttgtaagattgggctatgcgattcaatttttatgcgtgctgcggctgttgatactgcatcactactcttg

SEQ ID NO: 13930 - DNA, 1417 bp, Sorghum bicolor
  Clone ID: SORBI-28MAY03-CLUS24776_1
gcacgaggggtacgcgccagcacgaagcaaagccacaactggaagaaagcaacggcagcaagaaaccttggaaccatcggagaagagatcgcggcggcgatggcggccaaggggaggacggagctggacgtgggcgctgacggcgtggccgtaatcaccatccacaatccgcctgtcaactcgctctccatcgacgtcctatatagcttaaaggaaagctatgaagaagcatttcggagaagcgatgttaaagcgattgttgttacagggaaaggagggaaattttctggaggatttgatattagttcctttggtggtcttcagggaggccaaaaaatgcaaccaaaggttggttacatagcaatagatattctcacagatactgtagaagctgctacaaagccatcagtggcagcaattgatggtcttgctcttggtgggggtttagaagttgccatggcatgccatgcacggattgcaactccaacagctcaattaggtcttccagaacttcaattaggaattattccaggatttggaggaacacagcgactcccacgactagttggactgacaaaatctttggaaatgatgctgttatctaagccaatcaagggtggtgaggcacaccaactgggtctggttgatgccttggtttctcctaatgatttggtgaatactgctcgtcaatgggctttggatatatatgaatgtaggaggccctggatcaaaagcctttataagactgacaagctagaacctcttggggaggctagggaaattctgaagtttgcaagagctcaagctcaaaagcaggcagctaatctacatcacccacttgtttgtattgatgtcattgaagaaggtatagttgcaggaccacgagctggactctggaaggaagcaacttctttccaggaactgcttttctcagatacttgtaaaagcttagttcatgtgttcttttctcagcgggcaacgtctaagattccaggtgctacagacttggggttgatgcctaggaaaataactaaagttgccattttaggtggtggacttatgggttcaggaattgcgactgcaatgatattaagtaactatcctgtggtacttaaagaagtaaatgagaaattcctaaatgctggaatcgacagaatcaaagccaatttgcagagtcgagtaaggaaagggaaaatgaccgaagagagatatgagaaggctatgtctctcgtcacaggtgtccttgattatgaacgtttcaaagatgtggacctcgttatagaggcagttattgagaatgtgaagttgaagcagcaaatatttgcggacttggagaagtactgtccttcacattgcgtccttgctactaacacatctacaattgatcttaatctgattggggagaaaacaaagtctc

SEQ ID NO: 13931 - DNA, 1340 bp, Sorghum bicolor
  Clone ID: SORBI-28MAY03-CLUS26791_1
tgctcggcaatcttccattcctcctctcttctctcttgcgccgtgttccctctccctctcctcgcgagctcttcttcagcccttcttcgagcgcggtttggcgatggcggcagcgcaggcggtcgcgaaggggagcgtggttgcgccgtgcggcaatcgagcggcgccgggcctccttggcaggcggaggggtgccgtggcggcgcggatggcgccgtcggcggtgcggatcggggcctcatggaggaagaccgcgtttacaggcgggaggctagccttggggttggggacgaggagatccaggcccgcgtcccggagttctttcgcgtcgccggcgcagatgaacatgaaccttgcgattgggaaatcgatgaggtggtgggagaaggggttgcagcccaacatgcgtgagatcgagtccgcccaagaccttgtcgattccttgaccaacgccggcgacaagctcgtcatcgtcgacttcttctcccctggctgcggcggctgccgtgctcttcacccgaagatttgtcaatttgcggagcagaacccagatgtgctgttcttgcaagtgaactacgaggagcacaagtctatgtgctacagtcttcatgtccatgtcctacccttcttcagattctacaggggagcacagggacggctctgcagcttcagttgtacaaacgcaaccattaagaagttcaaggatgcacttgcgaagcacaagccagatagatgtagccttggcccaaccagggggctagaggaatcggagtttttagccttggcagcaaacaaggacctgcagttcacctacaccaaggagccagaactgattcccaggggagatgctcctggggaggtcattgctcccgagcctgcaaagcttcctgcggccacaaagcctttggtcaggctggggtccgaagaaaggtccttggtctcatcaggaagatgagatgtataattgattgattatcaaggatgatcagatgcttccattctgtacagttccgtggttcttgatgtgtgtaaaggttgtagcttctcatggtagcagagtgcaggctaagattttttacatgtgaagcctgccctgtcgtccggtagtttagctcggttgtactccattaccagtagcaatgagcgtgttgtggagctgccttaaggaaatcgcatggttgttgcatggatgaatgaattcgtctgcatgctatttcgtcgaattctatagatcatgtggatgatgagttgctcttgtttaatttctcctccagcctcaggatattgtatgggtgtctgttgcaaatctgaataatcaaatcatgctttttgtttgtgcc

SEQ ID NO: 13932 - DNA, 956 bp, Sorghum bicolor
  Clone ID: SORBI-28MAY03-CLUS26340_1
cccggcttgaggaacccccttttcgcaccaagggtcccctccccagccgccggcccccgtaggatcttcccctcagctcttccagccatctgcgcagccgcagcagttgtaagctgtctcatagtccttctcttcagcatgaaggatcccactctgcagatcaattgtgccctcctgagacggtggcacataaatggcattggctgcagttcttgcagcagtcagagaagcctttgcctttggaaggtttctcagagagaaatgtagcttgctctccagaaggtcaatgtccacaagaagtaacttgtcatccagcctcctgacttccttgatgagtccagaaaggagtgtaagggcctcagtatactcctgattctctaacagaagtgctgccagccttgcttccactcgctgcctgaggaaggtcctcttctccgcacgggtccattcaaccatctccttgcacagtgagatctgaagctcagatgttccaggtatcttggcaacggcatcaatgatgccacgcacaatctttgcggtctttgccttggggatcaatgcaaaaaagggcctgagctgggtcaaaaggttcctgagatcctcagctctgttctcttttgtgaggtagcttgtgagattcgtaatggcaagctcttttactctcaatgcatccgcagatgaagacggatcctcaagcacacggtagaggattgagatggactcagaagcgtccttggcctcctgagcctttgctatggactcagtggtagcaggaaggtatgaagattgcatcgatgaagacatggtgacttcccacgggagcagactcgtcgcggcgaaggtcgcagtgaagagggcgccgccgctcgcccagccgtcgccgccggaaacgaagccgagtcctcgggaagagacgtagtcggaacggcaaaccaacctttcgcctcgcgcttctt

SEQ ID NO: 13933 - DNA, 2205 bp, Sorghum bicolor
  Clone ID: SORBI-28MAY03-CLUS13255_1
gcacgaggagagacaggaggcgcgcggcatggcggctgcgacgtccccggcggcggccgcgaacctggcgggcaagtcgggcgtgcgggtcgccgtgatcggcgacccgggctccggcaagtccagcctcatcgtcgccctccccgccgagcggttccccgagaacgtgccccgcgtcgcgcccccctctcgcctccacgccgtgcacttccacgaccgcgtccccatcacccccatcgacacgtcctccggcccggagcagaagcccaagttgatcgcggagtgccaggccgccgctgccgtcgtgcgctcctacgcctgcgaccggcccgccacgctggagcgtctcagttcgttctggcttcccctgctccggccaccccagttgaaggctccagttatgggggtggggtgcaagctggacctaagggacgaacagcgggtcagccttgtgcaggttagcgccccgggtttgctttcccgccacgagaccgacacttgcgtccagtcctcatctcttagtcagtctccggcgcctgcgggcttctcatgcgttcagaaggcagtgccgcacccgacccccccacgctttgatcaaggctgtctttctctgactccgttacgtgtgctaccggccctccggatcgttattggtcgtgtggatgccacgggggccgctctcagtgatgtggagctcaatgaattccaggtccgttgcgttggtccccctccgctgcctactgaaagtgctcctgatcaaactctggaaatgacaagtgtagtggtcgaattcttgagagggatattcaccatgtttgacattgataatgatggagctttactacctactgagctggaagaccttttctcaacagcacctgaaaacccatggtcttccgatccatacaaagactgcgctgaaaagaacgtgttgggtggtctgtcacttgaagggtttctctcaaagtgggctctaatgacagttctagatccaacaaatagttatgccaaccttgtatatgttggctatcctggcgagttcagttctgcatttactgtcacaaggaaaagacgagtggatcgtaaaaagcaacagacacagagaaatgttttccagtgttatgttttcggtgccagaggctctggaaagacgtccttgctacaatcattcattggaaggcaaccttctgatgctctgccatctaacagcgaacgctttgcaacaaattctgtcgaaatggctgatggaactagaaagacactaatactgcgagagattcctgaaggtgatgtgagatccttactttctgacaaggaatcattggcgccgtgtgatgtagcagtatttgtttacgacagctgcgatgaatattcttggcaaagggctagagacttgcttgtgcaagtggctacacatggagaaaatactggctacgaagttccttgcttgatagttgctgcgaaagatgatcttgaccaatcttcacaagctctgcaagaatcaactagagtgagccaagacatgggaattgaaacaccaattccgatcagcgtgaagctgagagatttgaacaacattttctgcagaattatacatgctgcacagcagccccatttgagcattccagagactgaagctggcaaaacacgccggcaatatcggcaacttctaaaccgttcgctaatggttgtctctgttggagctgctgttgcagttgttggattagctgcttaccgggtttatgcagctcggaagaactcgtcctcttgaagccatcctggacaagtggggaaataaggtgcttccttcctgcagaccactttgcaacatcagctggatccatgctggttgaagtttgctgcttgggtttttttacccggcaggaaaccaacgtttttgtacagacgtcatctgctattaattatccggcctattggggtttcagattcctatataattgacagacatcacctggctccataaaatgccgtatctgataatctgttgttgctaaattagctcagctaaatattgttactaccctaaatttttgctctcttgtggtacttgcactagtctggtatttggagtctcttttcgttatcatcatttgcaaacatgctgagacgtttagtggaacagtcatgagttagtgttgtaccaagatttcgtttgggagtattcaattgaatttttttaagcac

SEQ ID NO: 13934 - DNA, 1532 bp, Sorghum bicolor
  Clone ID: SORBI-28MAY03-CLUS13302_1
gcattccgtgtcacttcctcgcgattctctctcgcatacatttcccaccccgggaatggccagaaccccttgaggcaagcagtagaacccacccgcggctcgctccagcagccccccacccccccatcgacgccgttggcgagcgagcgcacagacgcgcgtcgcaccacgtcagccacccacccaccaccgtcctcagctccggtgtgcagagccgttccgctggatggcctcgcgccagtagaatccgtccggcactttctaccccacccccaccccacctaaccggccgcggccgggtttgaccgagatcggcaggcggccgccggcgtctggctcgatcgatccgcctcgtctcagtcctaggtatggcggcggtggcggagggatcggcatctgcggcggcgaaggaggtggagtaccaggcgggcgtgcagaagctggtggacctgctgtccaagctcaacccggccgccaaggagttcgtcccctccgcggccgcgtcgccgcccaagaaggcgctgtcggcggatgcgccggtgttcgattaccgctccatcggaggcgggaatggggccaccgacgctgccttttacgtcgggtttgggaaccagcaccgcaggagggggaatggatacatcaaccaaggaaggaggaggacaaatgatagggtgaggcgtgcagagagagaggacagcattaggcgaactgtttatgtctctgaacttgaccatactgtgacagaggagagacttgctgatatctttgctacctgtgggcaagttgttgattgcagaatttgtggtgatccccactcagttcttaggtttgcatttattgagttctctgatgaagagggcgcgagaactgcacttaaccttggaggcacaatttttggtttctaccctgttagagttttgccttcaaagacagctatcttacctgttaatccaaagtttcttcccaggacggaagatgagaaggaaatggtcatgcgaactgtctattgtacaaacatagataagatggttactcaattagatgtaaagaaattctttgaagaactttgtggtgaggtctctcggttgagacttctaggggataatgtacattccacaaggattgcttttgttgagtttgtccatgctgagggtgccatcatggctctgaattgcagcgggatgattttgggaactctgcctgtcagggtgagcccttctaagactccggtgaagccacgtgtaaatcgagtgggacctaactgactctgcgtaagctgaactggatttgttcacgggaaggcatcgccataagatgaaggcttccgcggtccagtgcatcatgatgcatttgcttacatccttacaaacattctctttgtacccttttgcaaacctgctggaagggaactggttagatcaggcccttttatagccaacattcggttctcttgtttcattcggcatgatggaaccattgagaatgactattcggcaatcagccatcaacgtaacttatgttaatgctgttag

SEQ ID NO: 13935 - DNA, 1393 bp, Sorghum bicolor
  Clone ID: SORBI-28MAY03-CLUS12976_1
cctcctgggtgccatcgccattcattcacctccagctctctccaagccccggaaccttatcaccaaatcctcatcccatccccagcgtcatggcggccgcgctcttctccacctcgctctcgccacgcttccttgccctatcctccgcgaagccggctgcgcccgcggcctcagccttcctccccttcaggctgccgcttcgcgctgtgtcggcgccggggaggcgggtcttcgagcccgtggccgtcgcggtgtcgtcggagtacgagaccgagggcgcggagcaggaggaggagggagccgaggagttctccgaggacctcaagctgttcgtcggcaacctgccgttcagcgtcgacagcgcgcagctcgctgggctcttcgagcaggccggctccgtcgagatggtcgaggttgtatatgatagaatgactggacggagccgtggatttggattcgtgacaatgtcttcagctgaagaagctggagctgctgtcgagcaattcaacggttatacatttcaaggaagaccactgagggtgaactgtggaccgccgccgcctagagatgaatccgcaccaagagcaccaaggggtggtggtggtggtggtggcggtggtagctttgtcgattcagcgaacaaggtctatgtggggaaccttgcatggggcgttgataactcaactctggagaacctattcagtgagcaagggcaggtgcttgatgctaaggtcatctatgacagggagagcggcaggtcaagggggtttggtttcgtcacctatggcacagccgcggaggtcaacaatgccatatcaaaccttgatggcatcgacttggatggtagacagatccgagtcacggttgcagaatcaaagccgaggcgtcaattttgagattttgtttacgcagtttagaggttaatagtgtgtttcacaagttttagtttgtagcgtctattctttcctccatatgagtaacaagaagatgctgataatgagaaactggaagtgaaatatctgtacacaggaaaatatttttcccagccctacaatgaacacgattgcgccttcaaacagaagtagaaatcttaacaaagttgtgccacatgcgtacacaacaggcagtcaagagcacttttttctgaatgttcgtgatggcatgtatgaatgtatcgtgtacgtatgatccttctggaaagatgaatttatttgtttcagctgtaccacaaaattgtcaattcaaatctccctgccattgtctactgacggattctaagctttgactgcgtcgttctgttgtacttgagcccagctctagaaaaaaaaaaacttgtattcagttcaaaatgaaaatcgactttgcctggagaacttacaaaagtttcaaaaaa

SEQ ID NO: 13936 - DNA, 253 bp, Sorghum bicolor
  unsure (1)..(253): unsure at all n locations
  Clone ID: LIB3478-051-P1-K1-F4
cggacgcgtggnggactacactctggcacagtacaagcctgagaccttcgaggcccttgcttactatggtacaatagagaagcttgtgaaggatctgcgctaccctgaagagttgctgacttgggagtttgattggaaatatatggtcagaggactagttcttgataagaagagaggaaatatcttgaagaggatcgaccaagttgtaaagtgataccatggttaagacgcaagagaaagtgtgtatgagaca

SEQ ID NO: 13937 - DNA, 1981 bp, Sorghum bicolor
  Clone ID: SORBI-28MAY03-CLUS6481_1
gcacgaggaaattcaattcctgatttttgtcctgccatgaaccgttaggccatattgtatcggaaagaatttgcaactcaacacaaaacacacaatctagtgctgagttgcaaattcaattcctgatttttgtcctgccatgaaccgttaggccatattgtatcggaaagaatgcttccattattgtttcaccccagaatagtttcccttcaaaaaaaaaaaaaaaaaattagtgggacatgtgcacgtctattcaaatcagaagtgcagtttggtcatgctggtgccaagagtggtggtgagttggaatcagcacaagctaagaatcaggcactaagggaagctggtgcaattgtgccgacttcatatgaagctctagaaagtgcaattaaggaggcatttgacaaactggttgaggaaggaaaaatttctcctgtgactgaaattacacctcctcccattcctgaggaccttaaaactgcaatcaagagtgggaaggtccgagctcctacccacatcatctccacaatctctgatgacgcacgaggggaaccatgctatgctggtgtccctatgtctacaattattgaacagggttatggagttggtgatgttatctctcttttgtggttcaagcgcagccttcctcgctattgcactcagtttattgagatatgcatcatgctttgtgccgaccatggtccctgtgtatctggtgctcataactctatagttactgctagggctggaaaggaccttgtttccagcttggtgtctggattattgacaattggtccccgtttcggtggagcaattgatgacgcagcccgatacttcaaagatgcatgtgacaggaacctcacgccatacgagtttgttgaaggcatgaaaaagaagggaatccgtgtgcctgggattggtcacaggattaagagcagagacaacagggataagcgtgtgcagcttctacaaaaatatgctcacacacatttcccttcagtcaagtacatggaatacgctgtccaggttgagacctacaccttgtccaaagccaacaatttggttctgaacgtcgatggtgcgatcgggtcacttttcttggatcttctgtctggaagtggaatgttcaccaaacaggagatcgatgagattgtggaaattggttatcttaatgggctctttgtgcttgcgcgttcaattggcctgatcgggcacaccttcgaccagaagaggcttaagcagccactctaccgtcacccatgggaggatgtcctgtacaccaagtgagataggagccattctttgcaaggcataaagtattgttgtcgcctagggcttccagctgtctgtacacttcataaatcgagcagttccaaaaaaggattgttgatgaaactagggggggagagaggaagaggaacatcactagtcagcactagattgtgtgttttgtgttgagttgcaaattcaattcctgatttttgtcctgccatgaaccgttaggccatattgtatcggaaagaatgtttccattacttcttcttccagtccgtatctttcttcattgtcggtatcggctatgtcggcacaatcgtcccgcagtcgtaacagaagcatgttcgtggcatgttcagatcatccgcctctggttttcgcattgtcttcagcaagtttcgtagtcatgcggtcctctcttccatcgtccttgcgggcctccctccctgcggcctttgggggcaccgaccatgtagccttcggttgcatgtgcagtgctactggatcactgcaggaaagtttagagattggagccatatgggcaggaaatgtcggggcgtttttgcttatatattatagcaactttgtgctgtgttttaagggggggcaggtgcgctgcttccagggggcgcgggacggccgcttccactggtccagtcacgtgctgaggaacagaaaaatcaagtgttcatccttctcttgtaaa

SEQ ID NO: 13938 - DNA, 463 bp, Sorghum bicolor
  unsure (1)..(463): unsure at all n locations
  Clone ID: LIB3476-030-P1-K1-D2
catggatcttgccatccgggccagcctcaagggttggaagtttgtctaccttggcgatgttcaggtgaaaagtgagctgccgagtaccttcaaggcttttcggttccagcagcacaggtggtcgtgcggcccggcaaacttgttcaggaaaatgctcatggagattgtgacaaataagaaagtgacgatctggaagaagatccatgtcatctacaacttcgacgagattgtggaaattggttatcttaatgggctctttgtgcttgcgcgttcaattggcctgatcgggcacaccttcgaccagaagaggcttaagcagccactctaccgtcacccatgnggaggatgtcctgtacaccaagtgagataggagccattctttgcaaggcataaagtattgtgtcgcctagagcttccagctgtctgtacacttcataaatcgagcagtccaaaaaaaggatgt

SEQ ID NO: 13939 - DNA, 1000 bp, Sorghum bicolor
  Clone ID: SORBI-28MAY03-CLUS13896_1
gcacggcggccgttccctctcgagcgtgaccatggcggcgcaggggtccctcgtcacgtggagggcggtcttcgcggcgctgggcttgctcatggtggccacgctggtgtacaccatagccaccgacggctcgccgttccgccccgagctgcttacgccgtggatggtggcaacactgattgatttttatgtgaatgtaattgcgatctcggcttgggttatctacaaggaagcaaactggattagttctgccgtgtgggtggttctgttggtttgctttggcagtgctgctacttgcgcttatattgttaagaaactttttgaagtaacatctgcagggtcatcccaagatccacttgatcttctgtttatcaggcaaggtaatctatcccaaagaaagtgctcttatattgtaattggaagggttattttcagcattttggggatattcatggttgcggttgtcacatatactgtcatcactgatggactaccttttaggaaggaattgttgacaccgtggatggcggcaaccttaattgatttctacataaatatctttgcaatatcggtctgggttactcacaaggagtcatcttggatatcaactaccatttggattgtcttgttgatatgctttggaagcatcacaacatgcggctacattgtcctccaacttttcaaagtatcatatcaagatccaatctaccacgtgctattgaactctcacagcaagtatggaatttcaacttcactgtgataattcatcttctatgatcctggaagatttgaaaattcattgaagttgtatgtgcagcttggctggtaataccaaaatgttcgttctgtctatatgtaaggtaccacaattaacgggacagcaggatagcaattagagaagttatcttgctttgaataaaataactcatgtgctgacttctctgcaaaatgaaactgtaacctgaagttctttattgtatttctgatttaaattgcttgg

SEQ ID NO: 13940 - DNA, 873 bp, Sorghum bicolor
  Clone ID: SORBI-28MAY03-CLUS1738_1
gccggccgggccgggcgtgccgccagccccttaaccctcgtccctctcgcgcagccacagcctcctccttttccaccacctccacatcttccccggcggcggcgcggccagcttcaaccatggcggactccaaggccacctcggcggtcaccctccgcacccgcaagttcatgaccaaccgcctcctcgcccgcaagcaattcgtgcttgaggtgatccaccccggccgtgccaacgtctccaaggcggagttgaaggagaggcttgccaaggtgtacgaggtgaaggaccccaacaccatcttcgtcttcaagttccgcacccacttcggaggaggcaagtccactggcttcggcctcatctatgacaacctcgaggctgccaagaagttcgagcccaaataccgcctcatcaggaatggtcttgctactaaggttgagaagtcccgcaagcaaatgaaagagcggaagaacagggccaagaagatccgtggtgtcaagaagaccaaggctggtgatgccaagaagaagtaaacattcatttacatctgtaatactgttctggactctgggtggtctagttgcaatgtcataattgtggtcgtgttagattttgttccaccctcagcactgaagtgaagttttgtaattcctggttgtgaacctaccgagattggctgtagcatgttatgagatgagaaggttattaacttgcaagccaacctattttgtcaaaaaaaaaaaaaaaaaaaaaaaaacaaaaaaaaaaaaaaaaaaaaaaggaatgtatatggtgggggacaatggtattgacatcctttgaggactacagcgttctatactatttcacccttattaccctgtaattcaccac

SEQ ID NO: 13941 - DNA, 856 bp, Sorghum bicolor
  unsure (1)..(856): unsure at all n locations
  Clone ID: SORBI-28MAY03-CLUS17589_1
gccggccgggccggggctgacaagacacacctcacactacattcgtcacttggctctgcatcgttactttgggattagccactggggaaattaattaaaggagtactctattagggcaagaagaagaagagggcaacgatggcggcggcgatgatctccggaggacgggcggcggcgctggtgctggccgccgtcgtgctgtgctcggtggcggccatggcggcggcgcagcaggcgtcgaacgtgcgggcgacgtaccactactacaacccgcagcagaacaactggaacctcaacgccgtcagcgcctactgctccacctgggacgccggcaagccgctggcgtggcggcagaagtacggctggacggccttctgcgggcccgcggggcagaaggggcaggccgcctgcggcaagtgcatccgggtgacgaaccgcgcgacgggggcggccatcacggcgaggatcgtggaccagtgcagcaatggcggcctcgacctggactacgagacggtgttcaagaagatcgacaccaacgggcagggataccagatgggacacctcaacgtcaactaccagttcgtcgcctgctgattgatgatcactttcatcacccactccatcatcaagtactacagtacacatgtaataacaagccatgatatatatgatgcatgcatggcgtgatcgatgaataaaaccgatgggatagatagctctgcctgccgcaactgcgcaagcaagcccggatcatcatggtataaaccgcattggaatgcaataaagtggactacttattatatattaatttcaagaattccaaaccttggatganaaaaaaaaaaaaaaaggcccc

SEQ ID NO: 13942 - DNA, 637 bp, Sorghum bicolor
  Clone ID: SORBI-28MAY03-CLUS15929_2
ctccagggtccaagatcccttgctccgatcgccgtgcagcatttcaagaaccgctcaatccgtcgaggacgagatgcatgaaagccggcgggacatggatcatcaggtcgcccagcttcggggcgagctgcgcaaggtgcgcgacgagcgagaccgcgcgcaccgcgtcctggaggtgaccgactggaaggcgctggcttcggccaatgaccgcaccgcgattgagacgctcgaggccgatctcgccgtgtcgcgggaatccgagaaacggatgctcgactcgctggcgacgcagacgaagcagctggagctcaccaagatatcgctcgaggaagccaagctccagatcgcgtcgctgcaggacaccgtccagaggctggaggccgacagaagccccctcgccacgacgccgaggaaccggcgcgaccgcgacatgcagagggttcacggcgagctgcgggtggccctggcggcggaggagaagagcaagaaggcgatggaggagttcgtgcaggcgctcaaggaggtgaacgcggagctgcacacgacgagatgtgagctgcgcgcgcgcagcacgaggcggagtcggccaggctggacgccgaccgcctgcacatgtcggcgaagcgcaaggacg

SEQ ID NO: 13943 - DNA, 1518 bp, Sorghum bicolor
  Clone ID: SORBI-28MAY03-CLUS15929_1
gcacgaggtgcgaaccggactgcccagcccgccccgccgctttgccaagaccgcacgctccttcgaggcccagacgccgccaaccccccggcccatgtggcggcacgccgccgggactcgaggcgctccacaccggcgccacggcgcgcgagctcgcgccccgcgccgcaggcatggccgcgcctggaaccccctgccgcccgccagcgaagccgccacgcgggtgtgactggcagacggcccggcagtcccaggcagggtggagacaaacaggaggaactggaaaagctcccgaaggaagagaatgcacgtttcttggctgaggctcatgcagccatggaggctcgtcgagccgaagctgaagcccaagctgagcgtaaacgggattttgagagggagaaggcgcgtctggccctccttggggccagcgtggaccgctcccaccggccgttgctgtggctcttgttttttgttgctatataagaaaatatacatcctctatgcagatggagagaactgtagaaattaatgataacctccatatcaaggatttggaaatgcttgcacgaggcacaacagaacatattgtaagctctgttgatgagactagtccagagcgctctcaagatggcatggccggctatcatccaggatctgtcaatcctttggagcaacttggactgttcataaaggccgatgatgaggaagatgatgaagaaccgagcagtgttcccagcattaaagaaccagaggaaggagagatcaactgatggtgctgtgttttgccatgccctgtcaagggctagaggctggtgccaaactagtgatccaacaaagtgatcgcctcttgtgggccatcatgtgtggcacaatggctggacagcagcgcgtgttggatgctcaattggttctgaactggtggtgaaagccctcctccatattgctgctactggtttgttaaaatatgcttgggaaggatgaaggtaatctttgcatgattggtaaatgagtggtcatttgcttcgaggaggcgcacaggaggtcgagttggtcaaatgaacgtattgatgtgcctagaggatgttttttcagccaccgttccaaaacggcttgaatgatgccaccgaactagtggagttcaaattgctcattatttgctgcaacctccatttcaagccggtttgctcagcggctcatatagcctgttttctcatctttttctctgttttagattgtgtagcagttgggctagttgcttcctgctgtaaatccgaattttgatgtagtgaaggaagtgctagctgtttgttgagcacgagcgaaaagaactgctcttgctcagcatttacaagagaaattgttttgcagatgcacgtccagtcttctctgtaattaccatttcttgcgcaatcagtgtcttccgtgtgacattgttccatcagtgttttgaagcggcaccttccatcgaagggacgcctcaattagtgttagtaattagcagttagtcctttcgacgct

SEQ ID NO: 13944 - DNA, 1760 bp, Sorghum bicolor
  Clone ID: SORBI-28MAY03-CLUS34981_1
tctggctgctgaagataaccctgcggttatactccctgatcacctacaagctgcaaatgcagactgtgctcatttgagctttggtagttttgaatctggtgccttctctggcttgctttcgtcaaaggtcccaaaaggcagtttggaggacgatgaggtgcgtattccagatgaatcccgatcagttaatcgaatagatgacaggaatcaagattactatgacaacgatgctctaaattcttcagcaaatgaggatgttgagacaagaattggtactaacatggataacattgatggaccttcagtttcagagtctgatgtactgaggcagggggccatagctctgcctggtcttcaatatgagctgccatcagtttcaagtcatgcatattcaaacacaacacagccaattacaatggaagacccacaaggaaacacacaagcacaacccctttcccatttttctggcttactgcaagcaaatactctacccaataacttgttggggtcaaatcatacccctcttcgggagtttgacttctcgcagttgcttcagacacagtcagctccaaagtataacccatctgttgcacctaataatctgccagcaatctccatgcaagagactttaaaaccaggaggcttccccaacactcagtctacacaacatgttcccagtacaagcattccgtcgggtcttcctctcccacaacaattgcctgtatactctcagccaactctgcctcttgggccttttaccagcctggttggctatccatatttgcctcagaactattacctaccttcagcagccttccagcaagcgtactcaagtaatgggcctttccatcaatctgctgctcctgctgtgcctggagctggtatgaagtattcgatgccacaatacaagagcagccctcctgcttcaagcttaccacagccatcatcgctctctggttatggagggttcggaaatgcaaataatattcctggaaatttcagcctaaatcagggtgctccctctgcgcccacaactttgggatttgatgaagctttaggcacacaattcaaagaccccaaccattatgcagctctacagcagagtgataattcggcaatgtggcttcatggaggcgctggttcaagaacagtttctgcagttccgcctggtaacttctatggtttccagggccagagccagcagggtggcttccgccagacacatcagccctctcaatacggtggtcttgggtacccaagcttctaccagtcgcaggccagtctgccacaggagcacccccagaaccccaccgagggaagcttgaacaatccgcagggggtaccatcccagccatcgcaccagctctggcagcacagctactaaaccttctgtgctctcttgagagatgcctctctacactgccaggttacctgcaaagccttggcatgctgcgccgtgaagcgagcagactagctgagctgccgtcttgagcgctgctgagcagaggaggatccatccaacagcgatgaagtgtgttgtttttcttttccttttttttcccttccagctgtgtgttctggatcaaaattaggctgtcgtggtttttacttgatagtgagtggtgttgcagaggtgctatcttgtaacggtaaagtcctaactcatctaacagatctgcttctcatacccctgtaatgtgccattttgttcttgatgcctacaagcttctacgtgttccagctacccttgttatgcatgc

SEQ ID NO: 13945 - DNA, 2362 bp, Sorghum bicolor
  Clone ID: SORBI-28MAY03-CLUS3666_1
gcacgaggcaggaactcatggagagtcatatttgcagttctctagtgctactggtgatttgtctgcaacagagaacagcttcccacaacaaaatgatggttctctggaggcagccattggttatccatttttgaagactcagtcatctaatctatctgatatcctaaaagacagctttaagaaaactgatagttttacaagatggatgagcaaagagcttcctgaagtggaagattctcaaattcactctagttctggggggttctggagcacggaagaagcaaataatatcatcgaagcatcaagccgtgagccgctggatcagtttactgtttccccgatgctctcgcaggaccagctgtttagtatagtcgattttgctccaaactggacctatgtgggttcaaagactaagattttagttgctggtagcatcctgaatgacagtcaaatcaatgagggatgcaagtggtcatgtatgtttggagaagttgaagttccagcaaaggttttagcagatggtactctcatctgttattctccccagcatagacctggtcgagtacctttttatattacctgctccaacagattggcctgcagtgaagtgcgggagtttgaatttcgaccaactgtctcccaatacatggatgctcctagtccacatggtgaaacaaacaaagtttatttccagatacgccttgacaagttgttgtcccttggaccggatgagtaccaggcaactgtatctaacccaagcctggagatgattgacttaagcaagaagataagttcactgatggcgagcaatgatgagtggtccaacttgctaaagttggctgttgataatgagccttctactgctgatcagcatgatcagtttgctgaaaacttgattaaggaaaagttgcatgtctggcttctaaataaagttggtatgggtggcaagggacccagtgtgttggatgatgaagggcagggcgtgcttcacttagcagctgcccttggatatgattgggctataaggccaacacttgctgctggtgtgaatattaatttcagagatgttcatgggtggactgcactccattgggccgccttttgtggccgagagcggactgtagttgcgcttattgcactgggagcagctcctggagctttgacagacccaactcctgatttccctggaagtacaccagcagatctcgcatcagctaatggtcaaaaaggaatatctggtttcttggctgaatcttctctgaccagtcatcttcaggccctcaatctgaaggaagctaatatgtctcaaatatctggtctacctggtattggagatgttactgagagagattcactgcagcctccaagtggagattcattaggtcctgttcgaaatgctgctcaagctgctgcgcagatataccaagttttcagggtgcaatccttccagagaaagcaagcagctcaatatgaggatgataaaggtggaatgtctgatgagcgtgccctctcacttctttctgtcaagccacccaagtcagggcagcttgatcctctgcattctgctgcaactcgcatacagaataagttcagaggatggaaggggagaaaggaatttcttcttattaggcagcggattgtgaagatccaggctcatgtgcgaggtcaccaagtgaggaagcattatcggaaaatagtttggtctgttgggatcgtggagaaagttatattgcgatggaggcgtagaggtgctgggttacgtgggtttcggtctacagaaggttcagttgagagcagtagtggtggaacaagtagcagttcaatccaagataagccttctggggatgattatgattttctgcaagaaggacgaaaacagactgaagaacggctccagaaagctcttgcgagagtgaagtccatggctcaatacccggaagcaagagatcagtaccagaggattttgactgtcgtgtcaaaaatgcaggagtctcaggctatgcaagaaaagatgctggaggagtcagcagagatggacttcatgagtgaattcaaggaattgtgggatgacgatacacctatccctggttatttttagtgtttaaacctaatttgttggatttctctgtagattgcccccaaagtagcgttgctggagcatgacctgacatgcttcgatttggacttagatgtggtatttcttttgccttatgtacagtagaatgttatctacatttgaaggagccttgtatctactgtgtgaaatctgtgtaaagagttgacattagagatcttaccagatgacttaacggttgtatgtgtacggtgcagtgcagcagttaggaatttgagatttattttt

SEQ ID NO: 13946 - DNA, 824 bp, Sorghum bicolor
  Clone ID: SORBI-28MAY03-CLUS1770_1
gtcggccgagaaccggggtagcgcaaaaaaaaaaaaaaatctctgtttcgttagtgccttgcgtgaggaggtcggagtcggaggcagccgaaaactcagggtctcgagtttcctcggagcggaggcgatggctgggaagggaggaaaagggttgctcgccgccaagaccacggcggccaagtccgccgagaaggataaggggaagaaggcccccgtctcacgctcctcccgcgccggcctccagttccctgttggacgtatccaccgtcagctgaagcagaggactcaggcaaatggccgtgttggtgccactgcagctgtgtactccgctgccatcctggagtacttgactgctgaggttctggagctggctgggaatgctagcaaggatctgaaagtcaagcgtatcacccctcgccatctgcagctggccattcgtggagatgaggagctggacaccctcattaagggaaccatcgcaggcggaggtgtcatcccgcacattcataagtccctgatcaacaagtcttccaaggagtgaagactagggatgtgcatctttagtttaaactggacttttgtgctctcctctgtgagtccctgtcgtcgtgtaggttttagttgagctgtcaggttggagtgatccttctgtgtaacgcttgcctggtactgcttcagttatttggacactgtgtttgtgttgagttgttaacttcaggggtgcaaacctggatgcttatttagttatgtgactatctggcactattcggtttatgctaaaaaataaaaacatgttttacaaaaaaaaaaaaaaaaggccccta

SEQ ID NO: 13947 - DNA, 1386 bp, Sorghum bicolor
  unsure (1)..(1386): unsure at all n locations
  Clone ID: SORBI-28MAY03-CLUS15159_1
actgtgcggcgctcgaggcggccgggccccgggacacagcacgacatacatacatagacgacgatcatgatcatgatgaaggtgcacggcatggcaggggttgtgctggcagcagcaatgcttctggctgcagtggtggccgtggcggcggcaccgccacttgtgccggtgacggacaaggacctggagtcggacgccagcatgtgggacctatacgagaggtggtgcagcgtgtatgctgggtcgtcggacctcgcggagaagcagcgcaggttcgatgcgttcaagatgaacgctaggcaaatcaacgagttcaacaagagggaggatgagtcgtacaagctcgccctcaaccagttctccggcttgaccgaggaggagttcaacagcggcatgtacaccggagccttgcctgaattagacgccggcggcaacatcagcagcagcgttggtaccagtggcatgagcatgaccgacgacaacgacgataagttgctcgtctccgccggcggcaacgacgataaggtgccggccaagtgggactggagacgccacggagctgtcactccagtgaagaaccaaggacaatgcgggagctgttgggctttttcaatggtgngtgctcgagagggcatcaacgcaatcaagacagggaaactgcagacactgtcagagcaagaggtgctcgactgctccggcgctgggacctgtaaaggtggggacccgtacaagtcatttgatcatgccatgaggcctggattagccttagaccatcaggggaatcctccctactaccctgcctacgttgccgagaagaaaaagtgcagattcaacgcggagaagcctgtggtgaagatcaacggcaagagaatgatgagaaacaccaacgaggcggagctgctgatgcgcgtgtccaagcagccggtatctgtcgtcgtcgaagctagccaggccttcagtcgctacagcaagggtgtcttcacggggccttgtgggacaaatctaaaccacgcggtcctggtcgtgggctacggaactacgcccaacggtatcaactactggattgttaagaactcatggggcaaaggttggggtgaaaatggctacatccgaatgaagcgtaacgtgggtaccaaagcaggtctctgtggcatatacatgatgcccatgtaccctatcaagaataagtaattgaccggccatgtccggtgccacactgccacctactactactgcagccagcagatgcatgcttagttgcttatgtacgtacacaaattctactcataagaaagaaagaaaaaaagaaataaagaaagaaacgagtaagtaacaatcgaaataaataataactagtgtggagtttatgtgaacgtgtgtgtgtag

SEQ ID NO: 13948 - DNA, 1113 bp, Sorghum bicolor
  Clone ID: SORBI-28MAY03-CLUS17745_1
ccgctgcgagcccggggggccgggacggtatccacagcttaattaggatcgactgatctgagagagtagtacgtgctgcagctcaatctcgatcgataatggtgaagggaagcaagcaccacgagctggaggccgacgacgtcccggcgtccgagctgtggaagatctacggcacgctccgcttcgtggagctggtccacgagctgctcccgcaggtcctccaccaggtcgaggtcctcaggggcgacggcaccgtcggcaccgtcatcaaggtcaccttccctccagggaaccctggggtgcagacctacagcgaggagttcgtcaaaatcgacaacgagaaccgcgtcaaggaggcggcggtcatcgaaggcgaccttctgaccctcggcttcaccacgtacctgacccgtttccagatcatcgacaagggccccagctcttcggtgatagcatcgacggtcgagtacgagtacgacgacggccgtcctgagctcgaagcggcggcgtccactgcgcccttggctgccgctgctgagagacttgtccagtatgtcaaggagcagatgacgacgacgacgactgcccaggcaaccgccgcctgaaacgaaacgaaaatactcagaactgcgactagcagtctagcaccggtttctgaggacgatcgaacaaaatgaacgtgtgattctggtactgtaaaactgagcatgcaagctgttaccatgcatgcctaccatgttgcgatctatcatctgtgtgtgtcgttgtctggttacctctggtttgaataacggcattttctaattttccattcatatcaatttagtgacacttttcgtttaaaacaccaaaccatatcattggcacaatatgtgaactggctttgcttctcgcttctatcatctgtgtgtgtgtgtgttttgtctagttacttcggttttgaataatgggaattttctttttctttttcgtcattcatatcacttgagtgacacttttcgcttttttatatataccaccaaaccagcaggagatgtataataataataataatgtctacatctgtactctactgtactgtatttttcattatcattgtcctttcctcctgta

SEQ ID NO: 13949 - DNA, 1334 bp, Sorghum bicolor
  Clone ID: SORBI-28MAY03-CLUS25429_1
tgaaaagcacgagggaaaaaaactaataagcgaggcaggcgaggattcggcaagctccgacctcatccgctgcttgcctcgcaactatcggatcttgcgaaggcatcctcctcttcgtctcccccgtcttataatcgcatttcgaatccccaatcggagacctcgccgctcttccgagcttctaatcgaaggaacagtcaccgtcgttaagaggatgatacgctgcgctgtaacggccggcgggtgcgtcgcttcgtggagcggcgatcggaggtcgccggcggtcaacaacccctgcagcgtgcggatgccgacgggcaacggtggtgggtggtgcggcggcctgaggtcgcgggcggcggatctcgccggcctcgagatggccagcctgcgtggcggcgtcgggggcctcttccgcgcgagcccgcgctatgggcgcttgcaagccacggccgcagttgaccctgaagatattccattggagaaggttcaagttaaatcctcaggacatgttctgccatatgttggcgttgcttgtttgggggctattctgtttggttatcatcttggtgtggtcaatggcgcgcttgaatatctcgcgaaggatcttgggattgctgaaaatgctgtcttacagggatgggtggttagcacatccctggctggtgcaacactaggttcttttactgggggatctttggcagataaatttgggcggacaagaacattcatcctggatgcagtccctcttgctctaggtgcattcttgagtgcaacagctcaagatattcgcaccatgattattggtcggttgcttgctggaattggtattgggatctcatctgctcttgtgcccctctacatatctgagatctcaccaactgaaattcgtggaacacttggttctgttaatcaactttttatctgcattggaattcttgtagctttgttagctggattgcctttggcaggaaatcctgcctggtggaggacaatgtttggaattgctgtagttccatccattttgctggctgtaggaatggccttctctcctgaaagccctcgttggctattccagcaaggaaaggttatacaagcagaatcagctgtcaaaagactgtatggaaaagaaatggttaccgaaattatgtatgatctgagagctagtggccaaagttcttctgagcctgaagctggctggtttgatcttttcagcaagcgttactggaaagttgtgagtgtgggggcagcactgtttttgttccagcagcttgctggtataaacgccgttgtatattactctacatcagtgttccgcagtgcaggcattgcat

SEQ ID NO: 13950 - DNA, 2314 bp, Sorghum bicolor
  Clone ID: SORBI-28MAY03-CLUS25613_1
aagaggccactcgcaatccgccctcagggcctcgctcgctcagatctctccgcccgcgcctgcgtccccttgtccgcgtccctcctcccaccccccaaaccctcgcccgcctctctcgtcaacgccgcccgacgagagcgatggcggcctcgccggccccggccgcggccgcagcgctcctcgtcctcctcgccctcgcggcggccggcggcgtggcggccgacggctccgaccaccggtacaagatgaacgagcccgtcccgctctacgccaacaaggtcggccccttccacaatcccagtgagacatatcgttacttcgacctgcctttctgctctcctgagaaagtgagggagaagagtgaggcccttggtgaggtcctcaatggggatcggttagttgatgcgccttacaagcttgatttccgtttagaagttgagtccaaggcagtttgctcaaagaagcttaccgtagaggacgtagtgaagttccggaatgcagtggcaaaggactactacttccagatgtactatgatgatctcccattgtgggggttcattggtaaagttgagaagggaggcaaggctgatccgagcgagtggaaatactacctgtacaggcacatcatctttgatatcctatacaacaacgaccgggtgatcgaaatcaatgtgcacactgatcagagtgcattggttgacctgacggaggataaggagaccaatgtggaattcctgtactcagtcaagtggaaggaaacaccaacaccattcgagaagaggatggagaagtattccagctcctccaacatgccacaccacctggaggttcattggttctcaattataaactcttgtgttactgtcctcctcctcacagggttccttgcaacaatcctcatgcgagtattgaagaatgattttgtcaagtatgctcatgatgaggaagcagctgatgaccaggaagagtctggatggaagtatatccatggtgatgtcttccggttcccaaagaataagtcactattttctgctgctcttggcacaggaactcaactatttgccctcacaacctttatatttcttcttgcacttgttggagtattctacccctacaaccgtggtgcactatttactgcattggttgtcatctatgcactcacttcaggaattgctggatacgttgctacctctttctattgtcagctggaggggacaaactgggtgaggaacttgctattgacaggatgcctgttctgtggacctctcttcctgacattttgcttcttgaacactgttgctattgcttatagtgcaacagcagcattgccctttggcactatctgtgtcattgtgctcatctggaccttggtcacatttcctttgcttgttttgggaggtattgctggcaaaaacagcaaaagtgaattccaagctccttgccgtaccacaaaataccccagggaaattcctccgcttccctggtacaggagaactgttccacagatggcaatggccgggtttttgcctttcagtgccatatacatcgagctatactacatctttgctagtgtctggggccacaggatttacacaatctacagcattctgtttattgtcttcatcatcctccttattgtcactgcattcatcactgttgcactgacatacttccagcttgctgctgaggaccatgagtggtggtggaggtcattcctatgcggaggatcaactggatttttcgtgtacggctactgcctgtactactactatgcgcgatcagacatgtctggcttcatgcagacatctttcttctttggctacatggcctgcatctgctatgcattcttcttgatgcttgggatggtgggcttccgtgcggccttgttctttgtccgccacatatacaaatctatcaagtgtgagtgagcggttgttggaagatgaagagcagcagagttgtacccgtttttggtgcccactgagaagtctcaaatatagaaaaggttagctctcgcgtgcaacaggagcagctagagattgccatgtttcagattaggccattatttataggaacaggtaatgaacctataaatttgttctgtttttgtgactgctgtgataaaaatcgtcttttccttcgtcctatgtattatctcctagtgacgtcagacagtactataacttttgttggaaccgtgacatgctgaatatctgtggaatacccatgttatgttgtcatatatattctctaaagcatataataataatagaagtgtagagacgatgcctgaggcacgtccatttgtacgtgt

SEQ ID NO: 13951 - DNA, 1537 bp, Sorghum bicolor
  Clone ID: SORBI-28MAY03-CLUS2718_1
gtgcctgcccaccttcgagtgacctcgattattctgttcgctctcgcccaagtcatcgtctggtcgtcgcccgcagacgcccggggggccgccatggccgcgtcggatctggagagcaaggccaaggaggccttcgtcgacgacgacttcgagctggccgccgagctctacacccaggccatcgacgcggggcccgccaccgccgaactctacgccgaccgcgcccaggcgcacatcaagctcggcaactacactgaggctgtggcggatgctaacaaagcaattgaacttgatcctacgatgcataaagcctactaccggaaaggtgctgcatgcattaagcttgaagaataccaaactgcaaaggctgctcttgagttgggttcttcctatgcatcaggcgattcaaggtttactcgtctattgaaagaatgtgaagagcgcattgctgaggaatctagccaggctccagcaaagaatgttgagcctcctgtggctgctgctgctgctactgttgaggacaaggaggatgtcgcaaatatggagaatacaccgccagtggtagaacccccaagcaaacctaaatagtcccatgactactacaacagtgccacagaagtggttttgacaatatttgctaagggtgttcccgctgatagtgtagtcattgattttggtgaacagatgttaagtgtgtccattgaagtccctggtgaagaaccataccattttcagccccgtctgtttgctaagattatccctgagaaatgcaaatatcaagtcttgtccaccaaggtcgaaatacgccttgcaaaagctgagcaggtgacatggacaaccctggattatagcggaagaccaaaggctgttccccagaagataagcacgccagctgaaacagccccaagaccttcatacccatcttcaaaggcaaaaaaagactgggataaactggaagctgaagtcaaaaaggaggagaaggaagaaaaacttgatggtgatgctgcattgaacaaattcttccgtgacatctacaaggatgctgatgaagatatgcggagggccatgatgaagtcattcgtggaatctaatggcactgttctctcaaccaattggaaagatgttggatcaaagaaggtggaagggagccctcctgatggtatggagctcaagaagtgggaatactaaagttcggacttgcccgtcttttgtaaatccaggtctttggaaattatgatctagtaacgtccacccatttgggtgctgagcttggttaaagtcttctgctttttgtaagctttctgtatgacagtctagcgtgtctgagtgctgcttgccgtagtttttgatggacatatcatggtatgctattctgtggtatcaacatctgtggtaacaaagacagtaaaactataatctgtggaatgcctattctttttggtctaaagatgtttttcttgttagcaaagccatattgtgatcttcacaactgaatatagtactctgcagtgacttatgttacattggtttaccgtgg

SEQ ID NO: 13952 - DNA, 1210 bp, Sorghum bicolor
  Clone ID: SORBI-28MAY03-CLUS2608_1
gcacgaggatcttcggcagggtccctggtcgcgcctagggatatgagtttcgagcggctggtctagtgccggaggccccctggaaggaatgcatttctgggcgagattctttgcttgcacacgattttttattgatggcgatgacaaatgtcaagataacaatgtttctactattctgacatctgcgagcttggttagaaattctgatcctttcgatggtgagaacaaggttattgacggtttgaagattgaagtgaaacatacaaaaggaccactactagaggggtcactaatacattataatctagattataatgtggctctagtcagtgtcaagagactcaagagttatagtgcctgccctcttgcaatttggcaacggaatttgatatatgagtcttctaagggagggcctgtagggtgttgcctgtcaaacgggcaaattaatggcttcaggtgggaaactggttgcctggtcaggctcgcttgattgcaaattgcttatctactccacatgtgaaatcaccaaggctgggattggagggcctcttgttgattttgatgggaattttattggcatgaacttctatgacccgaaattgggcaccccggctgtgtcttgtgatgatattgttgatgtcctagaacgttttaaggaaaaatggactggtggagttgacagtttgtctaatccaaatggtgtgggtggtgttcaaggagattgcagtgttagtctgaactggtggccagtgcctaggccatattggcgtcagccagatgaacctgagaagtcttatttggatgaatatgaacgtggggtcctagacagcggcagcaagttcgagtacgttggtggatacatatacattctgaagtagtcgttttgtgagcttgtctgagatgctttctatataattgtaaattacttaagatatctcacttactattccttgtaaattagtcatgtaccgaattgtgcttgaagcaatctgaagttattttcatgtggatctgtaacaatgcggcagtttcattagctagcatctatagtcttatacagcggcgccaggctccagtacgggggtgcattcgcattctttcggttgtggtcgctccggggcctcgtccgtggcgccttctcgatatttggaaattacttaagatatctcacttactatccttgtaaattagtcatgtaccgaattgtgac

SEQ ID NO: 13953 - DNA, 1585 bp, Sorghum bicolor
  Clone ID: SORBI-28MAY03-CLUS5848_1
agaagcggcacgagggccgcaagaagcgaaccaacccaaaccctagccgattcgcggcgccttcgcacgccgcaccgtcgtccattcatcggattctctagcaacggcgtccgaccgcgccttccctccagtcaaggtccgctcccgtccacgtccagatcggatcgggtcggatggcttgtgagttaggcaagatggggcaggagaaggcacggacacctactatcgcctgcgaaagggggaggacggacggaggtcgattcgaggatgagaaggaggacgacgatgatttcgaaatcgttgggttccgtagaacatgggaactctgctatgccagtgactacggttccttcgaggacatcactgtgccctccatgcgctatacgtttagacccttcccaaagaatgccatacgccagggcggattgcagttcttctccgctaaagtcgccgaacttaaagaggaggaaggtctccactggccactgcacgtttatggcttgattgccaccagggactccgcagatcctagacgaaaccttcttttcgaccgcactagggatagttgccaaatcataactcaagaggatcccattttgcagttgacaggcccctctcgtgctgtggtgttaattgatccagttactatcgaagttcaactgaaagcaaagtgcaaaactgagtctgaagataaggtgctcaacttcagtgtgtttgaatacagccatcaagattcttatgaggaacctcctttcttaactacaatatatacccgctgcaaacgaagtaaacttgagtttgcagttgcgtttcttgttcaatcagttgaggccacagtccgtgtgagagttgttcgtgggtcatggccggatcattttcgaggacaaatcatgtcccgtacagccagtatcagtcatggtgctattgtgctactagattctcgatatggcagaatgaatttcaacaaatatggtgtaattgagctttcaagatgtgttgtttctgtggaaccatgtggacaactgaaagttgatgtggtggcttcacaagtcgatgatgatagaaatgttgttgcacaaggtctggttgatttcacaccgaaaatggccggtgtcagtcatggtatatgtgacctaggcttctgtgtgctgagattcagcgttcactggtcccttccctgctatgctggcgagcatgtgggcctgattacaaaataaggttctctttggctctagcagtatatagggtcgtcgtaggtctggccacaacaaatgagcgccccagttttagcgtgcttcagcgcactagctgagcacaagtgtggcacaccgcattaccggaattgaagcaaacagcaagctaacgtctggcagaggggggctgattttcagcgagtttttcatgttctcctgtgtctgttttgatgaaatgtctatatttggcatttttggtggcacattataaagctatctgactgtttctgtactcaaatcatcagatgcatttgtattattaatatatatcagtcttgctgttatttgtaagattgatttctaggtctatatttaaatggtttgttgtcttc

SEQ ID NO: 13954 - DNA, 1741 bp, Sorghum bicolor
  Clone ID: SORBI-28MAY03-CLUS5797_1
gcacgagggtttgtacccggcctttatacaagggtcaccccttgccttctctcttcccctctgcaccccgcgcacgcggtctctctctactctcggcggcgactgggtgacagccgctgcctccctacgcctggtgcccaggtatcgttcgccgccgacgagcaccggccaggggtatgggaatggaggtcgttggtgctgaagcagcaccagcagaggtcaaagtatctgatggagaagtgaatctattccaagagaaggaaagcaaagcaactgcaaaagaacgtgaggaggcagttgtttttggttcagagacaactaccaacattgctgatctggcacctccaaaggatgcgaaggatgagtggcctgaacctaagcaaacttatgccttctacttcatcaagatccgctcatttgaggatcctaaactgagggcaaaactcgagcaggctgacaaagaattccagaagaagatccaagctcgctctaaacttattgaggcagtaagagccaagaaggcagagcgctccagtattatcgcggagctgaagccattgagtgctgagaacaaacaatataatgaagttgtgaatgagaagataaaggagatggagcctcttcggaacagcttgggcaagtttcgtgatgaaaacaatgccatgagggcacagagtgcaggtttatgctcttctatcgaagagcttgacctaacgatcaagatgctgaatgatcggatggtgcatgagagcatacctttatctgaggagaagcgtctggtgaaagaaattaaggaccttgaaaaaaccagatcgaaagtcatctctaatgctgctaacagggctaaactgcaaggtacagtggttgaaaaagaggctatacaagaccaggtcaaaatcatcggggagggcattgatggaataaagaaggaaagacaggcagtaagatctaagattaaggtcctggaggatgagttaaaacttgttgatgctgagattgcatcgcttcaagaagatttagatgcagcaactgccagaaaggacaaggcgtatgaatcgttgtccgaattgagagcagtgcgcgatgcaaaaaacgcatccgccacgcaaaaccgtgcagttttaggcaaagctagggattgttcttcaaggaatatgctggcagaattgcaagagctccacaagactgaggtcgacaagttcatgacccaatggtgtgaaagtaaggccttcagagaggactatgagaagagaatccttgcctccctaaatagccgacagctgagtcgagatggtcggatgaggaatcctgatgagaagcccatatttatcgagtcacaggcgccagctccagagccagagcccatccctgtaaaattgcctgcaaaacaaaccaaagaagtgcctgctccccaggaagatgatgctcccaagattgaagctcgttcaaaaggacctgtcaagtcgcacaaggcaaaagctgctcttgatgccgatgatgattatgaggctgagcccccgaaggagaaggccaagcctacggaggctgatgtggcaaagttgaaagagatcaagagacaggaggagattgagaagaacaagcttgcgctggagaggaagaagaggcaggctgagaagcacgcagcaaaagccgcggcccgagcacagaaggaagctgagaagaagctgaagaaagaggagaagaaagccaaaaagaaatctggtgcagctgacaccgacga

SEQ ID NO: 13955 - DNA, 1327 bp, Sorghum bicolor
  Clone ID: SORBI-28MAY03-CLUS26709_1
gccgaacgcgaagctcgagctctactctaagctcagcctcacagctgctcctctcgagctagagtgttactaggagtagcttcagaagaaaccgctcgcgaaaatgctcgcttagaagaaacaccagcttgcaggctagcacacagccgcagcggcaaccatggcgaaatcctactcctaactgttcggcggacgccgccgcctcaagcgtccagccacccccactgcgctcgcccgcatgctcgtcgggcgccacgaactgcattccagccgcagggggttcgccagcttcttcgcggaccgcagcaactgcgcccggacctcctcggcggccggcgttcacagctccggcggctggctgactgccggcgcggcgcactacgccgcccccaacggaggcggccgtgacggcggtgcgtgcgggtgtaagagcgccgtcgggcagccgccctttctcgtcgatgtgcgcctccttgttcccggcgttggccgaggaggggagcgtctgctgcgaccgaatcaggttgctggctgggtgctgtaccacgcgctgtgggcgggcgtcttccgccacgaaatccttccagagaactgaactcctgttttccggtttggccggtaggctccccggcaggcagagtcccatgaacgccgcgtgaatcttggtcataatttccttcgtttaatttgccgcagggtgccgtgcaagtacagcggcgtgaacatcgccttcagggtggaccagggctccaacccattctacttcgaggtgctggtggagttcgaggacggcgacggcgacctcagcgccgtggacctgatggaggccggttgcggcacctggacgccgatggtgcagaactggggcgcgctgtggcgctacaactccaacaccggcaaggcgctcaaggcgcccttctcgctccgcctcacctccgactccggcaaggtgctcgtcgccaacaacgtcatccccgccggctggaaccccggcgccacgtaccgctccctggtgaactactcctaaattacagctgcagcgttaaggtgtgtgcttgcattgcatccgggcttttgcgagaggcggtgtcagaagatgaggaggaggttgaaggatcgagttcttccctccctccacggcctctgcagtccccctagtgatgtttgagtgtgtcgacttctctgtaattttgttttgttttggtcgtcccggtccctttgttgcaagagccgcgaccaattatcaatgttgcatgcagatgtataagttgtgtgagtgtttttttgtaccacgcaatcctttgagataattgaagtactgcttccc

SEQ ID NO: 13956 - DNA, 1651 bp, Sorghum bicolor
  Clone ID: SORBI-28MAY03-CLUS28461_1
gcacggcgcggcagctagctagtgccacacacacacctcgcccagcggcactgcagcagtctggtaggtgccactcgctcgctctcgctagctagctcagcgagaggtgccgttgctttctgctgccggccggccggcccgcgcgagtgagtgatcgactgcatcgtcgacgtctcgccggccggcgtgtccggcctgcaggctgaaagtgtaaaaaggaccgacgacgtacgacggcgacgatgaaggtgtcggcgctgtgcgcggcggcggtgctgctgctgctggtggcgcaggcgccgtcggcggcggaggcatcgcacctcaagctggggtactacaagaagacatgcccgggcgtggagaagatcgtcaagtaccacgtcgccaaggccatcaaggccaaccgtgccgccggcgccgccctcgtccgcctcatcttccacgactgcttcgtcagggggtgcgacgggtcggtgctgctagacccaacgccggcgaacccaaagacggagaagacggcgccggtcaacatcggtctagccgccttcgacgtgatcgacgacatcaaggcggcgctggagtctcactgcccgggcaccgtctcctgcgcggacatcgtcatctacgccgcgcgcgacgcgtcgagcctcctgagcaacgggcacgtccacttcgccgctcccgccggccgcctcgacggcgtgatctcccgcgccgccgacgcgcagcgggacctcccggactccaccttcacgatctccgagctgatccgcaacttccggcggaagaacttcaccgtcgaggagctggtgatcctgtcgggcgcgcacgccatcggcgtcggccactgctcctccttccgggcgcggctgtcgtcgccgccgagccagatcgtgccggcgtaccggaacctgctgtcggccaagtgcgcggcgggtccggaccccgtggtgaccaacaacgtccgcgacgaggacccccgtgccgtggcggcgtcgttcccgtcgttcttgaagaagctccgcaaggcgaaggatttcttggataacagctactaccacaacaacctggcgaggatcgtcaccttcaactccgattggcagctgctgacggagaaggaggcgctgggacatgtcaaggagtacgccgagaatggcacgctgtgggacgaggacttctctgacgcgctcgtcaagctcagcaagctgcccatgccgccgcacagcaagggggagatcaggaagagctgccgctgggtgaactgatgatgacctgatgatgatgagccatatccaatccattacttgcagctagtgtgtctgatctcctggactgcatctcgatctggatgcatgcgtgcacaccggaaattgtgattacttactggtatacaggatggatcgtcatcatgttgatcggttcatttgattcttggttctttttggttttattgttgtatgtttgtttgattatttatttccctgcttttcatgtgtttttcatcatttctgaattttacatacatcatatgcgtgttttcaccgagtagggtgggtgttgggatcgatgtgcatggttgatctgttgttgtatcttgtccttgtatggagtttggacaaactaataaaacagattaaattaaaggtgg

SEQ ID NO: 13957 - DNA, 1186 bp, Sorghum bicolor
  Clone ID: SORBI-28MAY03-CLUS2848_1
gcacgaggcacaagacacgcacaaaggtgggccgtcacaagaacacacacacacacacacacaaggcaacagtctccattctccacaccacacgaccaccagctcaactcagctctcactaaaccccatccactcctttatcatcgtctccctccctccctccctctccattctcagctcagctgggtcgtcctcccgccatccatggcaaatgcttctctgcaatcctttcttctcccgcagcaccattctttcgccagcaacggcggcagccatgacggctccccgtctgccctgttcaagctctccaccaacaccggcagcagcatttccttcaggctccaccccaacacctcccgctcggtgaccacaacctcgaccaccaactcgtcagctccaactccagtggccccggcagctgcatcagcagcagaagaagactcatcaccagccccctcccttgacctcctcagccgccagctcgcggcaggggactaccgccaggccgacgagaccacccgggcgctcatcatcgaccttgctggcgagtccgcgaggcgccgagggtacgtcttcttctcagaggtccagttcatctccgccgaggaccttcgcgccattgacgagctctggaaagagcacagcaatggcaagttcgggtacagcgtgcagcggcggctctgggagaaatcgcagcgcgacttcacccgcttcttcatcagggtcggctggatgaagaagctggacactgaggtagagcagtacaactacagggccttccctgacgagttcatgtgggagataaaggatgacacacctgagggtcacctgccgctcaccaatgcgctcaggggcacacagctcctggggaacatcctcacccacccggccttccaggaggagaaccagcaagacgaagctgcagctgcagcagagagtgccaccactggtcaaagcaaagatgataacaaagggagggagagaccaaagttcatgaaagatttcaagcctgattattccttttgaccgaggctgaccataaaagggcatgggagtttgtgatgcagagatgctggcatggtgtaattgatttaaaagatcatgtatccgtagttctgtttgggttactgtcttaaaacatgcatcaaagattgtgcaatatatattacgaatatataattggttc

SEQ ID NO: 13958 - DNA, 690 bp, Sorghum bicolor
  Clone ID: SORBI-28MAY03-CLUS33467_1
gaaaactcgtggcgccgcatgctccatgcttgttcgcttcacctcctctgtcgccgccgaacaccgccgccagcctccccctcactccactgaataacggcagcgaggcgcactgcagccgccccgcccacccaccaaccccacaaaatgccggcgatgttggcggcgaagtttacggttctccatctatcccagtcaccttcgccgcagtcgagcttccgccttggcatccgcccctccccggcggcgagggcccgctctgtcgctccgcgggcagcagcctctgcgaccgccgtatccgctaaaccggcggcggcttcgtctcccctggttgcggaccgcaaggtcgtccgtatcgggcttcccagcaagggccgtatggccgagcaaaccctaagcctcctcaagagttgccaattgtcggtgaggcagcttaacccacggcagtacactgcggatatcccgctgattccaaatttggaggtttggttccaaaggcctaaggacattgttcgtaaacttcagtcaggcgatcttgaccttggtattgtgggttttgacatagttagtgaatacggggagggcactgaggatttagtggttgttcatgacgctcttgactttggacattgtcgtttgtcccttgcggtacctaaggaaggcatttttgagaacataattactttggaa

SEQ ID NO: 13959 - DNA, 794 bp, Sorghum bicolor
  Clone ID: SORBI-28MAY03-CLUS29912_1
gtggccggcagttccagctttacaaatcgggtgtgttcagtggaagttgcaccacaaaccttgatcacggtgtagttgcagtcggttatggcactgagaatggcaaggactactggattgtccgcaactcatggggtccaaagtggggtgaggctggttatatccgtatggagaggaacatcaatgccaccactgggaagtgtggaattgctatgatggcatcctaccctactaagaagggcgcaaaccctcccaaagccatctccaactcctccaacaccgcctcccccagttgcacctgaccatgtctgcgacgagaactttgtctgctcagcaggcagcacctgctgctgtgcatttggcttcaggaacgtctgcttggtctggggttgctgcccgattgaaggtgccacctgctgcaaggatcacgccagctgctgcccgccggactaccctgtctgcaacattagggctcgaacttgctcagtgagcaagaacagcccactgagcgtcaaggccttgaagcgcaccctcgccaagctgaacaccgcatgagctcgtccgatcttggagggatgggactgccggagcttttctgactctggcgttcagatattgtccaaaattcggtcaagacaagctttcatagattatattgtatctaattattacttatcgtcccatgaatccgctgtaaataactagctaccatctgtacctctgattaaaggatatttgtcatggattgagttccataatttcaagtttaattgatcgatgtcattggaatttat

SEQ ID NO: 13960 - DNA, 1491 bp, Sorghum bicolor
  Clone ID: SORBI-28MAY03-CLUS33606_1
gagaccgcggccgcacgcctccgcccgaagccgccgccagccgacgactacgagcggcggcggcgcctcggctcccctgatctcccccaccggaatggacggccaggctccacctcttctcgacgccgtcgtgcccgagccccttgcagccggcgacgagctccacccgccgcgtcctgtcgaggtggaggacgccctgcactccggtatggacggccaggctccacatctcgacggcgtcgcgcgggatccccttaccgtgtccgacgagccgcagcccacggtcgaggtggcggaggagcacgccatacccgtcgcgcacgacatcgccaagggcgaggtggtggaggaggacgccctaccagtcgcgtccgacatcgtcaagggcgaggtggtggaggaggacgccctacccgtcgcgaccgacatcatcaacgacgcctcttcggaggttcccgaggctggcagtggtggcgtcgtgctcacggacgagctccgcgaccgcatcgtcaagcaggtcgagtactatttcagcgatgagaatcttcctacagacgagttcatgttgaaatatgtgaagaagaacaagaagggctttgttcctattgagactatcgcatcatttagaagaatgaagaaacttgttcaagacctgtcagtaattgaagctgcactcaggacatcaccaaagctggttgtaagttcagatgggaaacgggtcaggaggttacatccgctgccacacaatgaattgaaagattcaaagaaaagcactgttttggttgaaaatctacctccagatttctccatggagagtattcaggaaaaattcagtacagtgggcaaagttgtgtcaaaagaaaatcaggatgcagtttccaaaaagattgatcagaatcaacattcaaaagaagaccagcgtataacctcagaaaagatctccaatgctgatgcagtggggagtgccaaggacaaagagaatttgaaatctgtttttaccactgagactgagcaccatgaccagaagccaaattctagaggacgaaaaggacggtacaaaggtcaaggtcagatgcagcaaaatacaaacaaacaaggaagttctggttctgagtcattaaacaagcctattcctggaccaagaatgccagatggaacaaggggctttacactgggacgtggtaaatctctaccactacagaagtctgataaggctgaagagtagagctaccaaaaaaggcctggtaaagaaccttatccaaagaagctgggtaaaatctaacagaacaccttttttttaaaaaaaattaaagagcatccaagctgttctgcatgtaatggaacacagaagaatgggaacctgggaatgacttgttctctgcatgggatggaacacggaagaaagggaatctggaaatggcttgtacagtaacgcaattttgtgtgggatagttctgagttcactcgtttggaacgcagtagaaccattgc

SEQ ID NO: 13961 - DNA, 1294 bp, Sorghum bicolor
  Clone ID: SORBI-28MAY03-CLUS3364_1
gcgagtctaccacgcttcacctcctccagaaacaaaagccgggacaaagctacggaaggaaggaagaaagcttgtgcagaatcagaacccagcaccatggcgggatccgcgttcctcaacgccctcgtcctccgcgcgccatccccatccccgtcgctctcgtgctcgtcctcgtctacgcgccgcagcgccggcgccttcgcgttcccgaacccaccgcgcctcccatctctgcgttctgcgcgccgcgtcgtccttgcgcgggcggcggcgccgggcgcgggcggtgaccccgagcccgaggacgacgagtgggggccggagcccgagggcgggtccgctgtcacgggagcgaccgcggtggcggaggcgcctgaggcgccggaggcgagagaggtcgcggagctcaaggcgcagctgaaggacgcgctgtacggcacggagcggggcctgcgggcgtccagcgagtcgcgggccaaggtgctggagctcatcacgcagctcgagacgcgcaaccccacgccggcgcctaccgaggcgcttacgctcctcaacggcaagtggatcctcgcgtacacatcattttcccaactgttcccactattggggtttggcaatctgcctgagctcgtgaaagtggaggaaatatcacagaccattgattctgagaacttcacagtgcaaaactgtataaagttttcaggacctttggctacaacctcagttgccaccaatgcaaaatttgaaatcagaagccccaagcgcgtgcagatcaaatttgaagaaggcattgttggtacaccacagttgaccgactccattgtgctaccagagaagtttgaattgtttggacagaacatcgacctgagtccactgaaaggcatatttacatctatcgaaaatgcagcatcctcggttgcaaagaccatatctgatcagcctccgctgaaaataccaatcaggacaaacaacgctgaatcatggttgcttacgacctaccttgacgaagagctcaggatctccagaggcgatggcagcagcatctttgtgctgttcaaggaaggaagtactcttctaaactgagacccaaatcccgagtatatgatctttgaagatgaaccttgaagtagttatactgctgatgcttttcttttcttgtagtaatatactccgtcccaaaataatatactcttagactaggaccggtttaatccccaagttatataaactctgtatatatcacccaagacactacatgcaagttatccaatttcatccaatgctattctcctaa

SEQ ID NO: 13962 - DNA, 1490 bp, Sorghum bicolor
  Clone ID: SORBI-28MAY03-CLUS9334_1
gcacgaggctcgtccgcccccgggtccctactccctcgcgcacgccaccgtccagcagcgccgccgcggggcgagaccgaaccctcctccgttcgccgaggcggaggacgcccttccggaccagcttccaccggggcgagcgctaagtcgcctcgaatttttcctcagctagtagcgggcgccgttctccgtcgctctaccgggatggcgtcgagtggggatccgcccggatctactgatgagaagaaaactccaaaatctgaaggatcttccgacgaacgtcaaggggttcctccagcaggcttttcaaatccttttgactttgcttctatgcaaagtttgctcaacgatccatctattaaggagatggctgatcaaattgcaaaggatcctgcattcaaccagatggctgagcagctacagaaaagtgctcatagtacaggcgaacaggggatgcccccattggaccctcaacaatacatggaaacaatgcaaaaggtcatggaaaacccccagtttatgacaatggcagagcgtctggggaatgctcttatgcaggatcctgctatgtctagtatgctggaaacctttagcagtccatcacataaggagcagctggaagagcgtatgtctcgcattaaggaagatccagctatgaagtcaattcttgatgagttagagaatggaggtccttctgcaatgatgaagtactggaatgaccctgatactcttcaaaagattggcgaggcaatgggagctagcttcccgtttggtgcaggttcttctgctgaaccttctggtcctgaagaaactgaggaagaaggtggggatgatgatgaatcaatcgtccatcacactgccagcgttggtgatgaagagggtctcaagaaggcactagatggtggagcagacaaggatgaagaagactctgagggaagaagggccttacattttgcatgtgggtacggtgagttgaagtgtgcccagatccttcttgaggctggtgctgcagtggacgctttggacaagaacaagaacaccccgctgcattatgccgctggctatggccgcaaggagtgtgtggatcttcttttgaagcatggcgctgccgtaacgctccaaaacctggatgggaagacacccatcgacgttgccaagctcaacaaccaggacgaggttcttaagttgctcgagaaggacgtcttcctttaaatatcatgcctgccatagacacatgggactctttggttcaagtatggtcatgtttcacaccgcttgtttttgtttggatagccacatatcggggccttgtatctgttttatgcctaattgctatctgttctagttagcatgcgggtcatgctacagttaagaggctgctgtttgaacaagcatgtaatggtctaccgtacgtgacatgtgtattccccacttcatttctgatattgaagctcctatgcatgttatgtcaggccttccggatcaaattc

SEQ ID NO: 13963 - DNA, 2055 bp, Sorghum bicolor
  Clone ID: SORBI-28MAY03-CLUS91_1
gaattcggcacgaggacatctcacccagccgaagcagaagcacaatcagaccctagccaaatggcactggacctctcccccaccttcctactccagcttccggccgtctcattctcacaccaaaggccatctccagagcccttcttccgttgccagcatcaacgaagcaggctgccgatcttgatcgaggcatgaaagcgccacccgccgctccgatgcccgcattccccaaatcctgagatgtttctcccgagaccagagagctacagcaacaccttcccgacacctaaatcgctggtgtctcggcttgtgcagtcctcctgacatcgccttcacataggcagcagcgcagggagtgagaacgacgaaggtgaatatacgcgtggtcaagtatcaggtgggcatgaggaagcttggacgcaccatagcaaaggtcacgttcgctaaggtcacgtaggcgatcgaccccgtaaccggcgaggtcctagacaaggagaaagtcctcaggcacaagatggtcgagcagaagatgctggagaagtttacgaggaagatgtttaagcatccgtatattgttcggatttatgttgtgatggtatgtaaaacaaaggtaaacattatgttggagtatgttactggtggcgagctttttgacacaattgctaaccatggtcgaatgagggaagatgaggcaaggagatacttccaacagttaatcaatgcagttgattattgtcatagcaggggtgtgtaccaccgggatttaaaaccagagaatttactgcttgactcatatggaaatctgaaggtctctgactttggactgagtgcgctctctcagcaaatcaaggatgatggattgctgcatacaacttgtgggactccaaactacgttgcaccagaggtcctagaagaccaaggctatgatggtgcaatggctgatttgtggtcatgtggagttatcctgtttgttctgctagctgggtatttaccttttgaggactctaatcttatgacgctgtataagaaaatatcgaatgcagaatatacatttccaccatggacgtctttccctgccaagaggttgttaacaagaatccttgatccaaatccaatgacgagaataacaatcactaaaataccggaggatgaaatattaaaaaaggaatacaagaacccggggtacgacgagacatatttcaaaccattagatgatatcgagtctgacttcaatgatgcagaattgcatcacgtgacagagaagaaagaagaagaaccagtagttctcaatgcatttgaactgatttcaaggtcagcaggcctaaatcttgggaacctatttgactcagagcaggaattcaaaagagaaacaaggttcacatcaaaatgtccaccaaaagaaattgtgcgcaagattgaggaagctgcaaaacctctaggatttggtgttcagaagaaaaattacaagttgaggcttgagaaagtaaaagcagggaggaagggaaacctcaatgttgctactgagatactgcaagttgcaccctcacttcatatggtagaagtcaggaaagcaaaaggtgacactctggaattccaaaagttctacaagaacctttccaagaccttaaaggacgttgtctggaaatctgaagatctgcaaatgcaacctgcttcttagcatccactagggaaggaagatggcaaactatttgtcccatcttccaagcagattccgatttcgtagtctgggtcagcagttatgttaactgcgctctgtatgtagtatgtaccgtggttggcttggcattttgagagattgcagtgctcgttgtagccgggatgaagcctatgctatccagtaggttactaggttttgtgaatatggtgagttctgtaaatctatatgcctatgagtcatgttgtaagctgtaatactatgatcagaaaactgtgaagtgtagaagccaagtatgttctttctatgctgccccagtttctggcacttcccatgcattttgaatgaggaaaaaaaataggggcgaacccattgatatt

SEQ ID NO: 13964 - DNA, 663 bp, Sorghum bicolor
  Clone ID: SORBI-28MAY03-CLUS9059_1
gcgccggccgggccgggctccgtagcagccggttcacttctacaggtaaggaaagggttcgtcctcatggcgccgccgcagccgaagtcgggcctcttcgtgggcatcaacaagggccatgtcgtcaccaagcgcgagctgcctccgcgcccgtcccaccgcaaggggaaagcaacgaagagggtgtccatggtcaggggcctgatcagagaggttgctggctttgctccttatgagaagcgtatcactgagcttctgaaggttggcaaggacaagcgtgctctgaaggttgccaagagaaagcttggaactcacaagagggcaaagaagaagagagaggagatggctggtgtcctcaggaagatgagatcggctggtacgcacacagacaagaagaaatagagcatttcaagtttatgaagctggcggccagagattctgttccggtgtctgtttttcctacttgtagaacgtaatagacatgtcaaagtatctgtcagcgaaatattgtgttgttagttatgtatcgaaccacctcatggggattttgcaacaactttcaatgtatccatggtttgttaatcttttgctttggctttgcaaaaagaaaacaaaaaatgattactgcgtattgaatgctatggttgcaatccaaaaaaaaaa

SEQ ID NO: 13965 - DNA, 825 bp, Sorghum bicolor
  Clone ID: SORBI-28MAY03-CLUS387_1
cggacgcgtgagcagcgatcagaagctcaaacaaatcgttcgaacctctcagcccaaatctccaattcgtagtcgtaagctagactagataggaggcaaaatcgttcgaccatgtcgctgatccgccgcagcaacgtgttcgatcccttctccctcgacctctgggacccctttgagggcttccccttcggctccggcgggagcaacagtctcttcccgtcgttcccgcgcaccagctcggagaccgcggccttcgctggcgcgcggatcgactggaaggagactccagaggcgcacgtgttcaaggcggacgtcccggggctgaagaaggaggaggtcaaggtggaggttgaggacggcaacatccttcagatcagcggcgagcgcaacaaggagcaggaggagaagacggacacctggcaccgcgtggagcggagcagcggcaggttcctgcgcaggttccgactgcctgagaacgccaagacggagcagatcagggccgccatggagaacggcgtgcttacagtcactgtgcccaaggaggacgtcaagaagcctgaggtgaagtccattcagatctccggctagacgtcagtccgcacgtcggatcgtcgtgcctgcgtgattggaggaaacggcagttcacctcggtcgttctgtggaataaatttgggttaaaagaattatgagtatgctggtaatgtggtatgatggtggaatgtggtaaaaaaaaactctgcgtctctttggtccggtgatgtatgagcctttttttcagcaagtggtgtttttcttttacaataaatcaattaatagtaatctggt

SEQ ID NO: 13966 - DNA, 796 bp, Sorghum bicolor
  Clone ID: SORBI-28MAY03-CLUS3722_1
gcacgaggaccacctcagcaccacggcatttcccaagggaacccggccggagcattcgcatttcctaagggaaccagaccggagcattcccctccgctccacaatccctgcgtcgcaccctagccctcagcaaaccctaacagctcgtcgccatgaaggacacctcgttcaaggccagcggcgccaagcgcaagaaggccggcggtgccaagcgcgggatcacccccttcttcgcgtttctggctgagttcaggccgcagttcttggagaagcaccctgagctcaagggcgtaaaggaggtgagcaaggcggctggggagaagtggcgctctatgtcggatgaggagaaggcaaagtatggctctaccaagaagcagggcgacaaagcaagcaagaaggagagcactagctccaagaaggccaaaactgatggtcgggagggagaggaagcagtgaagtctgaggttgaggatgatgatgagcaggatggcaatgaggatgaaaatgagtaaatagtaggatggggaacagcagctttgcaattgggtgtttgcttcttgtttagcctccaatgtgctgttccttttgctgttatatatgctgtatgctgtaagaaaaatctgtacatgatggaaccttagggctatggcatgctggagtgcccgtttaactagaggagctggatactcttgccagccttgtcagcatgtgttaactggtgtttttcttggtttatcgactaattgggtgactacccttgcagttaacagcatctgcttatcccaaaaggccccta

SEQ ID NO: 13967 - DNA, 1471 bp, Sorghum bicolor
  Clone ID: SORBI-28MAY03-CLUS4_1
gcgaaagcacagcgagaaacaacgcaagcgaaagcagagcagaaggaaagcgagaagccagagcagcgagcgaagcagcaagcaagctagagcagagagctagcaagcacgccggcgagcgagagcgagagagaccaggcaggcaagatggtgcagcaacaagcagcgaaggaggtgatcccgctgctgacgccgtacaagatgggccagttccagctctcccaccgggtggtgctcgcgccgctgacgaggtgccgctcctacggcaacgtgccgcagccgcacgccgccgtctactactcgcagcgcgccaccaagggtggcctcctcatcgcggaggccacgggggtgtcgcccaccgcgcaggggtacccggaggctcctggcatctggacgcaggagcaggtcgaggcgtggaagcccatcgtcgacgccgtccaccgtaagggtggcatcttcttctgccagatttggcatgtcggcagggtctccacctatgagtttcagccggacgggcaggcaccgatctcgagcacggacaagcaaattaccgcggccgaaatttccccgagcggcgagtccggaatgaaccgaggagatccccgggatcgtcgatgatttcaggcgtgccgcgcggaacgcaattgaagccggcttcgatggtgtcgagatccacggcgcgcacggatacctcctcgagcaattcatgaaggagagctctaacgaccgcaccgacgagtacggcggcagcctggagaaccggtgccgcttcgccgtggaggtcgtggacgccattgtccgcgaggtgggcgcgcaccgcgtgggcatcaggctgtcgcccttcgtggacttcgtggactgcgtggactccgacccggtggcgcttggccactacatgatccagcaactgaataagcacgagggtttcctctactgccacatggtggaacctcgaatggcgattgtcgacggccgcaggcagatccctcacaggctcttgccgttccggaaggcgtttcacggcacattcatcgccgccggcgggtatgatcgggaggaaggcaacaaggtagtggcagaaggctatgctgaccttgtcgcatatggaaggctcttcttggctaacccggacctgcctaagaggttcgagctgaatgcgccactgaacaagtacgaccgttctacgttctacacgcaagatcccgttgttggctacacggattaccctttccttgaagacaattgcgataatgatgagtcaagtaatcaagcttaatcatgcaaatcgtttggttcatcaagtaggagtatttatatcattatttccaccatcctttattgacattgtggcagattcattacatcgtgtggtttcattctgtattaagtgtgaggtgaaataaatgtacttgatgaaattattagtcttggtttcaatttgttcaagaaatctcagagactcatgagtcct

SEQ ID NO: 13968 - DNA, 929 bp, Sorghum bicolor
  Clone ID: SORBI-28MAY03-CLUS40821_1
ggctacgacaggtgcgtgtccaacgagcaggcgcgcgacatcgccgcggggctcggcgtcgcgtccgtgttctgggactgggacctcccgcggaccagggaagggttctaccggttccggggctccgtgggcgccgccgtggtccggggccgcgccttcgcgccgcacgccgacgtgctgtggatggagacgtccagccccaacgtggccgagtgcaccgccttcgccgagggcgtcaaggcggcgtgcccggaggcgatgctggcctacaacctctcgccgtccttcaactgggacgcctccgggatgacggacgccgagatggcggccttcatccccagcgtcgcacgcctcgggtacgtctggcagttcatcacgctcgccgggttccacgccgacgcgctcgtcaccgacacgttcgcgcgggacttcgcgcggcggggcatgctggcctacgtggagaggatccagagggaggagaggatcaacggcgtggagacgctggagcaccagaagtggtcgggcgccaatttctatgacagggtgctcaagacggtgcagggtggcatctcctcaactgcagccatgggcaaaggagttactgaagagcaattcaaggattcaaggccggcaactgggagcagtggcctgcaagttatggccaaatccaggatttgatgaagactcagaaagaataatgattcggagaaggccctaaataaataagaaaaaaaaataagttggagtcagatcatcagccatgggaagatgctttccaaactgaactataatgagcataatgcataaatgaatcgtctagctagctatatacgaatggagttctgagttatgactccaaatggaaacccaggttgggttgaaagtattggtgtcaatctgtgagattatttatcacttgagattgaata

SEQ ID NO: 13969 - DNA, 911 bp, Sorghum bicolor
  Clone ID: SORBI-28MAY03-CLUS44417_1
gcagcacgaggcttcctagctagcacgaccacaggcgctagtagctaataagctactgagtatagcttgtagctagagctctatctcaaagccagcagtgatggccgcggcagccctgaggcccctgacggctccgaacgcggcgctgccgccgagggggccggggaaggagcaccggacggcgatcacggtgccggagttcaagcgctgggtgaagcagttcgacaccgaccacgacggccgcatcagccggaaggagctccgggaggccatccgccgccggggcgcgtggttctccggcctgcgcgcactgttcgctgtccggcgcgccgacaggaaccgcaacgggttcgtggacgactccgagatcgagggcctcatcgacttcgccgagagggagctgggcttcaggatcacaacggaatgaacggcggcgcgatgagctagtctgtcgtctcgtctgctccgatcctctctacagctacaggtcgccgacgacgtacatgccggcgtatattgtactgtgtactgtattgacgtaattacgtgacacgtacttgattaattatgtacggtctgtgtagttttttttcgctgtgtagtgctagcactgtactactagtagttttgttatttttctttttctttttcttttttctgtgtgtcatcgtacctagtagctgctacctccacgtactttctcctctgaataatttgtgtcgaagcaggagagggtcgaatcatgtctgtgtacatgctagcagcttgttaagtgtactgccgcgtgaagtgatgatgctaccgtaccgtttgtataattgtttgtagcaatccatccattccatgtgctatatcactaccagactaaggattattcatttctgacggttttctaaaaaccaacagaaacc

SEQ ID NO: 13970 - DNA, 1802 bp, Sorghum bicolor
  Clone ID: SORBI-28MAY03-CLUS43049_1
gcacgaggctgaggcatacttccctccgatctcccaacctgaagggctccctttaaaggttcaggatgccagtggtaaagaatggatattccaattccgtttctggccaaataacaatagcaggatgtatgtattggagggtgtcacaccttgcattcaggcaatgcagttacaagcaggcgccacggttaccttcagtcgaatagatccagaagggaaattgatcatgggctttaggaaggcaactaataattcttctgaacaggagcaaattacaaagcctgccaatggtgccccggcaacttcagaagcaaatggtaaagtttctggtgcagattctagtccaaatgctgcagtttcccgtcaaaacaaggtcaacatagagaccaaaagttctagccctgtggaacaagccactgcattgaaaatggataaggatggattaacacagaaggaagggccaggaactgctagttcttccccaggttctgtcaagagaaaaacaactaatcttggtcaaaagaataaaagattacggatggataatgaggaatcaatggagttgaagataacgtgggaggaagcacaagaattgcttcgtcctcctcctaaggcaccatccattgttattgttgatggccatgagttcgaggaatatgaggagccaccggtacttggaaggaagacttattttgtagcagataaatcaggttcggaccatcaatgggcccaatgtgaggattgttccaaatggaggaaactcccaatagatgccctgttgccctccaaatggacctgctctgacaataaatgggatccagaaaggtcttcttgcgaacatgcacaggaaataagtatggaggagcttgcagaaatcattcctataaaatatgccaaaaagcccaaatcgaggatggaatctgatgctattgatgcctcgagggggctggacacacttgcaaaccttgcaattcttggcgaaggtgaagctcttccttcgcagccaacaacgaaacatcctcgccatcgtcccggctgttcatgcattgtctgcatccaaccaccaagcggcaagggtccaaagcacaagcagacatgcacctgtaacgtttgtatgacggttcgccgccggttcaggacgctcatgcttcgacgtgagaagaaggcgacaacagatacgcctcgcaagaaagagacaggccaatccagtgagaaggtcacacaagctgtgtccaccccgccagtagccagtgccagtgcaaccagcccccctcggaaagcagatggaaacgccgatggggctgaagacatggccgtggatcacaaggtgacatcctctcccgtcaagaaccatattgacctgaacatccaacctgatcgggatgatgagcagtcaccgaaatctggtacggctggtttgttgagccgagacaatccaagttaagagagtgggtcgcgtggattgcctgatcattccggtgagtggacatagataaccgatcgaacccatccttccgaatgtctatacccattttttatgaaagatgtggcgtgagccgtgaggtgttagtgtagctgttacctgttaccttcccataccatagagccggtttcctttttccctcagactccagtggtaatgtttatcgtgtataccatagggcaggatacccgtaggtgttgcatggggccttgcatacccctgtatgcatgtatgtattgcaagaccagctcgtttcggctgaatgtaaaccgtaagttgctaatgtaccctgcatatatttcaaaaaaaaaaaaaaaaa

SEQ ID NO: 13971 - DNA, 2277 bp, Sorghum bicolor
  Clone ID: SORBI-28MAY03-CLUS4902_1
gcacgaggcacatctccaccaggccacagctcgagcccaacgaccgacgcctagacgcggctgggcggtcggtctcacctcgtctcccctccgcgcctcccttcttcctgctccgcgtctcgatctctcccctcccccgccgcgttgctcgacccgctcagatctcgcccaccctgcgctgcggccatggataacttgatcaccctcgtcaacaagctgcagagggcatgcacggctctcggagaccacggagaggagagcgccctcccgacgctctgggattcgctgccggccatcgccgtcgttggaggacagagctctggtaaatcctctgtgttggagagcgtggttgggaaggatttcctaccgaggggttcaggcattgtaacccggcggccgctggtgctgcagctccacagaattgatggcgacagggaatatgctgagtttatgcaccttccgagaaagagatttacagattttgctgctgtgaggaaggagatagctgatgaaactgacagagaaacaggacgttcaaagcaaatatcgactgtccctatccatttaagcatattttctccacatgttgtgaatcttactcttattgatcttcctgggcttactaaagtagcagttgagggccaaccggaaagtattgttcaggacattgaaaacatggctcgctcatatattgaaaagccaaattgtatcattctggctgtttccccagccaatcaggaccttgctacttctgatgcaatcaagatttcacgggaagttgatcccaaaggtgaaaggacctttggtgtgcttacaaaaattgatctgatggacaagggtaccgatgctgttgatatactggaaggaagagcttaccgtctccaaacaccgtgggttggtgttgttaatcgatcccaacaagatatcaacaagaatgtggacatgattgctgctaggcgtagagagcgagagtattttgcaactacaccagaatataagcacatggcttctaggatgggatctgaatatttaggaaagatgctttcaaagcatctggaacaagtgatcaaatcaaggatcccagggctccaatctcttataacaaagacaattgcagagctggaaactggacttaatcgacttggaaaacccattgctaatgatgctggggggaagctgtacacaatcatggaaatatgtcgtatgtttgacagtatctacaaagagcatctggatggagtgcgtcctggtggagagaaagtttaccatgtcttcgacaatcaatttcctgttgctattaaacgattgcaatttgataaacaactctctatggaaaatgtgaggaagcttataacagaagctgatggataccagcctcacttgatagctccagaacaaggatatcgacgccttatagaatcttgtcttattagtatcagaggtcctgctgaggcagctgttgatgcggtccatgcaattctgaaggaccttgtccgcaaggctatcaatgaaacacatgagctgaagcagtttcccacccttcgtgtggaagtaggcaatgcggcttttgagtcattggatagaatgagggatgaaagcaagaaaaatacattaaagctagttgacatggaatgcagctacttgacagtagatttcttcaggaagcttcctcaggatgttgagaagggtggaaatccaagccactctatttttgatagatataatgactcttatcttagacgaattggacaaactgttctgtcatatgttaatatggtgtgttcgaccttgaggaactccatcccaaaatctatcgtttattgccaagtgcgagaggccaagcgctcgctgctcgatcacttcttcactgaactgggagcaagagagatgaagcaactttccaaacttctcgatgaagacccagcagtcatggaacggagaacaaaccttgcaaagaggctggagctgtaccggagtgcccaatcagaaatcgatgcagttgcgtggtccaaatagtcctgatggccaagatatctgttcttacatgttctttaccccttgtctggcgattctctctcctattctggggcatatatagctgatttttcctgttctaggtcaggtcattttatagatcaccgcagctgtacggtgtcttttggttgtgcttttgttccttgtgcttgaggatctaggggacacctggctgctgtactcttgtatcacgaacaagttcatatattgtgtttttgttaccatgcattcttttgttccatc

SEQ ID NO: 13972 - DNA, 1742 bp, Sorghum bicolor
  Clone ID: SORBI-28MAY03-CLUS530_1
gcacgagggactgggaaaacagagatgccatgtttcgtgacgttgaagaaattattagaaggcaaataaagatgtcagtacttccaagtgtccaacctttccatgccattgcttatcctattgatccaatgcttgctttggaaataagctgtaaatatgcggcccattgttccttgatcgcctctcgttttggtctgccaccttttgtgcatccatctcctgttcctgtaaaagcagagggtaaacactgccgactcagagtaggatatgtgagtagtgattttggaaatcaccctctttcccatctcatgggatcagtatttggaatgcatgatcgtgccaatatcgaggtcttttgctatgcactcagtcaaaatgatggtaccgagtggaggcagcgtattcagtctgaggcagaacattttgttgatgtttctgccatgacttctgataatatcgctagacttatcaatcaagataaaatacagatattgataaatcttaatggctacacaaagggtgccaggaatgaaatttttgcattgcagccagcacctatccaagtttcgtacatggggttccctggaacaacgggtgctgcatacatagactacttggtcacagatgagtttgtttctccatctagatattcacatatatattcagaaaagcttgtccatttgcctcattgctattttgtcaatgactacaagcagaaaaatcgagactgtctcactcctgtatgtccacacaaaagatctgattatggattacctgaggataaatttatttttgcttgcttcaatcagctttacaaaatggatcctgagatatttgacacatggtgcaatattctcaaacgtgttcccaacagcgcattatggctcttaagattcccggcagctggtgaaactagagtgagagcacatgctgttgcaagaggagtaagatcagatcaaattatattcacagacgttgccatgaaaaatgagcacatacgacgcagtgcactggcagaccttttcctggacacccccctctgcaatgcacacacaacaggcacggacatactgtgggctggtctgccaatgatcacccttccactagagaaaatggcaaccagagtagctggttccctatgcgtagctaccgggcttggggaggagatgattgttagcagcatgaaggagtatgaagatagagctgtagaccttgcgttaaatccagtgaagcttcaagcattgactaacaagctcaaggaagttcgtatgacctgcccgttgttcgatacagctcgatgggtgcgcaatcttgaaagggcttactacaagatgtggaacctttactgctccagtcgccacccggagccattcaaggtgttagaggatgacaatgagttcccgtttgaccgctaacgagatttcatcaccagcccggctctgtaaataaggcgagagttgtagcatatttagcattgtgaccgctccaggtgcttgtttgccgccgcctgtcctgctgtgcacatcacctctgtggaggctaacttgtgtagtatgtacactacaaaagttctagggctagcctgtattgttatccttattgttgccgaggtctatttattagtaacgagccacaactgttatcgggttgttactttgtattgcagtcgtggtttataaaataatctgtaactatgaaggttgtcgatgtgaaatctcattcttaatgacttctgtccgctg

SEQ ID NO: 13973 - DNA, 882 bp, Sorghum bicolor
  Clone ID: SORBI-28MAY03-CLUS5125_1
ccgggaaaaaccccaaatccagttccattccaatcgccgccgagaagggggagggaaggaaaaaaaaaagggaaatcgatggcggcggccggcggcgagaacagcggcgcgggcgagggggagttctacctgcggtactacgtgggtcacaagggcaagttcgggcacgagttcctcgagttcgagttccgccccgacggcaagctccgctacgccaacaactccaactacaagaacgacaccatgatccgcaaggaggtcttcgtctccccctccgtcctccgcgaggccaggaggatcatccaggagtccgatatcatgaaggaggacgatagcaactggcccgagcccgaccgcatcggccgccaggagctcgagatcgtcatgggcaacgagcacatttcattcaccacttccaagatcggctccctcgtcgatgtccagtccagcaaggacccggagggcctccggatcttctactacctcgtccaggatctgaagtgttttgtgttttcactcatcaacctccacttcaagatcaagccaatccagtcttgagctccatcccaagccttcgtgtaactgttttatgagtgttttaagagagaattttgtaccatgtaagatgctgttgagcttgtgacgatgcgcttggctttgtgtggaacactgggtgggagtggaaccttttgcatttggattgtgcaaactgctgagtagcagtgagttgtaatatttatgcctttttttcagttttgtgttgggtggagtcttgtcgtttggcacgcactattcttctctgttatcagtgctccgctgaaggaggcacatcgtagtaatggatggatgcccagattgtttggttttcctgggaattgtgtt

SEQ ID NO: 13974 - DNA, 1948 bp, Sorghum bicolor
  Clone ID: SORBI-28MAY03-CLUS1716_1
gcacgagggttcaattcattgtgaaccacgcagccgcgggggttatattctgtgtgcctcaaactctaagcattctgttaagttttatagctcaaatgccatgtgttcggcttatagtggtagttggtggagacgatgcaaatatgccatcaacgccagtaactactggagtggaaatcataacttactccaagctgctcatccagggaaagatcagtcctcaacattttcgtccgccaaagcctgaagatgttgccactatctgttacactagtggcactactggcacgccaaagggagttgttctttctcatgagaacttaattgcaaatgtagcaggatcaagcctgaacattaagttttacccctccgatgtgtatatctcatatcttcctttggctcacatctacgagagggttaaccagattgctgcgctgcactgtggcgttgccattggattctaccaaggggataatttgaagctcatggatgatctggctgctttgagaccgacaatattcgcaagtgtcccccggttatataacagaatttataccgcaattacaaatgctgtgaaggagtctggtgggctgaaagaaaaattgtttcatactgcatacaatgtcaagagacaagcaatccttaatgggaaaaatccatccccagtgtgggataagttggtatttaacaaaataaaagctaggcttggtggacgagtgagacttatgagttcaggtgcctctccactgtcagcagatgtcatggaattcctgaggatatgctttggtggtgaagttcttgaaggctatggaatgacggagacatcctgtattatatctgcaatggatgttggtgacagatcaattggtcatgttggatctccgattgcatcttgtgaggtgaaacttgtggatgtcccagaaatgaattatacgtccgaagatcaaccttatcctcgtggagaaatttgtgttagaggacctatagtattccatggttactataaagatgaagttcaaacaaaagaagtcattgatgaagatggttggttgcacactggagacataggtctgtggctacctggagggcgtttaaagattattgataggaaaaagaacattttcaagttagctcaaggagaatacatagctccagagaagattgaaaatgtttatgccaaatgcaagttcattgcccaatgttttatatatggtgacagtttaaactctttcttagttggtattgttgcagttgaaccagaggttttgaaggcttgggctgcatctgaaggaatccagtgtgaagacttgagacagctttgtgcagaccctagagcaagagctgctgtcctggctgatatggattctgttgggaaggaagcgcagctaagaggttttgagtttgctaaagctgttcggcttgttgctgagccattcacagtggagaatggtctcctcaccccaacattcaaggtcaaaagaccgcaagccaagacgtactttgcaaaggaaatttcagatatgtatgcagagttgcgggaggcagaggcacccaggtcgaagttgtgatcacctgtgtaatggtcagaaaggagaagtgatacatatacaggtttatagatcatgtacaaaataacttaatcttttactggcgcagcaaataatggctcctgcaatgatcaggaagaatgaggaattatacaagacagaggcagtgcttggtgcagaatgatgaatattggtcctcgttatgaacttagaactgaaatttttgcccttgcccaacgtgccacgttagcctcaatggaagatacatcatataggaaaaaaaaattctgcaaatgtaaacagtaaacagttcgtctcggttgtatagcaaaaagttcggtacttttttccccccgtatgtcggacacagttcaattcaacatcatggtatggtgttgcat

SEQ ID NO: 13975 - DNA, 2174 bp, Sorghum bicolor
  Clone ID: SORBI-28MAY03-CLUS1372_1
tgactgcgcgctccgccgcaccagggagccaacatggatgaatgacttctcaggtgtgatgcgccatgcctctggaccagtaactgctgcaaaaacaatatatgaggacagcaagggctacttgatcattatcagcctgcccttcgctgattttcagaaggtgaaggtttcatggaagaatactcttacaaatgggattgttaaggtagcgtgcaccgccccgggccggggccctggccggggaagccccgaccggtcggtcagcgtggcggcgccggctcctgagcattgcccgccgggcgagttggtccgcgacagtccactgccggcccgcgtccccgacgccgctactttcgaagcataccgtgatgaaacagggacaggcctggagattattgtcccaaaattccgcgttggtccggagaggcatggtgtgcgtgtcttcatcacctactattcctcccgctgcctgtgaaacttgttcaaggtcacgggcggccatgtatcccgcggagtctcccagcttgaaaaatacgacctccgcccaacaaacgcggctctgtttccctaattttgatcagaagccgtcctggtcgatcgaggcatccgggtggatggccagggcagcatgtggaacagttggggaatattcgaccgatcacggacagcacagccgcattactcagtcagtggcgttgacatgttcttctgcgtgaccccttatccactatatttccatcaggctgtgtcaaaagacgatttgtcctgcgggatgtggtacatcttgtgcctcacctgacaaggccaaactaagcgctgtcatcgacggaagggcaactggatgtagagggcggaatttatcgtcattctccagcggttgaggtgtccttggggaggcttgtcgggtgcagcacgacatggagaacatgtacatgtgggtgtttaaggagcggccggagaatgccctggggaagatgtcttaatggggtttagtggtgctgtaggattctgtcggggttccacggttccctggcagcccagtcagagggtttgtgcgctcacaccggatgcagcgcaagcactatcgtgggctctctaacccgcagtgtcttcacgggatcgaaatcgtgagggcgccaaacttggcaggtgtacctgaggctgatttaaagaggtggatggagctcactgggagggatgccaatttctcggtcccaactgaggccagtgatttgagtcctggaggaatttgccgagcacagactttgagctcgagaggccagcaaccatggctcctgcaaagagcagctcacatgggcaccacaagaagttgctgaacggttctggccttaacctctcgacaaaccatccaatcacagttctggggatggcatggagatcacggccacctgtaacaagcgcaggaaggattcctcaccggctgcaatggaagaggattgcagcaactcgaattcagacaaggcccaagacatggatgtgagccacacctttgagccaacatggatgaatgacttctcaggtgtgatgcgccatgcctctggaccagtaactgctgcaaaaacaatatatgaggacagcaagggctacttgatcattatcagcctgcccttcgctgattttcagaaggtgaaggtttcatggaagaatactcttacaaatgggattgttaaggtatcatgcactagcgttggtcggatgcctttcctgaaaaggcatgatcggactttcaagttggcagatcctgctcctgagcattgcccacctggtgagtttgtccgggaaattccactgcctacccggatccctgaagacgctactttggaagcataccgtgatgaaacagggacaggcctggagattattgtcccaaaattccgcgttggtcctgaagaacatgaagtgcatgtgtccatgaggccaccttcgtcatggtgccaatgaaacttgttcaaggtgtgtgatggatgcccttgtagtagttactagtccattgttcttagcacttgagtgatgttttgttttctcctaaccctatagcttgcggggagacacatatggtgcggaggttcccaactgttaccacaaggctactgtacaacaaacgcagctcagttttgctaatttgatcagaaacagtcctaattgatgaagca

SEQ ID NO: 13976 - DNA, 446 bp, Sorghum bicolor
  unsure (1)..(446): unsure at all n locations
  Clone ID: LIB3476-058-P1-K1-B9
gagcgagggaccaccggaggcggaggccgccgttagcacccacaccaccccgcggcgcgtgtccgcagccatgggggaagacctcgtcaccaccctgtccatggagaacggcggcggcggcggcggccaccacggcccctgcacgctcctctccatggacccgtcgggccacctctccgcgccggacgaccgcgccgtcggcgtcatggtgcaggccctcatcggaggggccgtcggcgtcggcgcccgcgcccacgccgtgtcgccctccggcgcgcctccgcccgacatcaaccagccctggcagacggacctctgcgacatgctggacgtcggcctcggcccgcaggtctacagcgccgaggcagtactcagctgcgctcccaaggccgggaaccggaaggccgccaagcgcggngacaccatctggggcgcctggttcttct

SEQ ID NO: 13977 - DNA, 1033 bp, Sorghum bicolor
  Clone ID: SORBI-28MAY03-CLUS19493_1
gcacgcgcggggcatccgcttgcgtcagcagcacacttgaaagggagagtggagtgagtgatctttggtttctgatcatggccaccgtgactgaggaagttgctccggccgtcgcccaggagccggcgccggaggaggcgaagggggttatggagacgccggagaaggtggaggaggggaagaagcccgaggagggggttgaggggaagaaggccgccgccgagaaggagaagaaggcgaggaagccccggagcaggaagcccaagtccgccggaccgcaccacccgccctacttcgagatgatcaaggaggcgatcctgtcgcaggacgtcggcaaggtcggggcgagcccgtacgcgatcgccaagcacatcggagagaagcaccgggacgtgctcccgcccaactaccgcaaggtgctggccgtgcagctccgcgggttcgccgccaagggccgcctcgtgaaggtcaaggcctcgttcaagctcgccgcatccgaggagaagaaggccgccgccgcctccgcggccgccaagacgaagaagacgccgccggccaagcgcaagagggccgccgcgccggccaagaagaagccggcggttgccgcggcggcgccgcccagggaggcacggaaggcgcgcgcgaagcgggcgaggaaggtggccccggcgcccgtgcagccgaagcccaaggccgcccgcgccgccgccggcggcggcggcaagaaggccaacaaggccagcgcctgataagcaaccgaccaaccgtccttatccgcgcgcgcacgccgccgtgtatgtactagctggtagtggtagtagtaggaagtagtagcagcagcgtggcactcgtgtgctgtcgtcgtctccgccggctcgatcgatcgggcgctctgttctgctccgccgtttgtgtgtggctggcagagtgttgtaaatacccggacccgtatccagtgtggtgtgatctgtgatggcaataaagcgcgcgctttgagcttcctgcggaaaaaaaaaaaaaaaaaaggccccta

SEQ ID NO: 13978 - DNA, 988 bp, Sorghum bicolor
  Clone ID: SORBI-28MAY03-CLUS5969_1
tgcacgccgccacacaccaggtagggaggccctcttcgccggcggagaccatggtgtccttgaagctccagaagcggctggcagcgagtgtgctcaagtgcgggaaaggcaaagtatggctcgatccgaacgaggtctccgagatctccatggcaaactcccgccagaatatccgaaagctggtgaaggatggcttcatcataaagaagccacagaagattcactcaaggtcccgcgcaaggagggcccatgaggccaagcagaagggcaggcactcaggatatggcaagcgccgcggtacccgggaggctaggctccccaccaagatcctttggatgcgcaggatgcgtgttctcaggcgcctgctgcggaagtacagggaggcgaaaaagatcgacaagcacatgtaccatgcaatgtacatgaaagtgaaaggtaacatgtttaagaacaagagagtgctcatggagagcatccacaagactaaggctgagaagaccagagagaagactctctctgatcagttcgaggctaagcgggcaaagagcaaggcctctcgtgaaaggaaaattgcgaggagggaggagaggttagcacagggcccaagggaacccacggcagcaccagcagcagctcctgccccagctgcagctgcaccaaagaaggcgaagaagtgaagtgatcagaagcattggctttctggtaccaggacttagcctaattttggagctccttgtctcttttgctgtcatatatctaagctgtcatctgagatatctggaacatcatatctcgtttgttatgttggatgatttagtagacttgtttattttaagtgcctttggaactaattatcacaggatatggttgtgctttcgtgagccctagttcttgttaagctaatttatcttttatctggccgctgtggctagcgcctgtgctggttttgcccggaggtccatgaccttatctgttcttgtacggagat

SEQ ID NO: 13979 - DNA, 1050 bp, Sorghum bicolor
  Clone ID: SORBI-28MAY03-CLUS6717_1
ccgccgcggccgccacggacagcagcaaccggtagcaggagcgcagccagcaagcgcaggccccaagccctactgcaaccgccgacgccaccgcgccgaacgccatggccgaccccgcggagcaccgtccagcggaggaggaggaggaggccgcggcggccggcgaggatgaggacaccggcgcccaggtcgcccccatcgtgaagcttgaggaggtcgccgttaccaccggagaggaggacgaggacgtgctcctcgacatgaaagcgaagctataccggttcgataaggatgggaaccagtggaaagagcgcggaacaggcactgttaagctgctcaagcacaaggagaccgccaaggtccgcctcgtgatgcgtcaggcgaagacgcttaagatctgtgctaaccatctcgtggtggcgacgactaagatgcaggagcacgcggggagcgacaagtcgtgcgtgtggcacgcgctggacttcgccgaaggcgagctcaaggaggagatgttcgccatccgttttggatctgtcgagaattgcaagaagtttaaggatattgttgaagagatagctgaacagcaaggaaacactgaggagaaagaaaatgaggaagcctccactgccgctgatttggtagagaagttgacggtgacagaggccagcaaggaggaaactgtggagaaagaggaggctcctgcatctgatgataagaaggatgctaaagagtgaaggcgtttttatccgcaaaccagggtcaaatgagtgtccttccattcattttgttgtcaaggttcatcttcccttcacaaattttcattgtgttttctctgggatgaatgcttgtggtaggtgaaatcagagtcatcagtcatctacatggttttcttggttgatagactgttattttttaagtcgtctgtttatctgggatggctggggtcagcatgtctgtacaattatttggagttgcttttggaatggacgcggtttgatgagtttgcctaaagcttgaaatggtggtgtttcttttcactccccttctctt

SEQ ID NO: 13980 - DNA, 2651 bp, Sorghum bicolor
  Clone ID: SORBI-28MAY03-CLUS7193_1
cccacgcgtccggtttggaagagatcctgctatttcccgtgtttacgaggcgcctctggaaatggcaggaacagagtcatctacaggaactagtttcacagactcttactctgtcagtgttttgagtaaaccaactattgaccagtctgcagatgttgatctgaaaccatcagcgccaccgcttgcatactcagaaggtgatggtttcatgcctcttccatctgcacctcttgcaccaaagatggaggttcctggatcaggaccagcacctggaactcgtgatatagatcaatcagcctttgactatacaacaaatagaaacaaggaacgtgatgctttgaaaagacaagatacacccatgcccattagaaaagatatcttggtaaaagatgagccaagagatggtcacagtgatgttccaatgcttccaaatccccgtttgatgtttcaggttggagggaatgctccacgcttggttactccatctgaaattatatcgggcactctctcgtctgctgaaaacaatgatgtctccaaatctgatggaggaaaaagtcaagatgtttccagcagaagttcccgggttgcagaagtggaaccaaagcatattgatgagagtaaaccagatcaaaatgtaggacttgaagctgtcaaggaaactcagattgtttgtgagaatatggagaaaactcagagttccttggagcaaactgttgaaatgatcagtgagcgctcagttacaactgataagtacagtgtggaagaatcacagtcatcatctgatcgacgggcatcagaccagattggtgttgctgatgaaaatgttctgaagaagtttgtggaaatccctgagaaaattgattactcctctgcctccagggagcaatcatcatcgtttacgaaagaggagaaagttttgcaccctcaaacatctggtcagccatctcctcctgtgagtgctttcaattcaactgagtcacatgagcccttgagctccacatacctacctgccagctccttcccagaagctgctgccacacaagggatgctgcaacagctcatggggatgcagaaggacatggaaaaacagcttagtactgtggttcctgcatccatcgcaaaggagggcaaaagacttgagacatcattagggcgcactgtagagaaatcgatcaaggctaatattgatgcgttttgggttcgtctccaggaggaaaacactaagcgtgaaaaggctgatagagagcgaatgcagcaattggttactctcattacgaactcaataaataaggacttgccttctaatatggagaagtcacttaagaaagaaatttcttcacttggacctattgttgcccgcgcaattacacctattattgagaagtgcctgacctctgctgtttatgattcagttcagaaaggggtgggtgacaaggtgtgcaatcagctggaaaagtctattactggaaaacttgaagctacacttgccaggcaaatccaaatgcagttccatacatctggaaaacaggctcttcaggatgctttgcgtactagctttgaatcattgcttgttcccgcgtttgagcaaacatgcaagacaatgtttgagcaaatagatggtgcatttcaaaagggaatgtctgagcactccattgctattcagcagcaagttgaggctgcacatactccgttagcgctaactctaaaagaaaccatcaattctgcatcatcaatcacccagagcttttcatcagagttacttgatggcaatcgcaagctattggcacttgttacttctgggaatgccaaggcacataataccagtgctctgcagccctttaatggtcctatgggtggcccccaagaggctgaggctcccttagatccaatgaaagagctgagcagactgatatctgaacgcaagtttgacgaagcgtttacaatggctcttcaaaggagtgatgtttccatagtatcgtggctgtgctcccaggttgatttgcgggcattatgtgcaatgaccccagtacctcttaaccagggggtccttctggccttgttgcagcagctagcaattgacattcacaatgagacatcacgaaaggttcaatggatgacagatgttgccatggcaataaacccgtcagaccagatgatcgcggtgcatgtgcgacctatctttgagcaagtctacaaccagttggcccaccagcggacgctccccaccacgaccgcatcagatggcaccagcatccgtgtgatcatgcatgtaattaactcggttctgcttagctacaagtgattgtagctatgcaactgggaagtatggcctattctatcttgtatagagaaattttgaatgtcaaagggaaccaacaacccaggagggtgatggtgtgacattgtggctgagaatactttcaagagggtggaggctacctccttggtgtaaatttggcttctgttaaaattggactattgtagtaattgagcatccttgaattctctaggtcattttcatttgtcatatcatcattgggtcttgtatttccgtcataccgtaatggaaatgggtcgaatatatcagtgggaccttgtagctcggacagtttgcaaccaatagcagccgcttggtggtggttgatccacac

SEQ ID NO: 13981 - DNA, 888 bp, Sorghum bicolor
  Clone ID: SORBI-28MAY03-CLUS6291_1
gccggccgggccgggctctcttccctggccattcctcatctcgctcgctcgtcgtcgcagccgccttctttgggttcgctcgccagcggcagccatggtgaagtactcgagggaaccttccaatcccaccaaatccgctaaggctatgggtcgggacctgcgtgtgcactttaagaacacacgtgagacagcttttgccatcaggaagctgcagcttagcaaggctaaaaggtatcttgaggatgtgattgcccacaagcaagccattcccttccgtaggtactgtggtggtgttggacgtacagcgcaagctaagtctcgccactcgaatggtcagggacgttggcctgccaagtctgctaaattcattttggatcttctcaagaatgcagagagcaatgctgaagttaagggcttggatgtcgatacgctctatgtgtcgcatattcaggtgaaccaagctcagaagcagcggcgccggacttaccgtgctcatgggcgcatcaacccttacatgtcttccccatgccacattgagctgatgctttcagagaaggaagagccagtgaagaaagaggctgagacccaaattgcagcaaggaaggcctagaagatatgaagacttgtttagtatcagttaagagtggaccgattgtatctcctttttttttctgtactgttgctgcatacttaatcgatacccagaatgggacctttctttctgcagctgtgatgacatccccagaatgagaatgttgcctcagtagtttttcttatttataatccaactaaactaacatgaccctggattttgtacatcgacaatcgttatctccttgactatgatttggtcagcccatcctaaacatgagagtctgaactattccc

SEQ ID NO: 13982 - DNA, 914 bp, Sorghum bicolor
  Clone ID: SORBI-28MAY03-CLUS7397_1
ctactggaacttgatactccctcagattcttatcaaaacagaggaaccccctcacaaaaaaacaaaaccaccgcgccatggaatcgctgacgcttcgcgcctcgtctgcggcggcggccgcctcgccgctgcagcaacgccggctcccggggcggcagcgcgcgacgtacgtccgcgccacggcctccgcgtccgccgccggcgagccggacctctcggtgcgcgtgaacgggctgcagatgcccaacccgttcgtgatcgggtcggggccaccgggcaccaactacaccgtcatgaagcgcgccttcgacgagggctggggcggcgtcatcgccaagaccgtgtctttggatgctgaaaaagttatcaatgttactcctcgttatgcaaagcttcgggcagacccaaatggggctgccatggggcgcatcattggatggcagaacattgaactcatcagtgacaggcctctggagaccatgctgaatgagttcaagcagttgaagaaagagtatcctgacaggatactcatcggctcaattatggaggagtacaacaaagctgcatggcatgagcttatcgaacgtgttgaagagtctggagtggatgctcttgagattaatttctcatgtccacatggcatgccagagagaaaaatgggtgctgctgtggggcaagactgtgatttgctagaggaagtttgtggttggattaatgagaaggccactgtccctgtttgggcaaagatgactcctaacattacagatattacacagcctgcaagaatatctcttaagtctggatgtgaaggagtttctgcaattaacacaattatgagcgtaatggggattaatctcaaaacattgcgtccagaaccctgcggtggagggtattctacacccctggggttattc

SEQ ID NO: 13983 - DNA, 1027 bp, Sorghum bicolor
  Clone ID: SORBI-28MAY03-CLUS8529_1
tgttcatcctgctttttaaatagtcatacagctgggctctgtactcagaaagggccaacacttgatcacatagctctttgatatttgacaagtcaaggtcactaacttctgttcccatggatattactgctgcctcctttagctgtgtttctatctcttcatctgacaatatctcagaaaagtcaaggtcgactgcattagttctgttgcccatcatcttcacaactttggcatactgtatattatctgtaactattttggtgagttctggaaagtgccagccataccattcacgaactctcatggcgtaagtgttaagctccttgtcaagatcatccaataatccaatggcttgaatgatcatggtatcaaccttctcgggactgaacttcagcttatacctagacaagctgtgggacaatcccaagctcattggaccaaggtcttgtgcacccaacccagttataagctcggtgagctgatttctcagccctctcatcagctccatcacagcactattgtgaaggcagtcaattttcagcttttcttttatagcatttccaagcttagaatcagcaactgccaatgtttcaccctcacaatgtttctgcaagaacttgcgcagacccttgctaggcttgctatcaataatcagggttgccgcggatagggcatcagatgtgttctcaaacttgttgaaagccttcagctcaaccacctttctcgctgaatccgacgtcgtgaactccttccatagatcctcgactttgtcgagcttcccctcgtcgagtaccttgaacagggcgaaccccgcgggggtctcgaagagcaccaacatctccgcccacaaccagtcccccgataactcagctgaaacaacagatacccacccctcctctgacctgacctggggaggattcggcggtggacagcacggcgcgaggcgacgagggggggttcgcctgcggcggccgcgaggcgagaggggggtgggggaaagccagccgcccccagggttttccagtag

SEQ ID NO: 13984 - DNA, 1500 bp, Sorghum bicolor
  unsure (1)..(1500): unsure at all n locations
  Clone ID: SORBI-28MAY03-CLUS7360_1
gccggccgggccggggctttgctttgccttgccttgctctctctctctctcaacgcgaaaagaaaagaggaaagtggccggcgatagctcaatctctccttccatcctctctctctctcaacacatatatactcgagatacatatatatcagtaggatggatgtgcaaacctaggtagcctttctagctgcaaactgatcagctgtaccacctgttggtcttcctcctcgctcttcttcttgctggttgccaggagctgaggatcgagagtgcttctgttgttcgcgcggcgaggcggcggcggcggcggcggcagcagtgggcggccggagaccgattgatcagaaggaatgtcgtcggcccaaatcgcgccggcagatcatgtgtgctatgtgcactgcaacttctgcaacacagttctcgcggtgagtgtcccggggaatagcatgctcaacatcgtgacagttcggtgtggacactgcacaaatctactgtcagtaaacctgagagcactgatgcactcactcccagaacaagatcagctccaggagaatatcaaggtccatggcgtcaatggcaccttgcatgatcagtgcggccatttggagctcggttcttcttcgtcctcaaagttccgacttccaatgatgtactcgccgcaaaacgagcacctgctgcaggaacaaacactgaataatgctcgtcctccagagaagaggcaacgggttccatcggcgtataacaggttcatcaaggaagagatacgcaggatcaaggcgaacaaccccgacattagccacagggaagccttcagcacagcagccaagaattgggcacattatccaaatatccatttcggtttaaactccggacgagagggtggcaagaagctcgtggatgaggctgttgcagcagcaccggctccgaaaaagatccaaggtttctactgatagatgtccgagctcatcaatcatcaactgggtggaagaattaataccacaaattataatttactgtaagtaaagaattaagggggaaagggaaagttaagttataattaccttataccttattaatgggtgaaaacttgtgaagagatgtaccgtacatagtaacagtggtgagtgataagtgggaagtgaagcatacaatcacatgaattgctattaggcgccatgcacttgcattggttgaactgagaagacttaataaaccatttgacgacctaccatattattactgtctgaattttgtttgaaattatcaaactttctatctatcattctatctatcttgctaaattaaagagaggaacggattgttcgaatgccgcgcatgtatgtgttattaggtttagtttgcagctcatgtataaatgactgtgtactggaatgtgcaatctcttttattagtttgtgtattgactgatgacagaacaattttctttagtgtttcactattttttctcgtctanaaaaaaaaaaaaaaaaaaggccccta

SEQ ID NO: 13985 - DNA, 1817 bp, Sorghum bicolor
  Clone ID: SORBI-28MAY03-CLUS8573_1
ttttttttttttgcaatcaacttgtttggaatttattacggtgatgactgggagggtctttatgaagctatcactggttatggtcttggtggttcttctatggctctttttggtcgtgttggtggtgggatatacaccaaagctgctgatgttggtgctgatcttgttggaaaagtcgaaaggaacatccctgaagatgatccgagaaacccagctgtcattgcagacaatgttggtgacaatgtcggagatattgctggaatggggtcagatctctttggctcctatgctgagtcttcgtgtgctgctcttgtcgttgcctcaatctcttcttttgggatcaatcatgaattcacccctatgttgtacccactcctcattagctctgtgggtatcatagcttgcttgataaccactctttttgcaacggatttctttgagatcaaggctgtagatgaaattgagccggctctcaagaagcagcttataatttccactgctgtgatgactgttggcattgcacttgtcagttggttagggcttccatatacattcacaatctacaactttggtgtgcagaagacggtgtataactggcaattattcctatgcgtggcagttggtctgtgggcaggactagttattggatttgttacggagtattacacgagcaatgcatacagtcctgtacaggatgttgctgactcctgcagaactggagctgctactaatgtcatctttggccttgctctgggatataaatctgtcattatccctatttttgctattgcttttagtattttcctcagctttagccttgccgccatgtatggtgttgctgtggctgctcttggaatgctcagcacaatcgccaccggccttgccattgatgcctatggccctatcagtgacaatgctggaggaattgctgaaatggctggcatgagccacagaatccgtgagagaactgatgcccttgatgctgctggaaacactactgctgccattgggaagggttttgcaataggttcagcagccttggtgtctcttgccctctttggggcttttgtcagccgtgctgccatcgcgactgttccccctcggtcacctggtgttctcactgcccttattggtggggacctgcttcggtgctgaaactctcccaggagtttttgctggtgctcttgtttctggtgtccagattgccatctctgcatccaacactggaggtgcctgggacaatgcaaagaaatacattgaggctggtgcatctgagcatgcaagaactttgggcccgaaaggttcagacccacacaaggctgctgtcatcggtgacaccatcggtgatcccctcaaggacacctcaggcccctcgttgaacatcctcatcaagctcatggccgtcgagtcccttgtctttgctcccttctttgccacccatggaggcatcctcttcaaatggctttagaggaagaatggaagatcgatgggtaatttatttttgccggggggagagcactagatacctatgtcatagagaagtttcagtttacccatatggtgcatttcttcctttttgtttcgcttgtactgtgtcgcagtcttgttgaacttgtcagccatggtatcacctagttttcgggtctagttgcagtagccgagtgcagcaaaaatgtagtagcattctacaggatggagtctggacatgggtgtattgggaagtgtgatattgcctgtagatatttcgatgatgatgatcaagaaatgcacaattcagatttcctgtcttcatgaaaaaaaaaaaaaaaaaggccaca

SEQ ID NO: 13986 - DNA, 1327 bp, Sorghum bicolor
  Clone ID: SORBI-28MAY03-CLUS25457_1
gcacgaggcacacatcctcctccactccaatcaacctaggacatcctcgcttctccttgagctcttgcgagctcggagtcggagctcctcgcaactgccgccgatcagcctgcgctcagcgctggaaggtgtttgaagaatagcttgaaggttttttttttgaaagaatagcttgaaggttcatagtaaccttcaattgttggaagatgtatcgggctaagagggctgcattgtcaccaaaggtgaagcgccgtgttgggaagtatgagctcggacgcaccattggggaaggaaccttcgcaaaggtccggtttgctaggaacactgaaaaccaggaacctgttgcaatcaaaatccttgacaaggagaaagttcagaagcgcagattggttgaacagattaagcgtgaaatttgtaccatgaaattagtaaggcatcctaatgttgttcgactgtttgaggtgatgggaagtaaagcaaaaattttcattgttctggaatatgttacaggtggagagctttttgaaatcattgctactaatggaaggttgaacactgaatctggagaatttgtttgaagcaaaggaggagtataaaagagagacaagattcacctcacagtgtcccccaaaagagataatctcaaagattgaagaagctgcaaagccgcttggctttgatgttcagaagaaaaaatacaagatgcggatggagaacccgaaagcaggtagaaaaggcaatctaaatgttgcaactgaggtttttcaaatagccccatccctacatgtagttgagctcaagaaggcaaagggggatactctggaattccaaaagttctacagaagtctgtcaacccaactgaaggatgttgtgtggaagtgtgatggcgaggtgaagggcaacagcacggcagcatgaagcggcctttgaactttcacaagacggccctggctttccttgtacatagcttctctttcggatgatcggtgtccattgcagagtcggttttgcaagcaagttctttggttcatttgttgatggcgagtaagcccgatgaaacaaccgtcttgaaggctgttgtggatgagcttattggcgtgttgtttagtttattttacggtcaggaagttggatggaatggaaaccacaatcaaggctgtagtagtgtgtagtaatgaggtattgagatacatcaggtggtgtaagggagtaccagttgttagttcatggcttcaagtttagcccccttcaatttgttctatgatatgatgtgttacttcagaataaacattacttctagatgtatgaggtgaaacacactttcttt

SEQ ID NO: 13987 - DNA, 1418 bp, Sorghum bicolor
  Clone ID: SORBI-28MAY03-CLUS26663_1
cttaatcccacttccttccattgccctatctctcttcctcatcttaatcaccattcaccagacgaccagccctagcgaattcatatcccattcctggttctccgtccatggccgcgtcgctgcttcgccgtggcgctgtcgccagccgccggcgatgcccggaggggatgctgcggcggctggtctcgtctgaggcggcgcccgagcgggcaccgtcgtcgcggccgccgccggagatgccgtcgtttgaccaccagccccgcccgtacgccgggatgggtggcgccgagatcttccagaagaggaaggcggtgctcggaccgtcgctcttccactattaccagaagccgctcaacatcgtggaggggaagatgcagtacctgtatgacgagaatgggaagagatacctcgattgctttgggggcattgtaacagtgtcgtgtggccattgccatccggatattgtgaatgctgtggtggagcagaccaagttgctccagcacacaaccaccatttacttgcatcacgccattgtagagtttgcagaggccctcacctcctaaatgcctggcaatctcaaggttgcgtatttcgtgaattctgggactgaagcgaatgaattagcaatgttgatggcccggctgtatagtgggaatctcagtatggttgcacctactcctgcgtttcctggtgtgttagctcaaaaaatccgattgaccgctttgcgggcgtggccggtcccctctcctggtggattagctgtgcttaaggttcttgacaaggagaaacgccaggcacattgtgctgatgttggagctcacttggtggaacgtctaaaatcgcttcaggagaagcacgaaataataggtgatgttagaggaaggggcctgatgcttggggtggaactcgttacggacagaaaggagaagacccctgccaaggcagaaaccactgaactgtttgagaagctcaaagatctcggagtactagttggaaagggcggtctgcatggtaacgtcttcagaataaaaccaccaatgtgcttttcgaaggacgatgcagacttcttggtggactgcatggactacgcaatgtcagggctctgaaggaacatgctctgaactgcgaatgcgtctgcgtggaaccaacacttcctgcaaccgcaggatgcatggcctgaaatgaaactgaaaggcagatgattggatgggcatgctcgccggttgatgtgttggtggtttcatggtgaaatggtaacccccgcatgaataaatggatgaaaggggagaaaacgtcagaaaatcaaaatgtcttgtccagcttgtgagctgtttgtaaaagaactatagttaataaatatataatagcgagcaagcaagcatgatatcgatctttatatgtgcattttccaggtattt

SEQ ID NO: 13988 - DNA, 715 bp, Sorghum bicolor
  unsure (1)..(715): unsure at all n locations
  Clone ID: SORBI-28MAY03-CLUS2568_1
aggttactcatgagttgcttgaaagactagaagctcacctaagagcaactgcagagttaatggtcaccgcaaacatgaggggaaacagcgcagaagaagtggcagagagagttcttagccagacatcaatatgtggattgcagggcccgactgtaagtcctgtctattgcagacgtgatggaaaagttgatttggaatactatgccattaatgtggttgttccacagaagttgctttacaaatctatccaacaactgagatcaattggtggcagcggagtcttggtaacaaagctgacctacatattcgatgaagagacaccaaggtggcgcaatctcctctcggagctggggttgtaacttgggtgcatggtcagcttctggtctcttttacaacttcctatatgtactgcaccgcattcgtttgcccatgttgaagcatgtagacccatacgcagaagtgagaccgtgcggtatcagtgtaccccttcgcttcgcttcaggaaattttggcgtgtaccaccgtgtgttgtgctcagctgtttatactccaggcatatatcttgaccatctgcgatgtattgatagagttggggaatcctgttgggcgtgtgtgtgtgtatttcttgtgcggttgtgcctgacctctcttgccgcggcactgaataatcggccatgtttgaataaagaaagcccggtatggttctcattccnna

SEQ ID NO: 13989 - DNA, 1670 bp, Sorghum bicolor
  Clone ID: SORBI-28MAY03-CLUS9653_1
aagagagggctgcctgcctatcctccaattccattccatcccggcggtgccgtcccctccctcttcctcttcagcgcagcgcaggaactagctcagctcgcagctccatcgcccgatggtacagtacagtggtgacaagatgaagacctctctcttgctcctgccgctgttcatcgcactcctctctgcaaccagccctctcccatcagctgatgcgctgaacgtgaaaggccgcctggtgaagtccaagaccttcctgtccccgcccatcttcctgcgcccgggcgacgtcgccgacaagatctactacgacatcgccttcccgagaggccacctggcgttcaagagcttcaacggcgaggtggtcgacgagcacggcgtgccggtgcctctccacgagacgtacctccaccactgggtcgtggagccctactacgcggccaaggacgcctccaccgcggcggcggagggccgcccgcggatgatcccggcgaggaactccggcgtgtgcaaccacacgctggggcagtactacgggctcgggtccgagacccggcgcaccgccacgtgggtgcccgacccttacggcatcgagatcggcgaccccgacgcggcgccggaagggtacgaggagcggtggatgctcaacgtgcacgccatcgacacgcggcgcgtggtcgacaagctcgcgtgcaccgagtgccgctgcgacctgtacaacgtcaccgtggaccagtacggccgcggcatcgaggacggctacgccggcggcctgcgctgctgctacgacgagacgcggtgcgcgctggaggagcgaggaaggctcctcgtgaacgccgacgaggaggcgccgcccaggaaggtgttcttgcgctacaccgtgatgtggcaggactggagcgacgcggcggtgctgcccgtgaagatctacatcttcgacgtcaccgcgtgcaaggtggagtacgacgtggacgagtgcgccgccgggaacgacaacggcggcggcggcgagtgcgtccacgtgcagacggccacgcaggtgctgccgcggggaggcgacgtcgtgttcggcgtcgcgcaccagcactcgggcggcatcgccgcgtccctccacggcgaggacgggcgcctgctgtgcgagtcgacggccacctacggcgacggggaggaggccgggaacgaggcggggtacatcgtcggcatgtccacgtgctacccgaagccgggcgacgtgaaggtgcgcgacggcgaggctctcaccgtggtgtccaggtacagcagcgagcgccggcacacgggcgtcatgggcctcttctacatcctcgtcgccgagcagcaggtgccggctgacggcaagccgccgggcctgtgcttcagcttcccggtctcatggtgtctaccgtcatggctgtcgagcaacatgtgagagctctttgttgttgaatggttatgactagtagaaataaacaatgttctagtagcaagcagccaagcatgcaggccattgatgagtcgtcgtgctatatatcttgaaagaaccatcagcaagagtctcctttgatagatgcatgacttgtatgcgtttgtataacacactatagtaagctgggttttgcagatgtacaatctcttgtacaaaaaacagaaataaatataatgagattatatac

SEQ ID NO: 13990 - DNA, 1845 bp, Sorghum bicolor
  Clone ID: SORBI-28MAY03-CLUS10734_1
gcacggcgcccccgtagcccccacctcgcctcgcgcccccgctcttgcccggcacctgcacctgcacctgcactgccccccacttttcttaccaccgagggcgagcgcgaggaggcgccttttcgtgcctgccggctggccgttgccgctgctcacgagcctcccgccccccgcgctgccctgcgctgccttctgactgccccaacgagagccaggggagccaggaaaaaggaggcgtcaaaagcccgagccagaagggggagcacgcaaggacatggcgccaaccgttgccttcagctcagttagcgcccaagctgggctgatccaaaagccaaggaaccttggagccacaagctacgccggattaaaggtgccgagctttcgctcagagtcgtcattcctgggcaggaatgcgtccctacgagcagctgttacaccaaggattgtgcccaaggcgaagtctggatctcagatatctccgcaggcatcctacaaggtggcggtgctgggtgctgccggtggcatcggtcaacccttgggcctgttgattaagatgtctcctctggtgtccgagctgcatctgtatgatattgctaatgtcaagggagttgctgcggatctcagccactgcaacacgcctgcccaggttcttgacttcactgggccctcagagctagccaaccgcgtggagggtgtggatgttgttgtcatccctgctggggtcccaaggaagccgggcatgactcgtgatgacctttttaacatcaacgcgagcattgtcaagtcactggttgaggctgtcgcggacaattgcccagaggcgttcatccatatcatcagcaacccggtgaattccacggtgccaattgcagctgaggttctgaagcagaagggtgtctacaaccccaagaagcttttcggggttaccaccctggatgttgtcagggctaacacatttgtggcggagaagaagaaccttaagctcattgatgttgatgtcccagttgttggtgggcatgctggtatcacaatcctgcctctgttatcgaagaccaggccgtctgtcaccttcacagaagaggaaaccgaggagctgacaaagaggatacagaatgctgggacagaggtggtggaggccaaggctggtgctgggtctgctaccctgtccatggcctatgctgctgccagatttgttgagtcgtctctccgcgcgctggctggcgatcccgatgtctatgagtgcacatttatccagtctgagaaaactgatctgccattcttcgcatcaagagtcaagctcggcaagaacggtgttgaatccgtggtttccgccgacctcgagggagtgactgagtatgaggccaaggcactcgaggcgctgaaggccgagttgaagggaagcattgagaagggtatcgcctttgcgaacaaacagcaggaagctgctgcatctgtctgaagcgaagcaagtgaaatggaatgcagtccacaagggaataaaggaacgatgatcttgaatggcttttaagttttgcagcctagaatttttttggtgccgtgccggagtgtaggaagatgctccagatggttgctgttgttagtttctaattactacatgggggctcgactggacatcccccaagttatcaccggtatctaaaccaggccttgtttaacaccacacataaattttgctccgtctgtattgtggttctgtttgtagcttgttggagtttacaaactacaaagaagctaataaaacacttttgtggaaagtgatctgtgccatgtttgtattgtcgtatttgctactgttcaacagaaaagccctggcttcattggcta

SEQ ID NO: 13991 - DNA, 1401 bp, Sorghum bicolor
  Clone ID: SORBI-28MAY03-CLUS10511_1
gcacgaggcccagatccaataaacagcgagtcccaatagccgacccgcgacagcacccgcgatcccctctctccttccccaaattcgccggcggcgagcggatctaatcggcggcggcagatcggggcggcgtgatggctgggcagaaccagcgcctcaacgtcgtgccgacagtgacgatgctcggcgtcatgaaggcccggctcgtcggcgcgacccgcggccacgcgctgctgaagaagaagtccgacgcgctgacggtccagttccgcgccatcctcaagaagatcgtcgccgccaaggagtccatgggcgagacgatgcgcgcctcctccttctccctagccgaggccaagtacgtcgccggcgacggcgtccgccacgtcgtcctccagtccgtccgcgccgcgtccgtccgcgtccggtcccaccaggagaacgtggccggggtcaagctccccaagttcacccacttcgtagaccctgccgcggcctccgggggcccatccaacgcgtccccgagcctcacgggcctggcccgcggcgggcagcaggtcgccgcctgccgcgccgcgcacgtcaaggccatcgaggtgctcgtcgagctcgcctcgctgcagacctccttcctcacgctcgacgaggccatcaagaccaccaaccgccgcgtcaacgcgctcgagaacgtcgtcaagcccaggatcgagaacaccatcagctacatcaagggggagcttgacgagctcgagcgcgaggacttcttcaggctcaagaagatccagggctacaagaagagggagatcgagcgccagatggctgccgccaagctgttcgcagaggaacagctcgccgaggatctcgcgcttaagaggggcatctccgtgggggctgcggcaaatctgctggttgctggtggggaaaaggatgacgacatcatcttctgatcactccttccatggccatccaatcattcaatcgtggcagaaacaataagttgatgctggagctccagaattgtatctgtttatagagatggagattttgtttcagtaagtagtctggagtctagccatccaagaccctcaataatctgtacctggaaacaaaacattaccaaggaacttttacggagcgttatgtggtgttatgtgcagctggtgtagaaaattcaattggaccgtatttcctgtcatcttccttttagtataatattatatatttgtttaagaaaggtgtgtgcggtgttttgctgcacagcacctgcattctaaagttgcagactgggatgtatttgcttttgcacctgcatttttttaacagattgtcgtttagaatatttcgtgtatgaccatgagaatgtgaatgtatatttggtgtcctgccacgagttgatagaagctg

SEQ ID NO: 13992 - DNA, 859 bp, Sorghum bicolor
  Clone ID: SORBI-28MAY03-CLUS108031_1
gcagcacgagggcctctcgcatcgcaatcgcaacacccaagcaaagcaaagcctcgcggagaaggaagcaaccggccgatcggaatggcgatggcaccgtgcgcaccggtctcctccgttcccttggccgcccgcccggcggcgacggggtctccttcgtctgtccgtccgcgcgccgccgccgccgccgctggggtggtccgcgcggctggggcgacggagggcggcaggtggtgggcgccgctgctggggtggtcggggaaggccgactacctcgaggccccggcgccggcgccggcggtggcgcaggacgacgaggcgggcgcgcgcggcaggcagttcgtgggtggcctgacggaggagaaggcccggcagctgcgtgcgcggatggcgcagaccgagtccttccacgacgccatgtaccactccgccatcgcctcccgcctcgcccgctccgcctaaaccggaagcccgcccggccgggaagcaagtcgccgacgtcgccgtagatctagagctccacccattgtcgtcgtgtgttgtatatacctaccagtcgtttcctttccgtttcgggggtcggggatgtgtttgtttcccctcctctccccccattatcgtcgtcgtcgtggagcaggagggtgagggatctgccggttttacgaggcgcccccctcccctgctctgctctgctctgctccgtgctccgataggatccggagcccgccgtcctgaaaccatttccgatctgcgctggaatggcgcagatccgcgaagcgtttatgcattgtactactgctacttgatgatgaaattggataatctattattgctgttgctaaaaaaaaaaaaaaaaaaa

SEQ ID NO: 13993 - DNA, 1573 bp, Sorghum bicolor
  Clone ID: SORBI-28MAY03-CLUS11287_1
ccccgcgggcgggccaggcagcgcggcagatcaggggcggcgacgtggacacggtgaccggggtcaggaccgacgcggccgcgcggcgcggcaagtcctcggcccacgagatgacggtcggggacgtggcgtcggccggctcgtcgccggcgaagacggacgtcgcggagctggcggcgctgctggccaagagcgtggtcgacgagaccgccgcggtggcggcgttcgcgttccagggtgacgtcctcgtgtacggcggcgccaacctgacgctcgtggacatggagcaggtggacgtgtacgcgctggagatcaaggggctgcgcccggtgcacgtggagtacggcatggacggcgtcggcgaggagggcgccgtgctggtgcagcccgacgccgacggccgcggccgcctcgtcacggccgtgctgcccagggacgagatcgacagcctccgcgccgcgctcggtagcgcgctgcaggtcgcctgagcgccgcggcgttcgtctgaaactacagctacagcacgtatcatagcatggtgatctgaaaatacagtcgctcgtgtgttatctactggtgatgtgatgtacgaatgtaggctgatgcgccaatactgtggtcgatttgcgaagttatttgcaatgtattggatgatgtttccttaataatttgctcgaatagatcatgcaaaatgtaccaagatttacactgcagactatagacaaagttaacagtggtcttccttgtgagtgcaaagagccggatgactttaaacgagtggttcttaccatgtgagagccttgggctagcagctgagcacggctacttcctcaggctgtgtagtgcggctgtttcggcctccgcttgccgtcctgcgataggctgcagctggaagcaaatcgcagaacctgtgatgaagacctatactgagactacagacgggtcgacaattgagaacaaggaacccgctatcgtttggtgctacgaggatgctgatcctgatttcggatcttgccaggccaaggagctccacgagcatctcgagagtgtgctttcaaacgagccggtatcagtgaaagctggacccaaccttgttgaggtgaagccacagggcgtaagcaagggcctggtggcgaagcggatcctctccacgatgcaggagcggggcgacctgccggacttcgtcctgtgcgtgggcgacgaccggtccgacgaggacatgttcgaggtgatcacgacggcggcgaggggagtgtccctgcaggccgaggcggaggtgtttgcgtgcacggtggggcgcaagcccagcaaggccaagtactaccttgacgaccccgcggacatcgtgcgcctcgtccagggcctcgccaacgtctccgacgacgaccagacgcacgccccgccactcccgacggacaccgtaccgaggtgaaccgccgccggaaccggttaacggcgcgcatgagctagctctagggcagcatgagaccttttttggtggtggaaagggaagaccgtgggcttggctttgctgttccccaggtgtacaaaatggtctaggaatgttgtggtc

SEQ ID NO: 13994 - DNA, 375 bp, Sorghum bicolor
  Clone ID: LIB3478-026-P1-K1-F7
gcgcggacgcgtgggtgcttgttgtgtcagagttcatcggttgctcgccctcactgagcggtgctatccgtgtgaaccctgggaacgttgattcagtggcgcgggcggtggactatgcattggagatgcccgaaggggagaaggtgttgagacatgagaagcatcacagatacgtgagcacacatgatgttgggtactgggctaacagcttcctgcaagatcttgagcggatttgcctggaccataacaggaggcgttgctggggcataagatttgggctaaagttcaaggtcgtagcgcttgatccaaacttcaagaagcttgccgttgagcacttggtctcggcctaccggaggacaacaaaacgcgtcattc

SEQ ID NO: 13995 - DNA, 2047 bp, Sorghum bicolor
  Clone ID: SORBI-28MAY03-CLUS12475_1
gcacgaggcttgcacgtgggttggatggtttcatgggcacacgagatgaggagacacgcagatttttcaagcattcttcagtccaagtgttgctgtgcccacgatccgctgggaaacgccacagctgggtgaaacagcaggaaacaggaaccatttttactcatcatcagaaaacagttattgtggatgctgatgctggcaactataggagaaagatagttgcttttgttggaggccttgatttatgtggcgggagatatgatacaccttggcatcctctgtttcggactcttcagaacgagcacaaggaggattattacaatccaaactttaatacagttgatgctcgtggtccaagggaaccttggcatgacttgcattctaagatcgatggtccagctgcttatgatgttctacaaaacttccaggagcgttggttaaaagcggccaaacgccatgggattaaaaagttggcaaaatcgtatgatgatgctctgctcagtattgaaagaataccagatattataaacataaatgatgcaatatattttagcgacaatgatccagagacatggcatgttcaggtgtttcggtctattgattcaaactctgccaagggatttccaaaggatccacgagcagcaaccatgaagaatcttgtctgtggaaagaatgtacttattgacatgagcatacatacggcttatgtccatgctatccgggcagcccaacattatatttatattgagaatcagtacttcattggttcttcatttaattgggattcaaacaaggatttaggggctaacaatttaattccaattgaaattgctctcaaaattgcaaacaagattaaggcaaatgaaaggttttctgcatacatagtggttcctatgtggcctgagggtaatccaactggtgctgcaacacaacgaattctttactggcagaacaaaaccatgcaaatgatgtacgagacaatatacagggccttgaaagaagtaggcctggatgatatgtatgagcctcaggattatttaaacttcttctgtcttggcaaccgtgaagttgatgacagcactagcaattcaaatgcttcaaatacagcaaataatcctcaggaacatgctaggaaaaataggagattcatggtctatgtacattcaaaaggcatgattgtggatgatgagtatgttatcgttggatcggctaatattaaccagagatccatggaaggaataagagacacagagattgcgatgggagcgtatcagccacaatatacatgggctaataagctttctgccccacgtggacagatttatggctacagaatgtccttatgggctgagcatattggaagcattgaggaagacttccactatccggagagcctggaatgcatgaggcgtgtacggcatcttggggaagagaactggaagcagtttgttgccgatgaggtgacagagatgagaggccacctcatgaagtatccagtaagcgttgaccgtaaaggcaaggtgaaaccactaccaggatgcacaacattcccagatttaggtgggaacatctgtggctcatttacagccatccaggagaacctcacaatataaaatttagttttgcaattatataatgctgatggcctcttagggaccctggagatcaaagatagagcagtagatttgtccaaaaaaaaaaagatagagcactagcgtatcctctttcttgagagcgtatagatagggtgaagattttgcaagagctacaggtaggcaagtaggggaagtgctaatagggctttatccccttgccctttttcttgattcaattggtacatataaagtaggtaatcaatttgtatcgttattgggtacctccgtacctgtatagaaaaattaaagaggttcaggaatcacatttggaccaactgccaagatattccatgtaaatcccgaaaagtaaatgtttagtgtaaattgatcctgcagagtattttgaagtgtttcccccttttggggtttttgatgaaatcgcgaattccttt

SEQ ID NO: 13996 - DNA, 1338 bp, Sorghum bicolor
  Clone ID: SORBI-28MAY03-CLUS1424_1
tttgccgggaattgttgtggatcttcctacattaactgagaaagataaagaagacattttgggctggggtgttccaaatgatattgacatgattgctctatcctttgtccgtaaaggatcagatctggtgactgtcagacaggttcttgggcagcatgccaagcgcattaagttgatgtcaaaggttgaaaaccaagagggtgttgtaaactttgatgagatcttgagggagactgatgcttttatggttgctagaggtgatctgggaatggagattccagttgagaagattttccttgcacagaagatgatgatctacaagtgcaacattgctggcaaacctgttgttactgctacccagatgctcgagtcaatgatcaaatctcctaggccaacacgtgctgaggccactgatgttgcaaatgccgttcttgatggaactgactgtgtcatgctcagtggtgagagtgctgctggagcctaccctgaggtggctgtggagatcatggctcgtatctgcattgaagcagaatcttccctggaccacgaggcagttttcaaggcgatgatcaggtccgcgcctcttccaatgagtcctctggagtctcttgcatcatctgctgtgcgaactgccaacaaggccaaggccgccctgattgtcgtcttgactcgcggtggcaccacggccaagctggtcgccaagtaccgccccagggttcccatcctctctgttgtcgtacctgtgctaacgacggattctttcgactggaccatcagctccgagggcccagctaggcacagcctgatctacagaggtctcattcccctccttgctgagggctctgcaaaggctacagattcagagtcgacagaggtgatcttggaggctgcgctgaagtcggctgtgcagaagcagctttgcaagcctggtgattccatcgtggctcttcaccgtattggcgtcgcctctgtcatcaagatctgcatcgtgaagtgatcaccatgacttgactccaaagtccccggggtggttctcaccgctgggatccatgtttctgcctcctttttactgcatttttcggggacagataattatgttgtaagcctgcgtctgttctttgcagttgcaggatgttttttgttcacatagtttttgagctggtaaatgaggagggagaggactccattgatggtagtggtaataagatttgtatctacggagttaagttaaaaggctttttcatgaaaaaaaaaaaaaaagctgtatgctagttctttataagtgccccgaaggatagcaaattttgcaaacatacgtatttgagatacaaactgtga

SEQ ID NO: 13997 - DNA, 1403 bp, Sorghum bicolor
  Clone ID: SORBI-28MAY03-CLUS1777_1
gtagtaatgacataatatgatagcataattatgcttcgagttcagtctctcagcatatagtaagtttagctagtcagttctattacagaactaggcaatataccgacggagacgagggactctgaaaaactcaagtccgttcagttcaccactccagctaacacagaaatggcagttcatagcgccatgcatatcgatacggatacagtaggataggacaggacaggatagttgccatcgccctcggcgtgggaatcccacgcttgggcttcttgagcttcacttggaaagcccgccgttggagtgatcccacggccagacgtcgacgccggggccgccgcagctcgtcacctcgctagccatccggttctccaggctctcgaggctggcgatgctctgcagcggcgagttctggagctgctccgtcgcggacagccccgtgaagcacgcgtcgtcgccggggaagtccaggccggacagcacgtcggggccacggcacgcctgccgcgggttcagcaccggcgacagccccaggctgcccagcccgcacgacagcgcgccacgggccaccatgtcctccgccagcttcaccttgactctgagggcctccacatctgatttcaagatcctgttgtccgtgactgcggttgtgaattgctggttggcgtctgtcagctgcttaaagagcgatgcattctcgcctcgcagctggtcaacctgtgtctcaagatcagctaggtgggcttgcttcctcttcctcgaccgtcgagcagactcacggttcgacaccatccgtcgcattctcttcacgtcctgtgggtttgtgctttgttcgcatggaccaccctcgatatccaacagcgattcactatcggagtctgaaccacttgtgccacccaaagtttggctctctttcagatataggttggtagctgatgttggacttgctgctgcacagattgacgattgcgactcgattgtcgtggagactgcaggatgcctcacgttgtggttatgggaccataggtgattatgaatgcttccattgagggtgttcgagtcagcgaagctgaaggcggacagatcgctgggggggaacacgccacctgcgccgaacggcgccagcgcagcgacgtcgtgcacaggcttctgctcggccaccgccgccgccgccgccgccgtggcgtcctcccggccgcggaggaaggcctccagctccagctccgatgggcacttcttcatccgtctctcggtaggcagcgacgggcacctctctctctctctctctctctctcggcgcttctggctgctgctgcggccgcgtcggcgcccacaatccacaaggcttttagagacgggcgacgcagcgaagcagagcaccgagggcgcctcgtgcaaaggtc

SEQ ID NO: 13998 - DNA, 841 bp, Sorghum bicolor
  unsure (1)..(841): unsure at all n locations
  Clone ID: SORBI-28MAY03-CLUS3593_1
ggtgcgtggcccgcctgtcgagtctcctctcctcttccgtcctccaccacccaccaatcatcatcaccaccaaagctgagctgagctgagctctcctgagtccctcactactagctaagctaagctaagctaagctagtagctcgaatggagaggatgctggcaaggctgatgcggcggcggagctcctcccccctgtccgacctcctccaccatggaggagcagcagcggcgggctcgctgcaggccgccgccggcgccactgcggcctccccctggctcttctcccaccaccagcagcagcagcagcagcacacggcggccgccgcgctgccgggtctcaagatcagggactccgcgtcccagctgattgggaggacaccgatggtgtacctgaacaaggtgacggagggatgcggcgcccggatcgctgccaagctcgagttcctgcagccttccttcagcgtcaaagacagaccagcaatttcaatgttggaagatgctgaaaagaggggactgatcactccaggaaagaccacactgatcgagcccacgtctgggaacatgggcattggcttggcgttcatggctgccctaaaagggtacgaactcattcttacgatgccgtcatacaccagtcttgagaggagggtgaccatgagggcctttggtgcaaacctggttcttaccgacccaacgaaagggatgggtggaacagtgagaaaagcancatagctttatgagaaacatcctagtgcatacatgcttcaacagtttcagaatcctgctaattgtaaggtacattatgagacaacgggtccagaaatattggaggacacact

SEQ ID NO: 13999 - DNA, 1629 bp, Sorghum bicolor
  Clone ID: SORBI-28MAY03-CLUS38389_1
gcacgaggatctggtttgtatctttcctgggcatactgtggcatcagttgtcacttttgtgaaaatatcttacatttagtctcaagaagtccccatctgtgttccctctgcgggctctggccatggaagctagtgccaccaatcatatacagttgtcattatatagatgattaaagatccaatggcgtgtacatgctggaagatctgaatatgagatactgtaattgcatcacagattcagacatgaaatatttatcagatctcacgaatttgagagagctacagctctcttcctgcaaaatctctgattttggtgtttcttatctgagaggtctgcacaagctaggtcatctaaacctggagggctgttcagttactgcagcttgtttggaggttatatctgaactggcttcgttggtcttgttgaatctaagtcggtgtggcatatgcgatgaaggctgtgagaacttggaaggtcttacaaaattgaaggctctaaatttagggttcaaccacatcacaggtgcatgtttaattcatttaaaagatttgatcagcttggagtgcttgaacttggactcatgtaagattggtgatgagggtctatttcacctgaaaggcctcatacagctaaaaagcctggagctttcagacactgaagttgggagcaatggacttcgtcatctgtctggtctacgtaatttgcagagcatcaatctctcttttacattggttactgacattggtttgaagaagatctctggcttgagctcactgaagtctcttaatcttgacaatcgccaaatcacagatactggtttagcatctcttacaaatctcactggattgacacaccttgacctatttggagctcgcataactgattctggcatgaactgcttcagatttctcaagaatcttcagtccctggaggtctgcggtgggttgattacggatgccggtgtgaagaacatcaaggacctgaaagctctgacgttactcaacctatctcaaaatggcaacctcacggacaaaaccctagagctgatctctggcctgaccgcgctggtgtcgttgaacgtgtccaactcccgggtgtccaactcaggcctccaccacctgaaaccgctgctgaacctgcgctccctatccctggagtcctgcagggtgacggcaagcgagatcgataagctccggctggtcgccctccccaacctgatcagtgtccggccggagtgataggaccagcacttccacagcgacctgtaactgtaaagcaactgctgcttgactagagcaggtcgccttgtacatacttttgcaagaacgagatgtctgtacatattgttctttgtgtcgcgtcggtgtgcctgatggcaacggatacctccgtgtcaccgtgtgcacggtatcccacggatcctgtgataggaaggaacaattgtaaatatgtcgtgcttcctccatgtggggtgctcctgtgtaaatagattggtgcattgctaaatacctctccttggctgctgtgtaaatagattagtgcatttctaaatacctctacttggtatcggttaaatgctagttttgatgtaaaatcgtggtatcggttaaatgctatagtttttatgt

SEQ ID NO: 14000 - DNA, 894 bp, Sorghum bicolor
  Clone ID: SORBI-28MAY03-CLUS38430_1
gccgggcccccctcgccgtccgccgcctcggccggcggaagctcttcctccagggcggcgcgcagatgatcgtgtgccagctcgtggtgggcacgctcatcgccgccaagttcgggaccagcggcacgggcgacatcgccaggggctacgcggcggtggtggtggtgttcatctgcgcctacgtcgccggattcgcctggtcgtgggggccgctcgggtggctggtgccgtcggagatcttcccgctggagatccggccggccgggcagagcatcaacgtctccgtcaacatgttcttcaccttctgcatcgcgcaggccttcctcaccatgctctgccacttcaagttcggcctcttctacttcttcgccggatgggtcgtcatcatgaccgtcttcatcgcgctcttcctgccggagaccaagaacgtgcccatcgaggagatggtgctcgtctggaagtcccactggttctggaaaaagttcatcgccgacgacgacgtgcacgtcggcggcaaccacctgcagatgggccgcgacggcaagggggccgacgcctgatgaattgaatgaatgcctactagatcatcgtcatctgttctatatatctatctatctatcgtcagaactgatgaaatgtccccggattgatccatcgattgtacatgtgtaatgtttgttacgcccattaagtcttcttgagttagttctcctcctccatgtctcctactagtactagtatttgtttgtgtaatgtttgttacgcccattaattcttgatgaaaaaaacatgtaccgtaccactgtcaattatcacctcaatcacatccattacttagaagatgtatcaggtatttgctttgagcatgaacatacatgatgaatgaatgaatca

SEQ ID NO: 14001 - DNA, 980 bp, Sorghum bicolor
  Clone ID: SORBI-28MAY03-CLUS20055_1
gccggccggtggaaaacctcactcgtagccgtagcatcagctgcagcaggcgctctgggcagtgtgcgcacgtggtggtactacctagctcgctctgctaagctaagctaagctaagcagcttgccatggcggatcaccaccggggcgggacgggaggtggcgcgggtggctacggcgactacaaccgtgggggcggcgccggcatgtacggcgagtcgcagcagcagcagcagaagcagggcgccatgatgacggcgatcaaggcggcgacggccgcgaccttcggcgggtcgatgctggtgctgtccgggctgatcctggcgggcaccgtgatcgcgctcacggtcgccaccccggtgctggtgatcttcagcccggtgctggtgccggccgccatcgcgctggcgctcatggccgccgggttcgtcacctccggcggcctcggcgtcgccgcgctgtccgtcttctcctggatgtacaagtacctgacgggcaagcacccgccgggcgccgaccagctggaccacgccaaggcgaggctggcgtccaaggcccgcgacatcaaggacgcagcgcagcaccgcatcgaccaggcgcaggggtcttgagatgcacacgcgcgagagcggaccgcgtgtcatcctgctcctggataccgcgcgcgcggggtggcgtacgtacggcggcggcgcgcgaccaccgccggcgcggcatggccctacggctgccgctgctgctacgtacgtactatacgctgccgtagagtcttggtcgccgtgctagctctagctagtcgttatatgtgttgtgctttatttgtatgtgcatgtgtgtcgtcttgttggtacatgcagtgtagtatgctgtactgtatgcgtctttcttgatcggagtgaaggatgtactgcatgctcgatgtctaggttggatgtcatgtttatgatgatggaggaataaaatgcaggttcaagcgatcggg

SEQ ID NO: 14002 - DNA, 1085 bp, Sorghum bicolor
  Clone ID: SORBI-28MAY03-CLUS22472_1
aggggctctcggagtgaggggtctccattgcgagagcagtcgtcagcagctgtcttcttgtaacacaacaacatcgacaagctgtcacagtagtacgatcgacgccaccatgccgggactcaccatcggcgacaccgtccccaacctggagctggactccacccacggcaagatccgcatccacgactacgtcggcgacggctacgccatcatcttctcccaccccgctgacttcacgccggtgtgcacgacggagatggcggcgatggcggggtacgccaaggagttcgagaagcgtggcgtgaagctgctgggcatctcgtgcgacgacgtggagtcgcacagggagtggaccaaggacatcgaggcgtacggcggcgggaagcagaaggtgacgtacccgatcctggcggacccgggtcgggacgccatccggcagctcaacatggtggaccccgacgagaaggactccaacggggtgagcctgccgtcccgcgcgctccacgtcgtcgggcccgacaaggccgtgaagctgagcttcctgtacccggccaccacggggcggaacatggacgaggtgctgcgcgccgtcgactcgctgctcaccgccgccaagcacggcggcaaggtcgccacgcccgccaactggaagcccggggaccgcgccgtcatcgcgcccagcgtctccgacgaggaggccaggaagatgttcccgcacgggttcgagaccgccgacctgccctccaagaagagctacctccgcttcaccaaggtctagctagctaggtgttcgactgcggacctagttcgttgccggccggccggccggccggcggcggcgtacgtgcgcggatcttttgtgccaccggcctcggcctgctggtgcttctagtctgaactggtatatgggctgggctctatgtatgcggtgtatgttcagtaagtatgctgtaagcctgtaacgtcacccgtctcgtgtacgggtggaaaacagtgccgcttagcaacgtccatgtcctcttctgaacttgtcgcagtgcacatcttgtatatgtgtgagactgtactacgtgtcgtctgcccgt

SEQ ID NO: 14003 - DNA, 648 bp, Sorghum bicolor
  Clone ID: SORBI-28MAY03-CLUS10063_3
tgtggcggccggctcgaggggccggccgggcccggggcaacaaaccatcggccaattgggaagaagaagccgcgcgcaggaatcgtagcagccaagccaaacgtgagcatgggctccctgggtcctagcgtcgtgaccctgcagcagcagcagcagcatcccaaggccggcaagcctccggcggcggcgggtggcggccaccatgagcagcagagcagcaactgcggcggcgggtcgtcgtcgtcgtcgttccggatgccgctgcactacccgcggtacaagaaggcggactacgaggcgatgccggagtggcgcgtcgactgcctcctccgcgagtacggcctccccgtcgccggcgacctccgcgagaagcgggagttcgccatgggcgccttcctctggcccgatcagtactgatcgatcaactgtacgttcgtttggagtcccatcccagcatgcagattgaaggaccatatgcatatatggagtggagattaattctccccgccagattcttccacattcacctatctagacatgcatacgagtgtggtgtgggtatgcatgagctccttctccatcgatccgtgaaactactgtacactatcagtggtgattcttcatctcctgttgcctcgttcgtggcat

SEQ ID NO: 14004 - DNA, 1207 bp, Sorghum bicolor
  unsure (1)..(1207): unsure at all n locations
  Clone ID: SORBI-28MAY03-CLUS10063_1
gccggccgggccgggagcatcactcaaagccagcgccaccaaaccacaccctgtaagcatgggttccctaggcccgagcaccaagagccgcgcgggcatggtcgcagcagctccctgcgtgcgtgggatccccggggcttatcgtgtcgtggaccagcagcagcaagcccagccccggacggcagcgggggcggggggtggcggccaccatgagcagcagagcaggaagtgcggcggcgggtcgtcgtcgtcgtcgttccggatgccgctgcactacccgcggtacaagaaggcggactacgaggcgatgccggagtggcgcgtcgactgcctcctccgcgagtacggcctccccgtcgccggcgacctccgcgagaagcgggagttcgccatgggcgccttcctctggcccgatcagtactgatcgatcaactgtacgttcgtttggagtcccatcccagcatgcagactgcaggaccataggcatagatggagtggagattaattctccccgccagattatatctcattcaagtctttagacatgcgaacgagtgtggtgtgggtatgcatgcgctccttttcctgcgtcccgtgaaaataatgtatactaccagtgttgattcttcatcttgcgctgtatcttcgtagcttctccctgtgatgattaacaggtgtttaatttgatagagttatggtctgctgtcatccgtgcaggctttggtgttcacaaactctcggttgtgttgcaggcaggcatgaagaaatgtctctctgcttgtatctgtagtctcaactgttccaaccggaaaactctgatatgttgtataaagaaacaggataggccaggttccaactcccggccggactgtgacccgttttttttcaggaacctggatccacatccataatgaccaaccaagctcagcgctgcgtcgccggccgtgaactgatctcgtcatattcagaggatcagcagctgcatctgcaagttgcatcagttattatatatatatagcgagacctgatcatctcgatcgtatattctcactagttaccatcctgcttgtagttgtagcggccggacatgatacattctactagtatagctgagctggattgcgcgctgtatagtatagctattccgtatatggaataaagaggtgtttattttgtcatanaaaaaaaaaaaaaaaagggcccccta

SEQ ID NO: 14005 - DNA, 661 bp, Sorghum bicolor
  Clone ID: LIB5121-003-A1-PF1-A1
agtttcctcaaagccagcgccaccaaaccaagcagcggcagcctcgcttgcagagtgctcagagcagcagcttccacttccaccctgcgcgcatgggatccttgggccctaccgtgagcttgagcatcatggccaagcccagcggcggccagcagccggagagggagaggaaggagggcggcggcaggtgcggcgacggcggcgtcttcagcggcggctgcggcttccggatgccgctgcactacccgcgctacaagaaggcggactacgagagcatgccggagtggcgcgtcgactgcctgctccgtgagtacggcctccccgctgacggcgacctcgacagcaagcgccgcttcgccatgggagccttcctctggcccgaccagtactgatcggaccaaccaagctcagcgctgcgtcgccggccgtgaactgatctcgtcatattcagaggatcagcagctgcatctgcaagttgcatcagttattatatatatatagcgagacctgatcatctcgatcgtatattctcactagttaccatcctgcttgtagttgtagcggccggacatgatacattctactagtatagctgagctggattgcgcgctgtatagtatagctattccgtatatggaataagaggtgtttattttgacac

SEQ ID NO: 14006 - DNA, 390 bp, Sorghum bicolor
  Clone ID: LIB3478-009-P1-K1-G4
cacaaacatctgccctcttacacacacaccctgtaagcatgggttccctaggcccaagcaccattagcagcatgaacatggccaaggcagccagcgtcgttggtggtaagaccggcgttgttgctgtcgccgaccagcagaaagaagtcccccccaagacgatgaattgcagtagctacgccttccagatgccgctgcactacccgcggtacaagaaggcggactacgagagcatgccggagtggcgcgtcgactgcctgctccgcgagtacggcctccccgccgacggcgacctcgacagcaagagaaagttcgccatgggcgccttcctctggcccgaccagtactgaaggaactcgtgggcgtggccgcgctgaataccgagctgac

SEQ ID NO: 14007 - DNA, 1938 bp, Sorghum bicolor
  Clone ID: SORBI-28MAY03-CLUS2150_1
gcacgtcggccattcgcacggcggtatccgattgcgagcaggtggttcagcgatcggctcagtgccccagccccagtaggcagacacaacacaatcacacgacggctgtttcggtttcgcagtagctcagttcgctgctgcctcgagctctcgccccggagtgtccactgtccagtctcgagtccagcgggggatggagagcagcttgcttgacaccgccgcggccgccggtctctgcccggcggcggccgggcgccgccacgctgggagagcggcgagcttcctcagctgctcctgcgcctccagggactgcagagtgagcgcgtcctactcccactccatcagccggatgctgagcggggtgcggtcggcggcgcgcaagaagctcttccggaccgaccaggcggccgacctgctgggcatcgccaactggtcggatgagacgagcggcggcgccggaggccacggccaccaccagcagcagcactggtggacggcgctggagcacaacttcgtgctggaggccaccgacgacgagtacggcggggtcgtcgtcgacgccgacaggctgccagacgacaaggccgccttcgcgcgctcgctcgcggcgtcgctctcttactggaagtccgtgggcaagaaaggggtgtggttgaaattgccggtggatcgagccgagttcgtccctttggcagtcaaggaaggtttcaagtaccaccacgcggaggaagcgtacctgatgatgacgtactggatccctgatgaaccgaatatgctcccagcaaatgcttctcatcaggttggagtcgggggttttgtgatcaatgaccagatggaggttctagtggtgcaagagaagtatcgcggttcgtcgctggatggcgtctggaaactacccacaggcttcattcttgcgtcagaggaaatctatacgggagccagcagggaggtgaaagaggaaaccggggttgacaccgaattcgttgatgtcgttgctttcaggcatgcccacaacgtggcgtttcagaagtcggaccttttcttcatctgcatgctgaggcctctatcgagtgagatcaagattgacgagacagagattcaggcagcaaagtggatggcgctggaggagttcgtgaagcagcccttcatccaggaagaccacatgttccagaagatcatggacatctgcatccagcgcctccgcaagtgctactgtggcctgacgccgcaccacgtcgtctccaagttcgacgacagaacgtccacgctctactacaatgtcgccgagcctgaggacgtcaactgcagcgccacctgatatatgatgggagattgggagggatagtctagcttttgctgcgcaaagtttcatgatgcagcaatggcgattgctgagagtgaaatgctagctagtacgtagcagattgcgcaaggcaataacagtgttgccaagcctgtacatatacgtgtagggcataacaagcgagagctgtatatcggtagctctgctctgtcgtgtgttctgataaacgatggagccgtgtttgatcgtttgcgacttgcgaaacgaattctgcatcgaatcaaacgcggtactcgatcgccctcaccatctgtcctcttggccatcctcgccgctatgcactagagccgaacctcaccatgctaaccattttttgtttgttttggtaaaaccgattatgtggcatcacgattctcgactacctataattcaacaaaagaactctcacaagagactcccatcgtgccagcgttagacaaaacagaaagcctaacaaatactaccttgtctctcagtaattaggatcataggatggactgatatgatggagtagtctacttattattatttttagttagcgactggctgtctcttttggatgacgccaagtctaaaagcaatctcgctatttcctg

SEQ ID NO: 14008 - DNA, 476 bp, Sorghum bicolor
  unsure (1)..(476): unsure at all n locations
  Clone ID: LIB3481-004-Q6-K1-C9
cgtccgcggacgcgtgggatttcacgatattgagagcatgaagttctagacagtgatcaatcaagcttaataactaacccaccgaggcgttttgtttcagtggatggcgctggaggagttcgtgaagcagcccttcatccaggaagaccacatgttccagaagatcatggacatctgcatccagcgcctccgcaagtgctactgtggcctgacgccgcaccacgtcgtctccaagttcgacgacagaacgtccacgctctactacaatgtcgccgagcctgaggacgtcaactgcagcgccacctgatatatgatgggagattgggagggatagtctagcttttgctgcgcaaagttttatgatgcagcaatggcgattgctgagagtgaaatgctanctagtacgtaacanattgcgccaggcaataacanggtgcccaaccctgncatatacgggggggggattacaagggaga

SEQ ID NO: 14009 - DNA, 1423 bp, Sorghum bicolor
  Clone ID: SORBI-28MAY03-CLUS25380_1
actccagcgccccgctgctggccgctctggtgggcgggttggtcgccgctccccctattccgcctgctcgggggggcctactagttggtgctcgccttattgcgcatggtggaagtttgctaaatttggctaagcagcctggtagcacaattcagatactcggtgcagagaaggctttattcagagctctaaagacaaagcatgctacaccaaagtatggcctcatctaccatgcatccttaattgggaaggcttctcaaaagcacaagggaaaaatctctcgttctcttgctgcaaaaactgctctggccatccgatatgatgcccttggtgatggtgaggacaactccattggcactgagagtcgactcaagcttgagacacggcttcaagttcttgagaatagagaacttgggaaatctgctggttctataaaggggaagcccaagatagaagtgtatgaaaaggaccggaagaagggtgctggggctttaacaactcctgctaagacatacaaccctgcagctgatctggtacttaccgaagaaacaccaaagaagtccgaattggcttcaaagaagaggaaacatcatgaggtgaaaactgaaccatcagcagtgcctgcagaggaagcaattcaagaggatggtgaccaggaggatcggaagaagaagaagaaaaagaagtccaaggaaagcgaggaggctcctgctgttgaaggtgatggtgagaagaaaaagaaaaagaagtccaaggaggcccaggaagagcctgccgtggctgctgcctcagaaggtgagaagaagaagaagaaaaagaagtctgatgccgatggtgaggatgttgcaatgcaaaccgaagagtctggtaagaaagataagaagaaaaagaagaaaaagcatgctgatgatgagtgaggcattcaccggtagagaatgtacgggtaccaaaggctgggccgtagctgttctgtaaaatggttatcacggaggttagaaaccatattgagatcagcttctttttttggggggggacccggcttgtattcaagtacttgcttgatctggaggatgatggaatttaaattttgatgttgcaacttcataaattagtatgatgattgttcatggtaactgtgcagctgagagacctttcatgctgacctgaacgtgttttcgtaattcctagtgtaatgttgtagagatgcaacatgcaaatcttttatgtacccctgcagtcctggggaggtctaatgcctgctcaaaactggcagacacaaatacagtggctgataatttagcaaaaaagcaaggttttgattctttgttcttgcatgttctattgtgagtcttggacccattctagaaactatactgttcagagggcccggaaaactttcaatgggggtttccccattctatat

SEQ ID NO: 14010 - DNA, 923 bp, Sorghum bicolor
  Clone ID: SORBI-28MAY03-CLUS251_1
gccggccgggccgggatcaaacgcgtcacccagcagagaggcaaaaggaaaggaaaaggagctcgccaaaggcaccgtgcagctgcacgactcggctacaggattctcagagacaccgctgcagctgcaatggagatggcctcttcctccacggcgccgaccacgtcctactacaacgtgtccgtggcgcaggcggtgttcacgctctccatcaacgccatcctcgtctggctcaccaccgtcatcaagtcctcttcctcctcctcctcctcctcctcctccggccgccgccgcgatgccgcccccgcggcgaccccggcgcctgctagcgccaccgcaccaccaccgtcgccgtcgtcaccggctaagcccgccgccgccgccgtcgacatggacgtggtgctcgggctgatgggcgccggagccagcgcggtgtccgtcgggttcgaggaggcggcggcgctgttcgaggaggaagaggcgacggtggaggaggcccgcgaggcgttcgcggtcttcgaccgcaacggcgacgggttcatcgacgccgcggagctccggagcgtgctcacgtcgctcgggttccaggccggcgtcgcggacgcggagtgccagcgcatgatcgatgcgtatgacggggacagggatggcaggatcgacttcctcgagttcgtcaagctcatggagacgagccactgagaattagatggatgatgccattcgtaggaccgcccgatcagacgattcggccgaatttgttcaaacattctttgttcgttcgttcgttctttacctatggttttttcttggccggaattaatggagccgaatgatgcatacatataacacatgtgtatatattcaaaatccagcattctaagctatacgaatatatattttatcgaaacataaatcagtgctgt

SEQ ID NO: 14011 - DNA, 966 bp, Sorghum bicolor
  Clone ID: SORBI-28MAY03-CLUS25416_1
gcacgagggttctgctggctgagaccatgggtgaaactgcaggaaaacactagtttttcgaggtaacgaaagccgaaccccgtgttgtttgttcgtggataagtttcggttgctccgcacgcgggtggaccttcggttgccatcctcgcaagtagactcaccgtgcctagtgcggtgggatgctttggatggctcgaccgtcgtggctacgttggcgcatgagttgtgttggacctgtgactgcttggagtacccccgctgatgtgcggccgactcccggcgccagtgtcccttcaatcgtgtgggcaagttgtgcctgctgcattgacaagtgcttgcattctgctacctgtgcatgggaagttgcttccattatacgttgcctttgtcgagcgcaccctctgggcgtgcctcgttggctcaagtgctcttgcggtgttgcctcgtgttgtttgtccacctaggccaacactaccaaggacacctcgcttgcgcttttggtctcggatgtggctgatgttgaaggccgtatgggcggttgcctctcgtgcctgaaaacaaagtctgtttgtaaagaatgatagccagtccggttgatgcctcgtgcaaaaattggtgctggctcatcaatgaggacgtgctacctggttgatcctgccagtagtcatatgcttgtctcaaagattaagccatgcatgtgcaagtatgaactaattcgaactgtgaaactgcgaatggctcattaaatcagttatagtttgtttgatggtacgtgctactcggataaccgtagtaattctagagctaatacgtgcaacaaaccccgacttccgggaggggcgcatttattagataaaaggctgacgcgggctctgctcgctgatccgatgattcatgataacttgacggatcgcacggccctcgtgccggcgacacatcattcaaattttctgccctatcaacttt

SEQ ID NO: 14012 - DNA, 827 bp, Sorghum bicolor
  Clone ID: SORBI-28MAY03-CLUS25418_1
aaaaaacgcgcacttcaagttcgacacgacaggagctgcacgcacgctcctcaattcgcactcccatcgccactgctctgctcacgccgaacgctttcaatggctgcgagcaccaccgcggcgccggcgccatgctacgacgcgccggagggcgtggacgtccgcgggcggtacgaccgggagttcgcgtcgatcctcacccgcgacgcgctggggttcgtggccggcctgcaacgcgagttccgcggcgccgtccgctacgccatggagcagcggcgggaggcccagcggcggtacgacgccggcgagctgccgcggttcgacccggccacgaggctcgtgcgcgacggggactggacgtgcgcgcccgtgccgccggccgtcgccgaccgcaccgtcgagatcacgggccccgccgagccgcggaagatggtcatcaacgcgctcaactccggcgccaaggtcttcatggctgacttcgaggacgcgctgtcgccgacgtgggagaacctgatgcacgggcaggtgaacctgcgggacgccgtggctggcaccatcacctaccgcgacgcggcgcgcgggcgggagtacaagctcaacgaccgaaccgccaagctcttcgtccgcccccgcggctggcacctccccgaggcgcacatcctcgtcgacggcgagccggccatcggctgcctcgtcgacttcggcctctacttcttccacaaccacgccgccttccgcgccggccagggcgccggcttcggcccattcttttacctccccaagatggagcactccagggaagcgaggatatggaacggggtgttcca

SEQ ID NO: 14013 - DNA, 1074 bp, Sorghum bicolor
  unsure (1)..(1074): unsure at all n locations
  Clone ID: SORBI-28MAY03-CLUS49209_1
atttcaggactcttgctagttcatcaccccctcccttccttccttgagagttcgagatcccctctttttccctctctctcatagtctcatctacttactacagtagtctcagtagtcagtaggtagctagtagctagaaggtaggtagatcgagcagtataatccaagaggcagcagcgacatctcgccggcggtggcggccatggcgagtggtggcggcagtagcagtagagtgaccggcggcggtggcaacctgaacctcccagctgggttccggttccaccccactgacgaggagctgatcgtgcactacctcatgaaccaggccgcctccattccgtgccctgtccccatcatcgccgaggtcaacatctaccagtgcaacccctgggatctccctgcaaaagcattgtttggcgagaacgagtggtacttcttcagcccacgggaccgcaagtaccccaacggcgtccgccccaaccgcgccgccgggtcaggggactggaaggccacccggcaccgacaaggccatcatgtccacgccccccgccccagcaccgccgcctcgagggcccgctcctcctacggggcggccccccgcccaggggcctcaagaccgtgtggcttgcgcgcgtgccccccctccgcccccccgaccgccgcagcgggcgatgacaagaacagcagcatcaaacgcagatcagggtcctccatgaggctggacgactgggtgctgtgcaggatccacaagaagagcaacgatttccagttgtcggaccaggagcaggagaaggagggctcaaccgtggaggaattagacactcttgccaacaccaccaacaccgacnacagcatgaacgactctnctgaaacaacaactcttggtcatcatgaccagctccgtcatgaaacggcggccatgacgacgatgagcaagtcgtgctcgctcaccgacctcctcaacagcatcgactacgcgtcgctctcgcagatgttccttgacatccctgccgaggccgaggagcctgcacaacagcaaagcactccactaatctacccaccagcaacacaaat

SEQ ID NO: 14014 - DNA, 846 bp, Sorghum bicolor
  Clone ID: SORBI-28MAY03-CLUS5116_1
ttcggcacgaggcattgacgacgccccgagcatactcctctcatctgcaaataaagccattgggggcagtcagtgagtgagtgagtcagtgtgaggactgaggagagacctttgagcaagcaagcttgctttgagggtcagagggggctttcggcgccggccaaccatgggggaggtgaagcacctgtgcctggtgaagttcaaggagggcgtcgtggtggaggatgtcctcaaaggcatgactgacctcgtggccgggatggacatggtgaaatctttcgagtggggtcaggacgtgctgaaccaggagatgctgacgcagggcttcacccacgtcttctcgctgaccttcgccttcgccgacgacctggccacctacatgggccacgacaggcacgccgcgttcgccgccaccttcatggccgcgctcgacaaggtggtcgtcatcgacttccccgtcgtcgtcgccaagccgccgcctccggcatgatctgccggcggccattgtattgtacggcgccctttttcaggtagcatcagatcagatccatgtgtgttgcagcgctgctgctgctggtgtgctactgcttactgtacgtacttagtggtactactatttattgcttgttctgctctatctatctatctatctatctatctatctatctatctatctatctatctatctatctataatatgtccccggttagtgcatgcatggtgtagtagctgtaagcctgtaaactctgcaaggcaaaaatatctgcaccgtgcactctccgctcaagtacctattgtttggttatctttggaataaattccggtcatctttctggtatgcttgt

SEQ ID NO: 14015 - DNA, 1472 bp, Sorghum bicolor
  Clone ID: SORBI-28MAY03-CLUS26775_1
aaaaaaaaaaaacccaaaaaaaatcgcaatcaccgtcacgccctacgcggcatcaatctactgccactagcactatactactatactctcaactcaagtctcctcctccccatcggagcagagagcatagcagagacgcacgcagaaggagaaggggggatcgagatcgatttcgagcacaagcaggccccgatggcgacgacgacggcgacggcgacgaaccggcgggtgatcctcaaggagtacgtggaggggtaccctcgggaggagcacatggagctgctccccggctcctcggtgccgctccgcctgacggggaccgagccggcgggctccgtcctcgtccggaacctctacctctcctgcgacccctacatgcggcccaagatgtcgcgcccgctgcgtgagtcctacacggcggcgttcgtcccgggcgacgccatcacgggctacggcgtgtcgcgcgtgctcgactcctccgacccgcgcttcgcgccgggggacctcgtctggggcatcaccggctgggaggactacagcgtcgtgaccccgcccgtctccaagttcctcgccaagatctcccaccacggcgagggcgtgccgctgtcctactacaccggcatcctcggcatgccggggctcaccgcctacgtgggcttccacgagatctgcgcgccgaagaaaggcgagaccgtgttcgtgtccgcggcctcgggcgccgtcggccagctggtgggacagttcgcgaggctcgccgggtgccacgtcgtcggcagcgccgggtccaaggagaaggtggagctgctcaagaccaagttcggcttccacgacgccttcaactacaaggaggagcccgacctcggcgccgcgctgaagcgctgcttcccggacgggatcgacatctacttcgagaacgtcgggggcgccatgctcgacgccgtcctgctcaacatgcgcgtgcacggccggatcgccgtctgcggcttcatctcgcagtacaacctggcggacggggagaaggacgccgtgcgcaacctggccgccgtcattgccaagcgactccgcctgcaggggttcatcgagcccgaccacaagcacctgtacccgcagtacgaggcgtgggtgctgccttacatcagggacggcacgctcgcctacgtcgaggacgtcgccgaggggctcgagaacgcgcccaaggcactcatcggactcttccacggacgcaacgtcgggaagcagctcgtccgcgtcgccgacgacgagtcggcggcgtgaaaccggcggctcgattcaattggaccaatcgatcgatgtgtcactactgcgtgttcaaattttcccctttcttccatgaataagtaattgtggcaatcgatgcttttgtttgaaaaaaaaacgtggctcatttgggccgtgtttagtttctcaagtgaaaaatttcacgataatatagtacttttgttgtttatgat

SEQ ID NO: 14016 - DNA, 1815 bp, Sorghum bicolor
  Clone ID: SORBI-28MAY03-CLUS30792_1
gcacgaggcaccgccgctcagatctggcggagacgctccctgctcctccagttcgcacggaagaagatcgctatccccactgatccgtcaaccatgagccgatccttagtccttgcccgtccgcctctgttgtaccccgacgatctggatccgcctccggcttccatcctcgtcgacccgcgcggctacatcgacgaccgcaccaacgccaccaccgccgaaggcgtcacaagcaaaggcaagcgcatcaaggtaaccttctggattgttaacccgccgcgctgctcctgcttcacagtctacagcccggatttagagaaatccgcgttcggcggcattcccatgctcctcagcacagaagacgacctcgccatgcttcgcgtcccgatctgccgtctgggtggggacggtgtcgcgtggaacaacgaccactttgtctatcacgccggcgacgagaataagcctccgtcgctggatttgatccccagggatcccggccgagtctttgacgaaaacgttggcctcctgcgctgccgtgctggcgacatgtatttcattgctatactctgctgggcatactgcgtgggaaagtacgaactgcacctctacagctccaagacagagacatggagctgcaagatgatgtaccttgcttcattagagcagaagttgctctacacctaccccagcaaggtgatcactattggaggggagcatgggtccataggttgggttgacctctggcgaggcatcctcgtatgcgacgtcctcaaggacagctccgagcttcgctacatcccactgccacctccattggtgcccaggaaactcaagggtcctccattgtatgttcgtgacatcattgttgttgaaggctacatcaagtacttcgagatgtgttcacatattgtcggacctgaagcttggaaggcagtcacatgggaaaggaaggattcttgggatgagtggaagaaggactgcgtgattgaagttcccaagtacccagcacagaccaaccctgatcagcaggaggctgaaaccaaaaccctaccaaccttgaagggattctactcaggttatccagccctgagccaccacgacagtggtgttgtttacatattggacagacacggcctcgaggacacagacgtaactgtgcttgcagttgatatgaggaaacagactctaaagggtgtggctaattgttactctccgaggccgctgggttacagttccgtctactttggaagtgggatctccaaacatctgctttcccccagagggaacgctgctactgaaccaagtaagcacaaaactctgcaatttggcaatcaaggaggtccaaggaagaatgtgcaatctgagatgagttctaaaaagttgatggaacacactgcaagtgtagaggaagacgatgccgtcgtaaccaagctgacaacctagaagttcctgtgaagaatgatatcaactgaactcctaagcttatggaagaagccacgagtttagagaaagacaggaagtaaggtgtgcaaggaattcttgcggtggaacaaatgactagttctgtgtgtggtctagaggcttgttatggtataatgcacccgaaatcagaagctagatgctgtctgtattctgtttctttatcctcgtaccaacattgtcttctgtttgctctattggaagtcgacaactatgccaacgcttaaacttatctgcttacgtcatcagttcatcttggttgggtgcgaatgaagggaatgttcatgcggggtgaatccataaaagaatagaaatttcacgctttttgcctctttc

SEQ ID NO: 14017 - DNA, 1721 bp, Sorghum bicolor
  Clone ID: SORBI-28MAY03-CLUS3233_1
cgcgcggggctcattttcaagttccctgggtgcaagactctagttgtatcgagattcaagttccccacgttggtaaaacagacatatgaaatgcagttgctagatgaggcagcggctttgtctgtcttctgccgtgctgctttcgatcaggagtctgttccgcagactgctgacaagaaattggtcaggcaggtctctgcagagtgcagaggtcttcctctggctctgaaggttattggtgcatcgttgcgcgatcaacctcctaagatatggctcagcgccaagaaccggttgtctcgaggagaggctatttctgactcccatgagaccaagcttctagagagaatggcggcaagcgtcgagtgcttgtcagagaaggttagagattgtttccttgatctgggctgcttcccagaggataagaagatcccccttgatgtcttgatcaacatctggatggagattcatgatcttgatgaaccagatgcttttgccatcttggttgagctttcaaacaagaaccttcttacccttgtcaatgatgcacagaacaaggctggagatttgtacagtagctaccatgactactcggtgacacaacatgatgtgttgagagatcttgctcttcacatgagtgggcgtgaccctctgaacaagcggaggcggttggtgatgccaagaagggaagaaacacttcccagggattggcagaggaataaggatactccgtttgaagctcagatagtttccattcatacaggtgaaatgaaagaatcggactggttccagatgagcttccctaaggcagaagtgctgatcctcaacttcgcctcaagcttgtactacctcccaccgttcatcgcgacaatgcagaacctgaaagctctggtgctgatcaactacggcaccagcagcgctgcccttgacaacctatccgcgttcaccactctcaacggcctgaggagtctctggctggagaaaatcaggctcccgccgctgccaaagaccaccatcccgctgaagaacctgcacaagatctccctcgtcctctgcgagctgaacagcagcctaagaggatcaacgatggacctgtcgatgacgtttccgcgcctctccaacctcacaatcgaccactgcatagacctgaaggagctgccatcaagcatctgcgagatcagctcgctggagaccatctccatctccaactgccacgacctcaccgagcttccctacgagctgggcaagctgcactgcctgagcatcctccgtgtctacgcctgcccggcgctctggcggctcccagcgtcggtgtgcagcctgaagaggctcaagtacctcgacatctcgcagtgcatcaacctgaccgacctcccggaggagctcggccacctgacgagcctggagaagatcgacatgcgcgagtgctcccgcctgaggagcctcccgcggtcgtcgtcgtcgctcaagtccctcggccacgtcgtatgcgacgaggagacggcgctgctgtggagggaggccgagcaggtcatccctgacctccgggttcaggtggccgaagagtgctacaacctggactggctagcggactgatgtcacgtctctggatggctactatggcttccaaactgaccgtgtacatatttgatgatgtttatatgttgcttccccctgtgtagtgcagggagagtcatcaatccactggccaattttgagatctt

SEQ ID NO: 14018 - DNA, 923 bp, Sorghum bicolor
  Clone ID: SORBI-28MAY03-CLUS2581_2
cacgcgtcgtgtcacctctcctcgcgcgatccgcgtcgcagcagccgtggccgacggcgaggtcgtgtacaggaacaagtggcctgaggacctgccagggttcagagaggcgctggaggagtacacgaacgctcttgaagagctggcgttgaagctgctggagctgctggcccggagtctgaagctgaggcccgaccggctgcacggcttcttcaaggagcacacgtcgttcttccggctgaaccactaccctccgtgcccggcgccggaggtggtgctgggcgtggggcggcacaaggaccccggagcgctgaccgtcctgtaccaggacgacgtcggcgggctcgacgtccggcggcgatccgacggcgagtgggtccgcgtcaagtgcgttcccaactcgttcgtcatcaacgtcggcgacaccgtgcaggtgtcgtccgacgacaggtacgagagcgcggagcaccgggtgtcggtgaactcggagaaggagaggttctccatgccctacttcttcaacccggcgagcggcgccattgtggagccgctggaggaggtggtgagcgaggagaagaagccgcccaggtacagcgcctacagctggggcgacaacttcagcgccaagctcaacggcaacttcaagtggctggacgtggacaacctccagatcgcggatttcaggaagagctacagctccggagacgtgccgtgaccgtgaccctgagtgagtggtacaaaattgtgaccaccacaagtccacaagtgaagaagagccctttaggtgctagctgactagcggtgtgcacctacaacttcttcctctgtaaccttggaaataaacttgtcttcttgccctttgttctcggaacaaagacagatatatatattccctctatctataaaaagaaaatacaattttt

SEQ ID NO: 14019 - DNA, 777 bp, Sorghum bicolor
  Clone ID: SORBI-28MAY03-CLUS2581_1
gcacgaggctcctcacagcaagacatcgcagcctcacaaccacacagcaacgtgatcgccatgggcgggctcaccatggagcaggccttcgtgcaggcccccgagcaccgccccaagcccaccgtcaccgaggccaccggcatcctggtcatcgacctctcgcctctcacccccaccgacaccgacgcggccgcggtgggcgcgttggccgccgagcggggcgcgtcgagcccggactcgggctcctccgccgggtgtggcgccgccacggctacgagagcgcggagcaccgggacgcgggggactcggcgaggctgagcttcgccgtgcgcgccttcttcaacccggcgagcgacaccatgggggagccggtggaggagctggtgagcgacgacgacccgcccaggtacgacgcctacagctggggcgagttcttcagcaccaggaagaacagcaacttcaagaagctcagcgtggagaacattcagatcgcgcatttcaagaagaccctcgtcctcgcctagataagcagcaggatactacaggtctacaggactaggacaagccgatcgaggtgaccggccgtcgtcttcagattcagtatatgcgtgtcgccgttcgtgttagaacaaattaataatgtgcgcgctgtgtgctgtgtgtgtggagtaaaaaaaaactaaacatggatgtgcatgttcaaaaaaaaaaacatggatgcgagtatgtttgggaataataacaggcttgtgacggtctggtttatttgccaattcc

SEQ ID NO: 14020 - DNA, 408 bp, Sorghum bicolor
  Clone ID: LIB3478-028-P1-K1-H2
gcgcggacgcgtgggccaagcccaccgtcacctaggccaccggcatcccggtcaccgacgtggacgcgctggcggccgaggtgggcgcggcgagccgggactggggcttcttcgtggtcgtaggccacggcttgcccgcggggaccgtggcgcgcgcgacggcggcgcatcgcgcgttcttcgcgctgtcggcgtaacggaaggccgacgttcggaggagcgaggctgagccgctcgggcactacgagtcggagcacaccaagaacgtcagggactggaaggaggtgttcgacctctttccgcgcgatccggcgtcatcagcagtcgtggccgacggcgtggttgtgtacatgaacaagtggcctgaggaccttccagggttcaaagtggcgctggaggagttcacta

SEQ ID NO: 14021 - DNA, 1482 bp, Sorghum bicolor
  Clone ID: SORBI-28MAY03-CLUS33339_1
aaaaaaaaaaaaaaaaaaaaaaactactggacttcacttctccctcctgcaactgcaaagctccttgatccaccctcgatcactcactccaccaccgcggccgcagcgcgcgcgcaccgcgcaaacaaccaactcggcagcgacagcaatggcggatcgcgaccgcagcggcatctacggcggcacctacgggcagcatcagcaggggggcggccgcccgatgggtgagcaggtgaagggcatgatccaggacaagggtcccacggcgtcgcaggcgctgacggtggcgacgctgttcccgctgggcgggctgctgctggtgctgtcgggcctggcgctggcggcctccgtggtggggctggcgctggccacgcccgtgttcctgctcttcagccccgtgctcgtcccggccgcgctgctcatcgggacggccgtgacggggttcctcacgtcgggcgcgctggggctcgggggactctcctcgctcacgtgcctcgccaacacggcgcggcaggcgttccagcgcaccccggactacgtggaggaagcgcgccgcaggatggcggaggccgcggcgcacgccgggcagaagaccgcgcaggctgggcacgccatccagagcagggcgcaggaggccgcttcgggcggcgccggcgccgggggaggcaccggtgctggcaccggcggcggcggcagggcttcctcgtaagcatgcaagccatccgatccatggatgcgtgcgtgtcggtatcagcaggggtcgtcgtggaatgctgttttctgtacgtgggtgaccgtgtcgtcttctccccgagtgcgtgttacatgatatcacggtgttcgtcgtacgtgtgtgtgccggcccaggctggggtcggctgtgtaccggtgtctgtcctgttcatcgccgctccggcccgttcggagatgtgaataagttagctaggggaataagtgatgtctgtctggaagggaaaggttgagctttgctttgcagtgtgcctgggcactggactggatgtgtgtcgggcatcagctgtatgctcgtcgtctgttgtggaaaccattggtgaaggtatcgtctctttcgccgtagggggttctcaggccatcgtcaggcgattgccgggatggggctcctccatgtcaggcggtggatggtttgggcggcggcagaggaacaatctgtctgagcggatggaaggaaacaaaacgttggaagcaaaccaaaaatcgatctcttacgtgaatcgagcagaaggtaatatagtcacatcataacaaaatacatgtatttgagttgagaaaacatgatacaaagggaccaaacatcatgtaaaacaaagtatcaacacttcaaaggtccttttaacaaaatcaacgtttagagatctataatagcgaagcctattatttcacgtcctataaaaataatgttctcgttaattttacatttataactaatataatagtagccatgca

SEQ ID NO: 14022 - DNA, 1495 bp, Sorghum bicolor
  Clone ID: SORBI-28MAY03-CLUS3557_1
gcacgcgcacgaggaaggcatatagcagctgttgtgctagctgattcatcacaaaatgggcagctatactaccagagtccacgccgtagagaaagcagctaacaaccaagatgatgagacgtgcatgcatgctttgatgctccttggcggattggccgtaccttgtaccatcaaggcggtcatcgagctcggcatcatggaccttctcctcgccgcggaccgcgccatgaccgcggaggagctcacggcaaggttgccatgtcctgctgctgctactgctgctgctatggtcgaccgcatgctccgcttcctagcttcgcacggcgtggtcaggtgcgccgccgccaccaaggagtcgtcggagctgggctccgatggtggcaagagctgccggcgctacgcggcggcgccggtgtgcaggtggtttacaaggagcggcggcgtggagtcggtggttccaatggggttgtggatgaccggcaagaccgtcttggagacctggtacaacataaaagaagcagtgttagagggagaaacaccatttgacagagcatacggccagccattttttgaataccttggtgaaaacgggacagtgaacacgttgttcgatgaggcaatggcgaaccattcgacaatcataacgaaaaggctggtcgaggtcttccgtggctttgagaattacagtgtgctcgtcgatgtcggtggcaacaaaggcaccacgttgcaaatgattagaagtcagtatgagaatattagtggcatcaactacgaccttcctcgtgtaattgcgcaggcacctccaattgaaggtgtggagcatgttggtggcaacatgtttgataatgttccacgtggagatgcaattatcctaaagtggattcttcacgattggggcgacaaggactgcgtcaagatcctaaagaattgctatgcagctctcccggtgaacgggacgatgatcattctggagtacatcctcccagagacaccagaagaaacactaacatcgcaactagcgttcaacttcgatttcgggatgatgctcatgtacggcgccaaaggtaaggagagaacagagaaagagttgtcggagctcgccagagaggccggcttctctggagactgcacggctacatacatcttcgccagcatctgggcccttgaattcacaaagtaattaaactagctacgtagctcttatataattaataaccatgcatgtgcttcgtcgcggtgtatgaatgtcgtcgcacatccaggcatatatatatatacacatgccgccatctaaacatatatgtcttgtatgccatcaaaataccgtattgtaatagctcgccaaactgttcgcttgagcttatgagctgaatctaccatttattcagcagtattttttcataataaatcagtcaacagtactttttgccatatgtatttgtgataagtcaaactatatcaactttcacaaaaagaaattatgagtctagtgtgc

SEQ ID NO: 14023 - DNA, 1310 bp, Sorghum bicolor
  Clone ID: SORBI-28MAY03-CLUS3521_1
agcagcccacccgcacgcagcgccgcactcccgccgccgccgccgcactccccgcacgcgaccgcacgcgactgcgcccgacccctctgcctccgctccgactccgcgcgactgcgcccgacccgaccctagtctcgcccgcgtccgccggcatggcctcgcccacggtcgctgcctcctcgagccgggcgggccccaccgacatcctcaccgccgcgccctcgcccgcctccccgccgcggcggctcgcgtcggcgccgcccgccgtcgacgcgtccgggtccttctccccggactccgccgtcgacgcaccgcatttcctttttttttctttcctcttctgccctggtgcgtgtctgatgtggcgcggtgtttggttgtgcatagcccgctgctcgcgagcaggagcgaggagtacaggcttttgttccggctgccgcctcacgaggcttttctcgcagtccctgaggctttcccgacgacgacggagcactcccctcacgcgaccgcgcgggaccgcgtccaacccttctggctccgctccgactccgcgcgtctgcgccaggccccacccaaatctcgtcagcgacctttcccctgctcccgacgacggacacgtccgcccagcgtctcttgaagaccatggtcatcataacccccgaacactagtgcacttcgtgcacaatttggcacttgtctgtattttcggaaggttcgtctttagagaaacaggccccgtatgaggcaaacgtctcaagctataggtgatgtcctaatgcgctcgctggtccctgtaccgggcatatgcgacgatgtcctaggtcgtgcagatcacactgttggtgacctctggcaagttgtacatgatagcgtccaggagaactgttgttgcctcaggatatatactaatgtaactttctcaaagaaaacactagttagatggaaaatagaggagttccatgtgaaattaattatgctccggcgtttatgcgtccgctcctttgctctccccctttgcgttgtttggccccgtgcctctttcttgtggagtctgagaggtgcctttgttgtctggtgatagtttcatcggaaagctgtagattgaagaattatgctaatataatcataatgtggagtcccatggttttggaagttcttgcaataatagctatttggcttcacagactgaaatgctggcattgtagtggtgtcccagacttgttaaactcatttattatggtttatgtgtgctatatatgtggctttgtgtgatatatatgtggatctgtgtgatatatggaattccagtt

SEQ ID NO: 14024 - DNA, 347 bp, Sorghum bicolor
  Clone ID: LIB3481-024-P1-K1-B6
cgtgcggcaattattttagtgtcctcttttgttggttttatcaaacttagctctgtacctgaagaaaactcatgccttaatttcttatatttggattttagtccgatcaggttgccttcttggtatttgattgctatgtgcatgtcttagctttctaacctgatgttccgtgccaacttttgtgtttaagatattatcagcttggcatccagacattatcatgctagcagtaatctgttgctagttctgcatgcttgtttcttgtagcaatgtttcccttgtgaagaataatttatgttacagctccctgcaattaacttctgtcactggttgtaggcgtctaatga

SEQ ID NO: 14025 - DNA, 1560 bp, Sorghum bicolor
  unsure (1)..(1560): unsure at all n locations
  Clone ID: SORBI-28MAY03-CLUS69_1
gcacgcacgagggtactacgataagctttgccactagttagcttcggtcttgtattcttgttgctgttagttctctgtgtgccagcagcatccggccggtaggaaaaatgacgactgggaaggtaacattggaggcggtgagaaaggcgcagcgcgccgagggacctgctacggtgttggccattgggacggcgacaccggcaaactgcgtgtatcaggctgactacccggactactacttccgggtcaccaagagcgaacaccttaccgacctcaaggaaaaattcaagaggatatgccacaagtcgatgattaggaagcgttacatgcatttgactgaggacatcctagaggagaaccccaacatgagctcgtactgggcaccatccctagacgcacgccaggatatcctgatacaggagatacccaagctgggcgcggaagctgcagagaaggcgctcaaagagtggggccagccacgttcccggatcacgcacctcgtcttctgcaccacctccggcgtggacatgcctggcgccgactaccagctcatcaagctactcggtctctgcccctctgtgaaccgagcgatgatgtaccaccagggttgcttcgccggcggaatggtgctccgtcttgccaaggaccttgccgagaacaaccgtggtgcccgggtgctcatcgtgtgctccgagatcaccgtggtcacgttccgggggccctcggagtctcaccttgactcgcttgtcggccaagctctcttcggtgacggcgcagctgcggtgatcgtcggcgcagaccccagcgagcctgctgagcggccattgttccatctagtatcagcgagccagaccattctcccagactcagagggtgccatcgagggccacctccgtgaggtggggctcaccttccatctccaggacagggttccacagctcatctccatgaacattgagcgcttgctggaagacgctttcgcaccgcttggcatctccgattggaactccatcttttgggtggcgcaccctggcggtccagccatactgaacatggtggaggctaaggttggccttgacaaggccagaatgtgtgccacccgccacatcctggcagagtatggcaacatgtcaagcgtttgtgtcctcttcatccttgatgagatgcgaaacaggtctgccaaggacggacacaccacaactggggagggtatggagtggggtgtcctcttcggcttcggccccggcctcaccgtcgagaccatcgttcttcacagcgttcccatcaccacagtggctgcatgaccgctgtgtgcatgttgctccgggtgacgcgtgtgcatggctattcacctttacactttacagtttattttggtttctcacacaaataatgtactgcggcttctatgtgccgtgctgtgtgggtgcttgctgtttgtctttacacgaatacctgagatatctgtgctagtgttaaatgaataaaacagtacaagtcaacacagtgcagtggttataataatttattaataccatgtgcccctnaatattatactcg

SEQ ID NO: 14026 - DNA, 678 bp, Sorghum bicolor
  unsure (1)..(678): unsure at all n locations
  Clone ID: SORBI-28MAY03-CLUS5614_2
ccgggagtcgaaaccctaggagaggcacaacaaaggcacaggcgcaggcgcccctcagccgtgcggcggcctggcccttgggtgcggcagctcgatcggccttccagtcctggccggccagcggcaggccacacgaaggagcagccagcgtgtgtgctttctaggtgttgaagtggggcgccagatctggagtatcgaggagctgcagtgcgggatgagatcagaggagcggtgccggacctgaaacagagctgcgacggcacatcgttcaaatttgtccaagttttaagtggataaaacctcaatccatgtgaaaaagcatgtgtggctatgctgaagaatgttgttcgccactacatcaagatgctgaagaatgctgaagaatgcagtccaagttaaagaagatgtattctgatcctcttccactacatcaagtgcccaagaaatgtgttaatatttgtttgaaatgtgttgagacttgtaatggtgatggcattgacatgtgtaagtcttgccattttctgtgtaactggcattgatcatctgtacctgatcttttgttttctaaaccttttctatgatgaanatangttctaatctgtgatgatatttggntgtgatctgtgacgatcttcatgtaatgtcgattcaaatttgaatttaagtccgtatttgaat

SEQ ID NO: 14027 - DNA, 1662 bp, Sorghum bicolor
  Clone ID: SORBI-28MAY03-CLUS5614_1
gctgcagggttctagggactagcggatcatcacattcccacgcgaaggccgccaacaccccgcgagaaattccgtcctaagcagcgcgcagcagcacgtgcgcgcaggccacagcgccgatcgacaagccggccggccgagcaggcacagcgcacgcgcgcatgcctcctcacatggcggcgatctcgcaccggatcgcagcagggtcggcgcggcgcggcgccgtcgctgctccccctcggacacgcgaggtgcgggggcgagccgcggcgaagggcccaaatcggaagcggacactggggcgctcgatctgcgaccgcagggctgtccaggcccaggaccgggactcgacaccccctcaccgccgcgaagttgcctcctgagagcacgatatgccatctggcgatcactgctccttctaaatggctaccaagagattccaggcagagtgtaattacttgagtaatttatagtgcgttggataattctggtggccttgacatgtgtagctcttaccatgttttcggggtacactttttttttagcatggctagggggatatctgcactttcttttttgatggaattgctaagttgatagctgcggctggttatgctgttgatgctatggattattctggttttggcatgtcatatggtctccatggctatattgcaagctttgatggaatggtggaccatgtcattgaacagtatgcacgaataagaggcatgaaggaagtgtgtgagctgccacactttctcttaggacagtcaatgggaggtgcagttgccctgaaagtacacttaaagcaacaaaaagaatgggacggtgtgcttcttgtcgcacctatgtgcaagatttcagaagatgtaacaccacctgcacctgtattgaaggcactgagcatattgtcatgtcttcttcctgaggcgaagttatttccgcagaaagatataagggatttggcatttagagatccgcggtttcggtttctggctgagtacaatgccatctcatattctgaccaaatgagattaagaacagcagtcgaacttttaaaagccacgaaggacattgaatcacagttggagaagatctcctccccattgctgattcttcatggagccgcagacatggtaaccgatcctcaagtcagcaaattcctttatgagaaagccagcgcgaaggacaagaccctcaagctctatgaaggcagctaccactcaatcttagagggagagccagatgaacggatttcaactgccattagcgacatcatttcatggctagattcacactgttaaataacttgtgtctatagcctctcatgtcctcatccattgttttggatttatagtttcttagggtactacgggactatagtttaattttgccatggtgtgcacagaataagtatctctcgaatttaattaattttgtgtttgctatcttgacgttgttaagtgtttttgccgtaattgcggacaccgcactgtataatttctttctttctttctttcttttttttttttgcaaccatgggccaatcctcaaaccaagatctaatgtaatctgccaagaagattggtacccattcggggttttccccctcaaggacaataccagttctattggtagaatagctgtttatagcatagt

SEQ ID NO: 14028 - DNA, 505 bp, Sorghum bicolor
  Clone ID: LIB3476-024-P1-K1-E3
ccaatccccagcctccgccctcaccctgccctcggtggatctagcctcggcacagaggttggcatgcagctcgcggaggaggttcaagacaaagcgtgatccacggagaaggctgaagggtgacgccccacctccaacatgcgtggatctggtccgatctgcaagctaggtgagttccgcatggagttccgcatgacgcgcacaacaggaatagaaggagttccgcatggaggtcgcgagtcccacctgcaggctaggctggttgcagctttgcagaagcaagacaagcaaggcaccctagcttggtcctgcctgattgatttttttgccagtccaagtttgaagtggataaaacctcaatccatgtgaaaaaaagcatgtgtggctatgctgaagaatgttgttcgcaaacggcgctataacttaaagaagatgtattttgatcctcttccactgcatcaagtgccgaagaaatgtgttgatatttgtttgaaatgtgttgaga

SEQ ID NO: 14029 - DNA, 1071 bp, Sorghum bicolor
  Clone ID: SORBI-28MAY03-CLUS699_1
gcgcgcggcacgcacgcaaccaccattcccggctgtatttgtccggcaagcaagcatctccggcgccagcgagggtgggctgtgggctgtggcagccatggcgtccactgtaacagccgccaacagccatggaagcgtcctgcgtacccataccgccccctcctccaggcagctcgccggttggagcagcaggcgcacgcttgccatgcctgcacaccacgcgccgtcacccagagctcgggtcgtcgccgtccgagccgccggcacccagcggccgacctggttgcccggactggacccgcctcctcacctcgacggcacactaccaggtgacttcggcttcgatcccttgggcctcggcgaggatccggcaagcttgaagtggtacgttcaggccgagctcgtgcactgccggttcgctatggcaggggtcgccggcatccttttcactgacttgctccgtgtatcagggaacagcgacctccccgtgtggtttgaagcaggtgcggcgaaattcgaattcgcaaacaccacggcgctcttcttcgttcagcttctcttgatggggttcgctgaaaccaagaggtacatggacttcaaaaatccaggatcacaagcagaggaaggaacgttcatagggttagaggctgcacttgcaggtcaacagccaggctaccctggaggccctctgtttaatccactaggacttgcgaaggatatagagaatgctcatgaagagaagctcaaagaaatcaagaatgggaggttggcaatggtagccatgcttggcttcatggtgcaagcatccgtaactcatgccggccccatcgacaatcttttgacacacctttcggacccgttcaacaaaaatatcattcacgcattctcctcttcctaagtactcgtcccaactcccaaaacctttcttttcactgtccagtgctatggcacaaaaatgtcacaatgtttgctaacaggaggtggcctttgttagctttgctctttgcaaagttttctctcatgaaaattgaataaaagcttcaatagctgaaaaaaaaaaaaaaaaaaaaa

SEQ ID NO: 14030 - DNA, 1390 bp, Sorghum bicolor
  Clone ID: SORBI-28MAY03-CLUS40480_1
ccgtctccttgcaaacattagcctgttcctctcgtcttccctccctcccccccctactccccccctacccctactctttctctagctttctctccacattctccctgctctgtgcaccttgtagtttcggttgtggatcgccggaaatggcaatcgacgatgaatcgccgctcgcattctacacgggaccgcgggcaagagaaggcgacaggtcaggcgacgcctatcagaatcgagagcagaggcgccataggcggcggtgagtgcgactactctgacgccgagaccaagcggacgcggccgcggctgaagccgctgctatcaacgagcttcttcgtccaatgcaggatccgcgcggacgcgcacgagagcgagtgcaccatgtactgcctcgactgcatgtacggcgcgctccgctccctctgcctagcgcgccatcgcgaccaccactccttccggatatggacggcctcctaccacgcagtaatacgggtgtcggagatacagaccgtgctggacaccgccggcgtgcagccgtacatcatcaacaccgcgcgcgtggtgttcctcaacgagcggccgcagccacgcccgggcaagggtgtcaccaacacctgcgaggtctgcgagcgcagcctcctcgactgcttccgcttctgctccctcggctgcaagatagtgggcacagcccgtggctaccgtcccaagaagaagcacggcatcggcggcggcggtcacaagaagaagagggcggcgcttaaggtcaaggacgtgcgctctgactcggaggattcgtgcaccagcaccagcggcgccagcagcgacaagagcagcgtggtgcagagcttctcgccgtcgaccccgccgccgacgtctgccagccaccgccgcccagggaacaagcgccggaagggcgtcccgcaccggtcgcccttcggcagcctcatcgtcgagttctgaggactctctgtgtcagcgcctaggcaatgcaactctgtactctgcgtagtactgcatgacatagcccagaagagaagggaataacagccggcggcgcaaatgccagcgaagggccgagagcggtaagaacacaccagtggtgcttctatagtttgcttctttcttacagttacagttgctagtcactagcagtgctaccagtaagatagctgctacttacagcctccgtaaccgcgactaagttttgcagccttgtacattgtaatactcctatactatagaccagcactctccaaagttagatgtatatatacatatatatacttttgtagtatcagaatgtatgggttagcagtaggcagcgaggtgttcgtcagtttcgtgtgtgtgcatcatcacgctgtgtaataaaaataagaaatgctgctct

SEQ ID NO: 14031 - DNA, 582 bp, Sorghum bicolor
  unsure (1)..(582): unsure at all n locations
  Clone ID: SORBI-28MAY03-CLUS4292_1
gccggccgggtcgggactcgagcctgcccgatctccccgcgccaaaactccagctagctagcgcgatcgagactaccgtacgtgtcgccatggccgcaacagcgtctctgtccgccgtcgcggcgccgctgtccgtggccgggctcaggaagccgctcggcgcgtcgtcgttccggcccctgcagccgagggcggcggcgaggatgacggccgtgcgcgcgtcgtcgtccgtgaaggagaaggcggcggccgggctgaccgcggcggccctggcggcggcgctggtggtgccggacgtcgccgaggccgcgcagtcgctcacgccgtcgctcaagaacttcctgctcagcatcgtgtccggcggggtcgtgctcgtcgccattgtcggcgccgtcgtcgccgtctccaacttcgaccccgtcaagagggcctgatccgatccatcgttaggaggcacgtctcccctgtgccctgtcctgtctgtatccactgctggtgctgtatcttcctttgttgtgttaattaattttggagaatgtccaaacatatatatctctatgatacggagttcgagttattctn

SEQ ID NO: 14032 - DNA, 642 bp, Sorghum bicolor
  Clone ID: SORBI-28MAY03-CLUS44599_1
gcacgaggcacacattcaccagatcacaaccgcttcgaagcacaggcacaaaacaccaagcatcaccaatggctcactaccaggaggtggactactgctcggaggaggtgaagtcggtggccgccggcggccctgccggctttggtcgccatcatggcggccacggcggcgtccagcagcacgtcgtcaaggagaagttcgaggaggtcgacagcgtctcacgcgccggcggcggccgccacggccacttcgaggcccgcgagtccaagttcgaggaggacgtcaacacccgcaccggcgagttccacgagcgcaaggagaacttcgtcgtcaaggccgacaactgaccagcttcttcgcgcgggctcgatcgacgcacgtatcatgatctgaacgacctggactggaccctgaggcacgtacgtatatgtgtatgtacgtacacgtacgtacgtacgtgtcttctccatatacgtatgtatgacgactgtatatgtgtgtactcacttcgcgagcgtgcgtgcatgtactctgtacgcatgcagccctgtacgaacgacgtaaaaataagctcgtgatctgaataaagcaggttctcccgtgctgtaaaaaaaaaaaaaaaactcgagactagcctcgtgc

SEQ ID NO: 14033 - DNA, 1252 bp, Sorghum bicolor
  unsure (1)..(1252): unsure at all n locations
  Clone ID: SORBI-28MAY03-CLUS4493_1
cgtgcgcngacccntgggccgacgcgtgggctcctcgcacgaccggccaccacaatttcttcgccttcctctccgccggcaatcccacatccaatcagccgccgctccagccttccatccatccatccggtcgctgctctgtgaactccgcctgcgatccaggagaccaagaggaggaggaggaggagcgatggcgaggagctcgttcaagctggagcaccccctcgaaaggaggcaagctgaggctaaccgcatcagggagaagtaccctgatagaatccctgtcattgttgagaaggccgagaggagtgacatcccagacattgacaagaaaaagtaccttgtccctgctgacctcacagttggacagtttgtgtatgtggtgcggaagcgcatcaagctcagcgctgagaaggcaatcttcatcttcgtgaagaacaccctcccaccaacagccgctctgatgtccgccatctacgaggagaacaaggacgaggacggcttcctctacatgacctacagcggcgagaacaccttcgggctgttctgagtggaagcgccgccgccgcgatggatcgacattggacaatgaaaccccctcctgtaaatacttaataggcatctcaagaaccctgtgtacataatctcaagaatctgtgcgtctagcaactctctgtctttcgaaagcatcgaagcatactacaatatgctaaacacgtttaagtaatagtactcagtcagctctctgggttgcttcagaaaccctgttaaaaaaacctgctgtgtcatccgtgaacttatcgatgtgacaaagtaacatgaggggtgccagcaaaaaaaccaccaatgtcccctgatgttacctgctgtttgttcattaactggccctcgtgccggtggcaccgactgatgggtgacggtaacccaccggcatcgtgcatgccggcggtggcgaagggcaccggcatgcatgcagccggtgggcggtggcgatggaaccgcaccgcaccgcaccgcgcggcaggccggagaacctggacgttgtggcaggaaggatgaaacccgtgtgcagcaggcacggtggtgcagaaagaccagcatgtgtttgagcactgtatcgaatcattgtagatagtagatggaatgctgtaatttgattcgaaatcatgcggtgctgttagctgcgggaagagcgaatcttggttctgcgaccatattaaattccttgctatacagatgatacgtctgatgc

SEQ ID NO: 14034 - DNA, 711 bp, Sorghum bicolor
  Clone ID: SORBI-28MAY03-CLUS45318_1
cagcagcgtcgagcagctgaacctggcagggaaccgcccggtcggtcaggtgcccgacgcgctctgcaagctcgcagggcctgccggccgcctcgccaacctcacgctgtccagcaactacttcacctccgtcgggccggcatgcgcggaactaatcagagacggcgtgctggacgtgaagaacaactgcatcccgggcttcgccaaccagaggcgcccggcggagtgcgcggcgttccaaagccagccaaagacgtgcccggcggcgagcaccacccaggtgacatgccccgccgcagctgccatggatgcggcggcgccaggggagaggaaggtcagggactactccagctacgtgacgtacgctactctgcatgactgagccacatcggcatgcggtaggagacagaatgccttggtggcattttggctatttgttcttgtattcatgatgcgtgttcactagtgtgtcttggtgttgttgtagttgttgtctacttgcattggacgtgtgttgctgtcacatcctagatcatcccatcatttgtactgccacgtccattattatatattgtatgaaaaatgttgtttgtgtaccggtctgggatatgttccacgcttccatgttgcttagactgtgtaatttcggatatggcagtgactttggacaacattacttaattactacactagaatgaattgcttgccacc

SEQ ID NO: 14035 - DNA, 1408 bp, Sorghum bicolor
  Clone ID: SORBI-28MAY03-CLUS45331_1
gtgcccctcccggcgcgccaccccgccgcctccggcctcgccggcgtcttcgccgccttcgcctcccccgtcgccttctgcgacgagccccgcctgtcgctgtccctgtccccggcggcgatgtcggacagggagagcgtggtgtacagctacgggatggtgctgctggagaccatgaccggacggttcacggcgtcgtcggacggcggcctgctcgagagctgggccgcggcctacctcagaggggagcggcaccaagtcgtctgttccctctcgcctgcacacaagccgcatgcctgtccttccaaccacgagctggacggcgtcatcaggggatgcacggaccgggagcccaggcggcggctggcaatgccggaggtcgccaaacgcctcagggagatcaccgccatgccacccgacgcggccacccccaaggtgtcgccgctgtggtgggcggagctggagatcatctccacagaggtcaactgaacccaagacggacgaaccgatgttttattacaaattaagatgtcgacactccaaatcctgaaaaaagaatgaaatttccagaccaatgtttattagttcaaatgcccatgaaaaacactctttggtagtagataagacagtttgcttctttttgctgatagaccagtggccgccatcatggctgccgtgggcacccaaggctgctacgccgccgatgatgagctttccctttccaccaacgcaagccccggcaccttcgccggcggcggcgatggtctcaaatccttggcacagcagcatcacgctgcccccacagccgcccgcggcggtggtggtaccggccggcgtcggcagtaagccggtggttgccggcggcggtgcggcgaggccgccgcactctggcgtgagcaggcctgtctatgtcattgctgcggccggggcgtcccttgtggcggccatgtcggtggccctcttcgtcctctgctaccggtccaacaaggtggtcaccgtcaggccatgggcgaccggactcagcggccagctgcagaaggcgttcgtcacaggtgtgccgtcgctcaagagatcggagcttgagatcgcctgcgaggatttcagcaacgtcattgggaccttgtcggattacatggtgtacaaggggacgctgtcgaccggcgtggagatcgcggtggtgtccaccaccaagaactccgccaaagaatggtccaagcactgcgaatcacagttcagggagatcaccgccagcccgcccggcgcggccccccccaacgtctcccccctgcggggggccggcctggaggtcctcccctccgcgggcatctgggccctcgacggcccgcccgacggtccgctccttgtgcagctacccgctcgccaggtccgttacctggactggccgaag

SEQ ID NO: 14036 - DNA, 1833 bp, Sorghum bicolor
  Clone ID: SORBI-28MAY03-CLUS46218_1
gcacgaggaagaaattgggggaaagccttaagaaatctgtggaaaatggtgatatgcttagcgttcttctggactggagagaatcccttccccatcccgatgagcgtgtagagtatgagttctggacaaacagtaatgatgaatgtggtcctaaatgcgatatgcaaatggactttgtgaggagctttagaggaactgcacaaattcttgagaaaaagggttacactcagtttactcctcattatatcacatggtattgtccagaagcttttgtcagtagcaagcaatgcaaatcacagtgcatcaatcatgggagatattgtgcaccagaccctgagcaggattttagccaagggtatgatggaagagatgttgtggttcaaaatctgcatcaaatttgtgtattcaagattgctaatgagactggaaagccatggctgtggtgggattatgtgcatgattttgcacttaggtgcccaatgaaggataagaaatacaaccatgactgtgccagcgatgttatcaagtcacttggattggaaatggagaagataaacaagtgtattggcgaccctgaagccgatgtggaaaatgaaattttaaaggcggaacaagatgcccaaattggtcatggtaataggggagatgtcacaatactaccaacccttgtcatcaacaacaggcaatacagaggtacgctggacaaagttgctgtcatgaaagcgatctgttcaggattcgaggagacaactgagcctgctgtttgtttgagcgaagaggttcaaacaaatgagtgtttggagaacaatgggggttgctggctggacacagctaataatgttactgcatgcaaggataccttccgtgggcgtgtttgtgagtgccctattgtgagaggtgtaaaatttgttggtgatggatatacccattgtgaagcttctggtattggtaggtgtgagatcaataatggagggtgctggcaggaaactaaagatgggaagacaatctctgcctgctcaaacgaagtatctgaaggttgtaaatgtccagtgggtttcaagggtgatggagaaaaaagttgtgaagacattgatgaatgcaaagacaaactttactgtcagtgcaagggttgcagctgcaagaatacatggggaagctatgagtgcagctgtggtgatgacaatatgctatacatgagggagcatgacacttgcatcagcaaaaagggtactaccagtactgttggctggagcttcctctgggttattttctttggacttgtttttgccggggttggagcatacgctgtgtacaaatacaggctgaggagttacatggattcggagatccgtgccatcatggctcagtacatgcctctggataaccaagaaggggcaaaccagcatcaggtcgtgcacgcgaatgatatttgaagcggcactccttttctggagcagcatagaaggagcgcgcaacatttcacttgtgctgctgcatcattggacatgggttttacaaataggtcaactaggctcaaagatacacgggttgtgcgaggagatcaagatttactgtaacatgtattatgagagacgttgtgcacctcttgttacgacacttgatgaacagcataggggatgaataccatatcgtagttttagtagcacttggttgcctttagtttttcttcaaacttgtgagttcttgttgcctcgtcccatacattttcttttctttagatataatggaacacgtcgcatacatgtcatgtgaacactgtaaataccgttacctgaataaagcttcagcctgcaaggctacaagcagcgtccc

SEQ ID NO: 14037 - DNA, 1256 bp, Sorghum bicolor
  Clone ID: SORBI-28MAY03-CLUS4785_1
cctcgaggggcacccccaggaccaggagcgcgctccccagagatggattaaacactagtgcagttgttgttgatggccctgctgcaaattcagttaaaaggaagaggaagaaccagtttaggggtatccgccggcgcccatggggtaaatgggctgctgagatcagagatcctcgcaaaggtgttcgtgtttggcttggtactttcaactctcccgaagaagctgccagggcttatgatgctgaggcacgcaggatccgtggcaagaaggctaaagtcaacttcccagatgagggttcgacgattcctcagaagcaccgtgctggtcctacccctctgaaagtgcctgagatggactttgaagagaagccgattatcaagccggcagtcaacaacatgaccaactcaaatgcatatcactaccctgttgtcgaccacaacatacccgagccatttatgcatactcaaaacatgtcatttgctcctttcgtgaattctgctgctcccattcaggaacctttcgtgaacctgtcctcagaccaaggtagcaactccttcagttgctcagacttcagcctcgagaatgacaccaggacccctgacataacgtcggtagttgttggtgagtctgcgttcgtccagaacactggtcctgctgtggtgcctccgttgatggggaatgctagtgttgatctcacagagttggatccatatatgaatttcctgatggacagtggttcagaggactcaatcaacactcttttgagctgtgatggatcccaggatgtggttagcaacatggacctttggagctttgatgacatgcccatgtctgctggtttctactgaggttgaggccccagcgactggtgcttgtacatagggacaaagggaataatgttctggagatgatgaaacgcttgtgtggcgtgcctgcaggcgtgcagtagctgtggtattagcagtatatgcttagatgttcagtcactttcttaagtacacattggcgctggacatgtaccttatttgtatccgtgacaacaactatgtgtctgctcttttttattttcctgcctttacttcaaaaatggctctgaactttgcgagcttgtagccaaatatatgtgtatgtgcttgagtctatatagttcatcctaagctgcaatgtgatagtctttgtaggcatgcatgtgcgcgcagcacgtctatgaaaaaagcattccttcgaaatagatgaagtaacaatcatttttctcc

SEQ ID NO: 14038 - DNA, 1938 bp, Sorghum bicolor
  Clone ID: SORBI-28MAY03-CLUS28857_1
gcacgaggctaccaagtgggggacgaggaccgggaaccggtagagaggggatttctcggggccggagtggcggccatgacctgattgggctccagggcgcgatctttgagcgcagatttggtgcccgcgatctgccatggatttgatttaagatttggggagatcggttgggttcgcgctgcaagattcgatttttatgcctgttttgttcacgagattaggaggaggggaaataaagcaacaatagaaagatttttggggggacaaggcatgatgctggaagggaagtcctaccttgtgtcgcgctccctgccgagctcctgcgagccagagacggagtgggcgtacctcgcccacgaggtcctcagcggcaagcgcccgacgccggaagacgtcgaggtcgaagacctcgacgaagctgacggcggcggcaagcgcagcaagccgccgtctccacagccgcacacgccggacatctgcgagggccacggctccagccgccatgcctccggttgcggagagcagcagggcactgggagcaaccccatgaattcaatcggtcgtgacctgaccatcaattgcctcctccggctatcccggtccgactacggctcggtcgcctcgctcagccgggacttccgcgccatggtccgcagtggggagatctaccgcctgcggcgccagagtggggtggccgagcactgggtatacttctcctgcaatgttcttgaatgggatgcctatgacccatatcgagagcgctggatccaagtgcccaagatgccgcctgatgaatgcttcatgtgctctgacaaggaatcacttgcagtgggcactcaactgcttgtgtttgcgatggcgcatattgtgttcagatacagcatcctaaccaattcatggaccatggctgatccaatgaactctccacggtgcctgtttgggtcaacaagtgttggggaaaaggccttcgttgctggaggcactgattctggtggcaacatactgagctctgcagagatgtatgactctgagacacatacctggacgcccctcccaagcatgaatagggcgaggaagatgtgttctggggttttcatggatggcaagttctatgtgataggtggtgtggccaacaacaacagagtgctgacttgtggggaggagtatgacttgaagaggcgttcttggaggataatcgagaacatgtctgaaggcctcaatggagtgactggtgctcctccccttattgcagttgtcaacaatgagctctatgccgctgattacagcgagaaggatctcaagaagtatgacaagaagaacaataggtggatcacccttggaaaactgcctgaacggtctgtatcaatgaatgggtggggccttgctttccgagcgtgcggtgaccgcttgattgtcatcggaggtccaaggacctatactggtggtactattgagctcaactcatggatcccagatgagcggccgcctgtgtggaatttgattgccaggcggccatctgggaacttcgtgtataactgtgccgtgatgggttgctgagtccactgaataaaagataagtgcagtggatatttatgaaggatgctatgcacagaggcagcctgtccaattgcttcagcccttattcttcgtagcgatttctgccgtctgcccagttccggaattaactggacatcagctgattgtcagcagtctcatgtaacccttgagttctaatactcctgtttccctgctaatccatttctacatttgcatttgaatcaactgctcgtgatttcaaagatacgagattatggaaaacaaatgtcatattaataatctagaaacaacttcgagagtgttttttatctattgatgaggaagctgttaagaaatacttgattcgcctgtagctgcaagaaatgctaattcttttcgttc

SEQ ID NO: 14039 - DNA, 968 bp, Sorghum bicolor
  Clone ID: SORBI-28MAY03-CLUS82834_1
cctactggattcgatccctgaggtttattagagttcgctactaccaatggctacaaccaagttggcagccctttgcttcattgtcctccttggcattggaggggcaaatgctgcaagggtagcaagatatgttagcgccgggggtggtggtggtggtggagggggggggagggggaggtggcgggggggggcgtcacggtggggctcgggttccggctcgggctgcggcggggtacggtgaagctggtgggtctggggagcatatgcgcagggaggcggtcagggtggaggtggcggaggaggacaatatgggggctctggatccggttatggttcaggttctgggtatggtcaagccggtgggtctggatccaatggtggagcgtatgctcagggaggtgcccaaggtggagggggaggtggaggacaatatggtgggtctgggtctggttatggctcaggttctggatatggacaagctagtgggtatggtccttatggaggaggttatgctcagggaggtggtcagggtggaggtggcggcggcggacaaaatggtgggtctggacaaggttctggctctggctctggatatggtcaggctggtggatatgggccttatggtggcggatatgctcaggcaggtggccaaggtggtggtggtggaggcgggcaaagtggtcaaaatggtattggatatggaagtggctcggggagtggctctggaagtgctggcagtggttatccataagccttctacatggatttgcatgtccaatatgcacctttactaatatttgagtatttcgttaatgaagaataaaagggctttatgtgcccattgtattaaaattagctgtgttgcatacaaaatgtgctactatcaataatgcaagtgtgcttggcttcttgtgtgtatcaaacagttcttacattgagtgccattgtttgtgaatgttgctagtatg

SEQ ID NO: 14040 - DNA, 1232 bp, Sorghum bicolor
  Clone ID: SORBI-28MAY03-CLUS851_1
tctcccgctcacgctgctcccgcggctagaccagcccctcgcccgcctcctcgcccgtccggcatcccgtggactcccgattgcctcccttacctgtcccgggctccagcacttgcatccacccccgcgcggcggtcgccggagcggagcagagcagccggagggcccgtcggatccgccgccgcaaagatgaatgacaccgatgtagccaagcagatccagcagatggtgcggttcatccgccaggaggccgacgagaaggccaacgagatctccgtctccgccgaggaggaattcaacattgagaagttgcagcttgttgaagctgagaaaaagaagatcaggcaagagtatgaacgcaaagagaagcaggttgaagtacggaagaaaattgaatactctatgcagttgaatgcttctcgcatcaaagttcttcaagctcaggatgatctagttaacaaaatgaaagacgatgctatgaaggaactccttcttgttagccacaaccaccatgaatacaagaaccttttgaaagatctaattgttcagggcttgctccgtttgaaagagccagctgtattgctccgttgccgcaaggaagatcaccatcatgtggaatcagtactgcattcagcaaagcacgagtatgcatcaaaagcagatgtacatgaaccagagataattgttgaccatgttgtgtacctgccacctgccccaagccatcatgatgctcatggccagttttgctctggaggtgttgtcttggcttctcgagatgggaagattgtgtttgagagtacacttgatgcaagactagaagttgttttccgcaagaaattgccagagatccggaagcttctttttggccagactgcagcctaattgaccatccaccgattgtacggctgcttctatgtaatggttgcgggttgcacgcccccagccataaggaactctgcctgtttttgccaaattgattgtttaaggtattcatcccctatgtacaaactacctatttgttcattattatcgccgagcaccgactgtgtactctgtttgctccgaggaacaagaataaagcactgccagactttccattgcgaagctgaataaatattgtaaagccatttgttgtgctgaactttccgtttctggcccagtcgagtgtgtatatttagttatgtcggatacggttcttgtgaaaaatagttgaagttgtcagttcatctcct

SEQ ID NO: 14041 - DNA, 1526 bp, Sorghum bicolor
  Clone ID: SORBI-28MAY03-CLUS8592_1
aagcggcacctcaagcaaatccaagcgcttaaaccacactcatcagatcaaccacaaacagcctcccgagcagaactcgctcgtagccccgagaaccaacagccctcctcctccccctgcagcgagatggctcccgagcttgccggcaagatgaccgccaaggccgctgccgccgccgccgccgcggcggtgacgaagcccgcgacgagggcgtacgtgacgttcctggccggcgacggggactactggaagggcgtggtgggcctggccaagggcctgcgcaaggcccgctcggcgtacccgctggtggtggccgtgctgcccgacgtgccggagtcccaccgccgcatcctcgtctcgcagggctgcatcgtccgcgagatcgagcccgtgtacccgcctgagaaccagacgcagttcgccatggcgtactacgtcatcaactactccaagctccgcatctgggagttcgtggagtacgagaggatggtgtacctggacgcggacatccaggtgttcgagaacgtcgacgagctgttcgagctcgagaagggctacttttacgcggtgatggactgcttctgcgagaagacgtggagccacaccccgcagtacaagatcggctactgccagcagtgcccggacaaggtggcgtggccagcaaccgccgagctgggccctccgccggcgctctacttcaacgccggcatgttcgtgcacgagcccagcatggccaccgccaaggcgctcctcgacaccctccgtgtgactccgcccacccccttcgcggagcaggacttcctgaacatgttcttcagggaccagtacaggccgatcccgaacgtgtacaacctcgtgctggccatgctctggaggcaccccgagaacgtgcagctggagaaggtgaaggccgtgcactactgcgcggccgggtcgaagccgtggaggttcacgggcaaggagcccaacatggacagggaggacatcaagatgctggtgaagaagtggtgggacatctacaacgacgagacgctggacttcaagggcctgctgcccctctcgcccgccgacgccgacgccgacgacgaggtggaggcggtggccaagaagccgctgcgcgcggcgctggcggaggccggcacggtcaagtacgtcaccgcgccctcggccgcgtgatcccgtgctctggcttcccaccgccaccggtggccgccgtgctatagcagcttgtgtggtcatcgtcatcgcagaacataagaagaatctcactataaggactttgttttgcattttgttttttgaattagggtgtctaatcttcgatcagttccttgtacttaagtgtgagcttactatatagtaccatttcaaggtgcaagcatgcgttggtcaggaattgcgctttgtgaatacgccctttggtcacagctagagtatttgtcctgtaccgagggattatcattatatgtattttggttggtaaattattaatatatataaaataggaagccgcaaaattatggccg

SEQ ID NO: 14042 - DNA, 685 bp, Sorghum bicolor
  unsure (1)..(685): unsure at all n locations
  Clone ID: SORBI-28MAY03-CLUS14469_2
gtggcggccgcttcgaaggccggcnnccgggcggaaggcaaagcacgcgcaaatccacccccggcgtcgtcgtctccaagcaagcgaagagcgcccgcccctcgagatctctcggcctctccccctccccgcgccgccgctatggacgccgttgactcggtggtcgacccgctccgggagttcgccaaggacagcatccgcctcgtcaagcgctgccacaagcccgaccgcaaggagttcaccaaggtcgccgcgcggactgcgatcggcttcgtcgtcatgggattcgtcggcttcttcgtcaagctcatcttcatccccatcaacaacatcatcgttggctccggctgatccacttccctctggctagaggctgcaggtgtggacaatggcgtcactaccttggaggcagcaccattttcagccctgatatcagtaaagatccgtttaggacttgtgttgttaaggacaacctccttacctttttctcttgaggacttgtggtacacctggaactcttttgtacctgatgccgaatgggtttccgtgaattagcgggtaacaaaattgaatggttaccatgtcttctcgattgttttatggtgcggtatccttcataatttgcttttcgcgacgttgttagaaaaaaaaaagtatcgttcataatctgaatatgcaattttcg

SEQ ID NO: 14043 - DNA, 616 bp, Sorghum bicolor
  Clone ID: SORBI-28MAY03-CLUS14469_1
tacggccggggcggggaaaaaaagaagaaaacaagcaaaacttcccaaaggcaaaaaccgcattctcgcgtctgctttccttccacacccatatccaccccccgcgtgaccgcgtctcgccccgtcgccatggatgccatcgactccgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgtcaagctcatcttcatccctatcaacaacatcatcgtcggttccggctaggcttacaggagtgcaggacgattagcatgggagtagtgcgatacttctgagagcaggatcttggtctttcgaatagtattgttaatgacagtttttattcgttgtgtttctggagtaatcgttgtactgtaagacttcaggatgtctggataccggattctgagtagaccttgaaaccttgataaagcagccagtcttggaaagaaagttttatcttttgttgtttcgttaagctgtttttgttgctgtccaaaaaaaaaaaaaaaaaaggccccta

SEQ ID NO: 14044 - DNA, 327 bp, Sorghum bicolor
  Clone ID: LIB5052-005-A1-XP1-E2
gccggccgggcctgcttcttcgtcaagctcatcttcatccccatcaacaacatcatcgttggctccggctgatccacttccctctggctagaggctgcaggtgtggacaatggcgtcactaccttggaggcagcaccattttcagccctgatatcagtaaagatccgtttaggacttgtgttgttaaggacaacctccttacctttttctcttgaggacttgtggtacacctggaactcttttgtacctgatgccgaatgggtttccgtgaattagcgggtaacaaaattgaatggttaccaaaaaaaaaaaaaaaaaaggccccta

SEQ ID NO: 14045 - DNA, 830 bp, Sorghum bicolor
  Clone ID: SORBI-28MAY03-CLUS114_1
gccggccgggccggggcatcgacagatcgttcatcgtatcctcctccgctcagtcctccgggatctcctcctccggctataaattccggccccagttcgcccaatccagatgcgcaaacatcgaatcgtcccactcgtggctgccctgctcgtgctgcttgccctcgccgtatcgtccacccgcaaccgcaacgcacaagagggggaggagtccatggcgttggccggcggcatcaaggacgtgccggcgaacgagaacgacctccacctgcaggagctcgcccgcttcgccgtcgaggagcacaacaagaaggccaatgctcttctggggtatgagaagcttgtgaaggccaagacacaagtggttgctggcacgatgtactatctcactgttgaggtgaaggatggcgaagtcaagaagctctacgaagctaaggtctgggagaagccatgggagaacttcaaggagctgcaggaattcaagcctgttgaagagggtgctagcgcctaaggatctctcgtctccatgtgcaatttgctgcctgaagcgcaaaacaaagttgcagaataaggagctgcttcggaacatgcctgagcatgcccccttgtgcaatttcataaaattacagtgctatgtaatatcttaaatttccgtgccctgtgtaatatcatgaataacagttgctattatggattctaaaggtgtattaactagtaccatagatggaggaattctcatattactatgctgaagtttttgtcatggcagaattgtaaaattgcttcgctgaagtctttgttgaaacttcaaaaaaaaaaaaaaaaaaaaa

SEQ ID NO: 14046 - DNA, 413 bp, Sorghum bicolor
  unsure (1)..(413): unsure at all n locations
  Clone ID: LIB3481-051-Q6-K1-E10
cgtttcgaacaaattgcagaataaggagctgcgtcggggcatgcctgagcatgcccccttgtgcaatttcataaaattacagtgctatgtaatatcttaaatttccgtgccctgtgtaatatcatgaataacagttggtattatggattctaaaaaaaaaaaaaaaaaaaaaaaaaaaaaaaaagggggggggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggnggggtttaaaagaaaaaaagttannggnngggggggggggaaaggnaaaaantttttttttggggganttaaattaaatttatgggggggggtttttaaaggggggggggggggaaaaa

SEQ ID NO: 14047 - DNA, 1984 bp, Sorghum bicolor
  Clone ID: SORBI-28MAY03-CLUS2027_1
gtcctcgtcgcccacggaatcgcaattccacaccttcctagcagtctcctcaaagcgcccccattcattcttagcagatctcgctgctttccgccgctcgacgccgacgccgacgccgacgcagacgccaccaccgcttccccccattcccccgtcccggaccgcggagcagagagggagagagatccggagcggcgcgcgatggcgaacatcgacatggcgaagatcctggcggacctggaccgcggcgccggcgacgcgcgggtgcccaagaccaagctcgtctgcacgctcggcccggcctcccgcaccgtgcctatgctcgagaagctgcttcgcgccggcatgaacgtcgcgcgcttcaacttctcccacggcacccacgagtaccaccaggagacgctcgacaacctccgacaggccatgcacaacaccggcatcctctgcgccgtcatgctcgacaccaagggtcctgagattcgtacagggtttttgaaggatggtaaaccaattaagctaaccaagggtcaagaaatcactgtcaccactgattatgatatcaagggtgatgaaaatatgattgctatgagttacaagaaactgcctgttgacgtgaagcctggaaatgtcatactctgcgcagatggtactatctctctggccgttctgtcttgcgatcctgatgctggaactgtgaggtggaggtgtgtgaaccctccagggcttggtgtgggtctccccacactcacagacaaggacaaggaggacatccttaagtggggtgttccaaacaagattgacatgattgccttgtcatttgttcggaagggttcggatcttgtggaggttaggaaggtacttggcgagcatgccaagtccataatgctgatgtcaaaggttgagaatcaagagggagtagctaactttgatgatatcctggcaaactctgatgcttttatggtggcaagaggtgatttagggatggaaattcctatagagaagattttctttgcacagaaggtgatgattttcaagtgcaatattcaaggcaagcctgttgtgactgcaacccagatgttggaatctatgatcaagtctcctcgccctactcgggcagaagcaaccgatgttgcaaacgcagttcttgatggcacgggtcctgtcatgcttagtggcgagactgctgctggggcttatccagagctggcggtgcagactatggccaagatctgcctacaagcagagtcttgtgtagaccatgcttctgttttcaaatcaatcatggcttcagctccaattccaatgagcccattggagagccttgcatcatcagctgtccgcacagcaaactctgccaaggcagcacttatcttagtcctgaccaggggaggaacaactgctaggcttgtggccaagtataggccatccatgccgattctgtccgttgtggttcctgagctgaagacagactcgttcgactggacctgcagtgacgaggggccggcaaggcacagcctcattgtgaggggtgttatcccaatgctgagtgctggcactgccaaggcctttgacaatgaagccactgaagaagctcttggttttgccattgaaaatgcaaaggcgatggggctatgcaacaccggtgagtccgttgtggcccttcaccgcatcgggactgcatccgtcatcaagctcctgactgtgaactagggtctagccgaagggggagccacaccactttgtttggtggaatttttgtgaggctgcttacgcatatcagcgaatctgcagcttttttgttgccaaagatacagactttgggttctggtacaccttggtgtcacaaggttgtgggaatttgtcatttagatgttagtgatttaaacagttatcaactgctatagctaattaatttgcactgtgttgcaactgctatcgtactgaaaactttatggttgcttcaccatgtttgctggttgatttt

SEQ ID NO: 14048 - DNA, 1383 bp, Sorghum bicolor
  Clone ID: SORBI-28MAY03-CLUS20648_1
ggcggcccgactgccggggcccatgtcccaccctcctcctcctcctgttgatcaaaatatctcgctgcgcttttgcgagtccttttccctccaaggaacagaaacacccggcgcttttaccccacccgcacccgctttcccctcccggccaagaacaggagcaacaacaaggctcctcctcgagacattccattcatccatggcgaagctcgtgaacaagctggtcgattcgttcgaggagcaagacaccccggacgtcggctgcgtgcgcgccgtgctggccgagctcgtcctcaccttcctcttcgtcttcaccggcgtctccgccgccatggccgccgggtccggcgtgaagcccggcgaggctatgccgatggcgacgctggcggcggtggcaatcgcgcacgcgctggcagccggcgtactggtgacggccgggttccacgtctccggcggccacctcaaccccgccgtgacggtggggctcatggtgcgcggccacatcaccaagctccgggcggtgctctacgtcgccgcgcaggtgctggcgtcctccctcgcctgcatcctgctccgctacctcagcggcggcatggtgaccccggtgcacgcccttggcgcgggcatcagcccgatgcagggcctggtgttggcgatgtagcacaacttctgcctgtgcttcatcagctacgccatgatgctggacccacggagacaggtccgcaccatcggcccgctgctgaccggcctcatcgttggtgccaacagcctcgccggtggcaacttcagcggcgcgtccatgaacccggcacggtccttcgggccagccctggccagcggggtctggacaaaccactggatctactggatcggcccgctgcttggcgggcccctggccgggttcatctacgagtctttgttcattgtgaacaagacgcacgagccgctgctcaatggagacatctgacgaaccatcggcctgccctgtggctgtgggcagggcagtcagcatggttggttcatgcttgtttctgtaaaatagttcattgtctacaagcatgatggatacatatattggtcaaggtaattagagagggttgctgtaaaatagttaccctggtataggattgttggatgtagaaattgttgatgggctttgtatttttttcccccttttcatgccaaggaattcttttttttttagagggcggggttctgtcaaggatttgttaaggctattagtagttagccatgtagtagaaaactagagaatggtatacgtgggagtgggacctgaagttttttcaggtacactgtagtactattgtaattttgtcttgaagatggaattggatgtacagagtaaaaacttctcttttttgg

SEQ ID NO: 14049 - DNA, 1591 bp, Sorghum bicolor
  Clone ID: SORBI-28MAY03-CLUS26614_1
gcacgagggttactactactaccactactacctagctacgaacaaggatgcagtgccaaagcagcatcaacagaacccaacaccaacagagaattgaagtgaacacacacagcaaaatggcagcagttcatttcagttgaggcactgctgcagctagagctatagcagggaatcatcagtgccggccggtagtggcagcagttcttgtgcctccctacccaacgactcacccgatctctctagtcagaaggcacgaggcactgcccccgatccaccaatcccctcctgctcctgctgctgcgtgagttcattcgttgcagtctcaggttctcagcatatatactgcaggactccacccactgcccggacctccaccacctcgtctctttcctttcacctcttcctccgtcctcgctctctcctaggcctcttcttcctcatcgatcacagccggccagctgcaactaaaagctagcttagctagcagaagcaagaaaggcaccatcatatccgatccgatccatggcggtgaaggactgcggcgggcacaagggctgcgagtgcgagcgtgagcgtctgtaccggcggtgctgcgcggcgctcgtggcgttcatcctcctggtcctcttcgtcatcctcgtcgtctggctggtgctgcgcccgcacaagcccaagttctacctgcaggacctgtcggtgctgtgcctcaacgtgacgccgccggcgtccacgtacctcttcaccaccatgcaggcgacggtggcggcgcggaacgtcaacgaccgcgtcggcgtctactacgaccaggcggacgcgtacgccgagtacaagggcgtcgccatcaccgtgcccacgcgcctccccgtgcagtaccaggggcccaacgacgcctccgtctggtccccgttcctccgctccctcgacagcgtccagctcccgccgcagctcgccgtcgcgctggcacaggacgagacggcgggctacgtgctcatcgacgtccgcgtcgacggttgggttaggtggaaggtcggcacctggatctcgggacactaccacctccgcgtcaactgccccgcgctgctcaccgtcaacgagggcaaaggaagctatggcgccaacaccggcggcggaacgggctacttccgattccagcaggccgccgcatgcgccgtcgacgtctagtctctagtctagtgtacgtagctggctggtgttcgcttcgtcttgcgtcgttgcagctttaatttggtacatcaacattccttcgttctcttgtaaatcgatcgatcgatcgatcgtcgcatcagaatcagctgcgtttgtcaattcgtcgatcgaatggacgatggtctttaatttcagagcttggctgctgattaggcagtgatggatcggattctgattattggtgggttggttggagtctttggattgaagaagggagagagatggaggaaaagacgatcatgatcatatcgtactgtactatctatggggcaaacgtgaaggttgctccatccatataccatcaataatgtcaattgttcatatatatatatatatatatataaatacataattgtcttgtctc

SEQ ID NO: 14050 - DNA, 1063 bp, Sorghum bicolor
  Clone ID: SORBI-28MAY03-CLUS2821_1
gcacgaggcccatctgcccgacgccgcgtgcccccgacggctcgcagcgacgctctccgtccgtttgctcagcgcctccactcgctccccgtcgcccgccacgaagccatccgcagtccgcccccgggacgcgagcgccgccagggagccgaaagtacgcttcggttccgccggcacgggaggggattcgagctgggtcttgggtagcgcctctcacgatgccgccagcccccaagtccggcgacgccctcttcgccagcgtggatcgcgtcaatgccgagctgttcacgctcacgtacggcgccatcgtgcggcagctgctcacggatctggaggaggtcgaggaggtcaacaagcagctcgatcagatgggttacaacattggaactcgattggttgatgagttcttagcaaagtcaaatgtatcaaggtgtgttgacttcaaggagactgccgatgttattgcaaagcttggcttcaaaatgttcttgggtgtgactgccactgtgaccaattgggatgcggagggtacaagttgcagccttgtcctggaagacaaccctcttgttgattttgttgagctccctgacacttgccaaggccttcagtattgcaatttgttaagtggagttattaggggggcattagaaatggtgtcaatgaagacagaggtgacatgggtccgtgacatgcttcgtggggatgatgcctatgagatgcgggtgaaacttatcaagcaagtcccggaggaatacccctacaaggatgatgactagttctatttcagtggaagatttcggcacaggacgaggcctgtttgcttgtttggatttttcacatcattgtcgtcgacggattctagttctgctataacctgatgtcatacgaggaagctgtggattatattttacacttaccgtgtgtattgcttatgtattgtagaaatcatacatgatcttccatgagttgcgctgaggctttgaattagtctgcagaattcagagcattagcaatgcaaattgtgttacctagaaataaagtattttcaatctctttagcggtc

SEQ ID NO: 14051 - DNA, 934 bp, Sorghum bicolor
  Clone ID: SORBI-28MAY03-CLUS29618_1
gcacgaggggccaacagcaacctcccccgccgcatcatcaaggagacgcagcggttgctcagcgagccagctccaggaatcagtgcctcgccatcagaggagaacatgcgctacttcaatgtcatgatccttggaccatcgcagtcgccatacgagggaggcgttttcaagcgcgagttattcttgcctgaagaatatccaatggccccaccaaaggttcgatttctcacctcgccatcagacgagaacatgcgctacttcaatgtcacgatccttggaccttcgctgtcgccttacgagggaggagttttcacgctcgcgttattcttgcctgaagaatatccaatggctccaccaaaggttcgttttctcacaaaaatttatcaccctaacattgacaagcttggtaggatatgccttgatattttgaaggacaagtggagtcctgcccttcagattcgaacagttttattgagcatccaggcattgcttagtgctccaaaccctgatgacccacttgccgacaatgtggcaaagcactggaaggctaatgaagctgaagctgtagaaacagctaaagagtggacccgtgtatatgcaagcggagcttgatctttgcatgaagcatgcttgcctggtaagaaatttcgttccgtggatctgcggaggtggaggtgaacttgatcaacgattggttgctgaaattggaaatcgaaatgattgagtgaattgtggatttccaaatatcctttgatgatgcgtgtcaagagtctgatgtacattactctagttgagctgtgatgatgaaccctcatgcatgtaaattgtttctttggtacgtctggttcctgagagacatcagacatatatgataataaatatcctagaatgatgtatgcctgcccttaaaaaaaaaaaaaaaaaaaaaaaaaaa

SEQ ID NO: 14052 - DNA, 871 bp, Sorghum bicolor
  Clone ID: SORBI-28MAY03-CLUS3442_1
gccggccccgggcctaccctccttttacccaccgctccgtctctccgccgcttgcttggaagacgaagaaaccctccccccaccaacccaatccagccaaatccgggcccggagcagttcgccgccttcgttcgattcgttcgcatcccccaacgcggttcgatcccaccggaaggagcgtgatggccaagacgagctcgttcaagctggagcaccccctcgagaagaggcagtctgaggctaaccggatcagggagaagtaccctgacagaattccagtgattgttgagaaggctgagaggagtgacattcctgacatcgacaagaaaaagtacctcgtccctgctgatcttacagttggacaattcgtgtatgtcgttaggaagagaatcaagctcagtgctgagaaggctatcttcatctttgtgaagaacacccttccaccaacagctgctctgatgtcttcaatctatgaagagaataaggacgaggatgggttcctctacatgacttacagtggtgagaacaccttcggtctgctctagatggatggcgcaacaccacagctcaccgcaatcgggtcgccttgcccttgcttccctaccaatgccctgcccatgcggccatgcctcctgtaaataaggcctgccaagcaactgtgtatattctggtttcctcgttgcaagtgactgcactctactgctaaaacctacctatcagattgtcatcgatgtaatggacatcctttaaaccaaattgattggacctgaatcttgggtcgatgtgtgatatcttttatgtcagtttacggttactggcccgtgtaagggctgtaacaaggtcaatctgggtcgcagtatgccattgattc

SEQ ID NO: 14053 - DNA, 1535 bp, Sorghum bicolor
  Clone ID: SORBI-28MAY03-CLUS12516_1
gcgcgaggcctgttccggtgtcgtgatcccagagagcccaagcaagcccgcactggaatcaacccgtcgcccccaaagacaaaaccaaccaaccaagcaattccccgtccccggctccggaccagcgccgccgccgccagccagtccccggacacggacacctcgggcgcgccatcccgccgtggatcaccgcgtgaggaggggcgcaccggccggaccccggagggccagatggtgtccggcgccggagggggcgagtagcgcgattggcggccacgaacggatcggcggcggcgctgcgaggcggcggtcggggcgggggccaccatgtctgcggtagtgtgcggcaagaggtcctccatcttcggcgacgaccttgtagcttccccttcctcccctccgtccccttcccaccaccaccaccccgccaagcgggcccgctgctccccgtcccgccggagggaggttctgctccaccatcacctcctccccctcttccccgacatggatccccagttgcttgaaaaagctcttgaggcctctggagatgacttggactctgcaataaagagattaaacgagctgcgcctggagtcagctggggctatgctttctggcactttgtgcgaatctgagaacggcatgtcatcagctcttaagttatcggctgaaggtaccgccagtaatggtcatttggacgtagctactgaaaacccacctgcaactgataactctcaggcaagtcatcatagctctgaatgggttgagctatttgtcaaagagatgatgagctcctcagacatagatgatgcacgagctcgtgcatccagggctttggaggtgtttgaaaaatccatcatggatcgagttggagctgaagcagtgcagaatttgcatagggaaaatgtgatgctaaaggagcaactggcaataattctccgagagaatgctgttctgaagcggggcgttgcgatacagcatgaacgccaaaaagactttgacatgaggactcaggaagtcgacagcctgaaacagttggtattgcagtatcaggagcagctaaaaactcttgagataaataattatgcacttagagtgcatttgaagcaggctcagcagaacaattctatgcctggacggttcccacctgatgtcttctaatgccttatcagggctcagcagaataattatgtacctattaagatatttgaagtgagggagagggattcacttatttctactgtgataagtagactcaggaccttgagttcgactcgagcgtttgcatgtaccaaccatcatcggagataggctataaagcatgggcattaaggttcaaatatgttctgcacctggaagctggaagttgatatgaaatagtatgttcggttggctgcttgcagcctgcttgtaataatggctcttgcatctttgaagtgtaagaactgatatattgtatgtaagcttaagacacaaagaacaaaacaatgtttaaattgtttttttcacacatcaagctggagttactttttttt

SEQ ID NO: 14054 - DNA, 1494 bp, Sorghum bicolor
  Clone ID: SORBI-28MAY03-CLUS11535_1
atggagaggagtaatagcagctggttcgggtggtggaggaagaaggcgcgggaggggcagggcggcggccgccgccgtgaccgtgagaaggtggtggtggacgggacggagatccgggagctggtggaggaccgggaggcgttcgggatgctcgtggacagcaagttccggcagctcgacgccgacggtcacggcatgctctccgtgagcgagctgcgccccgccgtggaagacatcggcgccgcgctcgggctgcccgcggagggggcgtcgcccaacaccgaccatgtctacgcagaggtggtgagcgagctgactcatgggacatcccagggggaggtgagcaaggccgagttccaggaggcgctgtcagacatactcctcggcatggcggccgggctcaagagggaccccctcgtgatactgcgcatggacggcgaggacctcagggacttcgtcgccggcagcagatacgaacccacagctgctgccgttttctcgaaggtcggtttcggttctgaagaagacgcgtcgtctctgcgtcagtgcgtgttggccgctctccagaagctgaccgtcgaccacggagtgccaccggcttcagacacctgggtcgcgaagaacatcgtagagccggcgttgcagcagcttcctgcggatcagcttgagcagcagccggcctcccgggacgacttgttccagcaactgaagaagctgctgtgcgccatcgctgatcgactccaggagcagcctgtgatcgtcgcgcacaccgagaaccactatgacgggagtggcgtcaagaggctgctggccaacaaattcgagttggacaagctgctggattctgtttggaaaggtttaccagtagaacataagaacaaggcgtccaaggagtacctcatagctgcgcttgataagatggccgatgctgcaagcctgccatactatggtgctgttaaagaggtggatgctgtcgtggacgagtcgatcaaaacagcgggcgtcgaagaaggaaaagcagcagatgaagcagagttcaagaaatcactcacagatatccttagggccatcatgctgaggctgaacgacaaacccgttttcgtctctaccaacatcgtcgtgcacgagcctttgtctggctcatccaccctattgaagtgaaacgtagtacacgacggaaatatacgggaaaacacagggtcactactagtatttgagcagtgtctgtgttattgctttttgtctgatcacaggcactgccctgccgcagcatgctatgctagcttgctgcaagtttgcatcatgacaagatatcaagatgcgaagatgcaggccatctggtttgttaacccgattgacatataagtttggaataaggcgtccaagccatacataattacgtactatcatcaatggcaacctaatagctgttgtaaattttgttttggttggggatggcgcctatgggagctccgagaattagttactccggca

SEQ ID NO: 14055 - DNA, 305 bp, Sorghum bicolor
  Clone ID: LIB3478-030-P1-K1-F3
ttcggttctgaagaagacgcgtcgtctctgcgtcagtgcgtgttggccgctctccagaagctgaccgtcgcgcacaccgagaaccactatgacgggagtggcgtcaagaggctgctggccaacaaattcgagttggacaagctgctggattctgtttggaaaggtttaccagtagaacataagaacaaggcgtccaaggagtacctcatagctgcgcttgataagatggccgatgctgcaagcctgccatactatggtgcttgtaaagaggtggatgctgtcgtggacgagtcgatcaaaacagc

SEQ ID NO: 14056 - DNA, 2217 bp, Sorghum bicolor
  Clone ID: SORBI-28MAY03-CLUS7104_1
gcacgaggccttatcctcgattcgccgcaacatccgccgcgcggaggcggcaggcgctgcggcgcggcccgatccggcagcgccggcctcggctcccacccggagcacgaggggggaacgcggtgccgcctcgggggacccctcatccgggctgaaccgggtcggcggccgtattcctaacggccacggggacgaccaggcggccgctgcagctgagaaggctgagaaagcacggaagcgcagggtgaggagtgagctgcggcgccggctggcgggggagctggaccaggtccgcgtgctctccaagcggctgaaggaggctgccgaggccctggcgcagcgggaggcttctgagcccgcgcctttgcccttgatggtgctgccaacacaacagcaggtggtggaggctggttatgtgcagccacatttctcagctggtgatatggcagtgcccatgtctgctcaggttgcagctgccgttactcctggccgcacgctgctgcagcgcagaccactaaccgtatccgttattcataatgaagcctttgaaaaggagaaacggacgccaaaggccaatcaattgtaccaaaattcggagttcttgcttgccaaggataggattcctcccgcagattcacatgggcgcaagaaatccaagcaccacaagaagaagcataggtcactagaatctcgtggcgcagactttgatgctgagcggcggctctactctcatgcgttcaagaagtcctcatcacttctgagccgcctaatgaagcacaagtttgggtgggtgttcaacaagcctgttgatccagttgcacttggtttgcatgatacgcgtacgattatcaaacacccaatggatcttggcacgataaggggacggctcagccatgggcagtacaggaacccgaaggagttcgctgaggatgtccggctcactttccataatgcgatgacatataaccccaagggtcaggatgtgcatttcatggcggagcagttgtcaggaatctttgaggcacagtggcctgagattgaggctgaggttaactacctcgcatcatgtcctccattgccgaagaagtttccacctccaccaattgacctgcgcttcctagagaggtcagattcgatgagacaccacatggcattggacaccaattcaagaccgatcagtcatactcccacttatacccggactccatcaatgaagaaaccaagggcaaaggatccaaataagagggacatgacaatagatgagaagcgtaagcttagtgagaacctccagaatttgccgccagagaagcttgatgctgttgtgcaagtcattaagaacaagaacctatcagttatgcagcatgatgatgagattgaggttgaaattgatagcatggatgctgagacactttgggagcttgacaggtttgtggccaactacaagaagaacctgagcaagcaaaagagaaaggctgagcgagcgatgcttgccagacaagatgcagagttgcgtgcacagcaccagcaccagcaccagcaccctatacaaccaccgcaaccaatctcagccacccaagaacctgttggtgaaaaatctccaaagcaagctgcgaaagattcgctggcaggcaagcaaccgccaacgtctgcgccagaacaaaatgaggagaacagacagaatgcaagtagttcaagcaattcaagcagctccagcagtgactcaggatcatcttctagtgactcagacagtgatagctcctcttcagatggatctgatgctggcaattcatcttgagatataggttcagaagttttgtcgagtagacaataactgtctatttgacgtggcaatggcaccataagattgtacatgcttaccttgtctggcttaggaaacctcctgtatttttagtagcttttgtatgtggattcacccgccggaggcagtaacttgtaggtttgtggtgtacccgcctaataagactaggcttgttgctgacaccgttcatcgtacaccgcactgttgctaggagccctctggttggctcagtacacattagcggcagcttgaacatcgattctgtttagctgtatgcattgtttcttccttttgttaactgactgatgaaagcattgacaagccatataaccccccgttggtgttttagtttgccgccatctttctgtggagtaccagttaactgttgtggcttcatt

SEQ ID NO: 14057 - DNA, 986 bp, Sorghum bicolor
  unsure (1)..(986): unsure at all n locations
  Clone ID: SORBI-28MAY03-CLUS744_1
nnggccgggccgggggcgtagcctccttactcctacacagccggccgggccggagtcgtagctccttctcctacacagaaacgccgacgcctccagccaaaaaaccgtcaccacacacgagaccaaatcttttcctcccacccaacaccagctcgtcgagcgagcgagcgagtcgtcgcctcgccggccgaccggcggtatatacacaaggaagccaaggaaaacactcctccctcgcttccttccttccttctctagctaccatatatcccaaagctatagcttgcgacttggcaaccacttgtacaagttgggcgggctacacgagattcaagccgggatggtggcgccggtggtgatcgcgtcggcggggctgggcatgctggccggcgtggcgatggccaaccggtcccttgggggggacgggctcccagcggcgtccaggtgggacgcgcgcccgcgctgcgccacgtgcggcggctccggccgcgtcgagtgcatgtgcaaccgctggtccgacggcgactccggctgccggacctgcgcggggtccgggaggatgccctgccgcagctgcggcggatccggcacgggcaggccgctccccgcgcgtctcatcgtccagcaccagaagccgccgccgccgccgccggcccgccacaactgatgatggaatatgattgtcgcaggcgaggtgaaagtgcaacccatccgagaaatcagttaaacgtactgcgatatttatcatcctctagctagctagtttaagtatatatgtatgtatacgtccgatccattcgtgtggatgatatgcatatgttgtatactatgtaagtacatgtctcgtcttcttcaagactagttgtaattgagctgagcatacttggtgttgctgtggtttagttaatattttcaaatttcccaatcacacgaaggaagatgtaaaaacatagtggaaatggttatttttgggagatctattttaa

SEQ ID NO: 14058 - DNA, 1080 bp, Sorghum bicolor
  Clone ID: SORBI-28MAY03-CLUS7931_1
gctcgcggcccggcggccaacgcaattcgagtgcgcacacacacgagcagccgcaggcagccaggcacactcgcgcgaccatgtaccgggcggcggcggcggccatctcgaggtcctcctcagtgctgcggaggcagctcccgcggggcgcggacggggagccgccgcgtctgttggcgcgggggtatgcgtccacggcgaaggaggtgtccttcggcggtggtgccgtcgcccttctttatgccaccaaggagctcgacaaaattagcacatcaaacgaggatgaaaagattggagttcaaattatcaagaattctttgaaggctcccttgatgaccatagctgcaaatgctggcattgatggagctatagtcatagggaagctgattgaacaagaggacctcagtttgggctatgatgcagctaaaggggagtatgttgacatgatcaaggctggcatcatcgatcctgtgaaggtgatccgcactgcacttcaagatgctgcaagtgtttccctgctgatgacaaccacggaggctgctgtttctgagctcccggcaacgaaggccagaatagccagccgaatgccgcagatgagtggaatggatttttgaggaaaattaggcgatctgacttgtaagactagtactgtacttgggaagttggggacgaactttgtttccctagcggatacgtctacagagtttattggaaacgaggtgtgacaccgtgttgcaacttttgatagtgttcgatggacgatagtgatgtaacctggactgatagccccttccattttgtatgctctatttgatgcgtaataacttgctgccgtcgaagcagctgaattttactgtgctcttctacgagcccagctcatggattctctccttccagcattggaaatttctatcaagaaccgcaagcctcttctcattgttgctgaggatgttgatggagatgctctgtcaatgcttgtactgaacaagcatcgtgctggactcaaggtatgtgctgtcaaagctcctggatttggtgaaaatagaaggcacaatctggatgacatggctgtgatgactg

SEQ ID NO: 14059 - DNA, 911 bp, Sorghum bicolor
  Clone ID: SORBI-28MAY03-CLUS7738_1
gccggccgggccggggtggagccgtccctttcttcgccgaagccgagcgaaagaaaccccaagcccaaccccatctctctctctctctctctctcggcctcgcccaccccctcgatcgatcggccggtcggcgatgacgccgggaagctcggccgccggatccggcgtcgtcgttcctcggaacttcaggctcctagaagagcttgagcgtggagagaagggcattggagatggtacagtgagctatggaatggatgatgcagatgacatctacatgcgatcatggactggcactattattggcccacataatactgtccatgagggtcgcatctaccagctgaagttgttctgtgacaaggactaccctgagaagccaccatctgttcgatttcattcaagaataaacttgacatgtgttaatcatgaaactggagtggttgacccgaagaagtttagtgttctgggaaactggcagcgtgagtacacaatggaatacatcctaacccatctcaagaaagagatggcatccccacagaaccgcaagctagtacagcctccggaggggacattcttctaaagacgccagctactcatgtccttccatggtgactcaggaaacagcttccgcacctggtttctatatatcttatatatgtctagtttaatctcccagatatctgtgaaccaccgagatcgagtacaagcagacttggttcattacaatttgcacggtggttgctaaagatatgggatgaaacggttgctggtttggctgctattaaggttgtgtaatctgctgggcaatttcagcttcttaatgccattgttatgatgaatctttggccttttacaaaaatgcaaccttaacttggatcataagctgcatatctgcccatttttttgacccc

SEQ ID NO: 14060 - DNA, 1475 bp, Sorghum bicolor
  Clone ID: SORBI-28MAY03-CLUS7979_1
gcacgagcccggaacctgcatgcatacaggtacacaaacacaacacacacacatacacttcgttggtggttgttggatccgtgaccgtgagcatggcggtgctctgtagcagcagctgctgcagcagaccactactgcaagggatgctcctgcttgccgtcctcctccttgcttccatccaagctggtccggtcatggcggcgttggacgcgcaagaggtgcaagcctttggtgacatgttccataaggccttcgactacgggggcaaaaagttggcgacggaagtgagcaggcggccgggcatggagagattcggcaaaggcttgaagacggggttcaccgtcgaccgcagagcacatggaatgatggacaagcaccaaaacaccggcatgccgtacgtcgtcgacaccatcgccaccgccaccggtctcaggctcaaggtcgtcacggttgacatcaccgccacgcccgtcgcgaggaccggcttatgcggcaccggcacggcggtggcggccggtggtactggtacgcagatcatccggctgctcgggagcagtgagggtgaggccgttctcctcgccagaccctttgctgggacgctccagtactgcgccggacctcaaggggccgtgctgggactcggccggggcggcgagctgtccaggaacttgcgcacgttctcctacgtgacgagcacaggcaacacggtcgtctggttcccgcagccgcaggtagctggtactactggtgctagtagtattactctggttcccagcaagtaccccaacgacggccgctactacgtccggatgacgggaatacgggtcggcgaccagcagcctatcgtgccaacctcgacggcgttcaacctcggccgaccgccgccgccgccgttgtacctgtacctgagcaccacccagcccaacacctacatcgagagcaacctgtacgatcgcctcaggaacgccatcattcagcagatggggaacccgtgggccacgccgacgtcgtcctcccagctcaccgccggcaagctgtgctacgcggctgcggccgcgtcgtcgctcccgcgcatcgcaattctcctcgccaacaataacggcgacacgacgatggagctggggctaagcggcgcggcggcctggtacccagagcccaccacctccaggttctgcttgggaatcctgcctgctacgacggaagagcccgtcctaggcagcatgatccagagcggcaatatcatgaccatcgatctcatggccgccggtggccagggtacacttacgttcgaggcatatagataagctgtgtgtctactactacgcactgcatgccctttatttcgctgtggcatttcatgtcgttactacccctactctcttgtcatcaataaaataatgcgtgaaggacttgttcagttgtgtggttcagatgtacttgtattattattacaggggtgttttttttagctactg

SEQ ID NO: 14061 - DNA, 1133 bp, Sorghum bicolor
  Clone ID: SORBI-28MAY03-CLUS7914_1
gatctcatccgcgtctctgactcacctagctcacctgcagcaggtcattcagcacattgcaggtcatccaatccaacacaccgatcagcagcaatggcggcaggtctgcaggtgttcggacagccggcgtccaccgacgtcgcgagggtgctgacctgcctcttcgagaagaacctcgagttcgagctcatccgcaccgacaccttcaagaagtcgcacaagctcccggagttcatcaagctcagggatcctactggacaggtgactttcaagcacggtgacaaaacaatcgttgattccagggcgatttgccggtacctgtgcacgcagttcccggacgacgggtacaagaagctgtacgggacggggtcgctggagcgggcgtcgatagagcagtggctgcaggcggaggcccagagcttcgacgcgccgagctcggagctggtgttccagctggcgttcgcgccgcacctcaaggacgtgcgggtcgacgaggcccgcgtcgcggagaacgagaagaagctgcacaacatgctgagcgtctacgacgacatcctctccaagaacgagtacctcgccggcgacgacttcaccctggccgacctctcccacctccccaactcccactacatcgtcaactcctccgacaaggggaagaagctcttcaccgccaggaagcacgtcgcaaggtggtacgacaagatctccagccgcgactcgtggaagcaggtcatcaagatgcagagggagcaccccggcgccttcgagtgatcggccgcccgtcgtcgatcggcggccggcgtcgtggttcattaattctctctgcatgcatgcgccgcgcggcgtgtacgttcctcgccgccgccggccaccggcttcgtcgatcgtcaggcttcataccgtgatgtggttgtcgagttcgtcgtatcgtatacgtcctgtgggctaaaataacgtgaagcctgtctgcctgcctatacggtgtctcgtgtcttccttccgctgcatatatacgcagtgtctttttctgggtattgtatttttgtgatgtattcatcaactccttttgcaatattggtcaattcaataaaaatgtgtgtacgggcgtttttgctcgttcgcactacatttat

SEQ ID NO: 14062 - DNA, 730 bp, Sorghum bicolor
  Clone ID: SORBI-28MAY03-CLUS81929_1
gggaaggccagctgcggcttcatcagggggaacgacgacttctcccggaggctcgccgcgaactgctccgccggtcgcaccgggaagcagagcctggacgtcatcacgcccgacgccttcgacaacaggtacttcgtcgcgctgaggagcacccagggggtactgctctctgaccagggcctcgccggcgaccggcgcacggcccgcttcgtcaccgccttcgccagcaaccaggccgccttcttcaaccagttcgccaagtccatggtcaagctgggcagcatcaaggcagccgccgccggcgagatacgccgcaactgcttcaggcctaacggccgcgtcagcttcgacgacgtcagtgctctcactctcaccggtgatgatgccgccgccgtcgctagcagcgacgagggctttgcagcctctgcttaatgataagacatgcaggcatgcatggtcgtctggcatccatgtactacgttcttaattatttcatgctaagtttgctttccgtgagccatcagtatggtagaaggtagttgaatcgatggatggacgatatcggtactgtaataatgccagtgcagtgttagcactcggcaggtcgttgtagctatgtactccaatatgcatgcatacgtgttttaacgctagtagtttgatggatcatcgatcatgtgaatgcatgcccagccagaccagatgcatcatgcatgcatcacgttatgtt

SEQ ID NO: 14063 - DNA, 825 bp, Sorghum bicolor
  Clone ID: SORBI-28MAY03-CLUS8320_1
acgagagtattcacgttttgtattgccttacttggggcaaacttgcatcaacacatgttatgctggtttgaactaagccttgtaacccacaagccaagaaatgaccttcacaaatgtctagaggctaaagttgctcttcttcaaaattttacattattttttttttcacaaggttcataaatgagatgatagaaattggatgaggggaatggaagtacaattggcagttgtaacacatctgccggcaagtttattgtgcaccaaagatccagattccagtgcccggtttgattggccaaattaatccaccggcactggttccattgcttcagcctcctttctcaactcatcaaacagcgcagatgacaagtatcgctccccaaggcttggaagaacagtcacaatgagttttcctttgttttccggcttctttgctagttcaagagcagcaacagtgttcgctcctgatgatatcccaaccaaaagaccctccttgagtgccaattctcgagccatcttaacagcatcctcacctttcacctcaagaaccttttccattacatccatatccaaaatgtctggcttaaaccctactccatttccagtgatgaggtgaggtcctggctttccaccattcagaacatttgcttcagcaggttcaactccatatatctttgcattagggttcttctccttgaggtacttgccgactcccgtgacagtaccgccactcccgatgcccatgacaaaaatgtcaacctgtccaagtgtgtcctcccatatttctggacccgttgtctcataatgtaccttgacattagcagg

SEQ ID NO: 14064 - DNA, 1267 bp, Sorghum bicolor
  Clone ID: SORBI-28MAY03-CLUS2191_1
gcacgaggctgctttggtatggttatgatcgcaagaatggagtccattccctctgtccagctatatggtcaaaagcacgaggtggcagtgtgtgccctacgtttggaggaagtgatcctgggggtccggctgtggttctccattccccgaatgggcaactgactgtggtggctggcctcgcgtgctcaccccgcccttctcctccgtctgctggtgggttgcttcaagctcatggaaaatatcctggagaaacaagagtgagcttttcttgcaagaataagcgtggcacaaggttcgctcctatgtttcaatggcctgacaagtctgtttcattaggagttactcaacccttggcatggaaaagatctggtcttatggtgagacccagcatacaagtcagtgtgtgccctacgtttggaggaagtgatcctggggtacgtgcagaagttgtccattcattgaaagaggaattgaatgtgatgtgtggcctctcttgctcacggcatccatcagcttatactgctctctctattggacgatcaaagtggaatggtcaagtgggtagttctggagtggtaatcactttggaaacccctcttaataacattggaaggccgtccttatctgttcaactgaatggtggttttgagttgtgatccttccgagtcgtccactgaagctgtacataccagtgtatatattgccatcactaatattgttcgtgctactcagccaatcaaccttgaaaagtttgttgaagtgggctgaggcttgcaggttgtttttgttactgtagtctataggtctcaagtctcaactcaacaaatcaactgctattgtacccatgcgggcacagaagtaaacttttccccactcagagacttgcaatccttaaagagattgtggtacttgcagcagttgagctcatatttttagaagttcatgaaaggggagagccacgggctaatgttgctatagcctgcctccttgtgggagccacggggtcatgtaagatgttcatcaagctctcttttggtgcaagactgataatacctgtcgcaaactctgcaattgaacattgttaacaattgtcttgtgcggaccttattaacataatatctggccactgcttagttttgcatcgttggatgttgagacaaactagctggtgtaatttttggctgcaatcttgtattcctcgacatgtattgatccatgaatgaatgaatgaatggaagaccagcgatccctgaaatatatttgatcc

SEQ ID NO: 14065 - DNA, 411 bp, Sorghum bicolor
  Clone ID: LIB3481-004-Q6-K1-H1
ccgtccgacattgttggcacttttgccggtttctttgactccttgtctctctgttgtaacacccttgctcacggtgcgctgttggcagtgtgtgcccttcgtttggaggaagtgatcctggggtacgtgcagaagttgtccattcattgaaagaggaattgaatgtgatgtgtggcctctcttgctcacggcatccatcagcttatactgctctctctgtaagctctagttaacatttctcattggttctttctaggattatagtttagacgtaacataatctctacatggcagattggacgatcaaagtggaatggtcaagtgggtagttctggagtggtaatcactttggaaacccctcttaataacattggaaggccgtccttatctgttcaactgaatggtggtttt

SEQ ID NO: 14066 - DNA, 1547 bp, Sorghum bicolor
  Clone ID: SORBI-28MAY03-CLUS18685_1
tgtctagcgagcgcggcgatactttcctatcctgtagtcttccactgccgcaattcgccacatctcgccgtcggcggcgaggggcagggagacaggatcccctgtcgcgcggcgacgtagccctcctcctgctcgtgctgtccccgccaccctctgcttatcgtgcacctgggattagatctatttctggtatccgagagatcgagcgaaatcgatctagccaaggtgcggcggacgcggcttattctcaataattcttctgcgttgtttggaaagcagccatggacgagtggattcgccaagcggaggtgtgggtgcgccaagccgagagctggatccgccagcagcccccggagcagatctatgtcgcggccgcggtggttgccgtcacaatcctggtgcttatcgtagcatcttgtctgaaatcctctaaactaaacaccatagtgctatccgggcttagtggcagtggcaaaaccactcttttctaccagcttcgggacggatcatcacatcaaggaactgtgacttctatggaagaaaacagtgatacctttgtgctgcattcggagcaagaaaagaaaggcaaagtgaaacctgtgcatattgttgatgttcctggtcatgccaggctcaaacccaagcttgatgaagtcctgcctaaagctgctggggttgtttttgttgttgatgctcaagatttcttgtctagcatgcaagctgctgcagagtacctgtatgacattctgacaaaggcaactgtagtgaagaaaaaggttcctgtgcttatattctgcaacaagacagataaagttacagcccactcgaaggaattcatcaagaagcagttggagaaagaattgaacaagctccgggaatcaaggaccgccatatcctcagctgacatctctgatgaagtccagctcggggtccctggagaggctttcaacttcagccagtgccagaacaaggtggctgttgcggagggcgccggttccgctggtaatgttttggccgtggagcaattcatccgtgagcatgtgaaggcataggtggttgttattatcgttcccagggctgcaaatgtttcagttgattgatgaggcaagacgtgcattgcgtcaatgtggttacccttcatgcatatatacctccgttcaggtcctcggacattgctttccttagaggtgcagtcatattccgccgcactgcttcagctgacccttgttatagttatagaggcaggcattacatgttgcattgttgacgcctggcagtcatcggatatgaatagatcgatcctgttaaaagttgtctctgctggccatggacccatggttttgctgcataagttgtatatttcccagattttctcgacgtctcggttttaaactctttccgttatagttgcaacaagcaaaatgtcgatgcagctccacggtggagctggagcatcggtgttgtgaagcattgcctttgcacgtgttgttgcctagtcttgtttagaagtgcccttttatctcaaattagaagttattttaagaatt

SEQ ID NO: 14067 - DNA, 537 bp, Sorghum bicolor
  unsure (1)..(537): unsure at all n locations
  Clone ID: LIB5049-001-R1-XP1-G8
gccggccgggccgggaggacaaaacagagaacgagcgccctcctgcagtgccgctgcattctctcgcgagtccccaagcgaccgaccgactcccgccgccgcccgccgccgtcggccttctccaagcagaagcagccatggacgagtgggttcgccaagctgaggtgtgggtgcgccaagccgagagctggatccggcagcagcccccggagcagatctatatcgcggccgtggtggttgccctcacaatcctgctgcttatcctagcatcttgtctgaaatcctcaaagctaaatactatagtgctatccggacttagtggcagtggcaaaactactattttctaccagcttcgggatggatcatcacatcaaggaactgtgacttcaatggaagaaaacaatgacacatttgtactacattcggagcaagaaaggaaaggcaaagtaaaacctgtgcatgttgttgatgtccctggccattcaaggctcaagnccaagcttgatgaagtcctgcctaaagcagctggggttgttt

SEQ ID NO: 14068 - DNA, 394 bp, Sorghum bicolor
  Clone ID: LIB5052-009-A1-XP1-H5
gtgcggcgctcaggcggcgggttcgaattcatccgtgagatgtgaaggcataggtggttgttattatcgttcccagggctgcaaatgtttcagttgattgatgaggcaagacgtgcattgcgtcaatgtggttacccttcatgcatatatacctccgttcaggtcctcggacattgctttccttagaggtgcagtcatattccgccgcactgcttcagctgacccttgttatagttatagaggcaggcattacatgttgcattgttgacgcctggcagtcatcggatatgaatagatcgatcctgttaaaagttgtctctgctggccatggacccatggttttgctgcataaaaaaaaaaaaaaaaaagaaaaaaaaaaaaaaaaaggccccta

SEQ ID NO: 14069 - DNA, 1065 bp, Sorghum bicolor
  Clone ID: SORBI-28MAY03-CLUS228_1
accttcctttgttgttccgaccaaaggaaatggtgaagaacggtgagtttatctacaagtttgatcctacaaagaaagctcgttttggtattctcccacgctacgcaaaggatgaaaaagtcatcagatggtttgaactccctaattgcttcatattccataatgctaatgcttgggaagagggtgatgaagttgttctcattacctgccgccttgagaatccagatttggacaaggtgaatggacatcaaagtgacaagctcgaaaacttcgggaatgagctgtacgagatgagattcaacatgaaaacgggtgctgcttcacaaaagcaactgtctgtttctgctgtagattttcctcgtgttaatgagagctatactggcagaaagcagcggtttgtctactgcactatacttgatagcattgcgaaggtgactggcatcataaaatttgatctgcatgctgaaccggagagtggtaagaaagaacttgaagtgggaggaaatatacaaggcatatatgacctgggacctggtagattcggttcagaggcgatttttgttcccaagcagccaggtgtatctggagaagaagatgatggctatttgatattctttgtgcacgacgaaaatacagggaaatctgaagtaaatgttatagatgcgaagacaatgtctgctgatccagttgcagtggttgagcttcctaatagggttccttatggattccatgccttctttgtaactgaggaccaactggctcagcaagcggaggggcagtgaagatacggatacatcacctgcagactctgcacacgtgggtacacgttgaaaaatattgtaggatctaaactcagaaacggcaatgtatatgtatttgtctggtaaatacagtggagagccaagactacacattaaactctcaaaaatcaatgggttgatataaagaccccttcacatatgtatgtatatatatgtcaggtttattatagtcctgatcgatcacaaattacttagtctgtctgtggttagtgggctaagtgtttttttatagaataagtgggct

SEQ ID NO: 14070 - DNA, 860 bp, Sorghum bicolor
  Clone ID: SORBI-28MAY03-CLUS823_1
gccggccggtgcacggactctcaattagtagcttcattcattcatcacccaccccctcccctcactcatcatctccagcacacacacacacatccaagaaagaagaagaggaggatccatggagaagtgcaggtcggtgccgcacgagcactcgtcggcgtactacgggtgcggcggcgggtacgactacgaggacgtcggcggcggtcccgggcaggcgggcaagtcgtacagcttcaacgggccgagcggccgcgacgacccggaggcgaagcggcggcgccgggtggcggcgtacaacgtgttcgccacgcagggccggatcaagaccaccgtccgcagcagcgtcaagtggctcaagtccaagttctccgacatccgctacggtggcctctgaacatgaacactcaacctgctacctgcatgcaatccatcctactcctactccaccacatatatatgcatgatatatatacatgcatgagtatatcatgatgctcatatgaaattacatatgcacgaagtatttatatgtgtgctagcaagacgaacggccaagctaaatagctgctgcatatatatatggaggcaatactgtgtacatgctatgtttagatgcatgtgtgcgtgtgcatggttggtctgtggtcactgtgtgcttgcttactggatcgttgctttccagttcagcctgcttttactctgtcttgcttttactctgtcaggaaagaaactctgcttggttctactcttcttgaatcatcatcagtcctcccttcatcagtcaacctgcttaaacagtcgttgaaaaaaaaaaaaaaaggcccttgctttgatctgattgcttttcagtttccacc

SEQ ID NO: 14071 - DNA, 473 bp, Sorghum bicolor
  Clone ID: LIB3478-056-Q6-K1-E12
caaatcctactgttgatggtattcgttctgttatccagttcatcagcacaagcaagggagggcgacgtgtactgttgcataatatgagagaagaaccagttatctacataaatggaaaaccatttgtgctacgtgaagtggaaagaccttgcaagaatatgctcgagtacacggggattgatcgtgctagggtggaacgcatggaggctcggctgaaggaggacattttacgcgaggcagaacgatatggtggagcaataatggttattcatgaaactgacaatggagagatcttcgacatccgctacggaggcctctgaacatgaacactcaacctgctacctgcatgcaatccatcctacttctactccaccacatatatatgcatgatatatatacatgcatgagtatatcatgatgctcatatgaaattacatatgcacgcacaagttatatgtgtgctagcaaggcca

SEQ ID NO: 14072 - DNA, 1506 bp, Sorghum bicolor
  Clone ID: SORBI-28MAY03-CLUS9551_1
cccccgcgcccccctcctcggttcctcccgtccctcccgtgactcgcgactggaggggggactcgcgactcgcgagcacgactgcgcgaggaggagccgcgccgccgccgcggtccgccagccctgcgcccctgccctccactcccgcacgcggcacgcgcacaggcgcacagcttctcgcctcgcaccctcgccttctcccgcagtccgtgcgcggccagccgccctcgcgcgtccgctcgctcgagtgctcgacccccgacagcggacggccggcactcgactcgaactcgagcactcgggcctcggcagtctgccaggcgccagcgggcagcggccacggcccacggccagtccgggcgtgagggcgtcccgcgtccgactccggctgaatttctcaattaggggtaagcagttgtgatcctgccctcttggtcagatgccgggttactatgacatcgatgacatcctcatggaggatgagcctatttcagttgttttccaagtaactgcaaatggcgttggcctgctagatcccggtgctgaaagtaactgtgtagagaagggtgccaaggtggacctcccattttggcttgcgcatgggctgctgtctctggaacaagctgtgtcaataaacccacctccatgcttcacacagaaaactcggaaggagatccaagctgatgcagcctgtgtggatttgagggttcgttgcccgtacttttatgagctaggattcaagattgttcctttggtgagtgacaagagcattggcctgttcttgcgatatgcattcaccagtaggtacaaagaggttctaagcaagtcccacagttcttccatgatgacagttcccaagtttgttccacggcttacaaaagaagaaactcgagtgtttgaatctgctagagaatcgatggctggtttcaagaaatggagagcaggtggggtgagactgcaaaaggcttccattcttggccggaagaggaagacaaagctgcctgatggaccgccttgaatgagttttaagttctccatggaagagagtggttgaatagttgaggtgatgtgtgctgctttgatttgctagaactgtgagcaaagagaaatgtgaatggcagattaaatctggatggactataatctgatgtgcattgtgcacttctgtatagtctgacagcagctctgatcggtccatgctttgtaaggagaatgaacacttaaaccatgatgtcctgtttggagcaagtgtcatgattttcagcagggtatctagcagactttacaattgcgactctgcagaagagttcggggcaatttcacatgttctcacagggagaacacgggattgggatgtaatgaaataatttagagtaatggtaacgagattttcccttgccccgttgttttgcctgcaaatcatagatatagagttcactgttgttttgtcctgtaaagaaatttgaccataaagtgtgatttttttttccccaccacttaatacca

SEQ ID NO: 14073 - DNA, 1223 bp, Sorghum bicolor
  Clone ID: SORBI-28MAY03-CLUS9620_1
ccacgaggcagacacggccggccggaaaacctcctcgtgaaacagaggagaacaatccccaacacccccggaaaggaaacccatcacaccaaatccccaaccccaaacccccaatccaccctcatccactccgggcggccatggcctgctccttcgccgccgccaccaccgtctcttccgcccccaccccggcctctaggcccctcgccgctgccccgcagtccgtctccgtcgcccgctccgcggtcgccaccgccgccaggccgctccgcctcgccgcctccagatccgcgcgggccaccagactcgtcgcccgcgccggcggcgtcgatgacttgccgctggtcgggaacaaggctccagacttcgaggccgaggctgtgttcgaccaggagttcatcaacgtgaagctctctgattacattgggaagaagtacgtcattctgttcttctaccccttggatttcaccttcgtctgcccgaccgagattactgccttcagtgatagatacgaggaattcgagaagttgaacactgaggttcttggcgtctccattgacagtgtgttctcccaccttgcatgggtgcagacagacaggaagtctggtgggcttggcgatcttaaatacccacttatttctgatgtcaccaaatcaatttcaaaggcctttggtgttctgatccctagccagggtattgctctgagaggactgttcatcattgacaaggagggagtgattcagcactctaccattaacaaccttgccattggtcgtagtgtggatgagaccatgaggacccttcaggcattgcagtacgtccaggagaacccagacgaggtgtgcccggccggctggaagccaggggagaagtcgatgaagcccgaccccaagggaagcaaagagtacttcgcggccatctagactccccgtcattgagaagctttgctactctatcatggtgcctgttaagtgccccagcggtaggtccttgtggagttttgcggagctcgcgttttgacatgcctttgtgccttgaaccgagtgtgctagcccttgtgctgttgtgcatcccgattgagtgctgttctttgccacttcgtttaatttttcacctgacgaataaggttcatttggcacgtgattgagagttcacgcttctggtgtagtttgctgggcttctgtttgtagcattgtctggtaagcttcgcgtcgatgctgata

SEQ ID NO: 14074 - DNA, 804 bp, Sorghum bicolor
  unsure (1)..(804): unsure at all n locations
  Clone ID: SORBI-28MAY03-CLUS933_1
ccacgcgtccgcgctcacccttttggtacgactctgctggccgggtcttgcctccctttcctccagtttcctactttcctctgctccccgcagccgcacggcgaaaaccctagcaagcaaaccaccgtccaccggaggagcggcgcttgcgcgggcggagccatggcggacgaagattacaacgacgtcaacatgggctacgaggacgagcccgaaccacctgagattgaggaaggggatgaagaagagcttgagaacaacgaagatgcccctgatgaaatcataggtggagagggtgaagagaaagagcaggaaaagaccaagcgcgagcgcaaaacatcgaaatacatgacgaagtatgaacgtgcgcgcatcttgggtactcgagccttgcagataagcatgaatgctccagtcatggttgagcttgagggagaaactgaccctcttgagattgcgatgaaggagctgagagcacgcaagatacccttcacgatcagacggtacctacctgatggaagctatgaagactggggagtagacgagctcattgtggaggactcctggaaacgccaggttggtggagactgaagatgctgatctacttggcatttaaacgatatgtggtgcagcaggactttcctgtagttacaagtctttgttgcctctatgagtggatgctgtagtcaatgaaccaagatgaagtaatgctatgttaccttaacgtctgtggttgtcttgaactctgagaccgtaatgttagcatggttggtggttgcattatgcttgtttgtttcaatttcn

SEQ ID NO: 14075 - DNA, 544 bp, Sorghum bicolor
  Clone ID: LIB5051-010-A1-XP1-E2
gccggccgggttgggattacaacgacgtcaacatgcgctacgaggacgagcccgaaccacctgagattgaggaaggggatgaagaagagcttgagaacaacgaacatgcccctgatgaaatcataggcggagagggtgaacagaaagagcaggaaaagaccaagcgcgagcgcaaaacatcgaaatacatgacgaacatgaatgctccagtcatggttgagcttgagggagaaactgaccctcttgacattgcgatgaaggagctgagagcacgcaagatacccttcacgatcacacggcacctacctgatggaagctatgaagactggggagtagacgagctcattgtgtacgactcctggaaacgccagactggtgaatactgaacatgctgatctacttggcatttaaacgatatgtggcgcagcaggactttcctgtagctacaagttctttgctgcctctatgagtgcatgctgcagtcaatgaaccaagatgaagtaatgctatgttaccctaaaaaaaaaaaaaaaaaaagccccta

SEQ ID NO: 14076 - DNA, 929 bp, Sorghum bicolor
  Clone ID: SORBI-28MAY03-CLUS8736_1
ccgggatcgccccaaccggcaaccgccccttgccgactccgacgggaagcccgttgccgagtgcgcgacccagtcctcccctccccttcctccttctataaatcccgttcctcccaggcagggccgctctgcagcgatccaatccagcctcgccgcctcaccccagcattcccttccacctccacctcgccggaatcccgaatccacctcaacctcccatgggttcgcaggccatcgaggcgcaccgcgcgggcgcggaggtgtacaccggcgcggcgctatgcgccgagaagtcgacggagctactgtcagaggtgcacctcccgctaggcctgctgccgctggcggacatggaggaggtgggctacaaccgcgccacgggcttcgtgtggctgcgccagaagaaggcgctcacgcacacgttccggcagatcggccgccaggtgtcgtacgccgccgaggtcaccgccttcgtcgaggaccggaggatgaaacgcatgacgggcgtcaagaccaaggagctcctcatctgggtcaccctctccgacatgttcctcgacaaggacgaccagtccaagatcaccttcaagacgcccactggactcggtaggaccttccccgtctccgccttcgccaaggaaggtgacgccgcggccaagcccaaggacgcctccgccgccgccaacggtaacaaggaggccgtcgccgccggtaaggctgctgccagcaagtgaggtggcggcggcgtccgaactccggagcttttacctgtggttgtactgtagtagccgtaattgctaatacctgttctgtctcctgaataatgatgttgtacccctgctacctgcttgaatttactacactatgttttttatgaatggaaacgagtatccatccatccttgaaaaaaaaaaaaaaaaaaggcccct

SEQ ID NO: 14077 - DNA, 1736 bp, Sorghum bicolor
  Clone ID: SORBI-28MAY03-CLUS11168_1
gctcgggctgatgtttattcagctgctgcagatgaagtgggcaaaatatacctaatagcagatgagaacgtccaaggagcagtcttcgatttgcctgaggaaatttccaaggacctgcttgctatggagctccccccaggaaacaccttaatgaaaatatcttggctgcctgcgccgctacgtgttgcccctgcctccggtagctttggtccttcgtcctgcgcccgcgggtcctgctgcgggcgctccacctgctgtcctgttgtgcccccgcaccctgttacgggctggcaaccccctccggccggttgctgcttgcttggtggggccgtctcgcccgccctccaggggtgggctgccggactcctctgctgacctcctcagggcttccttgcgcggggtcctcccacacgcgccccactcctctcttggggcatatgctgtattatttcttctccttttgtgttcttgattgaggatctcaatagaactgtaaccacacgaactgtgtacagttgctgctgctacaccgttgcgacagagacgcaatcacagtctgctgcaactaactagagaacaaggatatgcacgaggcttcttttctcctagatcagttactggttttctgtctgatgtttattcagctgctgcagatgaagttggcaaaatatacctaatagcagatgagaacgtccaaggagcagtcttcgatttgcctgaggaaatttccaaggacctgcttgctatggagctccccccaggaaacaccttaatgaaaatatcaaagctgcctgcgttgcaagatgatggtcctgccactgatagctatggtcgtttttccaacgaccgaggttccaggaacaggcgttccaggggtggaggtgctgcaagaggccggggtggttgggacactgatggtgaggatcgttccaggggtggaggcgctgcaagaggccggggtggttgggacactgacagtgaggatcgattccgccgtggtggcaggagctttaggtctgacaacgatagttggtcagatgatgactggtcaagcggtgggagaaaatcaaaccgttcctcgtcctttggtagccgctcatcatcttatggcagccgtggctcaccatccttcggtggtcgctcatcatccttcggtggtagggagagtaacagaagcttcagtggcgcttgtttcaactgcggtgaatccggtcaccgtgcatcagactgcccaaacaagtagatggtagagatggcgcattcttccctgccgcacagggtcaccccttttgatgatcctgatcggcttccaacaagacggctggagcatcaggacgcacgcagagcaaaaaaatccaagccccactccacctgctgatcagtatagccagcggacgttattactggctggcaacccccaccgtgcggtagctacattttttgtgtggccgtctcgtcggaacagaagattttggcatgctgactacagttattacgtccagaggagttccttgagcttattcatgtcacacgggctctactctactctataggaatatgctgtattatttcttctccttttgtgttcttgattgaggatctcaatagaactgtaaccacacgaactgtgtacagttgctgctgctacaccgttgcgacagagacgcaatcacagtctgcattatcttgcttcagtgtgaacttgcataggttagctcccgttgcttcttttgaca

SEQ ID NO: 14078 - DNA, 1905 bp, Sorghum bicolor
  Clone ID: SORBI-28MAY03-CLUS1178_1
gcacgaggccggccagagcctcgttccactcactactccgtgctcccccacgcgctcgcacccgagcccccgatccaccaccgcggccgcgatgagcaccgcctccggcgacggcgcggacgccggcggcgacggggcctcctctgcagcggccggcgcgtcggcgcccgcggggaggcggatcccgcccgcctcgtccatgccgtgggtccgcaacctccgccgcttcgtcggcacgggcgccggcctcggatccgaggccctcatggaactggagactaaaaggatattgcttgagattttcaaggagcggcagcggaagagtgccgaagctggttccatcccaagtttttacaagaagaaacctgaagaaggatccattagctctagagttcagaggttggccaagtacaggtttctaaagaaacaatcagagcttctgctgaatgctgatgatcttgatgccatgtgggtttgtcttagagaaaattgtgttattgatgatgctactggtgctgaaaagatgaattatgaagatttctgccatattgccacagtctgcacggagcagattggtcagaaatgcaaacgtttcttcagcccttcaaactttatgaagtttgagaaggatgattctgggaggattgctatcctaccattttatctttatgtcatgcgaacagtttctcttactcaagcaagaattgatatgagtgagcttgatgaggattctgatggtttccttcagcctcatgaaatggaagcatatattagaggactcatccccaatttggcacaattgcgtgacatgcccactgcatttgtccagatgtactgccgtatagctgcacgcaagttctttttcttctgtgatccacacagacgggggaaagcatgtataaagaaagtgttgctgagcaattgtcttcaagagctaatggaactacatcaggagagcgaggaagaggtaaccgataccgagcaggcagaaaattggttttccttaacttcagctcagcgcatatgtgacatgtttcttgcactagataaggatactaatggtacactgagcaaacaagagctcaaggaatatgcagatggcacattgactgagattttcattgaaagagtttttgatgagcatgtccgccggagcaaagttggaggtggaaacagtcgtgagatggactttgaaagctttcttgattttgttttggctctagaaaacaaagatacccctgaaggcctgacatatttatttagatgccttgatcttaatggaagggggttccttacaactgcagatatccatactttatttagagacgtacaccagaaatggattgagggcgggaactatgagctttgcatcgaagatgtgagggatgaaatctgggacatggtgaagcccgcagatcctctcaggatctcgctgccagatcttctttcttgcaagcaaggcgggactatcgccagcatgcttatagatgtgcgtggcttctgggcccacgacaacagggagaaccttctccaggaagaggaagagcaagtggaagaggcatgagttctgttctccagctgtcaagtaaccgtatccggtgcctcaaagtcgcaacatcctacgaattgcctgtactgtggtatcagtcactgtaacttagctagcgtattagatccgtcgccacctcctgtttcctggagcttgttgtaagtgtgccatagtggtcttttgaacttgttgaggctagcgtggtttggccatgttgacatctgaacaatacagcctcggcagcctgtatgtacatctcgattgcaccaagcgcgcaatcctgactacggcattatgcctgtaagcctatatgtaatatacattgtgttcatttcgtgcatggcttgtggatcgtt

SEQ ID NO: 14079 - DNA, 1796 bp, Sorghum bicolor
  unsure (1)..(1796): unsure at all n locations
  Clone ID: SORBI-28MAY03-CLUS11236_1
gacctgcaaaatgaagcctttggtgctccgcatgctacatcttagcacttttattacatgcatctaccgaagtgccaacatcgtatcatatcatacaaacaaaaaaaactcattatgtaaaaaagcattttattacaggcatacatctcgataatttaggaaaccatacgacaacataacaaactccctcagctgatcaaaacatatcagcgatctacctcaaaagtaagttctattcttaggtacatcctggagggtgaaatatggtaaaacatagcacagggctatacatcctgcattctgcttgtttcatcttcacaagtagaaactcgatcatgtagcaagagtgaaggacatatcgacagaaacacatcaacagagacccaaggcatcctcaagttccttctcatcggtgcagttgtaacccaacataattgctcgcgcgtagcgtccagatcccatgaatggctctgcttcatccactacaccagcttgttgcagatcaaccctattatcatcagcttcccattcatcatcaggacacagccacctctcaaagcagtggccagatattgtacaaagaagcagcccactagattggtccaagacaaattcacgacaagcgtcatcacaaacatggacacgaccagtcttctcacaaatgtaagcatcgccaatctgggtgtacgagcatgtatttccagaactagcgggccccgtgtcagcttcctctgtaagccccccgctgctcttccgccggggcacttgtgcagcttctgtcttacccagcataacctggtcgtcgttgacttctgacgcctcggcagtgtgcctccggcgtgcggcccgcgccggtctaccgcaccccttgaacgccgtcggcgcactcctcacggatgcaaccgttgcctccctttcgctcggtatgctcaggtgcggccaggcgctcgccccctttttggctttcgctgccagtccccacctcatgcagtacaagcggcgccagagggtctcatcggacgcagcagcgttcatgaagcggcagaccagagcgcaggagatgaggtcctcggaggagaggaacttgaagatctgcaggaacagctcaggggggatgttgctgaacacgcccgcgtcgatctgaggcgccacggccttccctttgccctgccccgccgggtcctccctcctcgccctcttggtctgctccccctcactgccgctgccgctgcagccatgcccgtccgatcccgagccctgcttccgcttattcttcgcggcaccaccgtcctcctcctgcttccgctgctcctgatcaataggatcctcgtcgttggatccggagaggatctccgactcgaggaagctggcgaggccgtcgacgtcgtcctcctcttcctcgtcgcctccgctgcgtggttctcctccttcacctggatcctccggcaccaaaggcccgtcgtcgggaaaatcgtcgtcctccaggcctgcctccttgtctccctgcacgtcggccatcctcctccaccaccaccgacgccgccgacagattcttgcgagttctttcatgaccctttcaaggggcggagtgaagaaggtaaagtgcgtaaggttctaaaggttgagccaacaccagatggcaatggtcgctttttcaacctcagtgtccagaaccgacttatcaatgttgatgagagcatttacatccctataaccaagggagagtttgctgtcattgtatcaactntcaattacatcataccacaccctatgggctggagcacatttgcaagttc

SEQ ID NO: 14080 - DNA, 1043 bp, Sorghum bicolor
  Clone ID: SORBI-28MAY03-CLUS3439_1
caacaatagattggatctatccggctgcactttagaatatttttagtatttttttttgataaataagaaaaggtgcacgatctcgacgaattacttctgaataacttcagaaatcatatggaagaaccatagcatttcgagattcattggtaaatttactttgattctctatagaccaataatgtgagaccattaacacggttaaagctaaactgcttgaagtccgggcaaaaaggggtactctttctacaactacattagtattagtattagtctcgaaatgctttaaacgggaaatagctagtgtagaatttatctgatatagaacactcatatcgataaaatagtttgaactatttactagaagggcacgcagtcctttttccaatgccaaatcgacgacctatgtataaaaaaaaagagaaattttttggatttgaagaaaaaataaaaggaattctatcaatttttattttccatttatttagtttgtttttcttaatgaaattgaaattattaactaacagagcaaacacaaataaagaaacaactttgctgaccatgatagatttttatctagttggaagagtcctcttaatattcatctagtcttatataagtttgggtatatagaaatacaaacagaaaagagaggatagaggataggctcattacataaaaaaaagatatggaaatagccataatacagtcctatctagaagaggagggcgcgggagagccgtatccctcgcttgcgtcttgtttgctcccgggccagtccctgggagttgcgggcttaataccgagattttcgcctctcatctaatgattctttcggtagtcgatggcggagggtcttttgttcggttcgggattcggaagaattgcgtagagggacccttgaacaactcgaaaaagctcgtattcgattacggaaggtcggcctagaggcacccgtgtaccgctcgaatgggctcgctgtcgttgaccgagagtcggactagttgctgatggctaccgcttgtagggtggctctgaaatag

SEQ ID NO: 14081 - DNA, 808 bp, Sorghum bicolor
  Clone ID: SORBI-28MAY03-CLUS3684_1
gcacgaggatcaagagacgacacaaacacccacagccgccgcgccttccagtactcgaggaagaggaacaccagcagcgccatggccacatcgaccgccgccgtgctgtccccgccgtccgtggccgggctccgcctggcgccgtccccccgccgggcggcgcgcgtggcgttccgcgcggcgccggcgcggcggtccgtggcggcgcgcgcggagctgagcgcgtcgctggtgatcagcctgagcacgggcgtgtcgctgttcctgggccgcttcgtcttcttcaacttccagcgggagaacgtggcgaagcaggtgcccgcgcagaacggcaagacgcacttcgacgccggcgacgagcgcgccaaggagttcgcggccctgctcaagtccaacgaccccgtgggcttcaacctcgtcgacgtcctcgcctggggctcgctcggccacatcgtcgcctactacatcctcgccacctccagcaacggatacgaccccaacttcttctgagcgccggctggccgtgttcttgagcttgtattctactccgtgtgtgtgtctggctctgcgccatgcatgtatctgatgctcaaagattggttaatttggacaagtagtgtaactgcgcgtgtatagtgccgcatgaatttgatcttcctctgaatttctctgtcttcttcagttactgtccctgtttcagtatgtcatacgcaaagccaaagccaacctatgttgtgcttgtgctagttcatgacttgcgaacaacacatacatcagcagatcaaatgtcagatatctacagtataat

SEQ ID NO: 14082 - DNA, 958 bp, Sorghum bicolor
  Clone ID: SORBI-28MAY03-CLUS3424_1
ggccgaggccccctgcggcgctacgcctgcccgccaccccgcccgatacttgagaacggccaacctgcgctactgggagtggagagatggccagagtcgcggtgtacccaccttacggatctgagatgaccgggaaacatctagcttcgctgtcggatggcgccgtacggtcctcccccgtcacactacccccgcccgcgagcgcgcgggcctatagatgctctccaccgctgtaccaatacccccgacagccccccccgggcccagaatccctccctggccctctccatcgccctggagccgcctccatggactacgggcggcaatttgatgttccccaggggtcttattgctgagacggtcactcagagacattgcggtacagactacgctccggaggaatctgatcctcagtgggttgcttccgagtttgtggatccatctggttttgctgagttgtcggacttcccttccggccaaggtgctgacttagtctgctaatggaggtcatgtcggtgggcgcgacatgatttatccacctcttctaccttagaagcttcacctaagatgcttccgctactctatacaccttttggaaatttagttaagtttatacttcatcatatgttgtaaattaagttataaatcttccgcactctgatgtaagttatttttgtaacaaatgttgtaatgttgtggtaactccatgttgatcctgtacgagttaaaatgtggatgattcggggtcctccgagggcacccgacagacttcttgagtcatttggaactcgtgcacgctgatcagaagtctttgagacaatgatgggtgcatgtgggccacttaattcaggaggttctgccacagccacctcactacctctgaatccgcagctaatatatgtaccagtcattcagtcactacgtctgaatcaacagctaatacatgtatcagtcactc

SEQ ID NO: 14083 - DNA, 370 bp, Sorghum bicolor
  Clone ID: LIB3481-023-P1-K1-A12
cgtccgagccccgttgctctcttcctctgctccgcagcatccttgagcatcgtctaagccagctaacactctcttccctcgtcggactcggccatgagccggtttcccgtcacagagctccgccatggccgccatgggagcctgcgcacatggccaggaggccacagaccttctccggccaagccgctgacaccagcgcgagcgcgcgagcctcaggatgctccccaacgctttccctcgctgccaacaagcgtccaccggccggaaatcaggttttctccgacatcctctgctctggaatcgcgaccagggacttcgcgcgacaatttgaagttctccaggggtctaattgcacagactgtgactcagt

SEQ ID NO: 14084 - DNA, 1081 bp, Sorghum bicolor
  Clone ID: SORBI-28MAY03-CLUS1256_1
acacaacacacccttgcccgaggtcccgccggggcgcagctcacacaaacacaccctcgcaccacgcccagctccggcgagatcttccggcggccggcgacatgagccgcggcacgggcgcggggtatgaccgccacatcaccatcttctcccccgagggacgcctgtaccaagtcgagtacgcgttcaaggcggtgaagtcggcgggcgtcacgtcgatcggcgtccgcggcgcggactccgtctgcgtcgtcacccagaagaaagtgccggataagttgctggatcagacgagcgtgacacacctgttcccgatcaccaagtttgtaggattgcttgccactggccttacagctgatgcaaggtcattggtttcccaagcaaggaacgaagcagctgagtttcgttttaaatggggctacgagatgccagttgatgtgttagcaaaatggattgctgacaaagctcaagtttacacgcagcatgcatacatgagaccccttggagtagttgctatggtcttgggctacgacgaagagaaaaatgcccagctattcaaatgcgaccctgctggtcacttctttggacataaggcaactagtgccgggctcaaggagcaggaagcaataaattttctggagaagaaaatgaaggatgatcctaaattcacctatgacgaaactgttcagattgcaatatctgcattgcaatcagttctccaggaagatttcaaggccactgagatcgaggttggtgttgtgagaaaagaagaccgtgttttcagagctctcacaacagaggagatcgatcagcacctgacggcaattagtgaacgggactgaggtcatatgttcatgtcagcgctccacacactgggccgtgccattgtgcttcggcactctcatttagtttcatagtcatcaaaggaactgagtgtaccatttcatgtctaacactgaaaacaagccccccctcgatgtactcgtttcatatctttctgtggttgattgaatttggtacgttttggtttttgttgccaactatgtttgaatggctgagcgattgtagttcatgtcgctgt

SEQ ID NO: 14085 - DNA, 1205 bp, Sorghum bicolor
  Clone ID: SORBI-28MAY03-CLUS13586_1
gcacgaggcctcgaggcagcggtgttcagcgacggatccttctgctacgtgcccaaggacacggtctgccccatggaaatctcaacctacttcaggatcaacgacaaggagaccgggcagttcgagaggactctgattgtggccgatgagagaagcacggttagctatttggaaggctgcactgcaccggcatacgactcgaatcagctccatgctgcagttgtggagcttgtgtgtgaggagggggcagagattaagtactccacggtgcagaattggtactctggtgatgaggagggcaaaggaggcatttataacttcgtgacaaagaggggacggtgcaaagggcggggttcaaagatctcatggacacaggttgagacaggatctgctattacatggaagtacccaagcgtcgagctagtcggagatgacagtgttggagagttctactcggttgcacttacaaaggattgccagcaagcagacacagggacgaaaatgatccacaaggggaagaattcacgcagccggattatatccaagggcatctctgcagggaagtcaaggaattgctaccgtggcttggtcctgatgaactctagtgcggagaatgcttataattcttcacagtgtgactcattgctgattggggataatgcggctgcgaacacttatcccaccattcaggtgggttgcactagtggccgtgttgagcatgaggcaagcacttccaaaatcggagaggatcagctattttatttccagcaaagaggggtagatcatgaaaaggctgttgccgccatgattggtggattctgcagatctgttttcgagcaccttccctatgaattcgcacaggaggtggacgcactcatgaacctgaaacttgagggatcagttggctaatttgttggctcagcgactgcgtgtaatactccatgaacatgacaaccagttacctagaaaatccatgtgtacagcagtacgagaagaataaagtgcacgatagatatacatttcctggcttgttgtatactgaatgttgatggtgactatagcaattggcaacgaagatagcagtagtgcctgcttgtcttctgtttgcccagtttttgctactgctgtaagcgagctcacatggctcgcccatacaagaatggaaatcaatgtgttggctttatagaactatttctgtttgtgtt

SEQ ID NO: 14086 - DNA, 2700 bp, Sorghum bicolor
  Clone ID: SORBI-28MAY03-CLUS13066_1
gtacgaggcagcgttctggtctcaatcaaatccctaatcgaagatttaccttgtggtggtcaccaaccatcaatcgtgcaaatgtgtatgttggtttccaggtccagctagatcttacggggatattcatgcatgggaaaatcccgacattgaagatttctctgatccagatcttccgcgcacatctgtggcaaaagatccatgaaagtgttgttatggatctttgccaagttttagaccaggagttggatgcacttgagattgagactgtgcagaaggagacaatacatcccaggaagagttacaagatgaacagctcctgtgcagatatccttctgtttgctgcacacagatggacgatgtccaaaccaagcttagtttctgagtcgaaggatctctttgatcagaaagcaagtaataagtactggattgatgtgcaactgcgttggggagactatgattcacatgacatagaacgttatacaagagccaagttcatggattacacaacagacaatatgtccatatacccatcgccaactggtgtgatgattggaatcgatctagcttataatttgcactctgcttttggcaactggtttcccggatcaaagccactacttcagcaggcaatgaacaagatcatgaagtcaaatcctgctctgtatgtcctgagggagagaataaggaagggtctgcagttgtactcttctgaacccactgaaccatacctgtcttcacagaactatggagagatattcagcaatcagatcatatggtttgtggatgatacaaatgtgtatcgagtcactattcacaaaacatttgagggtaacttgaccaccaaaccaatcaatggtgctattttcattttcaatccaagaacgggtcaactttttcttaaggttatccacacaagtgtatgggcggggcaaaaacgtcttgggcagctggccaagtggaaaacagctgaggaggttgctgcattagttcgatctcttcctgtcgaagagcagccaaagcaaagggttgtgacaaggaagggcatgttggatcccttggaggtccatctacttgacggccctaacattgttatcaagggcagcgagctgcagctccctttccaggcttgcttgaagattgagaagtttggtgatcttatactgaaggcaactgaaccacagatggttctttataatatatatgatgattggttgaaaagtatctcatcatacacagcattctctcgcattgtgcttattctacgtgcacttcatgtgaataatgagaaggcaaagatgttgctcaaacctgacaaaacaattgttactgaaccacatcatatatggccaagtctgaatgatgaacagtggttgaaggttgagtgtgcactaagggacctcattctttctgattatgcaaagaaaaacaatgttaatacttctgcactcacacaatctgaaatgcgagatatcatccttggtgctgaaattgctccaccatcacagcagaggcaacagattgctgaaattgagaaacagtcaagagagacaactcagttaactgctgtaaccacaaggacgacaaatgtccacggagatgaactcattatcacaaccacaagtccatacgagcaacaagcattcgcatcaaagactgattggcgtgtcagagccatctccgccacaaacttgtatcttcgtgtaaatcacatttatgtcaattctgatgatataaaggagactggctacacttacataatgccaaagaacatattgaagaaattcatatgcatagcagatctccggacacaaattgctggattcttgtatgggctgagtccacaggacaatcctcaagttaaagagattaggtgtatagccattcctccgcagcatggaacacaccagatggtgactctgccaacaaatcttcctgagcatgagttccttaatgatctcgaacccttgggatggatgcacacacagccaaatgaagctccacagctatcgccacaggacctgacatcacatgccaagattctggagaacaacaaacaatgggatggtgagaagtgcatcattctgacatgcagcttcaccccaggatcttgctcgttgactgcatacaagttgacaccaagcggttatgagtggggacgcagcaacaaggacaacggaagcaacccgcatgggtacctcccaactcattacgagaaggtccagatgcttctgagcgatcgcttccttggtttctacatgattccggataacgccccttggaacttcaacttcatgggagtgaagcacgacccacagatgaagtacaacatgaagctgggcatgccccgggacttctatcacgaggaccacaggccgacacacttccttgagttcagcaacatcgaggagggagaggtcgctgaaggtgatagggaggacacgttcacgtaggcgcctgttagaaactgtatctcaaacgcacttagctctgttttgaacggcaatgtgtgaagctgtaacctgactcgacgggtgtcatctgttgttcacctgtattatactaccttttttgttgtaagacagccctggagaaaggggttaaaattgtacaagtgcacgccatggtaacagtaaaatttttgcttagtagctatgttattccatgactgttcaatcgcaaactacaacgttccagcgg

SEQ ID NO: 14087 - DNA, 2246 bp, Sorghum bicolor
  Clone ID: SORBI-28MAY03-CLUS1583_1
aaagctgaagaacgcagaacttcaggctaaaaaggatcaattgagaatctggacagggtttaagccaccggtgacaaactcgaagcccattcatgaccagaaatttactggaaaagtggtagaggttgtaagtggggattgtattattgtggctgatgatgctgctccatatggcagtccttcagctgaacgtcgggttaatctgtcaagcattagggctcctaagttgggcaatgctcgtacagatgtgaagcctgaaccttttggtcgtgaatctaaggaattcttgcgcacgaggttgattggcaagcaagtggctgttgaaatggaatactctcgaaggatcagcactgtggatggacagagtgctgctccaacagcaaacatggctgatacgagagttctagattatggttcagtatttctgggttcaccatcacagactgatggagatgacatatcttctgctccgagctctgccagccagcctggagttaatgttgctgagcttttgctctcacgaggctttgctaaaacatctaaacacagggattatgaggaaagatcacactattatgatgctttattagcagctgaatcacgggctgagaaagcaaagaaaggagtccattctctaaaagaatctcctgtgatgcatataacagatttgacaactgtatctgcaaagaaggccaaagatttccttcccttcttgcagcggaacagaaggcattcggccatcgtcgaatatgtttttagtggccatcggttcaaactaacaattcctaaggagacttgcagtattgccttctcattatctggtgttcggtgtcctggtaaaggcgaaccatactcagatgaagctattgctttgatgaggagaaggatactgcaacgtgatgtggagatagaggttgaagcagttgacaggacaggaacattcataggttctttgtgggagtccaagaccaacatgggctctgtacttctggaagctgggctcgccaaactgagttcatttggcttggataggatctcagatgcttatgtcctacaaagagctgaacagtctgcaaagcaacaaaagattaagatatgggagaactatgtcgagggtgaaaatgcttccaacggatccacacctgaatctaaacaaaaggaaattctcaaggttgtcgtcacggaagttcttggtggtgggaagttttatgttcagacagtgggtgaccagagggtggcttcaattcaacagcagcttgcatctttgaaacttaaagatgcgccagtaattggtgcttttaatcctgtgaagggagagatagtcctcgcacaatttagccttgacaactcctggaacagagctatgattgttaatggacctcgttctgtagaatctccgaacgacaagtttgaagtattctatattgactatggcaaccaagaggtggttacctacagtcgtctacgacctgtggacccatctgtttcctcgtctcctgctcttgctcagctatgcagccttgctttcataaaagtgcccagtcttgaggatgacttcggtcaggaagcagcagagtatctaagcgaatgtttgctcagtagctcaaaacaataccgggcaatgatcgaagaacgtgatgcttctgggggaaaatcaaaaggacaaggaaccggaaatgttctcattgttactcttgttgatgcggagacagaaagtagcataaatgctaccatgcttgaggaagggcttgcccggcttgaaagaagcaagagatgggacactagggagaggaagacagctctccagaacctggaacagttccaggagaaggcaaagaaggaaaggctgcggatctggcagtacggagatgttgaatcggacgaggaggagcaggccccagctgcaaggaagcctggaggtcgtcggtagaggcataaaaggctgcagtctggcatgctatggaagttttggacaaccccaaatgtgggactctgccgtgagttatagatgaaaacttagactgaggggtaccttatttattcggttagaaaagagaacttagtgaggcgaaactttctcggtttgagcacttttgatattccgtttttacaccgtaagcttataaggttaaagatacattgttttttctctgaacttaataaggtcgtgtctatgcgctgcggttctttgtagtcagaatataatattgagaagtgcagtgaatgaaagtttaaggattgcattt

SEQ ID NO: 14088 - DNA, 1619 bp, Sorghum bicolor
  Clone ID: SORBI-28MAY03-CLUS13933_1
ggtccgacggcacggccccccgacccaacccggccctccgcgtcgctgctctgcactctgccgcagagccagcagcagagcggccgcctgccggccatggcgcgcgccccgagctggtcgtcgcccctcgtcctggtgctcatcatcgtggccaccgccgtcgccgccgtgaccgcgtcggaggcgatcagggtgcccgccgtcggcaactggacggaggagctgcgcggggccgcgacgacgaggcgagcccggcagcggcacgggtggcgctcccggcgccggacgttcgagaacggcctcggccgtacgccgcagatggggtggaatagctggaaccacttcggctgcgggatcaacgagaacctcatcaagcagacagctgatgcactggtcaacactggtctggcgaaattgggctatgagtatgttaatatagatgattgctgggcagaatctgacagggactaccagggaaactttgttgcacatagacaaaacttcccttctggcatcaaggcactcgcagattatgtgcacgcaaaagggctgaagcttggcatctacagtgatgctgggacacgaacatgcagccaaaaaatgccaggatcacttgatcatgaagagcaggatgtgaaaacattttcatcttggggtattgattatctgaaatatgacaactgcaatgatgctggcaggagtgtaatggagagatatactaaaatgagcaatgctatgaaaacctatggaaagaacatcttcttctcgttgtgtgaatggggaagagaaaatcctgctacctgggcaggcagcatgggaaacagctggagaacaactgatgatatcgctgacaactggggcagcatgacatccagtgcagaccagaatgacagatgggcttcctatgccggaccttagaggtggaacgatcctgatatgcttgaagtgggcaacggtggtatgtctgaggcggagtaccgctctcacttcagcatctgggcacttgccaaggctcctcttctgatcggatgcgacgtacggtcgatgagccagcagacaaaggacatactcagcaactcagaagtcatcgctgtgaaccaagatagtcttggtgtccaaggaaagaaagtgcaatccaacaatggcttggaggtttgggctgggccactcagcaacaacaggaaggccgtggtgctctggaaccggcagggctaccaggcaaccatcaccgcacaatggtcgagcatcgggcttgcttcatccactgctgtcactgctcgtgatctatgggcgcactcatcattctcggctcagggccaattatcagcttcagtggcacctcatgactgcaagatgtatgtcctgacaccaaattaacttatagaagacatgagcggagtccatagtgtgggatgcaaccattcgatcaagattcaggaaaatgagtatgcaggcaaggattctaagataaggaaacgaaatatcattgttgtggtggggggaataatttataatctgtaagtgtatctaaggagccgtcaaatgtcggtgcctgtattctgagtgtttgcaacaaaagttgcaccaataaaattggcttgccctccactctctttacg

SEQ ID NO: 14089 - DNA, 1299 bp, Sorghum bicolor
  Clone ID: SORBI-28MAY03-CLUS2200_1
caatcctgaccccgagtggccaaaccgacgagacgacagagcggagtcgaggactcgagagcaccctcccggatctctctaccaccagcgcctcgtcgccgccgtccactgccgcagcgatggcctcccccgacctgctcttcaatctgcggaacctcttctacctgggcgcctaccaggcggccatcaacaacagcgacgtcccgggcctcgacgccgacgcagccgccgagcgcgacgccatcgtcttccgctcctacatcgccctcggctcctaccagctggtgatcagcgagatcgactcgtcggccgcgacctcgctgcaggccgtgaagctgctcgcgctgtacctcaccggagacaaggaaggtgctatctccagtctcaaggaatggttgagcgattcagcaattggaagcaatcctgttttgcgattgattgctggaattatatttatgcatgagcaggactacaatgaggctctcaagcacacacactctggaggaactctggatttgcatgcattgaatgtacagatcttcatcaagatgcatcgttcagactatgctgagaagcaattgaagatcatgcaacaaattgatgaagaccacacactgacacaacttgcaaatgcatggctgggcattgctgttggtggctctaagatccgtgaagcttatctcatattccaagacttcgctgaaaagtacccaatgacagggatggttctaaatgggaaggcagtctgctgtatgcacatgggaagctttgaggaggccgagactctattgcttgaagcgctgaacaaggatgcaaaagatcctgaaactcttgccaatctaattgtatgcaatctccaccttggcaaaccatcatcacgattcctcagccaactgaagctatcgcatcctgatcatgtgctcgttaagaacgcggcatcatcagaagcaaccttcgagagggccctccaagctgtcgcttgagctcgacaaaacccccaccagattacagaaaagcagcacattgatctctttttccccatttcgagtgtgttaacccagtaagtatggtggttttggttgtctatcgtcgctattaatgcgactcggccagtcttgtactacaacaactactgtataaacggatatgtagaatattgaatcgttacatctattgccaacatcagtatttttgttttgttatacttagtagatatgcaatactgtcaggtgtcaacccttgtgggcgacgatttgagtaccatacctataaagaacgtgaccgttctttctggccccc

SEQ ID NO: 14090 - DNA, 1062 bp, Sorghum bicolor
  Clone ID: SORBI-28MAY03-CLUS21293_1
gcacgaggcacactttcttccactgcccacatgcgcgcacagtgctaagctagcaaggcaagcccagccagctgagctccagtccagcaccgcagcaggtcgtcgtcggtctcgccgccatgagcaaggagaagcaccaccgcgactgggtcctccgccgctgctgcggctccatcgccgcctgcatcctcacgctcttcgccctcgtcggcttcatcgtgctcgtcatctacctcgccctccacccctccaagccttccttctacctccaggacgtgcagctccgctccatcgacctcagcgaccccgctctctccctcgacctccaggtgacgatcgcgtcgcggaacccgaacgaccgggtgggggtgtactacaagacgctggacgcgttcacgacgtaccgggacgagccggtgacggtgccggtgtcgatgccgtccatctaccagggccacaaggacgtgtcggtgtggtcgccggtgatgtcgggcgacgcggtgcccgtggcgcagtacgtggcggacgccatgaagcaggacatcgcggcggggtacgtgctgctccacgtcaaggtggaagggcgcgtcaagtggaaggtcggcagctgggtctccggcggctaccacctcttcgtcacctgccccgcgctgctcgccaccagcgggagcgccgtcgccggcggcgcgttcgccgccagcgccgcgtccggagtgcccgccggcgtcaacaccaccgtctcgctcaagttcacccacccggccgactgtactgtcgacgtgtgagttgcgacgacgacgacgggcgttcgttcgtactactagctagtacgatgatgaggatcaacctcgctctctcgatcgcgatcgcgattacgcctagtagctatcgatcgagcaattaatcttcttttgtagcaaatgatgttgttatatatattttccctttccgaacttgtgcagaataataagttaataagctgctagctctatctagctatacaacaccatgtgtcgtacatttgctaccatgtattaccaatatttaattttttatgcgcgc

SEQ ID NO: 14091 - DNA, 2627 bp, Sorghum bicolor
  Clone ID: SORBI-28MAY03-CLUS2268_1
gcacgaggcacacttctgttcagtgatggagcgaagtgtgaaatcctgttaagggatttggatgtactgaagcctgttcctcctattctttttgaagatgcaccttacttttattatcctggccaacgtgtgaggatagtcgatccgtcagtttccaagtcggcaacatggttgtgtggatcatggaggcccagtagagacgattgtattgtctctcatgttgatgtagggctggtgcatgtgaactggatcacatctgtgaccaatgtttggggagataaatcatcgagtccttcaaacattcaggacccaaagaagctcacattgctgtcatgtttcccttatgctaattggcaactaggtgattggtgtgctcttatggccgacaacaatggatatctctggatggattctggcaagtcttgtattcttagtgaagaccataagtgtgactctcatgggcacatgtatttcgaaagttatggttcagattgttctcaaacatatgttgttgccaagacaaagagcactgtcgatgttctgtggcagaatggaactgtatctcttggtctagaaccccaggcattagtccctgtgagtacccttggtgaccatgatttttggccaggccaatatgtcctagaaaaactgactgtagaggatgctgcaaaatgtcagcgaacggcaatagtgagagatgtggatgcactggagcgaacagtaaatgtaaaatggattgatccagctcatagtgacactgcccgacgtggaagtgaccctgcagtggagactgtaagtgtttatgagctagtagagcacccagatttctccttctgcactggtgaggtcgttatcaggtcagctgtgaacatagacaagtctgaagcagatctcacaaacgggtcattagcaagcaaagaatcattggttacctcctctggcttcttatcatgcatcggaaatgtacttgggtacaaggacaatggaattgaagttcaatgggctaatggtgtgatatccaaggtgcagcattttgagataattggattggacaggcttcttgataatagttctctagaatcaatgaatgaggaacatacaattggtgattcgctaggcgaggctgagcaggaggaaatgcaccatgagattgctctggagtctactgaagactgcactgggtccttgtgcaaagccactgcttttctatttcccaagacagcttttgacttcctgacaaatgtggctgctagtttgtttggtactcgtggttctccatctccaagctcagtttcggtagatcctcgatatgaaattgtgaagatggcagaaatgcagccatgtgtagaagaattgccaaaagaaaaacagatagtgaagtttgtggcgcagattgagaagccaatcctctcttcagaagatgccatctcaaaaagatttgatgtagtcactgactgtttggatcatcattttgtgaaggaaaatggccatgaaagtgttacaagaggttggctgaagaaggtgcaacaggaatggagcatcctgcaaaatgatctaccagatggtattcatgtgagagtttatgaggaaaggatggatcttctgagggcttgcattgttggggcagctggaacaccttatcatgacaacctttttttctttgatattttctttcctcctgactatccccatgaaccaccttctgttcactatcactctggtggtcttcgtttgaatccaaatttgtacgagtcgggaaaagtgtgtctcagcctcctgaagacatggacaggaactggtaatgaagtgtggaatgccgagaactcaactgttcttcagctcttgttatcgcttcaggcccttgttctcaatgaaaaaccttatttcaacgaggcgggatatgacaaatttgtgggtaaggctgatggagagaagaactccatcacatacaatgagaatgctttcctgctgtcatgcaaatccatgatgtatgttttacacaagccaccaaagcattttgagaagttggtcaaggagcatttcacttgtcgttccctgcacattctggatgcctgcgaggcttatcttgggggtgatcttgttggacatgcgcacgacaaagcatacatatcagaggacggcagcaagaactgttcaaccggtttcaagataatgcttggtaagcttctgccaaagcttgttactgccttctatgaggctggtatcaccagtgacccgtaaaccagagcaagcctgctctctacatcagtaatgaaattgggacccttttatattgtgcgtgtatgtcgatgcttgtgtattccaaataaaatgttgcctggtttatgtgttacttatgcctgtcttgtaaatgtggaacagtatatacacatgattgttgaactgatatgcttgtcatgtaaatgcggaacggtatatacgcatgattggtgaactgatatgttgctaagctaaaggcagctagagactgaagtgtctgggtttgggttgtattctgcttttggtgtgaaaaaaattgtatatatatgttcaatggtttttggactatcgacacagcagttgtctgtacatatttgcttatactgcaatgtgaaatacaaaggcaa

SEQ ID NO: 14092 - DNA, 2091 bp, Sorghum bicolor
  Clone ID: SORBI-28MAY03-CLUS5540_1
gcacgaggcaagaacagaagattgttggtctcagcgacagaccttgctcggggcaattattcacactgaaacataagaatggtaatggagactctgaagagatcactgtttatgattacttcgtaaagaaccgtggcatagagctgcaatactctggtgatcttccatgtatcaatgtgggaaaaccaaagcggccaacatattttccagttgagttatgcagtcttttgcctttacaaaggtacactaaagctttgagcacacttcagaggtcatcacttgttgagaaatctaggcagaaaccacaagaaaggataggtgttttgtctgatgtactgcaaagaagcaactatgatgcagagcccatgctgaaggcctgcgggattacaattgctagaagttttaccgaagttgatggtaggatactgcagccccccaagcttaaagctggcaatggagaagacatttttacacgcaatggtagatggaacttcaacaataagaggctcattaagggtagcagtgttgagaaatgggcagtggtcaacttttctgcacgatgcaatgtcagggatcttgtccgtgatctcatcaagtgtggaggcatgaaggggattatggttgaagctccttttgatgtatttgaggagaatccttcgatgagacggtcgcctgctgtaagaagggttgaagacatgtttgaacaagtcaaaaccaagcttcctggagctccgaagtttcttttgtgtgttctagctgaaagaaagaattctgatatttatgggccttggaagaagaaatgccttgctgaatttgggatcgttacacagtgcgtggcaccaactagagtcaatgatcagtatcttacaaatgtcctactaaagataaatgcaaagctgggtggcatgaattcgttgctccaaattgaaacatccccagcaattcctcaagtatccaaggtcccaactataatcttgggaatggatgtctcccatggttctcctggacattctgatgtaccgtccattgctgctgttgttagttctcgtgaatggcctcttatctcgaaatatagagcttctgtccgcacccaatcacctaagatggaaatgattgactctttgtttaagccacgggaaactgaagatgatggtctgatccgggagtgtctgattgacttctacaccagttctgggaagaagaagcctgaccaagtcatcatcttcagggatggtgttagtgaaagtcagtttaatcaggtgctgaacattgagttgcaacaaatcatcgaggcttgcaagtttttggatgaaaaatggaatccaaagttcacgttgattattgcccagaagaatcaccacactaaattttttattcctggaaagacagaaaatgttccagctggaactgttgtggacaacaaagtttgtcatccaaggaactttgacttctacatgtgttcacatgctggaatgatcgggactacgaggccaactcattatcatatactgcatgatgagataggcttcaatcctgatgatctgcaggagctggtgcattcgctctcttacgtgtaccaaaggagcacaacagccatatcagttgttgctcccatctgctatgcacatctggcagcagctcaggtcggccagttcattaagttcgatgagatgtcggagacatcctccagccatggcggccatacttcggcgggcagcgtccctgtccaggagctacctcgtctacatgagaaagtcaggagctcgatgttcttttgctgagcctctatagcttgctgcttcggcattggcctctaagccttacttttggtggatggttgggtctgaaccctggtagtagttatgtctggtggcagtaaacgctcttggatgctgcccataaacttgtgaacttgttgcggcatttggtgcctgcctctggaagacttaatcaagtaggatgttaaatgttagtttttaagcatcgctgcagttatgttggctgtcttgttgcagtgcttggtgccctcaggaagacttggaaccttgtaggatgtcgttaaaccatccttttaagcgttgctggttctct

SEQ ID NO: 14093 - DNA, 1710 bp, Sorghum bicolor
  Clone ID: SORBI-28MAY03-CLUS4961_1
gccctgcgctgtcactccacgcgcgacgcagctgctgcttctactgaaggaaagctttttcccagaataaaggctctctgtctgtctcagtgagaggaggagccggcggcgagggagatgaagacccggagctcagcgagaggggagccgaggcggctcgggaatgcggctctcctggcgctcatgctctgctccgtcgtcgcgctctccctcatccgggggaggttcgccccaattggagacgccatcaaatccgaggacgacgctgctgcagcggcggtggcggtcagcaaggcggctgctgtcaacgttgacaccggcgacggcgccgacgaggccgccgctgaagctgctgctgaggagaaagacaagggaggaggtccagccgaagccagaccgccgacggttcccgcggcggcgcagcccgagccggtgtgctacgagacgagccggcgctccgacacctgcgaggcggctggcgacgtgcgcgtgttggggagctcccagacggtgtacgtcgactcgctggaccgggagtggaagaccaagccgtactgccggaagcacgacaacttcgcgctcgcccacgtcaaggagtggtccctcaagccgctcccctccggcgctgcgccgcagtgcacggtgaacagctcggccaccgcgttcgtgctctccacgggcggcttcacgggcaacccgttccacgactacacggacgtgctgatcccggccttcatcacggcgcacccgctccgcggcgaggtccagttcctggtcagcagctacaagtcgtggtggatgaaccgctacatccagatcttccagcagatgagccggcacgaggtggtggacatcgacgccgacgacgaggtccgctgctaccggaacgtggtggtggggccgacgttccaccgtgagctcggcgtggacgcgtccaagtccccgtcgccggggtactccacggccgacttccgcaagatgctgcgcgacgcgttcgggctggagcgcgccacggccacgcccagcggcgaccggtgggacatccggcgccggccgtggctgctcatcatctcgcgccgcccgcgccatggtgaactcgtgcgacgtgatggtgggcgtcgtcgggggagagggaggccgcgtcggggcgcggtggcgtcggggtgtcagggagagagaggccgtgtcgggtcctatttttggggcctccaactagaatttggcagctctcctaaaatgagagcccaagtaggaggccccctggagttctcaaactcctaaaatttaggatggaggcctgtttaggaggtccattggagttactctgagccaggcaatcttgcgggttaaagcaaacacgcccacgggccacgggcctcggcccaccaccaccattgatgcttcctagcatgggaagccaaaaaaatgtaaaggtggttatgcttggaacagtctctgaatattatttgtagaggcgagtaggcgactcaattatctatgtataaatagtaggccccttgttttttcttaggatttttatagagatgattctacaaatctaatatagacatgggtcgaaaacttagccatctctaaaaatagattttatagaggcgattgttgttatcagccgcctctagaaaataacaagggcagctatgccctagtctctataaatcgctgatttgtagagacaagaaactaagtaat

SEQ ID NO: 14094 - DNA, 742 bp, Sorghum bicolor
  Clone ID: SORBI-28MAY03-CLUS238_1
ctgtgcggcgctcgaggcgggccggccgggtccgcctagcttgcagcgccgcctggaccgagcagccgagcgagtaagcgaagacccccgcttcccccaagctcaagagcaccatggcgtcggcggcagtttatggcggcctcaaggggaagcttggcgtagaggatgcccccgagctgcagctcaaccgcatccgcatcacactctcatccaagaacgtcaagaacttggagaaagtttgtgcggatttggtgaagggagccaaggacaagcaactgagggttaagggacctgtcaggattcctactaaggttctccacatcaccacccgcaagtccccttgcggtgaaggaacaaacacatgggatcggtttgagttccgcatccacaagagggtgattgacctaatcagttcccctgatgtggtgaagcagatcacctccatcaccatcgagcccggcgttgaggtcgaggtgaccattgcagacgtgtaaggacagtgcagttcagcaatgtcatcaactatctatatctttgtgttgcttttgttttgtgctccttgtgtgcttgtaagagagatatcgagttattcttagcatataagacttttctttccccccctataatcctatcgtagctgtatgtctgatctgtggcctgtgagctgttcaacttaaaaattttgattcagtaatctggtttatcagggcaacatggatagtgccaaaaaacccttcgttcg

SEQ ID NO: 14095 - DNA, 728 bp, Sorghum bicolor
  Clone ID: SORBI-28MAY03-CLUS25425_1
ctgttggcctctgggtgctgcgacgtttcaacacagtaaacacgatctagctctaagagaccaggcgaaacaaacactactgcgtttcgagagaagccgagagtgagagaggctacaccgaggagtgaccaccgacccaccgccatggcatcgaggcagcagaacacgcgtgaggcgcgcgccgaggccgacgcgcggcgcgccgtggaggagctggcgcgggcgcgtgacgagcacctcgagaaggcggagctgaacgcccgctctgccgcggacgagatcgcgcgctcccgcgccgaccgcggcggcgccggtggcggtggcatcctggggagcgtgcaggagggcgccaggtccttggccagcgccgtgggccgcaccttcggcggcgccaaggacacggcggtggacaagacctcgcagacggcgcaggccacgggcgagaagctcggcgagtacaaggactacgccgccgagaaggctcgggagacgaacgacagcgtggcgcggaagacgagcgagacggcggaggcgaccaagaacaagctgggcgagtacaaggacaccgccgtggagaaggcgagggagaccaaggacgcggtggcgcagaagacgagcgagaccgcggaggccaccaagaacaagctcggggagtacaaggacgcggcggccgggaaggcgcgggagaccgtggacaccaccgccgagaaggcgaggcaggccaagga

SEQ ID NO: 14096 - DNA, 820 bp, Sorghum bicolor
  Clone ID: SORBI-28MAY03-CLUS25647_1
accgcccggcggccgggaaggcgcgggagaccgtggacaccaccgccgagaaggcgaggcaggccaaggacgcccccaagcagaaggcccgggagacgatggacgccaccgccggcaaggcgagggaggccaaggacgtgaccaggcagaaggcgggcgagtacaccgacgccagcagggaggccgcccgccgacaaggcaagggagacggccagcactcacgacaccgataaagggcggcgaccgggtcggccggcgccgctcgggacgataaaggtcagggaccaggtgtggcgggcgcgcgcgcgagcccggcggcacgtcgacgtccggcggggcggcgaggacgagcgcgcggcgaaggagcgcgcggcggagaaggcggcgtcggtgtgcttcgaggagaaggaccggctgatgcgggagcgcgcggaggagcgggtggaccagtgggtggagaccggctgatgagggtgcgccggatcgtcctgcgtgcaccgccaggggaagatgtgagatggcgtggcgcaccgcgcacgccccggccgctacgtgccgcgccttccagtgccatccgtgcatgggcgttgagcgataataaactgttacactagtagcctttccgtggcgttgtgcgataataaactgttgcactagtaccctttccgcaatgttttttgttttcgccctacgttgctgagcactcttggtactagactccgtttggatgggaacagctctgcttttgtaccgtagcagtgactcggttttttctgttacgtactgcaaatacttatatgcgcatttaagattaattcgg

SEQ ID NO: 14097 - DNA, 784 bp, Sorghum bicolor
  Clone ID: SORBI-28MAY03-CLUS286_1
cccatagtggatgtggactcggaagggaaggttgttgtgctcaatggccaggggggcataccggagttttcaactccggggatccccgtttagttcgtccatgccagaagatgccaaaataggggcgtttttgtttcaacccccttgtcatatatgagaaggacagcagctacagcaggatcaagagcctggtcatcgaggagatgaagcagtacttccgacctgagttcctcaaccgtctcgacgagatgatcgtgttcaggcagctgaccaagctcgaggtcaaggagatcgcggagatcatgctcaaggaggtctttgacaggttgaaggccaaggacataaatcttcaagtgaccgagaagttcaaggagcgggtggtggacgaaggctacaacccaagctatggtgcacgcccgctgaggcgagccatcatgaggctgctggaggacagccttgctgagaagatgctcgctggggaggtaaaggagggcgactctgccatagtggatgtggactcggaagggaaggttgttgtgctcaatggccagggcggcataccggagctctcaactccggcgatcaccgtttagctcgtacatgacagaagatgacaaaatagaagagtttttgtttcaaacacattatcatatatagttagcatataactgtgtatatgtagtggtatagtcaaaggggaaatcgttgctgcctttgaattccttttcaaattcaagtattcttttgtctcaagttaatctgcctggttattgaggtattgtgt

SEQ ID NO: 14098 - DNA, 1692 bp, Sorghum bicolor
  Clone ID: SORBI-28MAY03-CLUS285_1
gcagtcgttggatggagcggacggtgaagattagctgactgcagaaggcagtcgtcgccgcctcgcctatccagtcgaggtctcgaggatgcccgcgcctgcgccgccgccgcgtctgcttactttgtcgcggagataggggagaaggagcaagtgagattgacggggaactcgagtatcgccctaagtacaagccggtccaatcagactaggtgctgcctccgcgctcgcactcccgcacccatccgcctcactgccaccgcgccccagtcacacgcgcgccactcgcgatgacgccggcggcggcgatctccggctccagcggccacctcgtcgtctcctccccccgcctcaggcagccgctcccgccatctccgcgcaccgctcgcccaatcgcggccaacgccgcctcgcccgtggcccgccgcggggtcgcggccgccgccgtgtccagccccgctgtgtcggccgccgcggggaaggatgccaaacaggctcctaaggatttccttcatatcaatgattttgacaaggatacaataatgaatatccttaatcgagcgattgaggttaaggcagcgataaagtctggggacaggagcttccaaccgttcaaagggaaatcaatggcgatgatttttgccaagccatcaatgaggacccgtgtttcatttgagacgggattcttcttacttggcgggcatgctatttatttgggtccagatgatatccagatgggcaagcgtgaggagactcgtgatgttgctcgagtactttctggctataatgacatcattatggctagggtctttgctcaccaggatattctggacttggcaaattatgcacctgtacctgtcataaatggtctcactgactataaccatccatgccagataatggctgatgcacttactatgcttgagcacattggtcgtattgaaaacaccaaggttgtctatgttggagatgggaacaacattgtgcactcatggcttctattggctgctgtacttccttttcactttgtatgtgcttgtcccaagggatttgagcctgatgcgaagacagtggagatcgctaggagtgctggaatcagtaagattgaaataacaaacgatcccagggaagcagttaagggagcagatgttgtgtatacagatgtttgggccagcatgggccaaaaggaagaagctgattatagaaaacagaagtttcagggattcacggtcgatgaagccctgatggagattgctggctcccaagcctaccttatgcactgtttgcctgctgagagaggagtggaggtgacagacggtgccatcgaggctcccaactcaatcgtgttcccccaggctgaaaacagaatgcacgctcagaatgccatcatgctccacgtgctcggtgcttaactcccctattgcacaccagtgtcacacttttcttaaattcttaggcatcgctgagggattgaggttgtttggctttagggcatatatgaaagcttaattcagacgaactgtttggtaatgtgatgactgttcttcagggaggagtttgttgtactgtaaaagtttggtaataaaaaataaacttctgtgctagtttcgcatgcaaatcatgccagttctaagggcacgtttcgtttgcaaatcatatcagttttaagggcatgtttggctgagaccattg

SEQ ID NO: 14099 - DNA, 1605 bp, Sorghum bicolor
  Clone ID: SORBI-28MAY03-CLUS29622_1
gcacgaggatcgcctctctattctattcacccgcctcccctctctcgctcatcaccgcacgcgcgcacgaacgctcctaccccctcctcccgccgccgccgccaccgccaccgccgccaaaaccccagctcgagtcgagcccgactcggcgtcctcaacctcctcgtcctcggcgggcgcgggcgagccgggcggggagagatggcgtcggaggacgtggtggggaagagcaggggcgacacggccgtcaccaccatcgtcaacctggcggaggaggccaagctcgcgcgcgagggggtcaaggcgcccggacaccagatcctcaccatctgcaagtcgctcgtcgccggtggcgtcgcgggaggagtgtcacgtactgctgttgctccactcgaacgattgaaaatcttgcttcaggttcaaaatccacacagcattaagtacaacggtacagttcagggtctcaagtatatctggagaactgagggcctccgtggacttttcaagggcaatggcaccaattgtgcaaggatcgttccaaattctgccgtgaagttttttagctacgagcaggcggcaaagggaattctgtgggcttaccgtcaacagactggggaagaggatgctcagcttactccactcttgcgccttggagctggagcgtgtgctggtatcatagccatgtctgctacttacccaagcgcgagggttaggggtaggatcactgttcagacagacaagtctccctaccagtaccgtggtatgtttcatgcactgggtacagtctaccgtgaagaaggctttcgtgctttatacagagggtggcttccatctgtaatcggagttgttccatatgttggcctcaactttgctgtatatgagtccctcaaagactggctactccagacaaatccatttggccttgcaaatgacaacgagctgcatgtggttacaaggcttgggtgtggtgctgtggctgggactattggccagactgttgcatatcctcttgatgtcatcaggagaagaatgcagatggttggttggaaccatgctgactctatcattactgggaaaggcaaagaagcactccagtacaatggcatgatcgatgcattcaggaagactgttcgtcatgaaggcgctggtgctctgtacaagggtcttgttccgaattcagtcaaggtggtgccctcaattgccattgcatttgtcacttacgaggttgtgaaggatgtgctaggagtagagatgaggatatcagactgaagaagcgggggtagtgctggtcgttatcaactgctatttttgtaggttttggggagtttctgtttttgtaggcagggcgagtaggaggatatgactgcggctacatttcagcatcaggccctcccagcccatgttgatatatcctgctactggcttcaggtcctagaattgttgctggatcgcgcgaaaagtaataagttggctgtaaagctttaagcatttgcctaactcataaaaaatctgtcccttgttgatgtaccgagattgaacttaaaagcggtattgcgtgctgctaatagttgattctaatgattttctcttccgttgtcgcgtttc

SEQ ID NO: 14100 - DNA, 1165 bp, Sorghum bicolor
  unsure (1)..(1165): unsure at all n locations
  Clone ID: SORBI-28MAY03-CLUS31561_1
ccccctcgcccaatccacaaaacaaaaaaagcaccaccccagcctctcgtctctccccaagcggcggcgaccaggccgacggccctccgcaggcggtgcaccggcggtataggtgctcacctgagctctaggcaaggtcaccgtatagatactgccgccgctttttctaaccttgcccgacgtttggcacgcaacctgaattcgtctcgcccgcggccgatctcctccatccgctcgccgcgccgcaatccggagaggagactacgctaggtcgagcaccacctggggctcagcgttctcgcgaccagttccggcgcggcgtccgccctctgcagccactcgcccccgcggccgtcgccccgctccttcttgtcctacttcgacactcgccaccttggccggcgacgaccaccaccaggacagcagctgggtgcacgacaacttacaagaggtcagccaacgtccgtcaatcaaccaggggtggcaccagcagcgatgcagctggggggagcgttgagtgcaacatatgctttgagctgcctcaagcgccgatagtgactctgtgccgccaccgcttctgggggtgatgcctgcaccggtggcggcacttacatctgcattcgctaaactccaatctggggttcgggacctggcctcggcggtggaaagggtatgtccggcagcgccttgtccatgggttaaggttgtgctggagtctgcagtacctgcaagggctgcggggatgtgggcggaccccaaggcggctgggctggcggtaccggtcgcggctctggatctggcagcggtggaatccactgagttttccttgatttgcttcttggagcaagccacagcagctggagcccagcaatagtgtcagtccattttggtgtcgttcgtgtaactgagttttccttgagagttggtggttttcgatttctttgttacaagaattagtcaggaataatggatttcgtgattgtggttcgagtaggtagtccagaatgcaactgacgtggatgtaatggctatctacgagtatgcatatcgtcatcttttgctgctgtaccccttgttgtaatctgtttctcatcgatcgttagaggttcgttgttgccggtttttatctttcaaaacaaanaatatattggaactcttgcagtct

SEQ ID NO: 14101 - DNA, 1506 bp, Sorghum bicolor
  Clone ID: SORBI-28MAY03-CLUS33577_1
gcacgaggctgcgtttgcacaatccgtttgcacggaagacggcccgtctgcccggcgctaggagtgacccgtcagtgtgttttccagccacggcaggggtgttgctcgcctctctcgtgcggtggccggcgacgggagcctggtccggccgacctttcaccgcggtcaacacccccacagcgccttgtcccgtccttattcaataccacgttcagcagggctatgccgtagtcgccgatgagttggctgtacacttcataagttatgttggggaatgcttccctcaggtctctattaactacaagatcacgacgttgagttgtggcatcattcatttgccctgctgccagtgcacattccattctgtcttccaatgcggatggtcatctcacggccacctttggctgttgaagtacccaaacgatttgttcacagggccattggcaaatgtggattttttcatttgccgggactcagatggaagttttcatgatgtccgcaatgtgcaacgtcattaagaatcaatctcttcttttagcagtcaactgcataatgacttctagtgaacttattctggttggatgtatggagtggatggcacccccccgatggctcaaagaatatcaggaatatgaaatttcaataagaatgattttggcctctttccaatcaaggtggttacttggggaccttttgtgttggtcagatttgatgatgagtccactgaagataatgtttatggtgcagttggaaatgaatggttgggtagtgcttcagatctgttgggtacaaatggaattgacacttcactgccgcatatttgcaggtcttttgtgacaattacctagatggtggatatcatgttccatacgcacatggggctcttgcatctggtctgcagctgcaatcctatgaaacacttacatatgaaagagttagtgttcaaagatgtgaaagtgcaccagcagaaccagatgattttgatcgcttagggacaaaagctctctatgcctttgtctatccaaactttatgatcaacaggtatggtccatggatggacactaatctagctgtcccattagactcaaccagctgcaaggtggtatttgattattttcttgacaagtctcttctggatgacgagagctttatcaagaaaagcctaaaagacagtgagcaagtacagatagaagacattgcactctgtgagggggttcagcgtggcctggaatcgccggcttacagtgttggaagatacgctccgtctgtggagatggccatgcaccacttccactgcctcatacatggtaaccttagtgggtagttattctcatgggcgcatcttgcaaacttgtacagaaccaaacgctcttttgtgcaggacactgcatgaacacttctctttattgtaatcttgtgatgttttttgtgaaaccaaccacacctcaattacacaaaaacatgtttgctggttattaaattgagttctcataaattttcagatgc

SEQ ID NO: 14102 - DNA, 1508 bp, Sorghum bicolor
  Clone ID: SORBI-28MAY03-CLUS8009_1
accccggtccgcgccgcccgcctatgtgccgaccaccctgtgcgtctggtcatccttgtccccgcccaccgacccccccctccctccaccgacgccggagccctgccccccccggcccccgcccccccggccggccactccctctccctcctttcatcttctgttccccttattcttttcccttgtataatcctcaagatctcgctcgcttggccacagcacctccaaggggtacagacgctccgcgctcccgtccccccctggtttgggcatgcccagcatcttcagcagctgcgggctccatccccggcagacggctggcggcttcacgctgcagctgcaacacgcgcagccagagcagtaacgcaccctccccctcccacctctccccccgcccgcatcccctcctggagccgccgccgtcggcgacggccgccggcgtgggcggccccggccctgggcctcgctacccggagtccacggagtcttgtccgcgccgcgcgggcggggcttcgtgggaccggccctgcccggcctccctggcgcggccccccgcgcctcccggcggcggtgtgggccggcaccgcctgatgtgcggcttccggggccccgtcgccccccgcccccccgactggtcgctctgctacctcagccgggtccctctcgtcgtcctcctcccccgccaagcccccctcgccgccccctccccgcccctctcgcggtcgccgtttcgccctccccgctttacggcagagtgtcctctgacgaaggtaagtccgatcacggtggcggaggtcggaaaccacaacctatgaagcaggaggtcccgccggctgttgatcccagcaatagagccgtctactataacgatagctctcccctctccgacttgaaacgagccatgcctgtgggaacggaagctgccagctaccgcctccctggatcagctccggacgcccctgcagctgccgcggcaacacaggtcccacctggatatgtccttacccagatgcatgtgcctcagccaccgcagcaacatccaccaccacagcagcaacagcaaccacaacaaccagctcctcagcagattgtttctgctggaaatcagcatttcatccacaaccctgccactggcaccttcattccaatccagtcctattaccaccatcctgttcctcagcaggcaccccagactgtgccgaggccgcaacaggcacctacattcgacccaaatacggggatgtattaccttcctatgcagcagaatgcacatcagccatatagcatgcctcctggtgcacaagtcactttgccacctcccacacttgttgacacaacgccaaagccgaccgtgccaattcctcagatggctgtaaggcctgaattacaacaacctggtgtttatcgaacaacagctgccgctacgcctgctccagcgcctaatgcagcacctggatatgctgggatggcataccaccatgtcattcaatcgcaccaccacccctcac

SEQ ID NO: 14103 - DNA, 669 bp, Sorghum bicolor
  Clone ID: SORBI-28MAY03-CLUS81946_1
ctactacacacactcttggagtagcagcagcgcctagcctagctagtactagctagtagatcgaagacgagagagatgggtgctcatgtcctggccattggcctgctgttggccggcgccgtcgtcggcgcagtagtgccgcctcatgatcatcttcagctggtgactgacactgacggtggtttgtcgctggacttccacgcggcgtcgtgcccgcagctggagggcatcgtgcgcgccgccgtgcaggccgagcgaggccaggacgtccaagtcaccgccggcctcctccgcatcttcttccatgactgcctcccgcaggggtgcgacgcgtccatccttctggacggcgagaagtcctttggtcccaatgcttctctacagccacgggcgctgcagctcatcgagagcatccgcgccaaggtgcacgccgtgtgcggcgccaccgtctcctgcgccgacatcatcgcgctcgccacccgcgacgccgtcagcctggccggaggaccatccatcgcgatgccccagggccgcaccgacagcctcaggccggccaccaacgccgaggtaaacaccctcccgtcgcccttctccgacgtgagcacgctcctcggcaccttcagccgcaggggcctcgccgaccccgccgacctcgtcgcgctctccggc

SEQ ID NO: 14104 - DNA, 1929 bp, Sorghum bicolor
  unsure (1)..(1929): unsure at all n locations
  Clone ID: SORBI-28MAY03-CLUS2584_1
ggatatgcattcatagagtatgtgcacacacgtgacatgaaaaatgcttacaagcaagcagatgggagaaaagtggacaacaggagggtattagttgatgttgagcgtggtagaactgttccaaattggcgtcccaggagattgggtggtgggttgggatcaagcaggatgggtggtgctgatgctgacaaaaaggattccactagggggcaacaacatggtggacgccctagatcagaagagcctaggagggatgatcgtcgtgccgatagggatcgtgaaaagtctcgtgaaagggtacatgaaagagagcgtgaagagagaacccgtgaacgttcgcatgaccggactcgtgatagagattcacgggatgagaagcatcaccatagagaccgtgagaggactcgggacagggagagaggaaaggaccgcgaaagggaccatggccgtgaccgtgaccgtgatcgtcgtgacagggacagggatcgtggtcgggaccgtgaaagggaccatgctcgctctcatgatcgccatcgtgagagaaggcaaggaccgtggtgaaagagattatgagcgcacccatgaacgtgaacgtggtcaccccgcgggatacaagaggttccaaacatctctccccacctcgcttcgcacctctctctcgagccgccgccgccctccttcgccggcgtcgacgatgggcgactatggccacggcggggggcagatgcggggcaacccggactcccgccccaggggccagggccagcgacctaacgtccagcagctaaagctcatggggcagatccacccgacggggctcacgcccaacctgctcaagctctttgaaccgcggccgccgctcgagtacaagcccccgctggagaagcgcaaattgccggcctacaccgggatggcacagtatgtgtcgcactttgctacgcccgaggatccagagtatgctcctccggtgcccaagtgtgagaccagggctgagaaaaaggctaggattcgcaataataagctcgagcaaggtgcagctaaggttgctgaagagcttcagaagtatgacccacaaagtgaccccaacgctcctggacacccgtacgacacagtctgagttgctagactcaactatgagacagcttagcagcggagctaaggaggggcagcaggtaggtcacgttgcatatgggtatggtctggatggacgtgggcatgaaattaaacaatcaaatctgcatgagcataggttttttcctaaagtcaactagaacacgccgacaaacaaggcggaaccagaaggccccgagataggcgaggcctaggagctgggcacctaccagtacctccgcgctggtgaactcatgattgaaacttggttgcagcggtgagatttgcctgtagctttgtaccgatacaatgataattccaaagctggttctttgtatgaatttgtttcagctgcatagtgcctgtcagttatgttctaccatgttgggaaattctcaaagggaaattgaggcatccctgcagccgtggactgatacaatacaatgatgattccgccattggttctttgtatgaattggtgtcagaatctgagtgccgagatccatatgatttcccctcatggttgtactcaactgtttaaaagttttgtatgacatattttaaattattagttccaagcctgtggctgtcaatttcttgtgttataagatgttagtgtaatctggttgtggagattcatattatctgtcctcatccttgtacttctgttatctgttaaaaagttctatatgacagaccctataaattatttctgccaacttttttgcaaaactttaaacaattgctgcaacctcggtttcctacaccctagcgcataggtctcatcaataaaatatactntaggtctcatcantnaaa

SEQ ID NO: 14105 - DNA, 338 bp, Sorghum bicolor
  Clone ID: LIB3476-019-P1-K1-F11
gcgaggaccgtgaatggtaccatgctcgctatcatgatcgccatcgtgagagaggcagggaccgtggtgaaagagatcatgggcgcatacatgaacgtgaacgtgcacacatgcatgagatggatgcagactatggcaatggtgggacaaagcatgacaaaaatctgtctagttatgggcaggattatggctatggtcagtatgagcaacacaaaggtcatgatgcatatggttatggtcaagatgggcgtaggcatgaaactgaacactcaaagcggcatgagcacgagtattatcgtgttgactcgtatggtaaaatggaagccaactatcagatg

SEQ ID NO: 14106 - DNA, 792 bp, Sorghum bicolor
  Clone ID: SORBI-28MAY03-CLUS44348_1
gcgccacgaccattcttcccccctcacaaacatcttatccctccatccaggtcgggaccgatcgaggccatagaattccagtccgttcctcgtccgtttcctcctccggggccaggcttcaacgacacggaccagctgcagcgcttgacgctcgacgatgctgcgcgcgccacgaccgcctcggcagcggcacccggaacgacgacgccgacagagctcccggcgctgtcgctcggcatcatcagccggccagcaaggaggcctgagcacgtcgtcctgcctccgaccagcctgtcgctgcagctgccgcggtgctcggcggcaatgggcagcctggccctggccgcgccgaaacacacacacccttcgtcgaccctgacgccggcggcaacggctagtagtagccaggcgctgccggacctggagctgaagatctcgatcgcccggccgcagagcgacgtccaccaggtccagactgggtcgtcgccgccgccgccgaggacgccctttctgggcaccatcagggtcacataaccgaaaagacgtcgccgacgacgacgcgggaatatcctgctggtagatgaagagcagcttttgctcatctgaagaagggttggttcaacgacgggacgaggtttgggaaaactgaaaaggaggagcttttggcagtggtgtatgagcgtgtgtgttggtggcagccgtgacgacgacgacgatggcgtcgtttatcatgtgggtgtagtgtaatatcatcatcagaaagatggaaactttactggcctaatttagtct

SEQ ID NO: 14107 - DNA, 1599 bp, Sorghum bicolor
  Clone ID: SORBI-28MAY03-CLUS4533_1
gcacgaggagtcaaggtaatcctcctttgaaacactttggtattgttcctagatagatcataagacaaataatcaatcagagcacagggagccatcttattatctttccctaaagaaaaactatggcgaattaactgatctttacatcagttgatgaaagagcccaatgcagaaaaatgcatgttgggtctttgaaacagttcgaatcatttcgataataatccgtttgatctgttttaccgagaaggtctacggttcgaatccgtatagccctaatatatacgtctttttttccattttaggatggatatcttatgtttcctttagtatagttttcttttccttatttagtacttgtttatagactcgacggtcgattgcgccataggctcgaggtaaaaacattaccataggctcattcatcgaaaatcagagagagaggaaaagaaaaaagaattttgatcaaatcaatagaaggaaggatcccttacctgatttgaatttcatcctccttcaaataggatatgctctaagtctccctatactttcctataatgactgcaacgattttatccattttgcgaattcctattttgtttgaagtatattactatcatatacattatctaaatttacattatataaatcgatccactttaaataaaatagaaaaaatcaaaagaaaaaaagaaagagtaaataataaaacaggatattctgtttcataattctgaaatagagttcttttttttagtattactcctcattaggatgtatatattaatcatccgattttcattatgttctaatctaattagtagtaagtattttcttttttatttaatagtctctgactatcattaaataaagggtagagctattcttttttctagagattctagagaaagtgagacaaagtgaagcgaaagagttttctttgtataagaattaggtctatatcatatctaaatagaaaggaaatcaaaaagaagggcagtggggattacattggatgaatccttaaggaagacatatcacaaaagaaacaaagcctaaagtaagcgctccttgcctttggtttgagcaaaacagattcttgtttcaccgaggaaaagagagaagttctggataaattgacaatgtcaacttgaattgactaattcagttccgcctattccacattaatgggagtacatttatgtttctgctttacgaatatgatattttttggacatttctaataatagcaagccttattcctattttggtattttggatttcaggacttttagccccggttagtgaaggaccagagaagctttctagttatgaatcgggtatagaacccatggggggggcttggttacaattccgaatacgctattacatgtttgcgctagtttttgttgtttttgatgtggaaacagtctttctctacccttgggcaatgagtttcgacgtattgggtgtatccgtttttatcgaagctttcatttttgtgcttatcctagttgttggtttagtttatgcatggcgaaaaggagccttggaatggtcttaactgaatattcagaaaaaaaaaaaaaaaaaaggccccta

SEQ ID NO: 14108 - DNA, 1109 bp, Sorghum bicolor
  Clone ID: SORBI-28MAY03-CLUS467_1
ctgatgcagtcttacctacacctatggatcttatcaacactgtgcgagagttagttctctcacaagatcttactcttattattgaacctggaagatctttgattgctaatacttgctgcttcgttaatagagtaactggtgttaaatctaatggtacaaagaatttcattgttgttgatggcagcatggcagaactcatcagacctagtctgtatggagcataccagcatatcgaactggtctctccccccactcctggtgccgaagtagcgaccttcgatattgttggaccagtttgtgagtctgcagatttccttggaaaagatagggaacttccaaagcctgatgagggagctggactggttgttcatgacgcaggtgcctactgcatgagcatggcttccacctacaacctgaagttgaggccgccggagtactgggtggaagaggatggttcaatcgttaagatcaggcatgaggagaagtttgatgactacatgaagttctttgatggccttcctgcttagacgtttatctgcaactgctacgggcaatgttttcttggggataattggagtttctttgtcaagctcattttgctttcttttggttgtggaatgtgactggatagttagttcggtctgttggtgtatcctcctgaacttccctgtcattgctgttagttttggcaccaagtttattctcaattgctatttaaggaatttactacaaaaggggctgtttggttgtaaccctgcagtaggatgcctcgttagtagttaggacccatgccggcaacctgcctgagcgtggtttagttgggactgaatatattacctggtgagaccggcctgcctgcgaactaaatctgtcacctgggctcccatatgataccaaaatctgttgtaggtttatagtgttatgatctaccagacatcttggttttgaccaaggtgacaggctctgtcgtcgatgtgagtacatgttctttggctttcctgctgtcattttagttagttttattttatttatgttgtttcaatggagtaataaacagacattttccattgttgaatggattcattatcgatgttctgttttttatggtt

SEQ ID NO: 14109 - DNA, 1766 bp, Sorghum bicolor
  Clone ID: SORBI-28MAY03-CLUS46139_1
gcatgatgcgtcgcaggaggagcgggtttcccctataaaaccccgcgtaaccccccgcgcggatggcacgggcgcgcggggacgtcctctcctcagtaactatattttgtcgttccttgggaagatagaaaaatatactcttggttttcttgaacagattccatttcaggtctgtttctgaagggagatttcgtcgaacaggatgaatgcattggcagcaaccagcaggaacttcaagcaggcagctaagctgctgggcctcgactccaagctggagaagagcttgctcattccattcagggagatcaaggttgaatgcacaatcccaaaagatgatgggactttggcatcctatgttggatttagggttcaacatgacaacgctaggggacctatgaagggtggaatcagataccaccatgaggttgaccctgatgaagtcaatgccttggcacaactgatgacatggaaaacagcagtggctaacataccatatggaggagctaaaggtggaataggatgtagccctggagacctgagcatctccgagcttgagaggcttacccgagtttttactcagaaaatccatgacttaattggcatccataccgacgttccagctccagatatgggcaccaactcacagacaatggcatggatacttgatgaatactcaaagttccatggttactcacctgctgttgtgacaggaaagcctgttgaccttggaggatcattgggaagagatgcagctactggaaggggggttctgtttgctactgaagctttgcttgcagagcatggcaaaggcatttcaggccagcgtttcgtcatacagggattcggtaacgttggttcctgggcagctcagctgatcaatgaagccggtggcaaggtgattgctatcagtgatgtcggaattcctcgcccgcgccgcttcctccgccggcctccgctgctagtgaagcactcggcggagaacagagggatcaagggcttcaacgggggagatgccatcgatccaaactcattgctcactgaagagtgcgacgtcctcatcccagcagcgcttgggggagtcataaataaggataatgctaacgacataaaagcaaagtacatcatcgaggctgccaatcacccctcagacccagaggcagacgagatcctgtcaaagaaaggcgtcatcatcctccccgacatcctcgccaactctggcggtgtcacagtgagctacttcgagtgggttcagaacatccaggggttcatgtgggacgaggagaaggtgaacgcggagctccggacgtacatgacgcgcgccttcggggacgtgaaggagatgtgccggagccacaactgcgacctccgcatgggcgccttcacgctgggcgtcaaccgcgtcgcgcgcgccaccgtcctcaggggatgggaagcctgatgatgataccgtctcgtgtccgtgccccactgcgtttgctgcgcgtcgtgtcctcttgagccttgtttttctttggttattatatgtcgatcgatcgatcaacggaggtccgggaaaaacaagttcggttaataattccaggaagtgcgtcttcttggagaccaatagcggaagaagggtaataagtctgtagcccatagctgcctgagatgatgcttgttggtggtctgcaagcagcaatgccaatgccatttggttttcttgcacgactttgggtcatccagccacgttatggaatatggtatatgcaaatccatttgttagcctt

SEQ ID NO: 14110 - DNA, 1936 bp, Sorghum bicolor
  Clone ID: SORBI-28MAY03-CLUS4791_1
gcgcgaggcttggatttacgaaagacgaacaactgcgaaagcatttgccaaggatcttttcagtaagccagaacgaaggtcgggggcgatctgcccatactttgctggggcctcgtgcacgggcaatgtgctgctgcggggcaaagcagagctcaaggggcaaggggcctgatgcgttcataaaggcaggcgctgctctccgctctggccctccgccccccacctcctccttccggctctcgccgtctcatgtcgtgtggcgcggggggagctcggatccggatggtgcagcgcagcgggatcgcccacggccatgattgatcgcgaacgagcagaggaaatgcaagttaataatgaggcaccactagtgtgcctcaagccaaatatttctcagtataactctccagagcagagaggtggagttgaagggtttcctgagaataatgaaaaaaggaatgatattgttgctgcggaaaaaatctgggaggcgtctcctattccaaatcaaggcctcagcaggcccttctaccgacaagaattttatgcctggccatatattcattcagattatcaaatggtgcgtcagccactaccttatggttttgacaaccaattttatcagataaatagggaccatggtttccctattgaaaacagagttcagtatcttccattcaagatgctccctcaaggtcacccccatgatgcacagcttcaggaatttcagtatttcgtggttattgactttgaagcaacctgtgacaaggtgaacaatccatttccacaagaaatcattgagtttccatctgtcttggttaacagtgcaactggaaaactcgaagaatgcttccaaacatatgttcggccgacgtatcatcaatttttgaccgatttttgcaaggagcttactggcatacaacagattcaggtggacagaggtgtgcctctaggtgaagccttactcatgcatgacaagtggctagaggacaagggcatcaggaacacaaactttgctattgtgacctggtctaactgggactgccgtacaatgctggagtcagaatgccgatttaagagaatcaggaagcccccttattttaacaggtggatcaacttgaaggtacctttccaggaagtgtatggggatgtccgctgcaacctgaaggaggcagtacagttggctggccttacatgggaggggcgtgctcactgtgggctcgatgatgcccgaaatactgctcgcctcctggcacttatgatgcaccggggtttcaagttttctatcaccaactcacttgtgtggcaacctgctccacagtcaaccacttgccaattatcccctgaccgctctccagatccagttcaacagcagcagaaaccaaaggagatgctgggatctcctgtgcaggttaacccatatgccacctccgcagggaaggacagagcgatgtactgttactgtggtgtgctgagcaggtggagcgttgtgcgcaagccaggacctatgcagggacggtacttctttggatgcggaaactggaccgccacgaggcgggcgatctgcccatactttgcatgggcctcgtgaaggggtaatatgctgctgcagtgcaaagcagatctcaaggggcaaaggacctgatgctttaactaagggaggcgctgctcttccgctgcgcctcccaatccgtatatattatgatataactttgctcataagacaatggaagttctctaggtagtgtctaacctgtcatactgacttctgtcgatagaagagaatgggggccagatgctgcttaggtgtgatctatccatgaataatctaagtttgtggattgctgtttttaacttaatggaattcgtaggtgtggtttgtgcaaacttgaacttggaggcttggtttgcagttgttcagtgagtggttaaagtattg

SEQ ID NO: 14111 - DNA, 848 bp, Sorghum bicolor
  Clone ID: SORBI-28MAY03-CLUS46868_1
gcacgaggcttttgccaacatgaggatcgtgaacaaccttctgggtggcaaggctggtccctggacgatccatgttcctactggggagaagctctatgtttacgacgtggccatggcacgcgggtcggaaggccatgatatggtcattatcgctggtgctgagtatggcagtggtagctctcgtgactctgctgccaagggaccaatgctactgggtgtcaagtcggtgattgcaaagagcttcgagcggatccaccggagcaacttggttggaatggggatcattcctctctgctttaaagcaggagaggatgccgattcacttggcctcaccggacgtgagcgctacaccatccacctccctaccagcattgctgagatcagtcctggccaggacgtgacagtcacaacccacgacggcagatccttcatttgcactcttcgcttggacacacagcttgaggtgacatacttcaaccatggaggcatccttccctacatggtccgcaacctggcagcacagatgaaataagttaaagtttattggtgggaataaattaaaaggtagtttaatgccacgtatttggcgcatgtctgtaaataagtggcacgtgcaaatcttcacttgcgctcttcgctctggcattgaggtggatcggaactgccatatactttctccgcagcacatgggcatgaattttgttttagcaccgattatttgtactcttgattctttggttacatgccctcttcggtcctcctgatgttaatttgctttgcaaacaatatcagcgtgcctttgtagatttcgaaatggatatatatgtcctattgaaatttgctgtcta

SEQ ID NO: 14112 - DNA, 2087 bp, Sorghum bicolor
  Clone ID: SORBI-28MAY03-CLUS5365_1
aagccacgcaaagcaaagcaaagcaaagcgcacccatccagatacacacgagcacgcgcccgcgcccgcgcccgcacccgcatagcaccaccagtccaccaccaggccggcgccgcccaaaatctccgcgtccctctcgcccaccatggcctccttcttcggcgacgacggcgccgacgagctcccgcgcaccacctcccaccccttcgactccgacgacttcggcgccgccgcggccgacggcgacggcgccggcgggtacggcgggtacgcctccttcgccgaggggggcgtcgaggatgtggacgaggagatcaccgtcgagtccgacggggtcccgatccgccacgtctccgggggttactcgccctcgccgttctcccccgagctcgagcccaacggcggcgacggcccgatcctgccgccgcccaccgagatgcgggaggagggcatcctcctccgcgagtggcggaggaaaaatgctattgaacttgagaaaaaggaacagaaggagaaggagctacgtgcccaaataattgcagaagctgaagaattcaagaaagctttttttgagaagaggatacagaattgtgcgtcaaatatggtcaacaacagagaaagggagaagatttttgtagccagccaggagaaattccatgccaacgcagacaagcagtactggaaatcgatttcagatctcatcccacatgaaatagccaccattgagaagcggggaaagaaagacaaggacaagaagccatccatcacagttattcagggccccaagcctggcaagcccaccgacctctcccggatgcgccatatcttagtgaagctgaagcatgctccaccgccacatatgttgcaacctccaccagcacctgctgctaaagagggcgcaaaggatggtgccaaagaaggcgcaaaggatggcgccaaagaaggcgcggcagccccagcaaacggcgccaagcagccagcagagagccaagaaacccccgccaatggcccctctgaggccgagaaagagcagcctgcagcgtcagagtgaccggaaagggtagcactacagaaacacaagagccttgactgtcagtagatggaagcgtgttttatttcttgatgatttccagacccgtttgtcccgtactgatcttttgtagagatctgcatcaggatgtctttatatcagcgcagaacattcataattagtatcaccacagcagttgtatctttactgttttcctcttgtccaagcgtgtctttcactgagatgcctgtgatctcaagttcagatctgaaactgttaccgagagaactgaatactctatgatatgctacagcactaatatgataataatctcaagctgtgcaataagcagcaatcttgcattgctctggcatgaattcactaatctatatgtacaagatctagttgccgcatttgcaggaggaaacaacaccacacacattgcactcactctcttataccgtcagatcggtagctctacatagtcgccagttcacaagcaaggaattactcaatcacatttacatctgcctggtgttgcttcacctggggctcatctcagtcaccgttggtggcacaaccgtgctgaacatgttggaatcctcggacgccgagttcttgaacctgtagttgctggaaacggtggccctggacccggggctcctcctgctgctctcgtggaggtaacctggcgccgtcagctcgctgtcgttgatcctgatgggcttggacagcatggtcacgacctggggcatcgtcggccggcgagcggcggccgcctgtaagcagaagagggccaccttgatgtacctgatgacttcttcctcagggtaatctacaagggttggatccaccagttccttaaggctctttgcttcatatagctcccatgtcttctccaggagaaccttgtcatccatcaatatgctcctggaactacttgtgccgctcactatctccaggacaaggataccaaagctgtatatatctgctttcttggttagctgaccatgccatgcatattcaggtgcaaggtagcctgttgttccagccactc

SEQ ID NO: 14113 - DNA, 2047 bp, Sorghum bicolor
  Clone ID: SORBI-28MAY03-CLUS11918_1
gcacgaggctccattgacccggcagccggcacgggcgaggtcagagagagcgagctgttggccgggtcgtccctgcgctcgccagcgctgctgtcatgccgtgccgagacacggtggcaggcggcttcccaacgacgctgggcatccgcagccagcgcgtgcagcagcagaccagtccaaccaggcgggctcgtataaagaggttcccctgttccccaactttggctgcgccccgcgcatttgtctcgtctcgctctcacgctcgcgtcaccggagctctccagaagcgagccccaactgcccaagggcgagcgatccgatccccttcgcagcctcgtcaacgacgccgagaacactttgaggaatggctgaagaggatgtccagccccttgtgtgtgacaatggcactggaatggtcaaggcaggttttgctggtgacgacgcaccaagagctgtctttcctagcattgtaggcaggccacgccacactggtgtgatggtgggcatgggccaaaaggatgcatatgtgggcgatgaagctcagtccaaaagaggtattctgacactgaagtacccaatcgagcatggtattgttggcaactgggatgacatggagaagatctggcaccacaccttctacaatgagcttcgtgtggcacctgaggagcaccctatactgctgaccgaggctcctctgaaccccaaggcaaacagggagaagatgacccagatcatgttcgagacgttcaactgcccagcaatgtatgtggccatccaggccgttctttccctgtacgccagtggtcgaacaactggtattgtgctcgactctggtgatggtgtgagtcacactgtccccatctacgaagggtacacgcttcctcatgctattcttcgattggaccttgctggtcgtgaccttaccgacaacctgatgaagatccttacgcacgggggttactccttcaccacgaccgccgagcgagaaattgtcagggacatcaaggaaaaacttgcctacgttgcccttgattatgaccaggagctggagactgccaggaccagctccaccgttgagaagagctacgagctgcccgatggacaggttatcacaatcggtgcagaaaggtttagatgccctgaggtgctattccagccatccttcattggcatggaatctcctggcatccatgaagccacgtacaactccatcatgaaatgtgacgtcgatatcagaaaggatttgtacggtaatgttgtcctcagtggtggctccactatgttccctggtattggtgaccgcatgagcaaggagatcactgcacttgcccccagcagcatgaaggtgaaggtggttgctcccccagagaggaagtacagtgtttggattggtggctccattctagcctccctcagtaccttccagcagatgtggatctccaaggcagagtatgatgaatctggtccgggcatcgtccacatgaagtgcttctgaatttctggagcagtttatctgttacttgtattttcagttaattgggatgcaagattgtcccatggtttctctagcattcttggttctttctggatcattgaagggctgttgaccatggagtattgtgaaaggtggtaaagtcgatcgatgttctacatgaagaaacatgtgcattacttcagcagtatagatcgtcaggtcagtttagttttttttcccccaacagcaccatatcagggcgttcctgatgtgtgcagttgatctgggtttttacacgacgcaagggtgtcggctgtcgcccatgcagtttgagtctttgagagcttttggtttctgcacttcagtacatggaacagagttcgcatttggtggccagcaccccagcgtggcatgggtgtttgatgatttgtactcggagctgtttgttttattccttttcatgaaacaggtgttattgtttgtatagggataaattgtttatccttcaaatgtcttagatactgttggatcaaacttcatttataatcatataatgccttggatttacttcga

SEQ ID NO: 14114 - DNA, 567 bp, Sorghum bicolor
  Clone ID: SORBI-28MAY03-CLUS11572_1
gcacgaggagaaaacccacgttagccgagagctcctctgctcctctcgtggccgaacaggcagagcgaccagtctccagagcgctccccatggcgtcaggagctgcggcggcccctggcgttcagaccgtggtgctgaaggttgccatccactgccatggctgcaagaagaaggtccggaaggtgctcaggagcgtcgaaggcgtgcagaacgtgacggtggacgcctcgcagcacaaggtgaccgtggttggcaccgtggacgccgacacgctgattcagaggctgtacaagtccggcaagaagggagagccctggcagtgccacccgcccgccaagaagaccgagcccgcgccgccggaggccccgccggctccgaagcctgacggtgacggcggcaaggacgctgctcctcctgctgctgctgctgcggtcgcggcggacaagaagccggaggaggcggtgaaggagccgccggctccgaagcctgccggtgacggcggcaaggatgctgctgcagctccggccgcggcggacaacaagccggaggctgccgcgaaggagccgc

SEQ ID NO: 14115 - DNA, 357 bp, Sorghum bicolor
  Clone ID: LIB3478-031-P1-K1-B11
ggcagagcgaccagtctccagagcgctccccatggcgtcaggagctgcggcggcccctggcgttcaggtgagcctccgtccatgcctctctcacctctccccacaagcactatgctcttcgatcccgtatcatcatatgagctgccaatttggttgtaaatgctaacccctcgattgctctgttctttccagaccgtggtgctgaaggttgccatccactgccatggctgcaagaagaaggtccggaaggtgctcaggagcgtcgaaggcgtgcagaacgtgacggtggacgcctcgcagcacaaggtgaccgtggttggcaccgtggacgccgacacgctgattcagaggctgtac

SEQ ID NO: 14116 - DNA, 1072 bp, Sorghum bicolor
  Clone ID: SORBI-28MAY03-CLUS15390_1
gcgctggcctacgacccggaggccgacgcgtgggcgcagctcccggacatggcggaggagcgcgacgagccccgcgggctctgcgtcgccggaaggttcttcctcgtcgtcggcgggtacccgacgcaggcgcagggccggttcgttggctccgcggagtgcttcgacccggcgacgtccgcctgggcgcccgtcgacgacctagtcgaggacggcgtgtgcccgaggacctgctgcgccgcgccgcccagggtctggctctgagcgcatgtacatgctaagtcgcgatgggcacctcgtggcgcgcgacggcggcgcggcgtggcgaccggtggcgcaggtgcccgaggacgcgcgcaccgcggcgaccgtctccgtcatcccggacgaccgcgtcgtggtcattgggtccgggtgccacggcggggatcagaccgtgtacgtgctccgcgaggaggccgggaaaggcgcgtcctggacgcgcgccgccgcaccgccggagttttccgggcacgtgcaggcctcctgcttccttgaaatctgaggtggaatgtacatgtacgtacatagtagacactacgtacttctgccactactactcatggctgtacatagcaaatcaagcagaggagcagtagtaggatctgtactgcaccgcactgtactagtgaagcatcaatggcagctctggatgccttcgttcgatcgcattttgttcggtccgatttgcaacttgggacgagctagaaactactactacctgataaggagataagtggtaccagtttcttgtttctagaaccttttgctggaactgttttcgcgagacaagcaagttttttctgtttttgggtcctgatcgtttagaagcttctgcgattgtgggcgtttatgtctcttgtcaatttttccctatccataccatacctccccgggccatatcgtcctctcgctgagaatttacaacgtcgttttcatttcccagcgttcatatcttccaccggcgtcacgcgcactatgacaagttcatccgcattcagatcaatcaaggccatttccacttccaccaaaa

SEQ ID NO: 14117 - DNA, 1456 bp, Sorghum bicolor
  Clone ID: SORBI-28MAY03-CLUS5416_1
acggcccattgccccggacttattaccgtcagttggtcctcgtcttcatctccctccgctgtccgactgtgccctgtcgccgcctctgtcctctcccagtccctccccctccatctccggtgaggcgcgaatcgagttgcatcgaatccatgggcagctcctcgaataccaacacgagcggcggggccagcgacaaggaggagaagaagaaggaggacaaggtcaaaggcaaggactcgtcggagccatccttcaaggagaacgaaagggtccttgcctaccacggccccctcctctacgaggccaaggttcaaaggatcgaaaatcatgaagatgaatggcgctactttgtccattatctcggttggaataagaactgggatgaatgggttgcaaatgaccgcttgttggcattaacagaggaaaacatgcgcaaacaacaagagcttgacaagaaccaggtagttgacaaaacaatgaagtctggacggtcaacacagcataaaccaaaaggctccaatgcagatgcaaaagctgataaagatgacactaagagtctcatgaaggggaagaaacgtaaaagtcagcctgggactgagattcaggaaaaggaaaaaagatcatcacagagtctactagtgttgcagtttcctttgacactgaagaagcaacttgtggatgattgggagtttgtctcgcagatgggtaagtttgtgaagctaccacgatcacctactgttgatgatattctaaagaagtatttggagcaccggacaaagaaggatggcaagataaatgactcctatgctgagattctgaaaggaatacgctgctactttgataaagcattgcctgcaatgcttttatataagaaagagcgagatcagtatgctgaagaagttaaaggtgatgtctcaccgtcaactgtatatggagctgagcacctattgcgcctttttgtgaaattgccagagttacttgcttttgtcaatatggaggaagatgcgctgaacaagctacagatgaaattgctggacattctcaagtttattcagaagaatcagagcaccttctttaccaccgtgtacgatgatggtcgtaaaagtgcagatggggctaaaaccaaatgattgcatctgaacgttttgtatgtaacatctttcgatggacttgtaggtgagtctggtactgttgttgatatggaaggatgtcgcttaggaccgtggcgtgtgaacattgattgctctacaatcagtttatgtaggaatgtaggatagatgccgcagatgcctgaaatacagtgcttgaactgcatgttgtgttttctttagatgttggaactgctcgcattttatgttgttgaatgtgtattttctttagatgctgttttagggtacaagcccaccttaaacattatgctaagtagactaaacccaagattactctttgggtgggg

SEQ ID NO: 14118 - DNA, 432 bp, Sorghum bicolor
  Clone ID: LIB3476-008-P1-K1-E10
gtcaaataagaaatatctgatttgtccatgcaatatgatccaaagaatgcaccaaacattctccatatttatttatttctgcaaagcaacaaacctcaagaacaatttgtccatgcaataggatccaaaagaacactgtaatatttgagcttggattcatttttttctggacccactgataaataggaattttgtacatcagctaaaagaaaacaagtaatcttagtgataaactgatctgaacaccagatgaaagtcttcttggaaatagataaccatatttgctttgcaatttttgttcaccacaactacctgagatttcattggcctgcagtttgtgaagctaccacgatcacctactggtgatgatattctaaagaagtatttggagcaccggacaaagaaggatggcaagataaatgactcctatgc

SEQ ID NO: 14119 - DNA, 1176 bp, Sorghum bicolor
  Clone ID: SORBI-28MAY03-CLUS60672_1
cgcccgcgcgccccgcccccagcccgccgggcgcgcctgcccgtccgcgccgcgggcccggcccgcccgccgctccaagaccatgcaagtcttctccttcttgccggccgccaccaagcacctcttccgcgctcggctcgataaagcacgggagctgcggcggcgcgtcaaggagctcttcgttccgctcatcaacgcgcgccgggagtacaagaagcggggaggcgagccgaaaggggaaaccacgttcgagcactcgtacctggacacgctgctcgacatcaagcttcccgagggcggcgggcgcccgctcaccgacgatgagatttgcatcccatgctccgagttcctcgccgccgggacggcggcgagggcctcgacgcggcgggcgatcatggcagagcgtggcaaaaacccagccatccaggagaagctctacaacgaggtaaaggctgccgccgacaacgacaaggaaggggtctcagaggaggacgtccacaagatgccatacctcaaggcggtgatcctcgaggccctccggaagcacccgccggcccacttcgtgctgccgcacaaggcggcggaggacatggaaatcggcgggtacctgatccccaagggcacgacggtgaacttcatggtggccgagatgagccgggacgagcaggaatggaagaacccgatggagttctctccggagaggttccttcccggcggcgacggcgagggcgtggacgtgacgggcaccaaggcgatcaggatgatgccgttcggcgtgggccggaggatctgcgccgggcttggcatcgccatgctgcacctggagtacttcgttgccaacatggtgctagagtacgagtggaaggaggtgcccggcaatgaggtggacttcgccgagaagaacgagttcactgtcgtcatgaagaagccgctacgcccacgccttgtccctaggaggtctcacttgaactagaactattttactgttctattgtatggtttcttgtattgtgatgaaactgttttactgttctattgtatggtttcttgttatgtgatgtatataaacatcagtgtactattcataactggcaaaaattctggttcttcaataattattcggcagagaatgtacccttcatggaaaaaaaaaaaaaactcgagactagttctctc

SEQ ID NO: 14120 - DNA, 1095 bp, Sorghum bicolor
  Clone ID: SORBI-28MAY03-CLUS66489_1
ttggggtcaaagaaaaagaacgcaatataggatggtgcacgaacatccgaattccaaggccaactatctacaacgtggtattggagatgactaccaggatgggatatgaggtgcgtttggtgcggattacagaaatggtccatgacgcatactattctcgactgtatcttgcaaagattgggaatgaccaagacactattagttttgacctcaagccatcggatgctatcaacattgctttccgttgcaaggtccctatacaagttaacaggcgtattgcatataacaatggattgaaagtcgtgcaaccaaaggtggctgagagttatgtaggctccgacgacattcaaatcacaaggcttgacaggcctgatgaccaacattgcagtgaggcccaagagtttgatttggtccggaatatgctcatcgctgcagtggaagaacgctacaaagatgctgctcaatacagagaccaactttccacgttgcggtcaaagaaaaagaacgcaatataggatggtgcacaattcaacttgttaggccttgatgggggtgtacataggaggccttttgctgaagcacatgaagcttcagcaaacatctaagaagcaccatgtaaatacctacagaatatatgtatagacacacggatagtataattctggattctttaattagcgcatagttacagtgattgtactcaaaccccttttggttgggtttccctgctttggcttccaaaaaacaaaaggcaaccaaaggggtgagaatttataggtacttctgcaaccaaatgggtgagaatttataggtttttggggtaaaagcagcttgaagagtatcgagcgtccactactacagaaatgaccattacgggtagctatatcgccgctgtttgtttttaaatcggcaatcggttatgaagaaaaaatagcatcactatcggggttcgacgaattacatgttggtgttcaaaaccagtctagtgtgaggattattttttagagaaattgaataggaccccaacttacataagagacttgtgaggatgtttcaaagaaggatcatataattcttagtgtatgtcaaatcaaa

SEQ ID NO: 14121 - DNA, 1154 bp, Sorghum bicolor
  Clone ID: SORBI-28MAY03-CLUS672_1
cgcccgggccgccctccctccccttccccgggtaggcgtcgtgttcagcgccgagaggtccctgagccacgtcacttggtacgggcggggccccttcgagtgctacccggaccgcaaggcggcggcgcacgtcggcgtgtacgagagcagcgtggaggagctgcacgtgccgtacattgcccccgtggagtgcggcgggcgggcggacgtcaggtgggtggcgctccgcgacggcggcgggctcggcctgtacgcgtcggcgcacggcggctccccgccgatgcaggtgagcgccagctactacggcgccgcggagctcgacagggcgacgcacgtccacaggctggtgaagggggacgacatcgaggtgcatcttgaccacaggcacatggggctgggcggcgacgacagctggtcgccgtgcgtgcacgagcagtacctgctgccgccgacgcggtacgccttctccctgcggctctgccccctgctgccgacgtcgttgtgccatgacatctacaggtctcagctacccagctgatggtgccggaggcccgtgaagagagaggcaggcccatcgagccttgcgaaacaacaatgaaccagagacgcattcgatcctgcaatggactggccagtgaattattatattataaataatatacaataaatcagagacgcattcgcgttctctatcaaggaatcgccggacaacaccgtggagttctccaccgtctactacggcgttcccgggcacttgccgaagcctgacgacgaagcctccgagtccattctcttccgggtgaagatggtctgccggatccacgagtcaggcgacgtggttctcgactacgaggtgcatcttgaccacaggcacatggggctgggcggcgacgacagctggtcgccgtgcgtgcacgagcagtacctgctgccgccgacgcggtacgccttctccctgcggctctgccccctgctgccgacgtcgttgtgccatgacatctacaggtctcagctacccagctgatggtgccggaggcccgtgaagagagaggcaggcccatcgagccttgcgaaacaacaatgaaccagagacgcattcgatcctgcaatggactggccagtgaattattatattataaataatatacaataaa

SEQ ID NO: 14122 - DNA, 990 bp, Sorghum bicolor
  Clone ID: SORBI-28MAY03-CLUS6879_1
gcacgaggccaccgtccgaagcaaagcgagcacgaggcagcacaagcgcagagcgcagagcagccaagcgccacacgccgacgccgaaccaaccaaccaaccagctggtagtagtagtaggttctcgcccttcgccgcgatgcctcgctgcgcggtcgtcgtcctcttcgccgcggtgctcctcgcggcctccgccgccgcggtctccgggttccacctcggcggggacgagagcggcctcgtcaggggcgtgctcgccgcgctccgcgagcgggccgaggccgaggacgccgcgcgcttcgccgtcgcccaccacaacaagaaccagggtgctgctttggagtttacaagggtgctcaaatctaagcggcaggtggtgaccgggaccctgcatgacctgatactggaggcagctgatgctggaaaaaagagtctgtacagagcaaaggtttgggtgaagccgtgggaggatttcaagtctgttgtggagtttcgccttgttggagactctgaatctgaatccgagtcttctgtcacttctgatgttagctctgggcaagcgattgccaagctctctcttgaagcagacattgcacaagaggaggctcacctgcacaccattgagaatgatggactttccggcgatttcgcatcatcctcttagacatacttggtgtgactaggattccaggcaaggatggaaagcgtgaaggttttaaatgaagttttaggtatttagaatgctatatcgtagattgctgtcaagctgaaatgctttgccttgtttactggaatatgtatatttcgtttgtaacgtgggagcatagaactgtatgtttcggttttttgcactgtccatttccgtgtctgtatataaggaggttctgtctgtgtacggcagagtacttcaactgcatatatatatatatgtaatgcaaaattgtcgtctggtttcaagtaaattctatccaacaagacgaaattctgttc

SEQ ID NO: 14123 - DNA, 2349 bp, Sorghum bicolor
  Clone ID: SORBI-28MAY03-CLUS6823_1
ccggactaaccacgccatcacttcttccgttaactgcattctccgcgcggcagtggcagcgggagggaggaccagcagcggccgcggcgacctggtggtggtgcgccggcagcggcaggaggtgggtttcggcggcttcggcctcagcgaagggcgagatggagagcacgctcaaggggatacgcggcagcgacgcgccgtgcgtgctggacatggacgacgcggccaccgtggcgggcggcgtcgaggacacctacggcgaggaccgcgccaccgaggagcagctcgtcacgccatggaccgtctccgtcgccagcggttacaatttgctgagggatccccgttacaacaagggacttgcgttcacagagagggagcgtgagacgcactacctccgtggccttctgccaccagctattgtatctcaggagctccaggagagaaagatcatgaataatatccgacaataccagttgcctttgcagcgctacatggccctcatggacctccaggaagggaatgagaggcttttctacaagctgcttattgacaatgtggaggagttacttcctatcgtctacacaccaactgtaggcgaggcctgccaaaagtatggatccatttttagtcgtcctcagggtctttatatcagtttgaaggagaagggaaagatccttgaggtgctgaagaactggccagagaggagcattcaagttattgttgttactgatggtgaacggattttggggcttggagatctcggatgccagggaatggggattcctgttggtaaactttccctttacactgccctgggaggagttcgtccatctgcttgcttgccaatcacattggatgttggtacaaataatgaggagctgcttaatgacgaattttacattggcttgagacaaagaagagccacgggccaggagtacactgattttctgcaagaatttatgagtgctgtgaaacaaaactatggggaaaaagtgctcattcagtttgaggattttgccaaccataatgcttttgatctccttgcaagatatggcaccactcaccttgtattcaatgatgatattcagggaacagcttctgtggttcttgctgggcttattgcagcccaaacactacttggtggttcattggcagatcacacttaccttttcctgggtgctggagaggctgggacaggtatcgctgaactaatagctcttgagatctcacgtcagacgaaagctcctatagaggagtgccgcaagaaaatctggcttgttgattcaaagggtttgattgtcagtacacgaaagggctcccggcaacacttcaagaaaccatgggcccatgagcataaaccagtcaacaacctcttagatgctgttaacgctatcaaaccaacagtgttgattggcacatccgggaaggggcaaactttcacaaaagacgttattgaagcgatctcctcatttaacgagagaccaatcattcttgccctttcgaacccaacgtcgcaatctgaatgcacagctgagcaagcttacacatggagcaagggccaagcagtgtttgcaactgggagtccatttgatcctgtggagtacaatggcaagatacatgttcccggacaggcaaacaatgcctatatcttcccagggtttggccttggtgtggtgatgtctggggctatccgcgttcatgatgacatgcttctggcagcatcggaggctctggcccagcaggtcacagaagaaaattttgaaaaggggctcatttatcctcccttctcaaacatcaggaagatctctgcccacattgcagccaacgttgcagcgaaggcatatgaacttggtttggcaagtaggcgccctcggccaaaggacctggtgaaatttgcagagagctgcatgtacagccccatttaccgcaactaccgctgaatgcgaatcaactccagttatgtacaatcagtagccttgcatcaactgcaagatttcctaagaatacaacttggttcagtcttccatgcttcaatacggctacctctaagctttctagcatagttgtttcacgtcctgttctgcccctatgtattccgcagtgtttatcttttgcgatgtgatgtaaaatagccccggttaggcttttggatcctagtcaatcatggcactgctgccgtccttccggagaaggataaatttggaataaagtttgaatcgacgattcctccgtcggtactgcgtctacgttcacctcgacgttttttgcttgacacttgctattgttttcagcgagtgcttggttgtatgcgtgtttgttggtaacaccaggaaagattcgtcccccctt

SEQ ID NO: 14124 - DNA, 1248 bp, Sorghum bicolor
  Clone ID: SORBI-28MAY03-CLUS7127_1
tactggctctcgcgccgcctcgccgggcctcctccctccgccggatccgcccggacggcccagcgccccgacgacggacgcccggcgccccgacatcctagcgttgccgttgccgatccccttaccgcacgcagcttcgtcaaagacacgcggaaaaagagagaagagaaagggggaggcgattcgacctaggcccggttccgatttgcgcgtccagatttaccagcaatggcatcatcttcggacccatggatgaaggagtacaatgaagcatccagacttgctgatgacatcagttccatgattgccgatagagggtctcttccacaatcaggcccagaaattatgcggcatacttcagccatccggagaaaaataactattcttgggactagactggatagcttggagtcattgcttggtagaattcctccaaagtcaatcactgacaaggagatgcataagcgccaagacatgctttctagtttgaagtctaaagcaaagcagatggcaacaagtttcaacatgtcaaactttgctaacagggaggatctgcttggtcagagtaaaaaggcagatgacatgagcagagttgccgggttagataaccaaggaattgttggccttcagaggcaaattatgaaagagcaagatgagggtcttgagaagctggaagagacagtgctgagcacaaagcatattgcgttagcagtcaatgaagaacttaccctgcacacaagattgatagatgaccttgaagatcatgttgatattacaaattcacgtcttcagcgtgtgcaaaagaggcttgcaattctgaacaagcgcaccaaaggtggctgctcatgcatgtgcctgcttctatctgtcgttgccatcgtgattcttgcggtcattgtttggcttctcgtcaagtatctgtaaagaaaagaaagaagcagtcggccaccctgcagacctctctcgaaatgcccctcgtgttaccagcggcctttgcttgaaaagtcccttctgtgctactccactgaaacgtgcagccctttaaaaataatatatatacggtggtttcatctcccctttgtgagtgaaatgtgcagccctttaaaagtaatatatatacagtggtttcatcttccctttcgtgagtggaatggttatgtacatcgaatttggcagacatgtgtatggcgtttgtcagtttgcagtgacaagtgtggatttattctgtgctataagcactcttctctc

SEQ ID NO: 14125 - DNA, 1347 bp, Sorghum bicolor
  Clone ID: SORBI-28MAY03-CLUS74252_1
gcacgagggtcccacatctgtccacaaaaggccaatccccctcggcagtaccgcaaccgcgcaacgcaaatcagcgatcgcatcgcactcgcaccacactcagagtcagggtcacagcctcacaggccagatccccgcggcggccatggccgagaacttccagctccagagccggcacggcaagtcccgcgtccgcgtctcccgcgtctggcgccgcccggccgcggcggggggccacatcatcgtcgagtggaacgtcgccgtcagtatcgtctccgactgcctcccctcctacatctccagcgacaactccgccatcgtcgccacagattccatcaagaacaccgtctatgtcaaagcgaaggagtgcacggaagtggtgtccatggaggaattcgccgttattcttggaaggcatttcacctcgttgtaccctcaggtttcagaggccacggtgactatcgtggagcgcccatgggaccgtgtcactgtcgacggaaagcctcattcgcatgggttcaaagttggtgttgagaagcacagcacagaggtcattgtcaaaaaatctggaagcctgcttataaattctggaatccaagggtactcgctgctaaagacaactcagtctgggtttgaagggtttgtgacggatcgctatagacttcttcctgatacaagggaaaggatagtagcaacagaagtaactgcttggtggaggtatccttttgaacatgtttcgcagctcccatcgaaaccattttgctttacgcaaagatatcaggatgtaaagagagttcttacagagacgttctttggtcctgctgatgttggtgtgtatagtccatctgtacagaatacgctatacctcatggccaaagaagttcttacaaggttcccagatatatcgtcagttcagcttagaatgccgaaccttcactttctgcctgtcaacttggggagcaaagaaactccgttggtgaagtttgctgatgatgtgtacctgccgaccgatgaaccacacggtaccattgaagcaactttgagccgtcccatgtcaaaactgtaagaatgtagtcatcaggctggtagcctggtatgagactcctgtttcgtctccccagcattcccaggccaaaatgaacaataagctgtaaggaaaagataaactatcataagtcataaccccgatgctatatgtgggggtaataagtggacagtcttgtgttggatgttgtcagctgtaggcgtccagcttgtgagttgtgacgtttcgccactgtaaatgtgtacattgcttgtcttgtatggaaacctgttaacatcttgaaagcttgctcaattttgctt

SEQ ID NO: 14126 - DNA, 2074 bp, Sorghum bicolor
  Clone ID: SORBI-28MAY03-CLUS7697_1
aggagacaccgcgcccgccaccaccaggcgcacgcaccgcctcctccgctacccgatcgatccaagtaaccctagcgctagattaaaccgtgtcctcgatcgccgccgctgcattccgtttccgcaatggcgctctccaccaacgccgccgccgccgccgccgccatctccggcgggtccgcgtccgcgtcgcagccggcccgtcgcacgccctcgtctctcctcccgctgacgcgccgccgccgcgccgtcgtccgcgccgtgcacgccgcggagccgtcgaagaaccccggcgtcgtcgtcccggccgccgccaaggcctcgtcgccgacgacggtcgcgcctgagaacgacgcggcccctgctccggccccggcccgtgcgccggcgaagtgggcggtggacagctggaggacgaagaaagcgctacagctgccggagtatccgaacccggcagagctagaggcggtgctcaagaccatcgaggcgttcccacccatcgtcttcgctggggaggcgcgccacctggaagagcgcctcgccgacgccgccatgggacgcgccttcctcctccagggcggcgactgcgctgagagcttcaaggagttcaacagcaacaacatccgcgacaccttccgcgtcctcctgcagatgtccgccgttctcatgttcggcgcccagatgcccgtcgtcaaggttggtaggatggccggccaattcgcgaagccaaggtcggatccgttcgaggttagagatggcgtcaagctgcccagctaccggggcgataacattaatggcgaggcattcgacgagaagagccgtgtccccgacccacagaggatgatccgcgcgtatgcgcagtctgccgcaacgctgaacttgctccgcgccttcgccaccggaggctacgctgccatgcagcgcgtcacgcagtggaacctcgatttcaccgaacacagcgagcagggcgacaggtaccgtgaattggcacatcgggttgatgaagcccttggcttcatgtctgcagctggcctaacaccggaccaccctttgacgacgaccactgagttctggacctcacatgagtgcctcctcctaccttacgagcaagctttaacccgtcaagactccacctctggtcttttctacgattgctctgcccacatgctctgggttggtgagcgcactcgccagcttgatggcgcccatgttgagttcctcaggggtattgccaaccctcttggcatcaaggtaagtgacaaaatgaaccccagcgacttggtgaagctgattgatatactgaacccaacaaacaagcccgggaggatcaccgttattacaaggatgggggcagagaacatgagggtgaagttacctcaccttatccgtgcggtccgccaggctggacaaattgtcacctggatcactgacccgatgcacggcaacaccatcaaggctccttgtggtctaaagactcgtccatttgacaatattctggctgaggtacgggccttctttgatgtgcacgagcaagaggggagccaccctggaggtgtccaccttgagatgactgggcaaaacgtaactgaatgcattggcgggtcacgcaccgtgaccttcgatgacctgagcgaccgctaccacacccactgtgaccccaggctgaacgcgtcccagtctctggagctcgcgttcattatcgccgagaggctgaggaagaggaggatccggtcatcgtccgggctcaacaacatcttgcccttgccgccttttggtttctgatgaatcggtagacggggccagaagaaggagagatgtgtgcatgtattccattcgttggtgttatgctcttggtaaaaaatcatatgccctgagcttagtagtgcacgctggggaggagctgcttgaatttttatcgtttgccttggtaaatactactgctatgtaatgctatgactgcattcgtcgacactaagttttctatatatttatatatcttgtatgtataagagaataatactgccatgtagaagagttggctttgtgaataagttactgtcagttgtttgcttcc

SEQ ID NO: 14127 - DNA, 1355 bp, Sorghum bicolor
  Clone ID: SORBI-28MAY03-CLUS2893_1
taccggcccgctcgctaactactcgccgcagccaggcagacgagacagacagatccccttcccctgccgccgccgccgacccccccaaatcaaaaccctagctagaccccaagacacaagcacaagcacaagcagaagcaggcatggccaccatccccaccacagattccggcctcctcctcggttcctccgctctcctccggaggactaggagggccgcctcgtccgccaggcttcccgccgccgcccgccgtcgcccgcagctcctcgtgcgcgcctccgccaaggagatcgccttcgaccagggctccagagcctcccttcaggccggcgtcgagaagctcgccgccgcggtcggcgtcaccctcggacccagaggaaggaatgttgtcctggatgagtttggaacccccaaagtggtcaatgatggagttaccattgctcgtgctattgagctcgcagatcccatggagaacgctggtgctgcattgattcgtgaagttgctagcaagacgaatgactcggctggtgacggaaccactaccgcctctgttctcgctagggaaatcataaaattgggtatgttgagcattacttcaggggcaaatccagtgtcagttaagaagggcattgataagactgttcagaaattggtggaggaacttgagaagaagtccaggcctgtcaagggtagcggggatattaaagctgttgctgccatatcagctggaaatgatgaatttgttgggactatgattgctgaagctattgacaaggttggccctgatggtgtcctctcaatcgagtcatcatcatcatttgagacgacagttgaagttgaagaagggatggagcttgacagaggatatatctcccctcagtttgtcaccaatcctgaaaaatctactgttgagtttgaaaatgctcggattcttgtcactgatcagaagatatcatcgataaaagaaatcattcctctgttggagcagacaacacagttaagagcaccacttcttataattgcagaggatgtaagtggcgaggcgctggcaacattagttgtaaacaagcttagaggaattctaaatgtggctgcaatcaaagctcctggctttggtgagaggcgtaaagctcttcttcaggacattgccattgttacaggtgctgaatatcaatccaaagatcttggtctactagttgagaatacaacagtagagcagcttggcatagctcggaaagttacaatctcaagttcctcgactaccattatagcagatgctgctagcaaagatgatatccaagccagaattgctcaactgaagagagagctttctcagacggactcggcttatgac

SEQ ID NO: 14128 - DNA, 1887 bp, Sorghum bicolor
  Clone ID: SORBI-28MAY03-CLUS30167_1
gcccgaggctcccccccgcctccccccctctcgccccccccctccccccagcctcgcttctctctccagtcccctgcgcagcgcgcgactcgacacgggtcaagctcccagccgccgccggcggcgatcgccggagctcggtgccggtgccgccgagcacgctccgcgcggaaccatcgtgaggaccgggagcatgcggcggtcctcgacgctgacgcccgcccgggcgtcggccccggcctccacgctgtctcccgccgccttccgcccgcccgacgaccgggtcttcggcgccgaggccgtcgtcgcgcgcgccgacttgtaccgcgcgatcttcccggtggccgaggatgttgtggcggtcgagtggctggacatcgatcaggtcaataacaacatcgatgaaatacatagggaggcgctagttatgagcttgatagttcagcctaatgtcatcagggcttactgctaatttgttgtggagcacatcccttgggtgataatgccgttcatgtcagagggatcttgttttcgctatcccaatgtcttctagcagggaggtttcggtgtccctgtcagcggctccgttagaggtgaaacgcatagggcttgggattaccttcaccggcagggtcaaatgcatggtgatgtcattgttgataatagcactatagatgatcttggggacgttggtgtctcagctttcatgtttgccaggggtgtgaggcatagggctgggaatacattagttggaactccattctgggtggctccagaagtgctccagcctggaactcgatataatttcactgcttatatatggtcatctggaataacttcactggagctgactgctgttcaagttcccttttggaaggaccctcccatgaaggttcttctcatgacgctccaaaatgctcctccaggtcttgactatgaccgtgataaaaggttctcaaagtccttcaaggaaatggttgcgatgtgcttggtgaaagatcaaacaaagaggccaacagccgaaaaattacttaagcattcttttttcaagaatgtaaaacctccggagctaactgttaagagcattttgactgatttgccccctctttgggaccgtgtaaaggcactccagttaaaggatgctgcacagctagctttgaagagaatgccttcttcagaacaagaagcactttctatgagtgagtaccaacgaggtgtcagtgcatggaacttcgatattgaggatctgaaggctcaggcatcactgatttgtgatgctgtgcctcctgatgacgagccaccagaaataaaagaagacgaggacattgcaagaaacattgaggctgctaaggatttatcttcacggaaaccatttgggaaagtcatctgcaaatgaatgcaactccaggcagcgagcctttgccagcactttaaattcggatggaaacagccccaccacaaacgaagcttttgattttgatttcgattttagcgatgctgacactacaagaagggctgatggatacgaaagcaacataagagagaatgattcgttgccctctacatcaaagcgagatccagagtcgaatcattggacaaatgacggttggcagagacaactgacttctggtgggagcaatagctcagcaactgaaaggggctatggttttgagagggatgcagctgtgcaaatgatatctgacaaacaaagaagtgagatgagaaaaacagcaagccttagtggtccactttcactgccaactcgtgcttctgcaaatagtttatcagctcctattcgatcttcaggaggttatgtagattcgtcaggtgacaagtccaagcgaagtgtagtagagattaaaggtcgcttttcagtaaccctcgtgc

SEQ ID NO: 14129 - DNA, 1647 bp, Sorghum bicolor
  Clone ID: SORBI-28MAY03-CLUS8201_1
gctctgggcttttgcgctgcctacttttctgttggatttcctgactccacaagggtctctttaataataagttctaactactttatattatcctctttgttttttctcatttcatgtttgaatcagtttagtatcgcctacaggtgtccgggattctatcccctcgagtgaacattgaccccccagtttctaccacgatttcctatctgtaaatcttgcaaacatatgtgtgcttcataatactatggctctatattggtaaaatttcagatattcaaacaactgaggtcgccccgaaatgtaaaacttacatgttgatggagaaggacaactcgaggccacaacttcgcagcatgtttactcattttaagagcatgaaatcaatgtgaacctggttaactacttctgtttaaattctttaaatctgacaagcgtgaccatatcgacaattttactttatgtagctatagatatggccacctcgtgggcataatttcgtagcatgtttatggatttttagaccttctctgtactttttacgctttaaaatatttttgctcaaatttagtctattttctttgcgtcagaaaactaagtatattgcttcaatctggtgtcccctatgttactgtttttgtgtaatggccatgatagccatgacctctgaacattcgtcattaccttactttgcttgtgtacttgcattcgggttcacccgctcttgttttggcataactgaggaaatgctcatgagctatggttgttcttccttttacatctatgtgctatattcatggctgaggcaatgatcatgagcaatgtttattctattttgggcatctctttgtacaaagccgatgggtttggccaccccttggctgtagccatggtagcagcttttttctagttgtgtgatcccagttagtgagagatagtagtatttattgcctactcgctttgcttattaggtcagacagcttgccattgaagttagcttcgtatggtgttgcttgtcatgatttcatccattctctactttggtcatcgactttggttttccagtcagacgtgcttatgatcattgtttatgatgtcaataatcacataattgtgcagtctaagattgtgcctactgcctgtgaagtggtaaatatgttcttgttcattataggcttgtgatcattgtctttgaccgttgcttctgatgtcaaattacgaactgttgtttctgagcactggccctattcccaaagattatattgtcaaagcactttgcttgtctgtgatcgtttttgcttctctttctctttgacttttgagtacaattatgtgcactgctgttcttccagctcaggtgggatacaacaaaggtcattgttttcttggttcggaagttcatctaaacttaggtttgtttccagtgtgaataaagagtggactacaatgttttaggtttgcaggaccagttctagttttccaagtgtccctgctccaatactgcttccatgcgtgctcgacagttgggaattactaaatttgaaaaagcatgctcattataagcatctgtggtgaggcagcaaaaattgtcggggctctctatccagaaaatgactatcacagtcccccttgcctcctttgaaacattga

SEQ ID NO: 14130 - DNA, 2546 bp, Sorghum bicolor
  Clone ID: SORBI-28MAY03-CLUS8853_1
gcacgagggggtggcgaggtgcgccagaggtctcaggtgggaggcccacaggagcagggggaggtcgctcagggtgaggtgcgatgcggccgtcgccgaaaagcccgccggggaggaggcggctggggagcagttcgagtaccaggcgcacgtgggccggttaatggatttgatcgtccatagtctgtacagtcataaggaggtatttctccgcgagcttgttagcaacgcgagtgatgcattggataaactgaggttccttggcgtgactgattcttctttgcttgctgacggtggtgagctggaaataaggattaagcctgaccctgatgctgggacgattactatcactgacactggtgttggtatgactaaagatgagctcaaggactgccttggtaccattgctcagagtggcacctcaaaatttctgaaggccctcaaggaaaacaaagaccttggggcggacaatggtctaattggtcagtttggtgttgggttttactcagcttttcttgttgcagagaagattgtggtgtccaccaagagtccaaaatcagataaacagtatgtgtgggaagctgtcgctgacagtagctcttatatcatcaaggaagagactgatcctgagaaaatgcttacacgtggaactcagattactctgtttctaaggtctgatgataagtacgagtttgcggacccttcaaggattcaaggcttagtaaaaaactactctcagtttgtgtctttccccatatacacatggcaggagaaatcaagaactgttgaggttgaagaggatgaagagccgaaagaaggtgaagaggcaacagagggtgagaaaaagaaaaagaagaagactgttactgagaaatattgggactgggaactagccaatgaaacaaaacccatatggatgagaaatccaaaggaaattgagaacaccgaatacaatgagttctataagaagacattcaatgagtttttggacccccttgcccacactcacttcacaacagagggtgaggtggaattcaggagtgttctttatgttccaggcatggcaccgcttagtaatgaggagataatgaatcccaagaccaaaaatatccggctatatgttaaaagagtcttcatctctgatgactttgatggtgaactgtttccaagatacttgagctttgttaaaggtgtggtggattcaaatgaccttcccctcaatgtttctcgggagattcttcaagaaagtcgaattgtaagaattatgcgcaagcgacttgtcaggaagacatttgatatgattgaagagattgccgaaaaggaagataaggaggattataagaagttttgggagagctttggcaagtttattaagcttggttgcattgaggacacagggaatcacaagcgccttgctccattgttgcgcttccactcttctaaaaatgagggagacacgataagtcttgatcaatatgtagagagcatgcctgaaagtcaaaaggcaatctactacatcgctacagatagtctccagagcgcaaagactgctcctttcttggaaaagctggtccagaaagatattgaagttctctaccttattgagccaatagatgaggttgccattcagaacttgcagacctacaaagagaagaaatttgtggatatcagcaaagaggatttggaattgggtgatgaagaggaagagactaaagaaaccaagcaggagtttactctcctatgtgattgggttaaacaacagcttggtgacaaggttgcgaaggtccaaatatcgaagcgtttaagttcatctccatgtgttcttgtatctggcaagttcggttggtccgctaatatggaaaggctcatgaaggctcaaacacttggtgacacatcaagcttggaattcatgaggggaagaaggattttcgaaatcaaccctgaccacccaattatcaaggatttgagtgctgcttgcaaaaatgagcccgatagcacagaagccaagagggctgttgagctcctatatgaggctgctttaatctcaagtggatatactccagagagtccagcagagttgggtggcaagatctatgagatgatggcgattgccctcggtgggagatggggaaggtccgacatggaggagactgagacatcaatgagtgaggccagcgcagagtcagactcatctgaaggcaccgtaacagaggtgattgagccctcagaagttagacccgagagcgacccatggagggattagtgagttctcccacggctaggctttgttagaacttcatatttagcagttccgggggtaaaattaaggccatgggctagaacattatttggttacagatacttctatacgggttcctgccgtggcattttttgtaggtgtagacttgctggccactaacattttattgaggtagtagtggccttagaaaacaataaagcatgaagactgattacatagcaaaattgtgctgcccctcaataataatgaaaaagaagtttctgcactgctgttttcacattctccc

SEQ ID NO: 14131 - DNA, 1915 bp, Sorghum bicolor
  Clone ID: SORBI-28MAY03-CLUS8920_1
ccgcttctgataataaccgattcacttccaccactccaccgccaccacctgtcgccggaggccggaccagccatgcggcccgccggccggctactcctccgggtgctcccgctcctcctcctggcagccgcaaccgccggctcgtgggaggacggccatgggagcatcctccgcctcccctcctcctcctcctcctcctccccgcgccggttcccccgctccgccgccgtcgacctgatccgcgcgctcaacctccacccctccgacgcctccccgccctcctccaccgccggcgtcgagggcgccctcgcctccgcggggaccctcgtcgagaggcccatccgcctcgcgtccttcgcggacgcaggcgacgccagcacgtcggtggaggacctcggccaccacgcggggtactaccgcctccccaacacccacgacgccaggatgttctacttcttcttcgagtcgaggggccaggaggacgaccccgtggtgatctggctcacgggcgggcccggctgcagcagcgagctcgcgctcttctacgagaacggccccttcaacatagcagacaacttgtcgctcgtatggaatgatttcggttgggacaaggcatcaaatcttatctatgttgaccagcccaccggaactgggtttagctacagctcggactcgcgtgacactcgccacaacgaagctactattagcaatgatctatatgacttcctgcaggcctttttcgctgaacacccaaagtatgctaagaatgatttcttcataactggggaatcatatgctgggcactacattcctgcctttgcaagtcgtgtgcaccagggaaacaagaacaatgagggcattcacattaacctgaagggttttgcgatcggcaacggtctaacagatccagcaatacagtacaaggcgtaccctgattacgcgttggatatgggattaattacaaaaacacaatttaacaggatcaataaaattgttccgacttgtgaacttgctgtcaagctttgtggtacctctggaacagtatcttgccttgctgcgtactttgtctgcaatacaatattcagtgccatcaggacaatcataggcaataaaaattattatgacatcaggaaaccatgcatcggaagcctgtgctatgatttcaataatttggagaaatttcttaatctcaaatctgttagggagagcctaggagttggggatatagagttcgtttcatgcagcccaacggtctatgaggccatgctattagattggatgaggaaccttgaagttggaatcccagaactccttgagagcgacatcaaagtgttgatttatgctggagagtatgacctcatatgtaactggcttgggaactcaaggtgggtaaattctatggaatggtctggaaaggaagcttttgtctcctcagctgagaagcccttcacagttgatgggaaagaagctggcgttctaaagagccatggtcctttgagtttcttgaaggtccacgatgctggtcacatggtaccgatggatcaaccgaaagctgctctggagatgctgaagaggtggacttctggaaacctttcggagccatcttcaagctcccagaggcttgattttacaatgtaacaaacagacacgcttctcatgacatttcgaggaacgttgtcgtgcactcgtctccttggactacaatacgtagtttaccgtgtacctctggatgttcgtaggctccgaaaatatcctggtcttatgatctgaaaatctcatcttgcgaccatatatgttatttaccttgtatgggcgctccgcttgctgatgagacacggttacgagttacgactcgatgaaaatgtaataaagcttttcagggaattgctaggccaggcatattgaagaatgctcg

SEQ ID NO: 14132 - DNA, 785 bp, Sorghum bicolor
  Clone ID: SORBI-28MAY03-CLUS9455_1
gccggccgggcgcgggccgcgactcagcgccgcgcttgcgcttcctcctctccgcttccaagatgtcgaagcgaggacgtggaggtactgctggtaacaagttccggatgtcactgggtctaccggtggcagctactgtgaactgtgctgataacactggagccaagaacctgtacatcatttctgtgaaaggaatcaaggggcgccttaacaggcttccttctgcctgtgttggtgacatggttatggcaactgtgaagaagggaaagcctgaccttaggaagaaggtgatgccagctgtcattgtgaggcagcgcaagccatggcgccgaaaggatggtgtctacatgtactttgaagacaatgctggagtgattgtgaacccaaagggagagatgaaaggttctgccatcactggacccatcggaaaggagtgtgctgatctctggcccaggattgctagcgcggcaaatgcgatcgtgtaatggaagcagctagttgaagtttatttcttgtgttgagacttgagagttcttagttagacagctttcgatggccctaaagatgtttccccgcttgatgtttgtgctgctagatcgtttcctagctttgatgacatctctccatatcgataagttgttgcttagcctgacatttggcagagtttaaatgttataagttttgatatctcgtgctgttttgcattgcttttccttgggagagctgaaatcttgtgatgtgttggaatggaatccaggaatttcattggaatggtgtagattctc

SEQ ID NO: 14133 - DNA, 2632 bp, Sorghum bicolor
  Clone ID: SORBI-28MAY03-CLUS88_1
atatacagagaagaaaggggggcacgaggctcgttgatgctggcatgagcgccccctcggcgcctgggtggctgcgtggccggatacctgcggggctttcaagcttctttgtcacgggccttcaacttccatggcgatggggcatgaagtacttctgggacacattactggttggagagggaagttcttggattggtcgcgccaagtcatgtcggccctctcgtcctcgtccctgtgcggcggggacccggcgatgaggagcgtggtgtggttccggagggacctcagggtgggggacagcccgacggtggcggcggcggcgcgtgccggtggggaggtagtgccggcgtacgtctggtcgccagaggaagagggcccttattaccccgggcgtgtgtcccggtggtggatcagccagagtctgaagcacctggacgcctcgctccgccgcctaggtgcaggaaagctcgtcacgcggaggtcggccgacgccgtcgttgcgctcctccagctggtccgcgacaccggcgccacgcacgtctacttcaatcatctatacgacccgatctcactagtcagggatcaccggttgaaggagatgctggcggctgagggcatcgttgtgcaatctttcaatgcggatctgctgtatgagccatgggaagttgtcgatgatgaagggcaaccattcaccatgttcactgcattctggaacaggtgcctcagcatgcagtatgatccccctgcaccacttctgcccccgaaagagggaagaccaggtgacttatcgatgtgtccatcggaagatctgatctttgaggaagattcagagaggggaagcaacgctcttgtggcccgagcatggacaccatggtgcatcagcgcagacaaggcactgacagccttcctcaatggtgggcgctgtggtcccagtttggtcacctcctgcagcatcaggccattcagaaacttttgctgctgatgaagctgacgtttctagtaggagttatttggataggcatccacagtcgcaccggttgatgaactggagtcaattatcacagtcattgacaacaggctgggaagtggaaaattctgtgcagccaaacttactcggttagggttttctgaagatggaattcatatgtagattgtccactcaactgctcatctatagtccgatgggatgcaaaccaggcagcttttcctggtggtgattatagttgtgtaaatctcatcttctagaacgtgtgtggtcggatatagtgtggttggctttaaaaagtcactattattgatcagacaacaaaggttttgcgtattttgagcctttttttttttgggaggtatgtgatgtatgtaactgtacattcacttctgggacacattactggatgctgatcttgaaagcgatgcactgggctggcagtacatcactggctctcttcctgatagtcgagagcttgaccgcatcgacaatccgcagtttgaaggctacaagttcgacccgcatggggagtatgtccgacggtggattcctgagctcgtaaggctgccgacagaatggatacatcatccatgggatgcacctgtttccgtgctgcaagctgcaggaattgagctgggatccaactatcccctccccatagttgagctagacgcggccaaagccagactgcaagaagccctatcagaaatgtggcagctggaggcagcatcaagggccaccatgaacaatggaatggaggaaggcctcggtgattcctcagaggttccatttcctgaagaattacagatggaagtcgatcgggcaacagccaatgtggtgatgactgttcggaggcgtgaggatcagatggtgcctaccatgacctcttcattgaacagagctgaaacagaggtttccgccgatctagggaacagtgaggacactagggcacaggttccgtttcatgcacatttccatccccgagttgagagggaagacatgatccaaaatactgaaggccctgcacttagaatcaatggcactcaccaacacaacatctttcagcaacctcagaatcataggcgagaagctcttgctccatcagtgtcggaggcttcaagtagctggaccggcagagagggcgctgtggtcccagtttggtcacctcctgcagcatcaggccattcagaaacttttgctgctgatgaagctgacgtttctagtaggagttatttggataggcatccacagtcgcaccggttgatgaactggagtcaattatcacagtcattgtgagttcggatgcacggacaacaggctgggaagtggaaaattctgtgcagccaaacttactcggttagggttttctgaagatggaattcatatgtagattgtccactcaactgctcatctatagtccgatgggatgcaaaccaggcagcttttcctggtggtgattatagttgtgtaaatctcatcttctagaacgtgtgtggtcgatatagtgtggttggctttaaaaagtcactattattgatcagacaacaaaggttttgcgtattttgagccttttttttttgggaggtatgtgatgtatgtaactgtacattcccttgtgtttctcagttaaccattgttagtttc

SEQ ID NO: 14134 - DNA, 434 bp, Sorghum bicolor
  unsure (1)..(434): unsure at all n locations
  Clone ID: LIB3481-006-Q6-K1-F4
ccgtccgcagggaaggacctgggtacccgctcgttgatgcctggcatgagggacctgtgggcgacaggatggttgcatgaccggatacgtgtggtggtttcaagcttctttgtcaaggtccttcaacttccatggcgatggggtatgaagtacttctgggacacattactggatgctgatcttgaaagcgatgcactgggctggcagtacatcactggctctcttcctgatagtcgagagcttgaccgcatcgacaatccgcagtttgaaggctacaagttcgacccgcatggggagtatgtccgacggtggattcctgagctcgtaaggctgccgacagaatggatacatcatccatgggatgcacctgtttccgtgctgcaagctgcaggaattgagctgggatccaactatccnctccccatagttgagct

SEQ ID NO: 14135 - DNA, 1254 bp, Sorghum bicolor
  Clone ID: SORBI-28MAY03-CLUS9519_1
cctactggctcccacggcacctccattcccagacccctttcccctccccctcctccgccctcctcccccttctcgactcctccgacgcgcccagcgccatccggcgagctccaccgcaccaccggcggcagcgaaagtgcgggggctgagtctgtaggaggcggcggcggcggaggaggaggtgagccgagcagagtcgaggcgaggcgaggcgaggcgatggggcagcagtcgctgatctacgcgttcgtggcgcggggcaccgtggtgctggccgagtacaccgagttcaccggcaacttcaccaccatcgccgcgcagtgcctgcagaagctccccgccagcaacaacaagttcacctacaactgcgacggccacaccttcaactacctcgtcgaagacggattcacgtattgtgtagttgctgtcgaatcagttgggcgacaaatccccattgctttcctggacagagttaaggaagacttcaccaaaaaatatggaggtgggaaagcagctactgccgcagcaaacagcttgaatagggagtttggatcaaagcttaaagagcacatgcagtactgtgtggaccaccctgaggaggtcagcaagcttgccaaggtgaaggcccaagtctcagaagtcaaaggagttatgatggaaaacattgagaaggttcttgaccgtggtgagaagattgagctgcttgttgacaaaactgaaaatctgcgttctcaggcacaagatttcagacagcagggcaccaaggtgcggcgaaagatgtggctgcaaaacatgaaaatcaagcttatcgtcctgggcatcatcatcgcgctcatcctcatcatcatcctgtcggtgtgccacggcttcaagtgcggcagcaagtgaggagtggggtggtgggacttacagatgggcccgtgcctgcaccggcgagagaagaccatgtggagttttgttttgctcttttagtcgtcgtgtcgagtcctgcgctgattattcttggtggtcatcaaagggagttgttcctgatgtcggtgttgattgttgttggattggtcgggaagtgactgggtgaaccgggtgaaacgggggtgttgtgtcgtgtaattttggatgctactatttgtgcatgtatagcttgtgtgctactaccctggtccatgctgctgctactcctatatcagtagatgttacgtactacgtttgctccctggattgcaggcaatgcactgttcggctatgcccatttcc

SEQ ID NO: 14136 - DNA, 1233 bp, Sorghum bicolor
  Clone ID: SORBI-28MAY03-CLUS9757_1
ctagttctagatcgcgagcggcgccctttttttttttttttttttttttttttttttaaatctcaaaagcgtcatctatatccacaggtcaagatttcaacgattgcccaaagttactcagagacatcaatcaaataacagaacgagtgatctaacattgtgagacaaacatgtccaagttcgttcataaacatggcgcttctacaattcatggttcatggatacatgcgccttcactcagggtttttctcaacaacaggtttaagcagaagcagtaggcgcatcagtcatttcctgttcaaccggagttttctgaaccgggtagtagtggtagtgcagctccccaacatcatccccagaaagctttgtccaaccatcagggccaacatgataaacactaacacaaccaccacttgctgcatcacggaaggttgccccataaatagcccgtcgcgctaattcggcagcttcctcaactgacatgttgaagcggtaaccgtcgtccaaaacaccataagcatagagggaaccagagccaacagagaacttgtttcccacaagccttgcaccctcactgtcaacatagtacaagccagggcccttctcatcccatccagcaatcattgtaccaatcgacagtcccatcccacgatatgaataaaggatgttagccaacagtttggaagcaccagctatagagatccttcgcttgtttgaaagctcatggaggcgacacttgtttcctaggttcctatgccagaattggcaatcagcagcgcctccagccattgtccccagcatgtaaggatttatttcaataattttcctcacggtttgtgaggatatataaccgcccatgctggccctggaatcagcggcgacgatgacgcccttgtcgaagatgaaggcgagcgtggtcgtccccttcttattcttcaccatggccttggtgtccgcctggaacccgtcgaagtcgtcgcaggtggggagcaccatggacggcacgtcaggggcgccggcggagaagtacgtgtcgtcgctggcggggaaagtcatgttggcgaagttggtctcgagcgcggacatgtccaccttcatggccatggcgccgccggcgtcgtgcgtgtgtgctgcggcgaggcgatggatcgagtgaggcgttctcttctcacgctccgatttctagtctctcccttttctttcttgttttaaaagaagccgccggcggccagc

SEQ ID NO: 14137 - DNA, 646 bp, Sorghum bicolor
  unsure (1)..(646): unsure at all n locations
  Clone ID: SORBI-28MAY03-CLUS92_2
actacctaccactccggcagtccggccggctagctccataaaagcaaagcgcagccggccggccgggagcagcagccagccatggagacggcctccttcctctcggtggcgctggccctggcggccctcgtccccgtctcgctgctcctcctgaaccggctcctctacggcaagctgcccccggggccgcggcggcggcccgtggtgggcaacctgttcgacgtgcggccggtgcggtgccggtgctaccaggagtgggcgcgccggtacgggcccatcatgacggtgtggctcggcaccacgcccacggtggtggtgtccacgtcggagctggcaaaggaggtgctcaagacccacgaccagcacctcgccgaccgctgccgggaccgctcgtcggagaggttcagccgcggcggccaggacctcatctgggccgactacggcccgcactacatcaaggtgcgcaagctctgcaacctcgagctcttcacgcagcgccgcctcgaggcgctcagacccatccgcgaggacgaggtcaccgccatggtcgagtccgtctacaaggccggcaccgcgccgggcaatgaagggaagccctttgggnggaagaaccacctgtcgatggtggccttcaacaacattacgc

SEQ ID NO: 14138 - DNA, 1844 bp, Sorghum bicolor
  unsure (1)..(1844): unsure at all n locations
  Clone ID: SORBI-28MAY03-CLUS92_1
ctactggccccaaccccggcgcccgccgagtagcccagccatggacgcctccctcctcctctccgtcgcgctcgcggtggtgctgatcccgctctcgctcgcgctcctcaaccggctccgcctcggccgcctgccgccgggcccgcggccgtggcccgtcctgggcaacctgcgccagatcaagccgatccggtgccgctgcttccaggagtgggcggagcggtacgggcccgtcatctccgtctggttcgggtcggggctcaccgtggtcgtctccacctccgagctcgccaaggaggtgctcaaggagaatgaccagcagctcgcggaccggccgcggaaccgctccacccagcggttcagccgcaacgggcaggacctgatctgggccgactacggcccgcactacatcaaggtgcgcaagctctgcaacctcgagctcttcacgcccaagaggctcgaggcgctgcgccccatccgcgaggacgaggtcaccgccatggtcgagtccgtttaccgcgccgccactgcccccggtaatgaaggaaagccaatggtagtgaggaaccacctttctatggtggccttcaacaacataacaagactggcatttgggaagcggttcatgaatgcaaacggtgacattgacgaacaagggcgtgagtttaagactattgtgaacaacgggatcaagattggtgcatctctctctgttgctgagtttatttggtatttgagatggttgtgtccacttaatgaggagctttacaaaactcacaatgagagaagggaccgcttgacaatgaagatcattgaggagcacgcaaagtctctcaaggagagtggtgccaagcagcactttgtggatgcactcttcaccctcaaacaacagtacgaccttagtgaagacacagttattggacttctatgggacatgatcactgctggaatggacacaacagtcatctccgttgagtgggcaatggcagagctggtcaggaaccccagggtgcagaagaagctgcaagaggagctcgaccgtgtggttggccgtgaccgcgtcatgttagagaccgacttccagaacctcccgtacctacaggccgtcgtcaaggagtcgctccggctgcacccgccgacgccactcatgctcccccacaaggccagcacgaatgtcaagatcggtggctacgacatccccaagggcgccaacgtgatggtgaacgtgtgggcagtggcacgcgatcccaaggtctggagcaacccgctggagtacaggccggagcgcttcctggaggagaacatcgacatcaagggcagcgacttcagggtgttgccgtttggtgccggccggcgtgtctgccctggtgcgcagctcggcatcaacctcgtggcctccatgatcgggcaccttctgcaccacttcgagtggtccctgccggaaggcaccagaccggaggacgtcaacatgatggagtcccccgggctcgtcacgttcatgggcacaccactacaagctgtcgccaagccgcgcctggagaaggaggagctgtacaatagggtccccgttgagatgtgaggtgcctgactgtgactgcctgctgccgcgttgaattcactgctggatttgggcttttctcgctgctgctgctttcagctaagctgttggacagatttgttcgcgttgtaaaatgtggggtgctagatgcatttcgaatctcataaaattgccacatacagttcgtcatagtcttacacaatgtgtctttgtaattttgtaatttgtataacagtataacacggtagaacaattctgcttggacctgaaattcggactngtgttt

SEQ ID NO: 14139 - DNA, 716 bp, Sorghum bicolor
  Clone ID: SORBI-28MAY03-CLUS3739_2
gcctcccgccgccgctgcttagcgcctcactcgcccgcaccgccgcatcgccgcagggttcgcaaagatggcggtgccgctgctgacgcagaagatcgtgaagaagcgggtcaagcagttcaagaggccccacctcgaccgctacaagtgcctcaagccaagctggcgcaggcccaagggtatcgactcccgcgtcaggcggaagttcaagggatgcaccttgatgcccaacattggatatggctctgacaagaagaccaggcactaccttcccaacaagttcaagaagtttgttgttcacaatgtctctgagctggagctgctgatgatgcacaacaggacttactgcgctgagattgcccacaacgtgtccacccgcaagcgcaaggagattgttgagcgtgctgcgcaactggacattgtggtcaccaacaagcttgccaggcttcgcagccaggaggacgagtgaaatgttcagtagttttgattgtgatttgctggtgttcaagacgttactgagattggagatactgctctaccatttttatgcttatgttagacttttcctatggacaaaattatatgttatgagtaaagagtgatggagagtaccatctagttttgaccggacatcatgaagtgtggagccttgcaattgcaagtaatgataatgaatctgtgactctgaagcttatattgcaatttctgaggccaag

SEQ ID NO: 14140 - DNA, 741 bp, Sorghum bicolor
  Clone ID: SORBI-28MAY03-CLUS3739_1
gccggcggccggcccgcccccgccgcctcgcgcctcgcccgcccgctcgcttcctccgcatctcggtgcgctccgatccgaagagatggcggtgcctctgctgacgaagaagatcgtgaagaagcgggtcaagcagtttaagaggccccacctcgaccgctacaagtgccttaagccaagctggcgcaggccaaagggtattgactcccgtgtcaggaggaagttcaagggatgcaccttgatgcccaacattggttacggctctgacaagtcaaccaggcactaccttcccaacaagttcaagaagtttgtggtgcacaatgtctctgagctggagttgctcatgatgcacaacaggacctactgtgccgagatcgcccacaacgtctccaccaagaagcgcaaggagattgttgagcgcgcctcacagcttgacattgtggtcaccaacaagctcgctaggctccgcagccaggaggatgagtagtctggtttcctgtcataaggacctactggatcttgtcattcccatctgtaggaaactactgtgctttgtgtcttgttagtactgagaataccagttattcgtacctttttgctatctgtagcgactaaaatgtggcagattctgcagttaccttgcatctatcttaattatatctgcatgtcatggtttagtaggtaaaaaaaaaaaaaaaaaggcattagttgataatacacagtggtttggcttatgtttag

SEQ ID NO: 14141 - DNA, 627 bp, Sorghum bicolor
  Clone ID: SORBI-28MAY03-CLUS45982_1
gcacgagggagagagagagagagagagagagagagagagagagagagagagagagagaggcacgaggcaaggacagtcagtccatcacactggtaaagctctgcttagctcggagcttcagtgctttgttcagtccagctcgatcggcagtcacaaccacagcaccctagctgcaccaatggccaccgccgaggtccaggtcccgactgccgtgcccgtcgaggaggctccggtggtagtggaggaggctgtccagccggccgccgttgaggaaacacccaaggaggaggcctctgctccggttgtcgaagagagcccggccgccgacgagccagctccggcggcggagaccgaggtcgctaaggagccggaggcggaagctgttcctgccgagactgagaccaaggaggtcgaggtcgaggccgtggctgagccggccgaggcagagacagagaccaaggaagcagaggcggccgaggccgcgccggcagcagagacggaggaggtcaaggaagcagagcccgtggaggctgctgccgccgtcgaggctgtcccggccgagactgaggctgagccggcggaggtagcggccgagcccgaggcagcagcgccggcagagaccgagac

SEQ ID NO: 14142 - DNA, 1126 bp, Sorghum bicolor
  Clone ID: SORBI-28MAY03-CLUS6034_1
gcacgaggctatcctcctgcctcctgcgttccgcttcttctctctctttcccccttcttctgtgattctctcatacaagctgtgttcctgtccctgttcttggacggacacacatatccaatccacccgagatttcctcaatttactccagacacacactggcaacgcccggaccgtcgaatctcgcggctcaggcgacatgcctacggcggtggcggaggtgcggccggccttcggtttccccagatccgggaaggggagcggcggcgggcatgagaaggaggaggcggtcgggaagaggagaagcgacgggttcttcatagaggaggtccaggaggaggcggaggaagaggtgctgaccgatacctcgtcgatcggggcgccgtcgccgtcgggctcgtcgatcggtgagaactcgtcgtcggaggccggcgaggacgacggggaggaggaagtcgagagcaagctcaaggatggtgatgcgctcggttgcttggatgcgctcgaggactccttgcctatcaagaagggcctctcgagcttctactccggcaagtccaagtcgttcaccagcctggcggaggccacgtcgacggtggcggcggccaaggagctgctggccaagccggagaacccattcaacaagcggcgccgcatcctggccaactggtccaggcgagcctcctgcagctcgctggccacggccacctacctgcctccgctcctgggccccgaccacgccgtcgccgagggggacgagggcgaggaggacgactccgacgacgacgtggaatacagccagctgccgcaccgcggcaagaacgtcagggacgcaccggcattgccactgccgcccaccaggctcggcggcgttggcatgcataggaggaatggccttgggagcttcagatctccgaggtccttctcactgtctgatctccacaatagcagcagtactgatggtagtgattagcagccgcaggtttgcttccagctttggcctagcctcttggccagtagagatgtagtatccacttactataatatggttccggtgtataagatccaagtttgttgtgttcatcctcctagcctcctggctttctttgacctcagaacaagtgct

SEQ ID NO: 14143 - DNA, 975 bp, Sorghum bicolor
  Clone ID: SORBI-28MAY03-CLUS66321_1
ccgcgccgcgccgcggcgctgagcacctacaccaagatgacgtccgactacgtccggcaggccatccggcgagacgcgtgggtcagcatcttcggcaagctcgcggagcccaacgcggggctgatgatcctggacccctacggcggcgcgcggatccagcagcggctacaaggcgacgtccgactacgtccggcaggccatcccgcggggcgtgtgggcgaacatcttcagcaagctcgcgcagcccaacgcggggctgatgatcctggacccctacggcggcgcgcggatcggcggcgtgccggagtcggcgacgccgttcccgcaccgcgccggcgtgctgtacaacatccagtacatgaacttctggtccatggcggggggagacggcgccgtgcagaccaagtggatcagggacttctacgcgttcatggcgccgtacgtgagctccaacccgagggaggcctacttcaactacagggacctggaccttggcgagaacgtcgttgtcggcaacgtgagcagctaccaggcaggtatggtgtggggacacaagtacttcaaggacaactacaggaggctcgccatggccaagagtcagatagaccccgacgactacttcaggaatgagcagagcatcccgccacttgcgaacagcaactagtattcatcatattttccgtacatacatggtagccacacactagctagactgtatttacatgtgtttgtgtatcttgaataaatttcatgaaactacacaatgtgtgaaagtttctttagcacgaaactaagcttctttagactctccaccccgagcgtgcccttcggctgggttctgcccgccggcccgccccccgcgtgccgcaactcctatcctgcttattgtccgtacatacatggtagccacacactagctagactgtatttacatgtgtttgtgtatcttgaataaatttcatgaaactacacaat

SEQ ID NO: 14144 - DNA, 775 bp, Sorghum bicolor
  Clone ID: SORBI-28MAY03-CLUS66568_1
cgcctccccgagcccgccttctgggcacgtcctccactcctgcgtgcgaggttctgactacagcgttgcaaccaagaagccgccaacaaagcacttgctgcagtccagctagcaaatccaaagctctcccctgcagtcctgcaccatgctctgatcagtgatcactctctttctcgcgggcgaaactaaattccggtccgggggacgacggtcgacgacgatggacatcatcaacggcgccgtgctcccgagctaccacgccgcggctcccgtcacgggcgctgcggcggcggcctccgtcgccgacgcgagggtcagcggccacctccagctgctccggcgcgtgcgcgtcagaggaaccggaggcgccgggctgctgcatgcgacgacggcccgcgccggcgtgccgcgcaggttcttctccctctccccgccgcagcagcacgggcacgggaggaccggatggcggccggctcgctgcaccctcggcggctcctcctccgacggcgacggcgccgccgccgcggacttcgacgccagcggcgaggagttcgtcgactccagcgtcatggaggccgttgagctcaggagcgtgtcggacggcggtttcgtcatcaagatgcgcgacggcaagaacctgaggtgcgtgcagaacaaccctcgggtgctcaggctccgggactcggcgccgcaccacgcgattgtgctcaagatggaagacggcagcgacctcctgctccccatcatcgtcatggagacgccgagcatcatgttg

SEQ ID NO: 14145 - DNA, 1136 bp, Sorghum bicolor
  Clone ID: SORBI-28MAY03-CLUS6916_1
gcacgaggccgggaaaaaaaccactccgcaagaccacctcaccagcctcctcgcccccgatctcctcccacccgcacccaagggtttcggtctctaccgccgcggaacgagccagcgaacagggatggcggcggcgcggcacctcagatccggcctccctctcctccgcgcccacctcgcatcctccgaatccgcggccgtcgcccaggtctcgaggggcttcgcgtcgcagccggccaaacccaccggcaaggacatcaaggttccagaagctctgtatggtggcacaggcaactatgccagtgcactgttcctcacagcagctaaagctaactcattggacaaagttgagtctgagattaaaactgttgtagaggcatccaagaagagcccgttgttctctctattcataaaggacctgtcagttccaaaagagaccagggtgaaggctgtaaccgaaatatttgctgacgctgggttttcggatgttacaaagaatttcttggctgtcctggcggacaatggcaggctgaaatatattgagcgcattgcggagagatttgttgatttgactatggcacataagggggaggtgaaggttgtggtcaggacagttattccacttcccgcgaaggaggagaaagaactcaaggataccttgcaggatatccttgggaagaacaaaactattttggtggaacagaagattgactacagcatcatgggaggattagtgattgaattcgggcagaaggtgtttgatatgtctatcaggaccagggcgaagcaaatggaggcattcttgaggcaaccccttgaattctaacagcctttggataaaaacatcatcagaatgcagaggctgtgctgttgaaggtttccccatgtctgcaactttgatctggcctttgaataaaatgtttcctctaacaagtgaagggcactgtttttattgtcttgtgggctagatgcctgctgaacaatttatgttcatttcttctttacttaaagaagcatgcaccaaaaacatgaaggatgcatgccatggaaagtttttgagctccaagtcattggaacgtatgaactcctcacacaatgcatcatttttctccgtattaacattaattggcttacgt

SEQ ID NO: 14146 - DNA, 1026 bp, Sorghum bicolor
  Clone ID: SORBI-28MAY03-CLUS6463_1
ccggggtcggctccaccttttttatctggctcccccgccccctggcccggggacgcccccatttcgaagctcctcctcgcgattccaatccacgcacgcctcctccgcctccgcgtccgcctcgcgcaggcttatagtcagtgatggaacacaaggaggcgggttgccagcagccggagggcccaatcctatgcatcaataactgcggtttctttggcagcgctgccaccatgaacatgtgctccaagtgccacaaggagatgataatgaagcaggagcaggcccagctggctgcctcctccattgatagcattgtcaatggtggtgatggtgggaaagggcctgtaattgccgcaactgtagatgcggcagttcctcaagttgaggagaagactattgttgtgcagcctatgcatgtagctgaaaccagcgaggctgctgctgtaatccccaaggccaaggaaggcccaaacaggtgtgcaacctgtaggaagcgtgttgggttgacaggatttaactgccgatgcgggaacatgtactgttcggtgcaccgctactccgacaaacatgactgccagttcgactatcgaactgcagctagggacgcgattgccaaggccaatcctgtggtgaaggcggagaagcttgacaagatctgaggcgggcattggggagcgaggtggttgcaatctgcaagaattcatcatgcatctttgctgctttatcattgaacttcccattcttgtctgctgtcacatcctctgaggttcaatactgtgatgcacacagcatcctggcagctgcaagaattcgtccccagtcgagtccaaaatggtttgcgtgttggctatgtcgtgtaagcttattcagttattcatggtggtttcggtcggtattgtggcattcccatttaggtagctctgtaatgtactattgtctcatgcatgttaaattccaatcagtaatagtaatcagcaattgtctgccaatttcctacaagtatatttctggttctatttttgcgtg

SEQ ID NO: 14147 - DNA, 1165 bp, Sorghum bicolor
  Clone ID: SORBI-28MAY03-CLUS6327_1
gccggccgggcctccccgggtagcttaaacctagcgcacccgcaaccagcgcgccgccccgctccgctcccctcgccgctgcacggacgcagcgacgagttctcgcagcagcaatggcggtaggcaagaataagcgtatctccaagggcaagaagggaggcaagaagaagaccgtggatccgttcagcaaaaaggattggtatgatatcaaggctccgtcggtcttcagtgtgcgcgacatcggcaagaccctggtctccaggacacagggcaccaagattgcatctgagggtttaaagcacagagtatttgaggtctccttggctgatcttcagagtgatgaagaccaggcgtacaggaagatcagacttcgtgcagaggatatacaagggagaaatgttctcacaaacttctggggtatgagcttcactaccgacaagctccgttcactggtgaagaaatggcagacgcttattgaggcacatgttgatgtcaagaccaccgataactacatgctacgtctgttctgcattgggttcaccaagaggcggcccaatcaagtgaagcgcacttgctatgctcaagcaagccaaatcagacagattcgtcggaagatgactgaaatcatgagcaaccaagcttcaacttgtgatctgaaagaactcgtgtccaagttcatccctgaggtcattggaaaggaaatcgagaaagccacctctagcatattccccttgcaaaatgtcttcatccgcaaggtgaagatcctaaaagcaccaaagttcgacatcggaaagctcatggaggtccacggtgactatgccaaggaggatgttggtgtcaagatggacaggccggctgaaggcgacgaggccatgggaggacaggaggttgctgcagctgagtgattagtctcactgtttatgtttagtatgagttgatgttaagacgaacttcggagttggagctgccttatttccgtaaactcttagaaacacttttttcgagagtgagacatttggtggctttgattctccttgaaaatttgaagcatggaatgttatcttgcgacgtcagtttgatcaccgttatttgggcaaacttatgtttttggagcatgcattgcgttcttgctgctctagactgaagagctcgttctcattccttt

SEQ ID NO: 14148 - DNA, 2600 bp, Sorghum bicolor
  Clone ID: SORBI-28MAY03-CLUS7578_1
cctactgggctgggcggcgggtgcggagttgcagtagaggccaggactcggagagcgaggcgcagatggaatgagcgaccgggctctgctccgccgctagcctgccgccgtgccgcgccgccccctcctccgccgccgcggccgtcgatcgccgcgccacggccggtccctgcggctactccccacatccccttctccaccggcaccttacccccgcatggcgtcgtgatccgatgatagcaacaagagcgcgccttcccctctccctgacggcgtcgtccaccccgcacggcgcgcgcaccaagaagaggaggaagctatgtcccccaacctggacagcgccatcaagagccaggtgccggcgctgctcctgaggcgtctcttcggagcgtcccggcgggacgaggccaagcagctccagcggaccccggcgccggcgccggtggggaggcggcgggtgttcgtgcagacggagacaggctgcgtgcttggcatggacctggaccgcggggacaacgcgcacaccgtcaagcgccggctgcagctcgcgctcaacgtgcccaccggcgagacctcgctcaccttcggcgatcgcatcctggagaacgacctctccttcatacgcccggactcgccgctgctgctcacccggaacagcatcaaccggagctgctccaccccgtgcctctgccccgtctccaaggacttcgagcacaaggactgcagcggcctggttgagatgctcggctgctccagcagctgcgcccgggtgaagcgcctcgtcgacgacgtggtgactgccatcaggagcggcgtggatccggtctccatcagcagcggccttggtggctcatactacttcaggaacgtcttgggcgacagggttgctattgtgaagccgacggacgaggagccctttgcgccaaacaatcccaaggggttcgtcgggagggcgcttggtcagccgggcctgaagaaatctgtgcgagtgggagagacagggtttagggaggttgctgcgttcctgttggaccatgataactttgccaatgtccctgccacagctctggtgaagataacacactccattttcaacataaattgtccggtaaatggaggaaatctggcaccggctcatgaccagcaacagcaagttaacagcaagattgcttcgttccagcagttcatcgcccatgactttgacgccagcgaccatggcacttcaagcttccctgttgctgctgttcataggatcggcatactcgatatccggattttcaacactgacaggcatgccggcaatgtgctggtgaggaagcttaatggtggcacaggtcgctttggttgccagacagagctgttcccaattgatcatggcatgtgcttgccggagaacttggaggacccttacttcgagtggattcattgggctcaggcgtccattccgttctctgaggaggaactcgagtacatcaggaatcttgatccaacgaaagatgtgcagatgctgcgcagagaacttccaatgatacgtgaggcctgccttcgtgtcctggtcctgtgcacgatcttccttaaggaggctgcagctttcggactctgcttggcagagataggtgagatgatgacaagggagttcagagggatggaggaggaaccaagccagctggaggttgtgtgtatggaggccaggaagagagtagcagagtgggagcccttctctgccacagctgaacatggagaagatactgatttccaattctccatggatgtgttaggagaatacaatgatgtaatgcgatcaccaaggttcagcggcccgggttccaaggggtccagtttcagaagccctttgtctaagctcatcgagagcgttgacgagggcagtgatggccatgaagatcaaatcgagtctgatcgagtcttctatgctggatggaatacacccaacaatcctagcagcagcaaacctataggtcagaatggcattgcttcaaaaagtgccatgaacaggagtgctgatgaacaacttccatcaagtatgtgttttgtcaggctgtcggatatgagtgcagatgagtgggatgtattccttgaaaaattcaaggaactgctgaaagaggcactacacgagagcgcaaggacagcagcaggtcaaaggatgaagcagcgcctgggcacttcatgcaagttttgagtagggcaatagtgcatcagagaagaaaaatatgcagtgctatttgtactgcctgcttatggagtgagtacaggatgaagatatcatcgtatgaggcaccttcaaccttgtgcaacggtgtaggttgcaacagctatgtccagcaggtagataggaccacaagcatatgtagtgatggtgtggagaactgctacgcatgtttatattagctatatgtttaagaagggaaatgcttaataataaatgtttgtcagcctgtgtatattgggttgatgttagatactgcagccttagcatgcaatttctttcttagttgctgaaaattctttgtagcttgtgatgtgacctgtgagctgtgtaaatattgcaccttttttgtttaaataatgcttacctggtgttg

SEQ ID NO: 14149 - DNA, 1314 bp, Sorghum bicolor
  Clone ID: SORBI-28MAY03-CLUS7082_1
cctactggagccacacatacaggtacacacagcactcacagtgtcggaacttggaaggggcagaagcagaaaaccgtatacctttgcagaatgacgggtcccatggagattccggtgatcgatctcagcggcctcaacggcggcgacgagcagaggtcgcggacactggcggagctccacgacgcctgcaaggactggggcttcttctgggtggagaaccacggcgtggacgcggcgctgatggacgacgtcaagcgcttcgtctacggccactacgaggagcacctggaggccaagttctacgcctccgacctcgccaagaacctcgacaccgccaccgacgacggcgaggctgaggtggagccgccctccgacaaggtggactgggagtccacctacttcatccagcaccaccccaagaccaacgtcgccgacttcccggagatcacgccggcgtgcagggagacgctggacgcgtacatcgcccagatggtgtctctggcggagcgcctgggcgagtgcgtgagcctgaacctgggcctcccgcccggccacgtcgccggcaccttcgcgccgccgttcgtcggcaccaagttcgccatgtacccgtcgtgcccgcgcccggagctggtgtggggcctgcgcgcgcacaccgacgccggcggcatcatcctgctcctccaggacgacgtcgtgggcgggctcgagttcctgaagggcggcacccactgggtccccgtcggacccaccaagggcgggaggctcttcgtcaacatcggggaccagatcgaggtgctcagcggcggcgcctaccggagcatcgtgcaccgcgtcgcggccggggaccagggccgccgcctgtccgtagccacgttctacaacccaggccccgacgccgtggtggcgccggcggccagcatccggcgggaggacgccgacgcggcggcggcgtaccccggaccctacaggttcggggactacctcgagtactaccagggcaccaagttcggcgacaaggacgccaggttccaggccgtcaagaagctgctcggttaagcgatcgatccagcaccagcagctgcattgccagaggccagcaggcagctagcttattagttcgtggattatgcgttgcgttgcgttgcgtttcgatttcgagattgcttcttgttgatccattgtcgatctgcatagtatatgcactggggtcgcgtgtttaagtttatttagcaaatcttttacgcagtcattactggtactacgtacttgtattcagctgtggttgactatacaatgttgcggcttaattaattg

SEQ ID NO: 14150 - DNA, 576 bp, Sorghum bicolor
  unsure (1)..(576): unsure at all n locations
  Clone ID: LIB3476-029-P1-K1-B4
caaagtgcagacacatacactcacagtgtcggaacttggaaggggcagaagcagaaaaccgtatacctttgcagaatgaccgggtcccaatggagattccggtgatcgatctcagcggcctcaacggcggcgacgagcagaggtcgcggacactggcggagctccacgacgcctgcaaggactggggcttcttctgggtaagcaacaacgaatcatacatatatacatatatagctattgacaagttctttttacatgcgtcgtgctcatcaccaatataatcatctcgcgccgctcgatcgcaggtggagaaccacggcgtggacgcggcgctgatggacgacgtcaagcgcttcgtctacggccactacgaggagcacctggaggccaagttctacgcctncgacctcgccaagaacctcgacaccgccaccgacgacggcgaggctgaggtggagccgccctcgacaagggtggactgtggagtccactacttcatccagcaccaccccaagaccaacgtcgccgacttccccgagatcacgccggcgtgcagggagacgctggacgcgtaca

SEQ ID NO: 14151 - DNA, 1073 bp, Sorghum bicolor
  Clone ID: SORBI-28MAY03-CLUS7025_1
tgcggcgctcgagccggccgggccgggacttcgtcccgagtctcagctccgcagcccccaagcgccgccgccgcttcgccgctagacgcccaccgcgcagccatggcggaacagactgagaaggctttcctcaagcagcctaaggttttcctcagctcaaagaaatctggtaagggtaagaagcctggcaagggaggcaaccggttctggaagagcattggccttggcttcaagactcccagggaagcaattgaagggacctacattgacaagaaatgcccattcactggaaccgtttctatcagaggcagaattattgctggaacgtgccacagtgctaagatgaacagaaccatcattgttcgcaggaactacctccactttgttaagaaataccagaggtatgagaagaggcactccaacattccagctcacatctccccatgcttccgtgtgaaggaaggtgaccatgtcatcattggccagtgcaggccgctgtcaaaaactgtgaggttcaatgtcgttaaagtcattccagctggatctgctgccgcgggcaagaaggctttcaccgcagcctgagtttagactatgttccatgagtagtctatagaatgatgtcttttttgttaaaaaaaatccctgctaggctggtgccttccgattgtggtttggagattcctatctcaatgaagtcccatcatctgaacatgttactatttattgtaccttgtcgtgcaaagttttgctaagatctatattgtttcgtgtctgttgatgtttctgggttgtgttccaaaaaaaaaaaaaaaatggcccattgcatttcgtcggagtctggcaagcagtggcagtctcaactgctgaagcagagttgaggccgtgaagttctcgcagttctgcctggcatattttagtttgtctttacgttgtatgctgtgatgtgttctctcctgagataattggtccagttagtgagattgcggcttgggctaatggttaattggtcgttagcgagatcatttgtgcctgtcatgttatggatatcagtaaccagccctgtgaaatttagc

SEQ ID NO: 14152 - DNA, 632 bp, Sorghum bicolor
  Clone ID: LIB5121-010-A1-PF1-D5
gatctggccaacccgagcacggccaaaaaggcgcgcacccagcggcagcaggcagatcgagcaccaccacaccacaccacagctcacgcttcgttcgcgctcgcgcgtggaagaacagggagccggcgtgcggtgcggtgtccgtccggtgccggtgcgcagttgtgtgcggtgccagaatgctgcccgccgggtgcggcctcctctcgtgcctccgccgcgacaagggtgaggcggtggggcgaaccgacccccgcgtcgcggacgagcccgcgtcatcgtcaactattgctgcaatcggccagggcgatgacatgaacagaaccatcattgttcgcatgaactacctccactttgataacaaataccagaggtatgagaagaggcactccaacattccagctcacatctccccatgcttccgtgtgaaggaaggtgaccatgtcatcattggccagtgcaggccgctgtcaaaaactgtgaggttcaatgtcggtaaagtccattccagctggatctgctgccgcggtcaagaaagttttcaccgcagcctgtatttaggccatgtttccatgactagtctatacaatgatgccttttttttgttaataataaattccttgctatgctgt

SEQ ID NO: 14153 - DNA, 1533 bp, Sorghum bicolor
  Clone ID: SORBI-28MAY03-CLUS8037_1
gcacgaggatctatagcacccccattttcttctttcccttagcccatccctctggggagaccgggatcccgcggcgcaccacgaactccgcctcctccgctccgcccctcccgccctgcctcccgcgccgtctcgccccgcctccctccgtcgttcctggccgccgggcttcttctccgtcgccggctacgcgcgcggggagggaggaggagccgcagcgcgtggatccaggagcttcggcgtccggtgagatctacttttttcagcccctccatttcccgcagctctctctctcgcgcgttttgcggagattcatcggtagcgacggcggggcagtcccaggctcggcggcggcgtcagcggatgcctctcccccctctcgccaaggctgctaagctagtcactgtatggacggtggttcctgtggtctcgagggagtgccggtagtcacatctggcggcaactctccatccagcgctggtatcccgcttctgccagagaagcgctgtggctcgtttcctgaaacttgtggagccgcggggggcagtgctggccctgaaggtgtgccagtggtgacatctgctgataactctccagcccacgctagtattccgcttccctgtgattccgctgataaaccttgtgaagccgcagcgggcagcactgctccgttggaggctcagatatgtacgggtttctccaattcgatcagcctggaagtgaagaaaggcctccagaagtgcgcgacgttcccacctacatctggtcaggctaagcaggaggatggttcatgctgctatgcagatgatgggctcaaggctgctcctgcttacgagcgctctgtgtccttacctcagccaactttaaagctcatccctgctatgaaaggaggccgtgaaaagaatggaatagcatcaccaacagaaaatcgccatgtcaaatgggctcctgatgtgtatgaccccccggtgacatcggtatgccattcagtgactaacagctatcagcgccggtcaaaacaccgcaagaaggagaagaacaaacagaagaagaaacagaaggggaagtcaaagaagaaccaacagagttctacccagaatccatctgcaccgcaggtttctgatcttgggttgaaaggtgttagcaccactggtggccagtcttcagtagacgatctgagcaaacatgaggctgggatcatggattacagcatgggcagtcaggaagccaaatgtggaagcagctttctgcgcgagtctgttgctaaaatgcatttctcgatcgctgaagcttcctgagaggcgcccggtttctgcagatgcaccctcagttctgtaaatatgatggatgtatataaataaatccagcatgctgtttgtggtgttgtcgtgtgcgttgtgctgcgttagaggtgtttgagagcttggcctggtgatttggagaaataatttttggacagactctgttctgtatgttttggacggcagacatatctatcttcaatccatggctttgcagttgttgcctaatatt

SEQ ID NO: 14154 - DNA, 1141 bp, Sorghum bicolor
  Clone ID: SORBI-28MAY03-CLUS894_1
ccgcaagccttaccactccacggtttcaatcaaaaaaaagaaaagaaaaagcttagcttagctttgctcgccagacaaaccggagcagaggcagagctgcagcagcagatggcgtcgacgatcatggccgccacctcccgcgtcgtcgcggccaagacgccgttcctcggccagggccgcgccgccgccaatgccagccccctccgggacgtcgccgccgccgccagcggccggatcaccatgggcaacgacctgtggtacggcccggaccgcgtcaagtacctgggccccttctccgcgcagacgccgtcgtacctcaccggcgagttccccggcgactacgggtgggacaccgccgggctgtcggcggacccggaggcgttcgcgcggaacagggcgctggaggtgatccacgggcggtgggcgatgctgggggcgctgggctgtatcacccctgaggtgctcgagaagtgggtgcgcgtggacttcaaggagcccgtctggttcaaggccggcgcgcagatcttctccgagggcggcctggactacctcgggaaccccaacctggtgcacgcgcagagcatcctcgccgtgctcggcttccaggtcatcctcatgggcctcgtcgagggcttccgcatcaacggcctcgacggcgtcggcgagggcaacaacctctaccccggcggccagtacttcgaccccttgggcctcgccgacgaccccgtcaccttcgccgagctcaaggtcaaggagatcaagaacggccgcctcgccatgttctccatgttcggattcttcgtccaggccatcgtcaccggcaaggggccactcgagaacctgctcgaccacctcgatgaccccgtcgccaacaacgcctgggtctacgccaccaagttcgcgccagggtcttaagctagccggacacggcggcggcgtgccgggacattgtacactactcgtttgtcttgtgacattacatttgtaccatgaacgaatgcaaatattcttgtgctctctcatcagaactcaggaacgtcgtactggccactagttttgatcttccattccatccaatccatgtatgctccgttttagttgttaactgatttgtgtccatatatgtagatgtctctactat

SEQ ID NO: 14155 - DNA, 549 bp, Sorghum bicolor
  Clone ID: SORBI-28MAY03-CLUS177_3
cgtccgaatggactggactggtcatggtggaagtgatggtctccatggatatgtgcaatctcttgatcatgctgtcaatgatttgaaaatgtacctcaagaaagtattagccgagaaccctggtcttccatgcttctgcttcggccattcgactggtggaggtatcattctgaaggctgcacttgatccagaggtaaaaactctcattagcggtattgtcctgacatcaccagctgtccgtgttcagcctgcccacccagtcatagcggtcatggcaccgattttcgccctcatcgcaccgaggtatcagttcacggcgtcgcacaggaacggcccaccggtgtcgcgcgacccggaggccctgcgtgccaaatacacggaccagctggtgttcacgggcgccatccgcgtgaggacgggctacgagatccttcggctgacgtcgtacctgcagcagcacctgcaccgcatcgacgtcccgctgctggtgatgcacggcgccgacgacctggtgaccgaccccaagggctcgcgcgcgctgtacgagca

SEQ ID NO: 14156 - DNA, 1468 bp, Sorghum bicolor
  Clone ID: SORBI-28MAY03-CLUS177_1
tagccatgcgccgggcgcgggaggccgggcgggagtacgagctcatccccaccgctcgcggcgagacgctcttcacgcagtgctggtgcgtccgcccgccttcctccaccgttaaaccaagggcgctggttgttgtcatgcacgggctaaacgagcacagtgggaggtatgatcatttagcgaggcgattgaatgacatcggcatcaaggtgtacggaatggactggactggtcatggtggaagtgatggtctccatggatatgtgcaatctcttgatcatgctgtcaatgatttgaaaatgtacctcaagaaagtattagccgagaaccctggtcttccatgcttctgcttcggccattcgactggtggaggtatcattctgaaggctgcgcttgatccagaggtaaaaactctcattagcggtattgtcctgacatcaccagctgtccgtgttcagcctgcccacccagtcatagcggtcccttgtggtttttgtcacggggtcagtaaactttcgtataacatattgttccacatttttatgggttgattgttctgagaaaatattacttcacgcttgctaccaattttgtgcttacggtagtgtgtgcagtctgcagacaccatcactcttttctgctgccaactgcaggtcatggcaccgattttcgccctcatcgcaccgaggtatcagttcacggcgtcgcacaggaacggcccaccggtgtcgcgcgacccggaggccctgcgtgccaaatacacggaccagctggtgttcacgggcgccatccgcgtgaggacgggctacgagatcctccgcctgacgtcgtacctgcagcagcacctgcaccgcatcgacgtcccgctgctggtgatgcacggcgccgacgacctggtgaccgaccccaagggctcgcgcgcgctgtacgagcaggcctcctccgcggacaagtccctcaagctctacgacgggctgctgcacgacctcctgatcgagcccgagaaggacaaggtgatggacgacatcgtggcgtggctgagccccaaggtctaacgccggcatgcagatgcccgtaggacgcgcgcgcgggcttcgatcgtctgctgagcgcggaggacctgcaggcggaagacgtacgcctcgcctccggacggtgatgacgcgggtctggtcggccgcggagcaagggagagcgggtgtgcctcctcgcccccttgccgtggtgattatccgagagcaggactacaggagtacggcatactactactacctacgctacggcgatggctttactcgtgcctcccattgtatcccgataatttttgtcaggggtacttacgaattatgtaaaacatgctcgtttcgccctgtacgtgtggctgcacgagcggtgtccgatactgtagaagacgcccgccctcttgtgaattgtgaatgcattaacgcaattccatatcagagttggc

SEQ ID NO: 14157 - DNA, 639 bp, Sorghum bicolor
  Clone ID: LIB3481-052-Q6-K1-D10
gcgttcggttagtgtctggtaattggaatgagtgcaatctaaatcccttaacgaggtatcagttcacggcgtcgcacaggaacggcccaccggtgtcgcgcgacccggaggccctgcgtgccaaatacacggaccacctggtgaccgaccccaaggctcgcgcgcgctgtacgagcaggcctcctgcgcggacaagtccctcaagctctacgacgggctgctgcacgacctcctgatcgagcccgagaaggacaaggtgatggacgacatcgtggcgtggctgagccccaaggtctaacgccggcatgcagatgcccgtaggacgcgcgcgcgggcttcgatcgtctgctgagcgcggaggacctgcaggcggaagacgtacgcctcgcctccggacggtgatgacgcgggtctggtcggccgcggagcaagggagagcgggtgtgcctcctcgcccccttgccgtggtgattatccgagagcaggactacaggagtacggcatactactactacctacgctacggcgatggctttactcgtgcctcccattgtatcccgataatttttgtcaggggtacttacgaattatgtaaaacatgctcgtttcgccctgtacgtgtggctgcacgagcggtgt

SEQ ID NO: 14158 - DNA, 1504 bp, Sorghum bicolor
  Clone ID: SORBI-28MAY03-CLUS30651_1
gcacgacccccgccccgcccctccaaccaaaaccccagctccatccatcccactcccaccccgcgccgccgcgctcctctacacacgcgccgccgccgccaccgccaccaccaccacagcgcgcaggaatccctgcctaatccctcgttctcgcagacggttccaggcgttctatgtaagagaagatggcgctggcaatctccatggagggcatcgatgcgcgggcgcgggagctcggggtggacctctccgctgtcgatctggactccatcaccctcccggccggcgaggacttcggcatcctcagtgatgatgaggaggtacttcgtagtgaggatcctccagaacttgaaatgggtttatccaacattattgtcgtggacaacctgccagttgttcctccagaaaagtttgagaagcttgagaatgtcatacgcaagatctacagccaaattggtgtgataaaagaaaatggtctatggatgcctgtaaactcagagacaaagaagacatatggctactgtttcattgagtataatacccctcaggaagctgagctggctggggaaaaaaccaatgggtacaaactcgacaagtctcacatcttcgcagttaatttgcttgatgatttcgagaagtacctcaaggcccctgacacatggacccccgctgaaattaagccatacactgccggagaaattcttctgaagtggctaaccgacggacagccccgagaccactttgtcgttcgtcgctggcccacggcaacaggagagcattttatggcaacggatattatgtgggatccaactgggagatatctcgcgactgcagttacctcagttcatgaaatggagaatggctttcaaatatggtcctttaatggcaagcatctttacaaggtgtcaaaggatcatttctatcagttcatatggcgcccgagaccaccctcactgctaagccctgagaaggaagaagagatctcaaggaacctgaagaagtacagcaaaaagtacgaacaagaggaccaggacgcgttcaaccagttgagcgagcaggaccggaagaggcggacacagcttcaggaagaatgggactcatgggttgccaagtggaagcagatgcatgaggaggagcgtgctttcaggatggagctcagggatggggaagccagtgacgaggaggaagagtacgaggccaaggaagttgaggtagaggaagttgttgatgtccgtcaggaagttcttgcattcgacctagatcaggagtgaaaaggcttgtgatagaatctggttctttttgtcgtgttaaagttcactagggttgcattgcacaataggctctagtgatcaagtgcacaatttgctgatcatttttctgttttgtacacttctgcttgaattgtcggatcatgtattcagatatcaaattttgctgctggattacgaaccgggctggttctcctgctgttcaagttgatagtgcccatccaacttccactttc

SEQ ID NO: 14159 - DNA, 1363 bp, Sorghum bicolor
  Clone ID: SORBI-28MAY03-CLUS30342_1
aagagaaagggagaagcacaagcaagcagtgtcattatcgtggtggctagtgacatggttagatttggtatatccaatcagatcacaggcaggaagcagtcagatctcactcacccctcaaaaaaaaaaaaatcaaaaacaaaaacaaagaaaaacccggtgaatctcccgaatctgttgcttccctctctctccgtcgcccaccaccaccaggccagcacaatatattccccgctgcggccgcagaccgcaccttccaccaaatttccgtccccccatatccaccgcaccacaccacggctgtcccttcctctcctggttctccagtctccactcctccgcctcaacagcgctcggctattcccggattgcggcttggggttggtctggtgattggcggaggagggacttttcaagaacgggcggcgcggcggcggcggcggcgcttttttcctgacgcaaacaaattgccccggtctcctgccttcttgctggcgcgcttggggccgtggttgggctcaggaatggggggaggagagcaggggctgcgtcgcctggcccggttcccatctctctgaacttagatggatgcatcggtgaacgccaagaagaaggttagtttctgtgggaacactggccacagccgctgcggtgaagttcatttagctgccgccgtgtgctccggtcgtatgcgaagcaaccccttctcacttcaggtttggtttgcatttccgttcaagtataaaggaagcagtatttggcatggcatttgaatagcattggaacctatagaaaaaaagtgttccagcagtattacgttacactggtgttgtactgttaaaaaacatggtggacgtagaactgttctataaggacactagcgatcacagcatcagctctgaggaagaagatatgcttatcaggagttgtagcaatctcaatgtgagttttggataccattgtgattcttctcagagcttttctcctgaaaatgatcatgggaatggcatttctcctaagaacatatttgggactaataccatgatcgggtcacgaaatggctcatttacttgtttatctggtgctgctattagtgcaaattttacactggcaaacacaaatatttgcaatggtcttattggtgaagaaattttaccagaactagattctccaaactccttcagaaaaatcgtttcttctccatcaatgtcaagattggactcatactccacctcacaaggcagccctgtgtcaactgagagctctatatttgagatcagtaaaaatctttggaggtccagtgccccaacaactgtatcatccaattttctgactaatacagaggtgaaaatggctggcggac

SEQ ID NO: 14160 - DNA, 614 bp, Sorghum bicolor
  unsure (1)..(614): unsure at all n locations
  Clone ID: SORBI-28MAY03-CLUS2808_2
ctctcaaaccctacacgcctcagccgccgcgccgcctccgcgcctcgcccgccgccgccgcgtcccgcgacctcgccgaccagcttcaacttcaaccatggcggacgtcgatgtggagcctgaggtcgccgccggcgctcccaagaagaggacgttccgcaagtacagctaccgtggcgtcgacctcgatgcgctgctcgacatgtccaccgacgacctcgtccagctcttccccgcgcgcgccaggagaaggttccagaggggtttgaagaggaaaccgatggcgctcatcaagaagctgcgcaaggcgaaaaaggatgctccagctggtgagaagccagagccagtgaagacccatctccgcaacatgatcattgtccctgagatgattggaagcattgttggtgtctacaatggcaagaccttcaaccaggttgagatcaagcctgagatgattggccactatcttgcagagttctccatctcctacaagccagtcaagcacggtaggcccggtatcggtgccacccactcgtcgcggnttatccctctgaaatgagttgttacccagatctgtagtgtcccaagggttcagtggcattgttctttcagct

SEQ ID NO: 14161 - DNA, 1007 bp, Sorghum bicolor
  Clone ID: SORBI-28MAY03-CLUS2808_1
cgtccggctgcttcgcctgctttgtgcggagattatcagcagtaggagtcggaactcctagcgactcagtctctagctgacgagacatgggtgggtgatcgctcgaactggtgtatccagctccaagatccagcgcgtccctatgactcgcacgaggactaattcgtgctgcgccccgccgcttcctcccgccgtccaagcagcgcctccgctaccagcacacgtcgtctcgagctcccgctccccccttcgaccatggcggacgtggaggtggatacggaggtggcggccgcggggccgaagaaaaggacgttccgcaagtacagctaccgcggcgtggacctcgacgcgctcctcgacatgtccaccgacgacctcgtccagctcttccccgcgcgcgcacggcggaggttccagaggggtctgaagaggaagcccatggcgctcatcaagaagctccgcaaagcgaaaaaggacgcccccgccggtgagaagcctgagcctgtgaagacccacctccgcaacatgatcattgtgcctgagatgattgggagcattgttggtgtctacaacggcaagaccttcaaccaggttgagatcaagccggagatgattggccactacctcgcagagttctccatctcgtacaagcctgtcaagcacggtaggcccggtatcggtgctacccactcttcgcggttcattcctctgaagtgaggaccaaatatgggcttctgttctatcagttggattttttttccatgtagcatgagctgccaagttaaaactatgtatacctactacttctatgtaatgagcgtactggctgtgaaccattattaactgttatgttgtttttgacgttctatttgattgccatatacctccaagacattttgttctgttccagccctagaattcaaagctaagcattgcacaattatgctgttttgttggaagtatgtgagttatatatttaagctgtgatgctatgttctttgttgttt

SEQ ID NO: 14162 - DNA, 601 bp, Sorghum bicolor
  Clone ID: LIB5050-011-R1-XP1-H1
gcctcagccgccgctcccactacgcctcgcccgccgccgccgcgtcccgcgacctcgacatgtccaccgtcgacctcgtccagctcttccccgcgcgcgccaggagaaggttccagaggggtttgaagaggaaaccgatggcgctcatcaagaagctgcgcaaggcgaaaaaggatgctccagctggtgagaagccagagccagtgaagacccatctccgcaacatgatcattgtccctgagatgattggaagcattgttggtgtctacaatggcaagaccttcaaccaggttgagatcaagcctgagatgattggccactatcttgcagagttctccatctcctacaagccagtcaagcacggtaggcccggtatcggtgccacccactcgtcgcggcttatccctctgaaatgagttgttacccagatctgtagtgtcccaagggttcagtggcattgttctttcagcttttctactcgttttgaacaagttacatacccgagacattttgttctgttccagccctagaattccaagctaaccattgcacaattaatgctgttttgttggaaaaaaaaaaaaaaaaaaggccccctagg

SEQ ID NO: 14163 - DNA, 1857 bp, Sorghum bicolor
  Clone ID: SORBI-28MAY03-CLUS33551_1
agtggccagcgttccaactctctctgcctgcgacgccggctagctgcgttaccgccgccgccgccgccgccgccgccttccgccctacgccaggtgcgaggccttcatcggtatctgcaccgacgagcagcaccaacaaggtccgtctctgccccagtctgcactatacgatggcggcgcctccggccacggctcccgcgacctcccggtgtctgtccggtgccaagccgcgctgggctgctgagcggagctccagctcgtttgccatctcggcccctgcgattggcctccggcaaagtgggagccgcgtcctcagcgtccgtgccaaggttgccactggcgtgcagagggccagcatcgtggatgatggagcggaaaggccgtggaagctcagtgatgctcgtcttgtcctggaagatggttcagtgtggagggccaagtcttttggtgcttcaggaacacaagtcggtgaagttgttttcaacacatcactgacaggctatcaggagattttgactgatccaagctatgctggtcaatttgtcctgatgaccaatccccatattgggaacactggcgttaatcctgatgatgaagaatcaagccaatgttttcttggtggcctaatcataagaaatctaagcatatgtacttccaactggcgatgcaaagaaacacttgaggagtatctgattaagaggaacatcatgggaatatatgacgtggatacacgtgctataacacgaagattaagagaagatggtagtcttattggtgtcttgagtactgaccagtctcagacagacaatgagttattggaaatggcccaaaagtggaaaattgttggagtggatttgattagtggtgtcacatgtgatgctccatatgtatggtcggacaagaccgattcagaatgggagttcaagggggatcagtcaagtgaaacttttcatgtggttgcctttgactttggtatcaagcataatattttgagacgattggcatcatatggatgcaaaataacagttgttccagcaaattggcctgcttcggaggtactcaatttgaagcctgatggtgttctttttagcaatggtcctggagatccagctgcagttccctatgctgtgaagacagtgcaagaaataattgggaaggttcctgtttttggcatctgtatgggccaccaactgattgggcaggctcttggtgggaagacatttaaaatgaaatttggtcatcatggtgggaatcaccctgtctgtgatctccgtagtggacgtgtagacataagtgcacagaaccataactacgcagtggacccagaatcacttccagaaggagcaaaagtaactcacgtcaatctcaatgataatagttgcgctggccttcagtactccaagatgaagcttatgtctctccagtaccatcctgagtcatccccaggtccgcatgactccgacacagccttcggtgagtttatagagctcatgaagagcaacagattgtgagggagggaagtacttgaaatgaaaaggccaataattgtattggtgctctctcgcaccaagctcaaaagaatttgtttcatctgtagtgtttttcttttggatgttcatgtgcttgaatttttgggtctagaggacaaagcatgagatgctctgtgcattgtaccatgaaatgacctggttgaatttcgtgagaataacatgttatcaaattgtacggcagaatttctgatcggcaagtggtcatgacgagcaccagtagactagtagagataaaggatggccatgaaggctggtcagtggatacttttgttgttccaggctaatcagatgtgcacaacgttgtgtc

SEQ ID NO: 14164 - DNA, 1396 bp, Sorghum bicolor
  Clone ID: SORBI-28MAY03-CLUS3587_1
cggcgcggccaagcaccggaggatcatcaaccaagcgttccatctcgagaaactcaagcggatgttacctgctttcgccgcgtgctgcacggatttggtgaggaggtgggaaggcttggttgcagatggacagccgtgcgaggtggatgtgtggcctgagatgcagaacctgacaggggatgtcatctctcgcgcggcgttcggcagcagctacctcgaaggcaggaggatcttccagcttcagggcgagcaggttcagctcgtcgttcaggccatgcacaagcttcacatccctggatacttgtacctgcctacaaaaaccaaccgaaggatgaagcagatcgcctcagagatcgaagcgctcctcaagggcagcatcgccaagagggagaacgcgctgagaaccggcagcgcggcaagcgacgatctcctcggcctgcttctggagtccaacatggagcactgcaggggtgacggcaacggcaataactccaaggccggcatcaccaccgacgacgtgatcggggagtgcaagctgttctacttcgccggcatggagaccacgtcggtgctgctcacctggaccatgatcgtgctctccatgcacccggagtggcaggaccgggccagggaggaggtgcttcacgtcttcggtgacaagacgccggactacgatggcctcagccgcctcagaatcgtgacaatggtgctgtacgaggtactgcgtctgtacacgccgctgacgtcggtccaacggcagacgtacaagccgatggagctcggcggcgtcaggtacccggcaggcgtgatgctgatgctgccgctgctgtgcatccaccacgacaaggacgtgtggggccccgacgcaagcgagttcaggccgcagaggtttgccgaggggatctccaaggcgtccagggacgcgccggcgttcttcccgttcggctgggggccgcgcacctgcatcggccagagcttcgcgctgcttgaggccaagatggggctctccatggtcctgcagcgcttcgcgttccagctctcgccggcctacacgcacgcgccgtttccccacggcatgctgcagccggagcacggtgcacagatcatgctcagggcgctccactgagatgatgatgatgagctacctgccaagtgccaacactagcttgatgcatgggccgatgttaggttaattgatgacttcatctgcatctgcatgtacagcatatgtactacgtagtagatacaaatcaagcaaggaattacacttgcaaggcgggcttgtgaaaagttaattgcctttctagttactgttgagatgtatctcacttattaattcctggttaagagactgctggtctaattgcaggcaaaaaaaaaaaaaaaaccctcgtgc

SEQ ID NO: 14165 - DNA, 1543 bp, Sorghum bicolor
  Clone ID: SORBI-28MAY03-CLUS3838_1
gcacgaggcgccggcagaccaccggaggctgagccccgcaaacaccacaggaccacacatccacacggtttcgtggtgtggcgtggaagcgcacaagagcagaacaagacggcgagaaacacagggataaaggagaggaacggggagctggaaaaggcagaaaagacttggcttttggagccaagtcttccgttgccggcaatggcggccacctccgaggaggtcatcaagcagttatccgcgctcatggagcagctggaggagccgctcaagaccacattccagaatgtgcatcaaggaaatctgagagggactttggttcgttttctgaaggctagagaatggagtgtcccgaaagctcataaaatgctaatggattgcttaaactggagagtacagaatgagattgacagcgtgttagctaaacccattctgccatctgatttatatagagccattcgggacactcgagatcgtgttgtcctgccgtctgcatcaaagaagttcgggagacagatcaatacctgcttgaaggttatggatatgactggcctgaagctgtctgcactgagccaaataaagatgttgaccatgattacaactgttgatgaccttaattatcctgagaaaactgagacttattacattgtgaatgctccatatgttttctcagcatgttggaaggttgtgaagccacttttacaagaaagaactaaaaagaagatccaagtcctgtatgcctctgggagggacgagttactgaaggttatggactccgagtcacttccgcacttttgcaaaagagaaggatcaggctcatccagggactctttagatggagtagattgctactcgtacgatcacccttttcaccagcagctgtacaactacatgaagcagcaatctctgaaccagtactctgctggtcccagaaaacaaggctcagtccatgtggatgtgccttcacctggcctcgaggaggtcaagattgcggagacaattaaagcagagctccaaaatttgaggggaagcaacggtctcactcattcattcaacagcatacagatcgagggtccatgagggcgccaagcttgagaaggggccgcgcctgagacagtggtccaaagagaagctctggttatcttgtccccaggaacctatgctgtggtggtaatagtgcctcttgcttgcaattattggctgctggcttgatcagggcgaatacagagcgtagtagagaacgggattctaataactgtatccaagattgttatggttttctaattaacctagtgactagactagtgagtatgtattctcatgcttacggcatggaaatgtgatgtttccaacaaggaaagctattggcttgtactatctgtgtatgcatgtatatgtaaggagacttgctatatatgacggccaactggatggagttgtatatgtaaggagacttgtactcccttctaatcacttaggcaccgttaggttcccagggaatgatgccccggaaccatttctataagaaatcgttgtgtaattt

SEQ ID NO: 14166 - DNA, 1548 bp, Sorghum bicolor
  Clone ID: SORBI-28MAY03-CLUS4542_1
gtccagacgtgcatccctccaatcttgtccagacgtgcatccctccgttgtgatccattcctctccgcgccgcgatagctagcttagttgcaagcaccagcagctagctgaccaccaaaacgttagcgcacgcagacaatttcgacagcatccatcaggttttaggcccctgctgccgtcgttgagcgccacctgaaagcaatggagatcgtcgccacgcgctccccggcctgctgcgccgccgtgtccttctcccagtcgtacagcaggcctaaggcgtccaggccggcgaccacgttctacggcgagtcggtgcgcgtgaacacggcgcggccgctctcggcgaggcagtccaaggcggtcagccgcgcggcgctcaccacccggtgcgagatcggagacagcctggaggagttcctgaccaaggcgacgccggacaagaacctcatcaggctgctcatctgcatgggggaggccatgaggacgatcgcgttcaaggtccggacggcgtcctgcggcggcaccgcctgcgtcaactccttcggcgacgagcagctggccgtcgacatgctcgccaacaagctcctctttgaggctttggagtactcccatgtgtgcaagtatgcgtgctccgaggaagtccccgagctgcaggacatgggtggcccagttgaaggtggtttcagcgtagcattcgatccccttgacggttccagcattgttgacacgaacttcaccgttggaaccatcttcggagtctggcccggcgacaagctgactggcgtcactggcggcgaccaggtcgcggccgcgatgggcatctacggccctcgcaccacttacattgtcgccctcaaggactgccctgggacacacgagttcctcctccttgacgaaggtaaatggcagcatgtcaaggataccacgaccattggggaaggcaagatgttctctcctggtaacttgagggcaacattcgataaccctgagtacgacaagctcatcaactactacgtcaaggagaagtacacattgcgctacactggaggaatggttcccgatgtcaaccagatcatagtgaaggagaagggcatcttcaccaacgtgacgtcgccgacggccaaggccaagctgcggctcctcttcgaggtggcgcctctgggccttttgattgagaaggccggcgggcacagcagcgacggcaagcagtcggtgctggacaaggtgatcaacgagctcgacgagcggacccaggtggcctacgggtccaagaacgagatcatccggttcgaggagaccctctacggctcgtccaggctcgccgccggcgccaccgtcggcgctgccgtctaaagtttttgctgccgatcgagtggctctgaattactatatataatccaatcgggtgatgcgtatacagatgggctcgtagatattgaagtataaatgaattgctggtcttttcttatcagaaacttttaggttaatcttgtccgcgtatacaagaatatatataactcaaataattgttatcgctcttttataaaa

SEQ ID NO: 14167 - DNA, 1269 bp, Sorghum bicolor
  Clone ID: SORBI-28MAY03-CLUS40281_1
gcacgaggatggtgcctatcatgaatgttggctccatcgcggttgaggtcgccggcgctgacaccacttctgaaactagctgtaaagcggttcaaaagacatctgttgcactagtcgagcgactaaagcccattgatgagaatctggaggccaaggctggcacaatgcaaggcagtgcctccaaagcttaggctgagccgccacttcttctagctccagcggggccttgtccgatcaggcagaccggcacggtcgccaggatggcacacgcggtctgcactgcgccgctgaactccgccagcgcgaaatagatggccttaccggcgacacaaccagtcgaaggagtgctcttgtctacgattgcgggcaaagcttgaaccctgctgtcgatttgggccaggtggaaggtgcattcatccaaggagtaggcttcttcacaaacgaggactacgcaaccaactctgacgggttggttatccacgatggtacatggacatacaagatccccacggtcgacaccatcccaaagcagttcaatgttgagctgatcaacagcgcccatgaccagaagcgtgtcctctcttccaaagcatcgggcgagcctccgcttcttctagcttcctcagttcactgtgcaatgagggaggccatcagggccgccaggaaggaattctcggtttgcactggtccagcaaactccaccatcacgttccagatggacgtgccggcgacgatgcctatcatcaaggagctctgcggcctggatgtcgtcgagaggtacctggagagcatgtccgctgccagcccaacagccactgctcaagcatagatccagcaggcacactgcctatgatgagagggcttaatcagtctatgtaaaattctaaagaacagcatgacatgccgagcttgtctgtgttagctctgatgtacagaagaagaggtagcaatgaagagctgtggtctttgcgaatcaggagtcgtgaacaatagaggaaaaaaaataaaataaataagtgtcggacaggcgaatgtgtggatgaaatcatgtggtttcgactagattttgaagaaatcttgcaatggatctttgtttgtactcctaggtgcatacctgccttctgggcacatgagggataggattgtaccagccagctaggtttggccttgctgcctcgttgcgaccttcactggtagctactccctgtgtgcctatttgaagtagcagagcggcggaaaagctgagatcagactgcttgatttcccggg

SEQ ID NO: 14168 - DNA, 800 bp, Sorghum bicolor
  unsure (1)..(800): unsure at all n locations
  Clone ID: SORBI-28MAY03-CLUS12923_1
caggaaggaaaagccttctgataacaagcttttctggaatgggtgcttcaatgctactcttagcattgtccttcacctggaaagctctggcaccttattctggtactcttgctgttgttggcactgttctgtatgtgctgtcttttgctctaggagctggtcctgttcctgccctacttcttcctgaaatatttgcctctagaataagggccaaggctgttgcattatctctaggcatgcactgggtaatcaacttctttattggcctgtacttcttgagtgtcgtcaacaagttcgggatcagcaatgtatatttgggatttgcatcagtgtgcgcccttgcagttctttacatagctgggaatgtggtcgagaccaaggggcgatcacttgaagagattgaacgggaattaagtgtagcagaatgatgtgcttttgctagtcatgctgcggctccgttttggggattgagaatgcaaccaagcacacaaccgagcatccttggacctggagactctttccagtttcatcatgtagtttaagaaataatcgaacggcaagagtgccaatcgtaggtgacttgttgtgtgccgtgaggggttgtgttcgagcagtagtttagctgtgcttcccttactcccctgacatcaatcagaattcagaaacaataaacccgtcgatgtttctggagataagtttttcgtttttcttctcaaatttcgtcgtttncccgtgtatagatttttttgatatgagggatcttccctatttccattgcattaacagaaatacagttcgtc

SEQ ID NO: 14169 - DNA, 418 bp, Sorghum bicolor
  Clone ID: LIB3480-011-P1-K1-F8
ctctacatcagtgttccgcagtgcaggcattgcatctgatgttgctgctagtgctctgggtggagcagccaatgtttttggcaccatgattgcatcttctctaatggacaagcaaggaaggaaaagccttctgataacaagcttttctggaatgggtgcttcaatgctactcttagcattgtccttcacctggaaagctctggcaccttattctggtactcttgctgttgttggcactgttctgagctggtcctgttcctgccctacttcttcctgaaatatttgcctctagaataagggccaaggctgttgcattatctctaggcatgcactgggtaatcaacttctttattggcctgtacttcttgagtgtcgtcaacaagttcgggatcagcaatgtatatttgggaattgcatc

SEQ ID NO: 14170 - DNA, 1149 bp, Sorghum bicolor
  unsure (1)..(1149): unsure at all n locations
  Clone ID: SORBI-28MAY03-CLUS1356_1
ccacggggcgtgcgtcccccttttccccctctctccgcacgaggctctccactagctttccccaattccccttctctccggtcccggattcggaagcacacggcagaagctaagggactatggggcagaagcaccttttgttgctggcttgtttctgggtcctgtcatgttccttgctacttcatgcttcctccgatggactgttaagaatcaacctgaataagaagaaactggacaaggaagctttgactgctgcaaaattggcgaaggagagccgccttcgaaggtctgtgggtgctggccaatatcttggtgcctcaactgatgacatagttcctttggacaactacctggacactcagtactttggagagattggtattggcacaccatcacagaacttcacggtgatatttgacactggaagctccaacttgtgggttccctcatccaagtgctacttttcgatagcatgctacttacaccacagatacaagtcaaccaagtcgaagacttacaaaaagaatggagaatcttgtacaatcacatatggttccgggcaaatcgctggcttcttcagtgaggacaatgtgttggttggtaaccttgttgtgcaaaatcagcaatttattgagacgactcgtgaaaccagccctactttcatcattgggaagtttgatggaattcttggcctcggatttcctgaaatttctgtgggaggagcccctccaatttggcagagcatgaaagagcagaaactggtcgcagaggatgtcttctctttctggcttaatcgtgaccctgatgcatctgctggaggcgagcttgtctttggtggtgttgatccaaaacactacaaggggaaccatacatatgttcccgttactcgcaaaggctactggcagtttgacatgggagatcttcttattggtggccactcgactggatactgtgctggtggctgtgctgctattgtggactcagggacttcattgcttgctggtccaacaaccatagtggctcaagtcaatcatgcaattggggctgaggggatcatcagtacagaatgcaaagaagtggtgagagagtatggagagatgantcctgagttactcatagcacagacaagcccgcagaaagtgtgcactc

SEQ ID NO: 14171 - DNA, 1932 bp, Sorghum bicolor
  Clone ID: SORBI-28MAY03-CLUS11258_1
tgccccgatgctcttcgtcccgcgccaagtcgcactcgccgccgcctcctcgcagccccgcgccgccgcttccgccatggccaaggaagagcccaagaaggagaagaggagcaagagaaaggcggcggcaaatggaggggccgccgtcgccgtcgcccccggcgcgagggccgcggtggtcgcttccgtcgccgcctttctcgagtcagccgggctcccgcgcacgctcgccgccctccagtccgaggccggccttgaggccggcgcgtgtgggacgtcgcaggtgaacttggaggagctggttgccaaattcttggagtcgagcaatttaactccagcggctgttgtcctgggaagcagtgaacaagagaaggaaaatggttatctagcagccgaagttagcaaggaatataagaaaaatggcacagaagctggtgagccagagagcgaggtgactgagcattcagctgaggaaaagccgattggaaatatggatggtgaggccaaagagaagaaacagaagaagtagaagaaagacaagggtgacccttcagttgtgaatgctgcttgcggtgaagcaactgaaacagtgaagaacggtgaccggacacttgatgtggattgtgagcctacaacattatcagttcaccaatttatatagccattaattacctgatcagttctagtacgaagaagtgtggcgacggaaggaaggtgctacgtggtacagcgggattaagattgctgcagtgtgccaattttgttagcatgaacgacctgcgaaatatctatgaaattttgtttgctgggctcaccgatgtaccaattttgctacagcttatgcgacgtaacgttgctactacatgcgtattgtgagtttgcccgtgcactcgattttgctgtcctctgggatgggcctgccgtagagaaaaagaagaagaagcaagataagtcatctgtccagacttcagagaagactgttgctgcttctgcacctgccgaggctgatggcgccgcggaaaagaatggtgctgtagaaacagtgaagaatgataaggagaagaagcccaaaaagaagcgcaaggccgatccccctgctgcaggcgcggcgcccgttcgcgccactggctgtgtgctgcacgatcttccaaggcgggtgcgccagcagctgcgcagcaagaagcagggaaaagatgatgatgtcgaagctaggctggaaaagccagaattagcaataattaacaaatttgaggcagcagaaaaggtcaatggagatggcaatgagtctagagaggaagaaccaaaaaatcagaacgatggtgctgatgacagaaatggtgctgtggaaaagaaaaagaagaagaagaaagataagtcatctgtcgagacttcagagaagactgatgcaggaagtgcacctgctgaggctgatggcgccaaggaaaagaatggtgctgtagaaacagtgaagaatgataatgagaaaaaggccaaaaagaagcggaagaagtgtaaccaggaagaaaatgttcaggtggaaggtaaagaagctgcagagaaagattcagatgacgagtgaaatgctgaaacctgagccttcccccaaagatggaaagcctacaacattatcagttcaccaatttatatagccattaattacctgatcagttctagtacgaagaagtgtggcgacggaaggaaggtgctacgtggtacagcgggattaagattgctgcagtgtgccaattttgttagcatgaacgacctgcgaaatatctatgaaattttgtttgctgggctcaccggtgtaccaattttgctacagcttatgcgacgtaacgttgctactacatgcgtattgtgagtttgcccgtgcactcgattttgtaatccttttggaaatgcctgccttagagctggtaatctggctac

SEQ ID NO: 14172 - DNA, 416 bp, Sorghum bicolor
  Clone ID: LIB3478-026-P1-K1-C12
gaaaaaggccaaaaagaagcggaagaagtgtaaccaggaagaaaatgttcaggtggaaggtaaagaagctgcagagaaagattcagtcccaaaaccagatgatgggaacaagagtgggatggatgttgatgaagaacaccaaggaaagtcgtcaaatgaaaatgcagttgctggcaaaaaacggaagctagaagaagttgaaggaagcattgtccctgtgactccgaaagaagatagcaccgctaaccaaagtctaagcaatggctttgctgaggataaaacaaatgaagatagtaacataaaaccaagtaaaaggcagaaaaaatcatctgaacctaagagtgtgactccttttcaacggatcaaggtggatagtgtcacatttgcagatgataggcttcaagataactcgtact

SEQ ID NO: 14173 - DNA, 2103 bp, Sorghum bicolor
  Clone ID: SORBI-28MAY03-CLUS6036_1
gcacgaggggttatagcccatgccggtggttctgctctctgggaaagcacaagaaatcattatcttaagaacagtatctcgccctacttaaaggttgtctctgctatggtgggcaatgatttaatgagttttgtgagtgcccggccactaagttcatggaaggaaactcttgctctgctttgcacatttgcacggaaagaggagtggcatattttgtgtgacacacttgcgtctagacttgtgaaccggacgcgtgggctagcggcaactctctgttatatttgtgctggaaatattgacaaagctgttgaaatatggtcccgcaccttgaaatctgaagatggtgggaagacttatgttgatcttctccaggatttgatggaaaaaaccattactcttgcccttgctacgggccacaagagatttagcgcgtcactgtctaagcttgttgagaactatgctgaattgctggctagtcaaggtcttcttaaaactgcaatggagtatttaaaactgttgggatcagatgaacattcgcaagagctggcaattttgagagatcgaattgcatgttctacagaagaaaatgataatgctaggagttctgtttctgaaaacaccagcactccttccccctatgtcccaaatcaaccatatactaccccagaacatcctcagaatgtttaccaggtacctcaaccatacaatgtaccaagtacatattcagaagcttacccacaacctactggaccttatggatacaacaatgcatatcaacctccacaaccagccaatatgtttgttccacctagcacacctgccaactctcagcaacagccaggcccttcacctgtaccagtgcctcagcaaacagtgaagacatttactcctgcgaacccaactggtctaaaaaatcctggacaatatcatcaacctaataccttaggttcccagctttacacgggtgctgcaaatcaaccgtattcttctggaccatctgctccttatccaagcggacctccaacaacatttcatcagcctgtatcgcctgttcaatatcagcctgctgctccaccagtatcttcttttggtccgagcgcccctgtaccaggaacaccacgcgtccggatgtttccccattctgctgctactaactcaacttctaggtttatgccatcgaacaatcaaagctttgctcccaggccaggtttaagtcctgcacagccctcaagtccgacgcaggtgcaggcacagcccactcctcctgcacctcccccgactgtgcagacagctgatacgacaaaagtgtctgctgagctgagacctgttattggtacactaaccagactatttgatgagacatccaaagctctgggaggatcacaagctactcaagcaaaaaagcgtgaaattgaggacaattcaaggaaaataggggcattgttttcaaaactaaatagtggcgacatatcttcaaatgtttcatctaaactcattcaattgtgcagtgcaattgatgctagtgattttgccactgcgatgcacctccaggtactcttaacaacaagtgactgggatgagtgcaacttctggcttgcggcattgaagcggatgatcaagacaaggcagaatttcagaatgtaaaccttgtggtcttctcatgcagccagttctgtacacaccttttctgctgcttgccagcaatcatagtgttagcagttcagagggttcgccagcacagcggtgttatcctgcttctttgttcttggctcttgattctgcctcggcgtgttggtgaaattggtctgatactttggttctcttatacattttgataatagttttggtttttgacactgtaaggtgacatgttgctgggttggttattctgaatggtaattgtaaggccacttagttcgttatagttggtggatcaccgttttcaattcttgcacttagaattctgtcaccttggacattcggagaactctagatggttaaaacgagtggcagtcgcttgtttttttgtaccgtcaacagcaatcaataaatttctgtaatcttgaatcggtattgcatgatggacgtgcgggttttgctctc

SEQ ID NO: 14174 - DNA, 1874 bp, Sorghum bicolor
  Clone ID: SORBI-28MAY03-CLUS6597_1
attcaccaaacccacaataaaagccgtcccggggcaccacgctccggagttcctccggcgatccctccctaagacggccgtccccttgcgcgcgcgctccaggagggccttccgccttcagcttgcagagcccacctaattgctgcgaaatggatagagggcagaacaggagggatgacgtcttcaggggcagggatccatttgatgatccattctttacccgtccgtttgggggtcagatgatgggtggcatgtttggacctagcccgtttgggggtcagatgatgggtgagcatgacatgtttggacctagcccttttgggccgatgggagggccttttggggacagggggaaccatgggttcatcgaccaagctccgcctaggggtaacagcagaaggcctgtgatcacagaggttgatgatgctgaacgaggacccacacaacataaaaaagccgtcccggggcaccaggctccggagttcctccggcgatccctcccttagacggccgtccccttgcgcgcgcgctccaggagggccttccgccttcagcttgcagagcccacctaattgctgcgaaatggatagagggcagaacaggagggatgacgtcttcaggggcagggatccatttgctgggtttggttcccacaggagcttgatttctggcttctttggggggagggatccatttgatgatccattctttacccgtccgtttgggggtcagatgatgggtggcatgtttggacctagcccgtttgggggtcagatgatgggtgagcatgacatgtttggacctagcccttttgggccgatgggagggccttttggggacagggggaaccatgggttcatcgaccaagctccgcctaggggtaacagcagaaggcctgtgatcacagaggttgatgaagatgaaggagaaaacgcagagcacggtaacgagcagcccaaccaagattcttatgttcaggagccagatgatgggagtgatgggacagaaggtggccaagtccagctgcgcagggatctcaatagggctaatagtggagggcagccgcaggctcgtactttcacatatcagagctcttctgtgacgtatggtggtattaatggagcttactacactgcttcaaagactcggcggactggcagtgatgggatcactgtggaagaaagcaaggaagcagatacaacaactaaagaggccactcatcggatctcccgaggaatccatgataagggccattccctgacaaggaaactgaattcagatgggaaggttgacaccacacagacactgcacaacctgaatgaagatgaactagctggatttgaggaatcatggaaggggaatgctggacattacttgcctggctggaaccaaaatgctggtgtacctaatagtgataattctggtaaccgtagctccaatggacgtgaccggcggtcggcctggggctgggcgcttcctggcacggagcaaggccgtgatccaaggcgcaatggaaagccaaagtcacgggtcatcccaatctcctgaagagagtacacacgctttagcatggacggagtagatagataaataaacagctggtttgtggaagctgcaactctgcaaggttcaggtccaagttcgtttcaaggaaacaacctaaggtccaagtaaccagagtcctgacgaaggtccgaacgtgcccggtacctgaattactatttgtgtgaatgtgtggaaacgtagaaactcccccattcctgtggttgtacagtgttactaccttattatctctgatgtgaaaccatttgtttcgtcgagacgtcttgctataaaagcatcgcgtatattgcaagccaaacctgattcgttag

SEQ ID NO: 14175 - DNA, 729 bp, Sorghum bicolor
  unsure (1)..(729): unsure at all n locations
  Clone ID: SORBI-28MAY03-CLUS67823_1
tactgaaaaaaatacaaaaaaaaaaacataaacacatcaacacacaaagcacagctctctgagaagccactcgtttcctgctcgaatcaagcacagctctctgcgtttcgatcgatacatcagaaacggccacacgaaactgatcaagctaggcattagcattatcggcaatgggcgagttgatccctgggttgccggaggaggtggcgagggagtgcctcgtccgagtgggcttcgaccagctgccggtggtccgccgcatctcgcgccagtggaaggccgaggtggagtcgcctgactaccaccgccagcgccgggcggaggggctggcgcgcccggtgctcgcgctggtccaggcgcagccgacagctccaccggctgacgacgctggtccggtggcggacaagcactcgacggcagcagcagcaggctcgggaggaggcccagcgaactcgtaccggatggtgttgctggacccggtggaaggacggtgggcgccgctgccgcccctgccagggccaagcgagagcctgcccctcttctgccaggtggccgccgtggacggcgggcaggggaggaggaagcggctggtggtggtcggcggctggcacccggagacgtgggcgccgacagacgcggtgttcgtgtacgacttcctgacgggcgcgtggccgcncngnncgcccatgccgggcccacgccggtccttcttcgcgtgcgcggccgncg

SEQ ID NO: 14176 - DNA, 1101 bp, Sorghum bicolor
  Clone ID: SORBI-28MAY03-CLUS6920_1
gcagaaccgcgactggaccactcaccagtcaccacctctctactccgacgagacttccgcgatggatgctgctgctctcatgcctccgctcgtcgtctccctgctcctctgcctgctggcggcggctgccccggcggcgtccgcggcgcgggccttcttcgtcttcggcgactccctcgtcgacaacggcaacaacaactacctgctgaccacggcgcgcgccgacgcgccgccctacggcatcgactcccccacgcaccaagcgacggggcggttctccaacgggctcaacatccccgatatcatcagcgagcacctcggggcggaacctttgctgccgtacctgagccccgagctccgaggggagaagctgctcgtcggcgccaacttcgcgtctgccggcgtcgggatcctcaacgacacaggaatacagattgtgaacatcatcatgagtgatgtgtcacgtacgtagcacgctagtcatgtgctgctggatgatggcatctcagtttgcccgtagtcgcttaatccaattaagcgacagtgtttcccatcacgctgggcggcaacgacttcgtcaacaactactacctggtccccatgtccgtgcggtcgcgccagtacgcgctcccggactacgtccgcttcatcatctccgagtacaggaagatcctctcgaggctgtacgagctgggcgcgcggcgcgtgatcgtgacggggacggggccgctggggtgcgtcccggcggagctggcgatgcacagcccagaacggcgagtgcgcggtggagctgacgcgcgccgtcaacctcttcaacccgcagatggtggacatggtgcgcggcctcaaccgcgacatcggcgccgacgtcttcgtcaccgccaacacctaccgcatgaactttgactacatgcacccactgaatctcagcaccatcctcgccgtggaccgggagggcctgtagagtggagcgtatagcttgatcagctggccacgagatgtacgtacatgtgtgatgtgtcacgtacctagcacgctagtcatgtgctgatggatgatggcagctcagtttgccattcgtgccttaatccaattaagcga

SEQ ID NO: 14177 - DNA, 1002 bp, Sorghum bicolor
  Clone ID: SORBI-28MAY03-CLUS6605_1
gcacgagggagtcttccattccacaggagcagggctctcttcttctcccatctcatctcgcgccgggggtcgcctgaggtctgttgatgcttagtattagcgtgttgctaatcctagtgcggcagcatactgactgaatggacataggctgcgttgacttattatgcagtgaagcattcagctacagtattcgggaaacagatgccggccgggccggggtcagtcctcggttcgcgagtcttccattccacaggagcagggctctcttcttctcccatctcatctcgcgccgggggtcgcctgagatcacagagaaaatggtgaagggagttgctgtcctcgctggccctgatgtcaagggcaccatcttcttttcccaagagggagacggtccgaccacagtgactggaagtatctctggcctcaagccggggctccatgggttccatgtgcacgcgcttggtgacaccaccaacggctgcatgtcgactgggccacacttcaatcctgctggtaaggagcatggcgcacctgaagatgagaaccgccatgccggtgatcttgggaatgtgacagcaggagaggatggtgttgttaatgtcaatattactgacagccagatccctctcactgggccacactcaatcattggccgggctgtagttgtccatgctgacccggatgaccttggcaagggtggacatgagcttagcaagagcaccggaaatgctggcggacgtgttgcgtgtggtatcattgggctccaaggttaggtgttaacctccgaggcaaacaccatcgaagcgagcacctcaggagatgctgttccatttcccttgtattaattggctccacaatttggttactccaaataagcgcctgatccatgatcagagcacatgtcattttgcatatgaacaatattgcacatctccttaagtggtggttccaacaaatgcttgttttgtaaaaaaaaaaaaaaaaaaggcccctagggcccgg

SEQ ID NO: 14178 - DNA, 662 bp, Sorghum bicolor
  Clone ID: LIB5049-001-R1-XP1-G7
gccggccgggccgtatcgatcaatcactcgaaccaaacctagggttcttcgtcgtttcgtctgtagatcacagagaaaatggtgaagggagttgctgtcctcgctggccctgatgtcaagggcaccatcttcttttcccaagagggagacggtccgaccacagtgactggaagtatctctggcctcaagccggggctccatgggttccatgtgcacgcgcttggtgacaccaccaacggctgcatgtcgactgggccacacttcaatcctgctggtaaggagcatggcgcacctgaagatgagaaccgccatgccggtgatcttgggaatgtgacagcaggagaggatggtgttgttaatgtcaatattactgacagccagatccctctcactgggccacactcaatcattgcccgggctgtagtagtccatgctgacccggatgaccttggcaagggtggacatgagcttagcaagagcaccggaactgctggcggacgtgttgcgtgtggtatcattgggctccaaggttaggtgttaacctccgaggcaaacaccatcgaagcgagcacctcaggagatgctgttccatttcccttgacttaattggctccacaatttggttactccaaataagcgcctgaccccagatcagagcacat

SEQ ID NO: 14179 - DNA, 1002 bp, Sorghum bicolor
  Clone ID: SORBI-28MAY03-CLUS6060_2
gcggctggggtgagctcagagccttctgccaatgagagccacaagaccacaaccggagcagatagtgaggcaggtggagacgtggcggagaaatcctaagccaagcaccctgggctgggtgaaaataatgccttgtatactagcaacgaaagagaaggactcttgaatgacaactactagtccttaccagtttactgtgtggtttagatggtcagtctcatcgattgatgtagaacaaagtttagattggtggtgtaatctgtccaagatactcgggccgggcattgctgtagccattaccgaatgattcatataagcctgttgcccaagtggattttatctatgtttatgagctgatgtaacttggtaagtaaaactgatgtaacttggtaagtaaaactggctcgcagttgctttttacatacaggtcactaatgcatgtatctgtaacatgttgagccgtgaattgtcacagttttaatgcaacagtgagatacatcagctgcagtataaaaaaaaaaaaaaaaaaaaaaaatacacacgagttacaaacaatcactctcgactatagaagagaatgtcaacatgatgacatagttgattcgcttacttacatagaggaaggagaggagaaaagcatgaacggctctgcttccgcagcgcctcacaaagaagagcggcagcagttcctgcattgcttaagatttgcagccaatggggacgagatcaaccgtggccgcacagtgtggaggaagctagctagataagaagtggtttttggtcatcaatattcttctgcatttgcttctcacggctggcggcccttgtaccacaattttgtgatgtgttgttgccctttggaatgtactctgccatgtaacggtgccgatttgtgacatttctcgcagttttaacggtctgtccgttttgtaccagtgacaatgtttgtggtatggaataacctgcgtttcccggtgaaaaaaaaaaaaaaaaaggccccta

SEQ ID NO: 14180 - DNA, 1428 bp, Sorghum bicolor
  Clone ID: SORBI-28MAY03-CLUS6060_1
gggactccggacaaggccaacagcaggcgagggaagcaaggtacgccccacccacccggttcaggcagccagcggcgatgcagcagcagatgcccatgccgccggcgcccgctgcggcggcggcgacggcgcccccggcggccggcatcaccaccgagcagatccagaagtatttggacgaaaataagcaacttattttggccatcctagaaaatcagaacttaggaaagttggctgaatgtgctcagtatcaagctcaacttcaaaagaacctcttgtacctggctgcgattgctgatgcccaaccccaaccaccgcaaaaccctgcaggtcgccctcagatgatgcaacctggtatagtgccaggtgcagggcattacatgtcacaagtaccaatgttccctccaagaactccattaaccccacagcaaatgcaagagcagcagcagcaacagcttcagcagcagcaagcgcaggctcttgcattccctgggcagatggtcatgagaccagctaccatcaacggcatgcagcagcctatgcaggctgaccctgcccgggcagcggatctgcaacagccagcatctgtcccagccgacgggcgagtaagcaagcaggacacagcggctggggtgagctcagagccttctcgtgattggatcctcaaggacctggctaatggtgaagttattggaagagctaccagcaagtgggtcacgatgaaccaaaatacacggagacttcagcgagtcagtgatgacgtaagggatgaggtgtttatacattgtccaaagactccaaggttagcattcccagaggaaaataatggcagtttgaagaagattccgaatctttcagatcctgcacaatactcaagactaggactagtgccaagaagagctgatctggacatgaaccaacatgtcaataatgttacttacattggttgggtcctggaaagtatacctcaagatataattgatacacacgagttacaaacaatcactctcgactatagaagagaatgtcaacatgatgacatagttgattcgcttacttacatagaggaaggagaggagaaaagcatgaacggctctgcttccgcagcgcctcacaaagaagagcggcagcagttcctgcattgcttaagatttgcagccaatggggacgagatcaaccgtggccgcacagtgtggaggaagctagctagataagaagtggtttttggtcatcaatattcttctgcatttgcttctcacggctggcggcccttgtaccacaattttgtgatgtgttgttgccctttggaatgtactctgccatgtaacggtgccgatttgtgacatttctcgcagttttaacggtctgtccgttttgtaccagtgaacaatgtttgtggtatggaataacctgcgtttccccggcaaa

SEQ ID NO: 14181 - DNA, 949 bp, Sorghum bicolor
  Clone ID: SORBI-28MAY03-CLUS7252_1
tgtgcggagctcgagcccggtgagctctttccggttcgttcctctccctgcctatatacgcccgtttctctctcctcgcgcaacatcggacaaccacacaagcgaggaatctagtccagtcccggcggcaatggagtgcgttttgggcgtggttggccgcgacttcgcggtggtggcggccgacacctccgccgtgcagagcatcctcgtccacaagaccgacgaggacaaggtgatggtcctcgactcgcacaagctgatgggcgcttcaggggagcctggtgaccgggtgcaatttacggagttcatacagaagaacctccacctgtaccagttccgcaacaccatcccgctctcaaccgccgccgccgccaacttcactcgcggcgagctcgccacagcccttcgcaagaatccatatatggtcaatattattcttggtggttatgataaggatgttggtgcttccctgtactacattgactacattgcaaccttgcacaagattgacaagggcgcttttgggtacggatcatatttctgcttgtctctgatggacaagttgtaccgcccggacatgactgttgaggaagcagtagatcttgttgacaagtgcattaaggagattcggctgcgactggttgtcgcgccccagaacttcgtgatcaaaattgtcgacaaggacggggcgagggagtacgcaaggcgtgaactcgtcggcgacaatgcacctgttgatgctgcaatcacagttgctgcctgaggcatgaacttgttggaagttagactgtgttaattgtgttttctcagcgaggctacttatgtaatcacaggatactggtgggggtcccacaactgttttatcaatttgagcccagacgtgtgtatttctgtttctgcactattcatgtctttgctgagtacaagtttacaactagttttaacgctg

SEQ ID NO: 14182 - DNA, 799 bp, Sorghum bicolor
  Clone ID: SORBI-28MAY03-CLUS7207_1
gccggccgggcccggtcctccgacggcgccgacgaaaaccagaccaaacccccccaaacaaggacccagcgcccttttgcagtcgccgcaatggagagcaccttcatcatgatcaagcctgacggcgtccagaggggcctcattggtgagatcatcagccgtttcgagaagaagggcttctacctcaaggccttgaagcttgtgaacgtggagaggtcgttcgccgagaagcactacgctgatctgtcctccaagcccttcttccagggcctcgtggactacatcatctctggccctgtggtggccatggtctgggagggcaagagcgtcgtcacaactggccgcaagatcatcggcgccacgaaccccctggcttctgagcccggcaccatccgtggtgactttgctgtcgacattggcaggaatgtcattcatggaagcgacagcattgagagtgctaacaaggagattgccctgtggttccccgagggccttgctgactggcagagcagccagcacccctggatctacgagaagtaaatgggggaatgtttcacattgaaccttgagagccagaggaagcatggcaccagctgtgctttagcaatatttagagtttgaaaagattatgatctgtatctcaaaaccttatttccgtggaccgaatttccttccttgccttgcattttataaatgcttgacattttgcttatgaatcttatatgtttatggtattgatttcatgaggtacccccaagcaaaaaaaaaaaaaaaaggccccttagggcgcggccgctct

SEQ ID NO: 14183 - DNA, 1368 bp, Sorghum bicolor
  Clone ID: SORBI-28MAY03-CLUS2375_1
ctgttggcctctggatcgcttctcttctccacacgaactcaccctcctgagatagagctaaacaccaagccgcgaaaaaaaagagggacaggggaaaaaaaatcattctcgtttcgctctccggcagacccccgcccgaatcgatggagattagggctcagccaacgagcctgaggctcgcgccgccgcccgcctccgccagcttccgccggacccctctgaggacctccttccttaagggaaacgtgtcacttaaagttgtgcaagtacgacaatcaaatgtcaacagatttaagtgcaatagcatacgaagtaacctctttgaaagactaacaagggttgtcaggtcctacgcaaattcagttctaagttcgtttgaagatcctgagaagattctagagcaggcagttctggagatgaatgatgacttgacaaagatgaggcaggccactgcacaggtcttggcgtctcaaaagcggcttgagaataaatacaaagctgcagaacaagcttctgctgattggtatcggagggctcaacttgctcttcaaaagggtgacgaggatcttgctcgcgaagccctcaagcggcgtaaatcatatgctgataatgcgagctccttaaggtcccagcttgatcaacagaagggtgtagttgaaaatctgatttcgaataccaaggttcttgagagcaagatagcagaggccaagcagaaaaaggataccctaaaagctcgtgctcaatcagcgaagactgccacaaaagtcagtgaaatgttgggcaatgtgaatacaagtagcgccctttctgcgtttgagaaaatggaggaaaaagttatggcgatggaatcccaagcagaggcacttggccagttagcaactgatgatctagaaggaaagtttgcactgctcgagacttcatctgttgatgatgatctttcacaactgaaaaaggaattgtctggaagctctttgaaaggagagcttccaccaggaagagcagcagtcagcaactcaggtgctgggcgccctttccccgacctagagatcgagagcgagctaaacgagctgcggaggaaggccaaagaatattagattccatccttcttgtcgattcagcaggcctgacggaatctcgtttccccgaagatagtacagccgcagattgctcacattgcgcttttgaaacacaagcgcgcgttgactgtttgttaatgagtatggaatcggtaaatttctcggcattttcccttggagtgacatttgtacagctagccataaattgttgtaaatcaccactcgccctagagcctttttgcatactatatatatagtcaaagtttgaagtttccacctcgtggttttattt

SEQ ID NO: 14184 - DNA, 3051 bp, Sorghum bicolor
  Clone ID: SORBI-28MAY03-CLUS254_1
gcacgaggctccggcctcctccttcccccaatcgcacgccacactcccgcagaaatccccctcacccaaattcccgtcctcccccccgatcgccgctcgtaaaccctagactagccgtacctccgcccgtgcgctgtcgtgcccgcgctcctgctccccctcccccgtcggcggcacgcggcgccgcgagccaaaaccctagccgccgcctcctccagatcccgattccgcagggaaagcgggagagggaagggagggccgacccgacgtagatggagcctgcgggggcgcgcaaggagtggcgcgccgtccccgactcctcgctccgctccaatggcgccgaggatgccgcggagcacgggaagctggggcagcaggaggaccgagctatctacgaggaaggggcgggtggaatggaagacttctgcgccatcaccattgatgggagcggagggctcagcgaggacatcctgcagcagcgcctgcagagccttgcgcggcagcgggaggagctacagcaggtcgagatcgagctgcgtgcgcaggccatcgcgcacccgcagatcatcgaggcgcaacaaagcttccaggctgctgccaaggagcatgccgcagctgtggcaaagatcaaggagcaactgcatgagcgggagcactacattcttgaactagaaatgaaactcaatgacaaggatagagaactaaatgctctgaagatcgatcatcaaacggtgtgggcaaatcaagatcttattagagaacagaccaaagagctggcaactgtcagaagggaacgcgacaactctgaagctgaaagagcccaacatcttaaacaaattcatgatctccaagaacttctgcgggaaaaagaaagccagttcattgcattagatgaacagcatagggctgctcaagacaacattctttacaaagatgagcagttgagggaagcccatgcttgggtttctcaagttcgagaaatggatgctttgcagtctcaatccctacaagttgagttacgtgagcgcatggagcaatttaatcaatattggattagcttccagcagcagtatgctgaaatgcagcggagccttcttcatacaatacaacaactccagcaagaattagctgagacaagggcgtctggagcacaaaaagatggcccacaagtttctcgggaggggtcagctgaatcatcacatgttcaaagcatagcaaacagcgtcgcttcaaatggtagtgcaactgcagatgggaaccagcaattgttgaaaaataatggaagtgtggatgtctctgttaagggcaataatgcgtcagctgtacctgttccatctctactgggaataggtggtccggctgcacatattgctgcgatgcattcttttatgattcatcctcaaggcattcctcaacctttagcatcacccaactctggtgttcctcaatttggcagttttcagtcacagtctatgattcaaccaaactcgcactggtcaaatcagcaggaagtacaaaatgtctctcaaccgcaagctgaaacaaactatcagacatcccaatcagaccagactgcattacaacaaggctctattaatactgatgatctgtcctcgaagccaagtcagggtatccatccagatcatcataatgctcatgcgaaacaacagcagagccctgcaagtgcacctactgaatcaactcatgatctaacggttgttgaaacaaatgtagctgaacttgtagcttatgatgagcagcaaaaagccttaaaagaacaggattcgtcgtcaaatatgaacagccatattggaagagttgagcatcaagagcagaatactgaatcaaaggatgaaagagctgcatctgacaagcagcctgagcctgtatctaggcagcataaaccttcaaactttcctctgtcaactacccagattcacttgaaaaacagtgcaacagagaatcctaatgttgtaaatcaggttgatacaacgaaatcagttgccagtggttttggttcacaattacctcgtgtaccaaaggaacctgctctcctagatgagagatctctattggcttgcattgttcgtgctgttcctgctggacctgagggtggaatcaggattagttcaactctgccaaataggcttgggaaaatgttggctcctcttcactggcatgactataagaagcaatatgggaagcttgatgattttgtggctagtcatccagagctgtttgtgattgagggagacttcattcaccttcgtgaaggagcacaacagatcatttctgctactacagctgctgcaaaaatagctgctgctacagcatcttctgccccttactcgtccttactgccttctgttgctgttactcctgtggcacaaagtactcggcaaaagagggggcctgcagttgattccagatcatcaaatgcaattccctctggaaatggccacacagatcaatttaacatcattcagggggttagtgacgtaacaatttcaggcaaagtaagaaacacccaagataatggcttcttagatgaagttcgaactgggcagccatctatggtcacagctgctgccaatggtgcaagacacgacaaaggtgcaaataatatcagacatggttatggaggaaaacaacaggggaggtcaactgggacgacatacctttccagaagatgaagtagctttaactggatgcaattggtttttgagggtggtgacgcggatggacaccatacaagtggcaatgttttggcttcctaatggtcgatgctgaagatgacctggattaaaattattctagatttattttcttttgcaccattgctcttaacagcgtctgtatgggggcctgttttggcaaagctgtactgatatccctagcccaagaatcagaagctgtgctgaagttttgtgactatgtaactcgtctgtgcttgtattgtggttcacttgggatgatgtgaatgttatagcggatgtccttcagcgtggatgtctctgggaaaaaaaaaaaaaaaaactcgagggggggccc

SEQ ID NO: 14185 - DNA, 1623 bp, Sorghum bicolor
  unsure (1)..(1623): unsure at all n locations
  Clone ID: SORBI-28MAY03-CLUS2425_1
ggatgcaggtttattatatgatttaggcgttataggacaaatactgtacagttgacaaaagtaacttgatctggttttgtgtgcttttcaagcatactcctacataacaataaaagtacttccagcctgttttcttagacctatcaggtgaaacatcttggtcaaaaattatcgccactaatttttctcaacatatctggccatctgggtggtggtccgaagtagtgctggttctttcatttcatttatttctagctcatcttgcctgcccacttatgtagtagaactagaataaactgttgggtttgttatgttactaaaaagagttgtgcctgagagcgttgtggccctccagatttcaaaccactttcaaaaatcatgctgctgcttggactgcagctaanatccaatcctaatgcanttgagtttcaccacgcgcccgcgcgcggcggggacggcacggcgacgctcttcctcctcctcctcctcctcctcatctcgccgccccgcaagcaatggcggtggcgcggctgcgcgcggcggccgccgcccggctgccgccggcgctctcccgcggagagaggcggccgctcgggacggcggcggaggtggccacgaccgcggggccaggggccgcgaggtgggagctcatgggggcgcgggagtactacgactaccggcgggccatctacggcgacatcacgcataaggccatcctcgtcgacgccgccggcacgctgctcgcccccaccgaacccatggcccaggtgtacagaacgataggccagaagtatggagtggattattcagaggatgagattctgatgcggtatcgccgggcttatgcgcagccatggggtagatcacgtctgaggtatgttaatgatggaaggcccttttggcaatacatagtgagttcatccactggctgttcagatctacagtattttgaggaactgtatcagtactatacaactgaaaaggcttggcatctctgcgatccagatgctggacgtgtttttgaggcattgaggagggctggtgtcaaaacagctgtcgtgtccaactttgacactcgtcttcggccacttctacaagcactgaaatgtgacggctggtttgatgcagttgctatatctgctgaggttgccgcagaaaagccaaaccctacaatattcttgaaggcttgtgagctgttgggagtgaaacctgaagaagctgtgcatattggtgatgaccgtaggaacgacgtatggggagcaagggatgcaggctgcgatgcctggctttggggcagtgatgtgtactccttcaaggaggttgcagagaggatcggggttgaggtgtagtaagtgttctcctgagccgtaataggagtcatccgagcttgtacatagtgtcaacgccacttaccaagggcgtcttgtacatatttccaagggaaataacaagagcagtttctctctgtgtgcgactatgccaggcattttgtagcaaatactgatgtttatgtatacatttaaatgttcagttaaccacctgttagtttcctgtgttgcggctgtgagctgtagaatacactttgtgagacccctacggcacctttcatatttcatctttcgt

SEQ ID NO: 14186 - DNA, 2537 bp, Sorghum bicolor
  Clone ID: SORBI-28MAY03-CLUS748_1
gcacgagggcagcgcggcccccttatctccagggaccaggggaggacgcacaccaacgcaccgcccttccttccctcccccccccccccctcccctcgctctcctcggtgggttaagggacggtatttctgaccatggcagggaccttactccagtcagttgccctcggaacaacattcgggggtcgcataagcacccagcgttggaggtcccatggcgccaggaggcctgcctctatgttggcaatgtcacttagccgccccgtcaagatgtcagcatttgtgggtctaagatcagtgcatagcttctcggtcacacccacggtgtccaattccaggtcgacagttgcatcttacaggtcatctcgacggacaagacgttctcgttttgttactcgggcaatgtttgagaggttcacggagaaagctattaaggtcatcatgcttgcgcaagaggaagcaagacgcctggggcacaactttgttggaactgagcagattctcttgggtctgattggagagggcactggtattgcagccacggggctcaagtccatgggaataaatctcaaggatgcacgtgtggaggtggaaaagattattggccgtggcaatggttttgttgctgttgaaataccattcacaccacgtgcgaaacgtgttttggagctctccttggaggaagctcgccaattaggacataattatattggatctgagcacctgcttcttggactgcttcgtgagggtgaaggtgtggcggctcgtgttcttgagagtcttggagctgatcccagcaatatccgtacacaggttattcgaatgattggtgagaccacagaagctgttggtgctggagttggagggggcagcagtggtaataagatgccaactcttgaggagtatggaactaatttaacaaaattagcagaggagggaaaattagatcctgttgttggaaggcagccacagattgagcgtgtggtacaaattttaggcagacgaactaagaacaatccctgcttgattggagagcctggtgttggaaagactgcaattgctgaaggacttgctcaacgcatttctacaggcgatgtacctgaaacaatagaagggaaaaaggtcattacccttgacatgggacttcttgttgctggcacaaaataccgtggagaattcgaagaaagattaaagaagctgatggaggaaataaagcaaagtgacgagataatactctttattgatgaagttcacactctgataggagcaggagcagccgaaggtgctatagatgctgctaatatcttgaagcctgcgttggccagaggtgaattacagtgcattggagcgactacacttgatgaatataggaagcacattgagaaagacccagcacttgaacggcggtttcaacctgtgaaagtgccagagccaacagtagatgaaaccattgaaattctcagaggactgagggaacgatatgagatccaccataaacttcgttacactgatgaagctctgattgcagctgcaaagctgtcatatcaatatatcagtgaccgtttcctcccagataaggcaattgacttgattgatgaagcaggttcccgtgttaggctacagcatgcacaggttcctgaggaagcaagagagcttgacaaggagcttaaacaaatcacgaaacagaagaatgaagctgttcgtagccaggatttcgagaaggctggcgaattgcgagaccgtgaaatggaattgaaggcccagataacagccttcattgacaagagcaaggaattgagcaaagcagaggaagagtctggagagacaggacctatggtcaatgaagcagatatccagcacatagtatcgtcatggactggcatccctgtggagaaggtttccagcgatgagtcagataagcttcttaagatggaagagactttgcacacgcgtgtcattggccaagatgaggctgtggtagccattagtcgctccatccgccgtgctcgtgtgggtctcaagaaccccaacaggccaattgcaagctttatttttgcaggtcccaccggcgttgggaagtcagagcttgcaaaggctcttgcagcctattactttggctctgaggaggctatgatccggcttgatatgagtgaattcatggagaggcacacagtatccaagctgattggttcacctccaggatatgtaggatacactgagggtggccagctggaggaggaagacgagtgggaaccggaatcaccgccctcgcttacgccgtcgcggccacggcggcgaccggcgcgcacggggccgccgccctccgcggcgagtgaccgcgcggcgcggacgatccaggcccacttccgccgcttcctggcgcggcgctcccggacgctgcgccatctcaaggagctcgctgtgctccggtccaaggccgcggcgatccgggggtcgctctccggccgccacgggggcgccgaccccgctgccgtctccgaggcggccatgggcctcctcctccggcttcgacgctat

SEQ ID NO: 14187 - DNA, 895 bp, Sorghum bicolor
  Clone ID: SORBI-28MAY03-CLUS9315_1
gcactcaacgacgcctccctccagtccttcgaaaaccttcaaacgcccttgcacttgcagtgaaggggacgaccgaatttgagcagagcctgccctgcccagcgatcgattagagagaagcaatcatccaagcagctatctgtacgtagctagttgcgacttgcgagagagcttgtgtacgttaatttccttcgtaggggatcggatcggaagcaagcatccaacaacaaggctcaaatggcgagctccgacgatggtggttccagcgcccccagggacgtgccgggcagctacgggctgccgctggtgggcgccgtgcgcgaccgcctcgacttctactacttccaggggcaggacaagtacttcgagtcccgcgtggagcgctacggctccaccgtggtgcgcatcaacgtgccgccggggcccttcatggcgcgcgacccgcgggtggtggcggtcctggacgccaagagcttcccggtcctcttcgacatggacaaggtggagaagaaggacctgttcacgggcacctacatgccctccacctccctcaccggcggctaccgcgtctgctcctacctcgacccctccgagcccacccacaccaaggtgaagcagatgctcttctccctcctcctctcccgcaaagacgacgtcatccccaccttccgctccaacttctccgcgctcctcgccaccgtcgagtcgcagctcgccaagagcggcggcaaggccgacttcaacaagctcaacgacgtcacctccttcgacttcatcggcgaggcctacttcggcgtgcgcccctccgcgacggacctcggcagcggcgggccgaccaaggcggccaagtggctcatctggcagctccacccgctcgtcacgctcggcctcccca

SEQ ID NO: 14188 - DNA, 771 bp, Sorghum bicolor
  Clone ID: SORBI-28MAY03-CLUS8666_1
gcagcccgcctcgctctcacctcgcaatctcgcactcctccaatctccagagccctttgtcctctgtcccgagaagcaactcgcagcacagccgcggccatggactccaccgcagccggagcgggagggaaggcgaagaagggagcggccggacgcaaggccggcgggccgaggaagaagtcagtgtcgaggtcggtgaaggccgggctccagttccccgtcggccgcatcgggcgctacctgaagaagggccgctacgcgcagcgcgtcggcaccggcgctcccgtctacctcgccgccgtcctcgagtacctcgccgctgaggttctggagctcgccgggaacgccgccagggacaacaagaagacgcgcatcatcccccgccacgtgctgctcgcgatccgcaacgacgaggagctcgggaagctgctgtccggtgtcaccattgcccacggcggtgtgttgcccaacatcaacccggttctgctgcccaagaagacggcggagaaggcgtccaccggtgggagcaaggaggccaagtcgcccaagaaggccgctaagtcccccaagaaggcatagaagggtgtctatgcttatctgatgtttaccgtcgtattaccagtgatgtgttgtagatgggtgtggatggagattaaccggtcttgtagtatgttatctttaattcccagtacaagaaattcctagtttcttgaaagttaaaaaaaaaaaattattttcatgcctgtattcccgttcgctcgtgtgctctgc

SEQ ID NO: 14189 - DNA, 1178 bp, Sorghum bicolor
  Clone ID: SORBI-28MAY03-CLUS971_1
gcacgaggaacgccaagcgccgcggccggccccccggctccggcaagaagaagcagttcgaagccctggggcacgagggcatcgccttcacccctcacatcctcagcgtcaaggccggcgaggatgttgcttcaaaaataatgacattctcacagcaaggccctcgcacagtctgcatcctttctgcgaatggtgcaattagtaatgttacccttcggcagccagccacatctggtggactagttacttatgaggggcgctttgagatcatctcgctatctggttctttcctgcttgcggaggatggtgatactcgcagcaggactggtggcttgagtgtcgcacttgcaggatctgatggccgagttcttggagggtgtgttgctggaatgcttatggctgcaacacctgttcaggttgtggtggctagttttatcgcagagggaaagaaatcaaagccagctgaagcacggaaggttgaaccaatggctgctcctccaccacagatggctacctttgtgccagctccggtggccaccagccctccatcggagggaacatccagtgcatcatctgatgactctggcagcccaatcaaccacagtgcaatgccgttcaaccactccagccagcatcagcaccctcaccagcaccagcacatgccgcctgcctatgcatcggggggttggtccctctcagtgcaccagcagaataggcatgattctgacatgaagatgatgtcgaactaacagtgctcaacctaggctccccatttgttggttgggctggagaggaaggaagctgctgatggttggtactgctgctatgaaatggtctttttgcgtcatctgctctgatctgtggcggcatgttgctctgatcagtgatggcgtgtctgctatagctaagctagctaggagaattagggttcatggtctcacctgctgttgttcccctgagtaagattaatttaatttgaattagccgctgttgtaatgctgtagccggtgtcctaaagtcacttatcagtcagtccctaacgcgagttgtgatggttgcctgatgagatcttcaccttctaggctagttaaaaataccatttctctagtactattatgaatcatgaatttacttggatacttcgggtttaattcaggaatttgatcgtattctgtttt

SEQ ID NO: 14190 - DNA, 2631 bp, Sorghum bicolor
  Clone ID: SORBI-28MAY03-CLUS10496_1
acccatacactcacctctggttgggtttctgctgtgtggccgctctccctccacccaatacagagcacacacagagagagcggccgccgctccagctccgagccgagagacggagaactccatggccgccatggacctcctctccggcaagctcgtacgctccctccgcctccattcctcactcctcccctccgctccttcctcctcccgcgccgtccccacatcccgccgtctccgccgccgccgccatgcgcccctacactgccgccttaccacgtcctcctccccttccaccaccacaaccaccgaggtggaacaggacggcaaaagccaggacctttcctccctcctcacctcctccgacccctccgcccccgccggcgccgggaccaagaagaagcggtcgggcggcagcagcagcggcgcgtctagcatcccgtcgggggtgcggctggaggggatcaccaagtcctacaagggcgtgacggtgctcaaggacgtgtcctgggaggtgcagcgcggcgagaaagtggggctcgtgggcgtgaacggcgcgggcaagacgacgcagctgcgcatcatcgcggggctcgagcagcccgacggcggcgccgtcgtcaaggccaaggacaacatgaagatcgcgttcctcagccaggagttcgaggtctccgcgtcccgcaccgtcagggaggagttcttcagcgccttcggggaggagatggaggtcaagcgccggctcgagcaggtgcaggcggcgctcgagggcgccaccgaggacatggacctcatgggccgcctcctcgatgagctcgacctgctgcagcgccgctcccaggacgtcgacctcgacatggtggacgtcaaggtgcagaagctcatgccagagctcggattcttgcctgaggacgccgaccgcctcgtcgcctccttcagtggtgggtggaaaatgaggatgtctcttggcaagatacttcttcaggaccctgatttgcttttgcttgatgagcctacgaatcatgtcgatttggacactgttgagtggctggagagctatcttaagacacaggaggtgccgatggtcattatatctcatgacagggcgtttcttgatcagttgtgtacaaagatagtggaaactgaatttggtgtgtccaagacatacaagggtaactattcagagtacattctagcgaaggcagtagcagtgcaggcacagtatgctgcttgggagaagcagcagaaggagattgagcagacaaaggagctgataaacagacttggtgccggagttaatgcagggcgtgcttccagtgagcagaagaaattggagaagcttgagaaggaagggttgattgagaaacctttccaaaggaagcagctaaagatcagattccctgagcgtggaagaagtgggagaactgtgttggcaataaacaatcttcaatttggatttgaggataagactttgttcaacaatgctaatcttatagtagagagaggtgaaaagatagctattattgggcccaatggttgtggaaagagcacattgcttaaacttattttggggatggagaagccacaaggtggtgaggtgcttcttggggaccataatgtgttgccgaactatttcgagcagaatcaggcagaagctcttgatttagagaagactgtgctagacactgtatcagaagctgcagaggattggacacttgatgatatcaaaggtctccttggccgttgtaactttagggatgacatgctggatagaaaagttcagtttttaagtggtggagagaaggcaaggcttgcattttgcaagttcatggtgactccatctactttactcatcttggatgaaccgacaaaccatcttgatatcccatcaaaagaaatgcttgaggaggcaatatcagaatatacaggtaccgtaataacagtttctcatgaccggtactttataaaacaaattgtgaacagagtcattgaagtgaaagatcaaactatccaagactatcaaggagattacaattattaccttgaaaggaaccttgaagctagagaaagggaacttgcccgcgaggaagagctcgaggagaaggcccccaaagtaaaagctaagtccaaaatgtccaaggcagagaaagccgtcagaaagaagcagaagatgcaggccttccaacaaagcaaacaaaaatcaaagtcgcttaaaaactcaaagaggtggaattgagctttcatggtgaatacaatgcagacaccagtatttgctactctgcctggcgtgctgtatgctataatcggcatatcaacagaagcactggaatacatcagcagaatgtcgtcctagtagcaccatagaataccgaaaatactgttattaagcaggaagggttatgtgaccttgtacatactacatactataggcagcttctgaaggaggaacggtttatttttgcgatgaatggaaatgccatcatgtccattcagttagttttcctacttcgatagtagaaccacatattgtacaatgctgttgatcacaggctcacatgcagttcttttctcatgtacaacatgtactaattgatacatattaaatatattgaatgcaaaccaggttgttttatt

SEQ ID NO: 14191 - DNA, 1279 bp, Sorghum bicolor
  Clone ID: SORBI-28MAY03-CLUS1080_1
gcacgagcccacgcgtctacctacccaccaccgcagagctctcctcttctctctcgtcggcacacccgagctcgcgctctccttcctcgtccgaggtccaagtcactgcattgatggcgaccgacgtggctgagactcccgcgccgttggcggaggcggcccccgaggcacccgcggaggctccggcggcgcccgccgccgaggcgaagccggccaaggctaagaaggccgccgcgcccaggaagaagaccaacccgacccacccgccgtacgccgagatgatctcggaggcgatcacgtcgctcaaggagaggacggggtccagccagtacgcgatcgccaagttcgtggaggacaagcacaaggacaagctccctcccaacttccgcaagctcctgctcgtgcagctcaagaagctcgtcgccgccggcaagctcaccaaggtcaagaactcgtacaagctgcctgccgcacgcgccccggccgccaccaagcccaagcccaagccgaaggccgcgcccaagaagcccaagactggcgcaaagaagcccaaggccgccgccaagcccaaggcgaaggcacctgccaaggccaagcccgccgcaaagcctaaggcccctgcaaaggcgaagccagctgccaagccgaaagccgcagccgccaagccgaaggctgcagctaagcccaaggcagccgctaagccgaaggccaagccagctgccgcgaagccgaagccgaagccgaaggcagtcgccgccaagccgaagcctgctgccaagaaggccggccgccccgccaaggccgccaagacgtcggctaaggacacgcctgggaagaaggcgccggcggccaagaagcccgcggctgccgcgaagaagtcggctgccaagaaggccgctccggcgaagaagtccgctgccccggcgaggaaggtgcctgcccggaaggcgaagaagtagagcggcggtcgggcgccggaggaatctagggtttcgttctcgtttggtgctagatgtattactcttttttgctcttcccttagtcgaggtggtgtctgtggtacttagcctgtaaattggatatcggaggcgggggtacactaggtcattcgtgtacccatggtgaaaggcgaaagcggcggcgaaaggagtctgttattattactagagggtgtatttctgtagctgatgatgatggtggagttgctgtcctcatggagagttgttaaaggttatgtggtgataaaagttaatgttgagaattacctacctttttgctg

SEQ ID NO: 14192 - DNA, 1703 bp, Sorghum bicolor
  Clone ID: SORBI-28MAY03-CLUS948_1
gcacgagggcgaggggcagtgcttgagagagagagagagagaaggggagacccatcacccattaccaatgccaagaacaagaagccagagaggacagccgcgaatccaatccgaatcccctccaaaaacccaccaaactgcctcccccatctgcaagaacaagagcagcaggagagcatcctagtagggaaaaaaataggagaaaaaaaagaagcccagagagaccagctgaccaagcaaaaaggtagcatctttgtgtcaccaagacaccgccgatcacagaccaaatcccccctcctctggtccatcccgagcgtagagcagcggagatttcttcgatctgtgcttgcgttttttttccgtgtaaagattttgtttttcctttgactgttactagcgttgggttgttgagaagtttcgagaagagtgctgtgtgagtgttgaagagctcaagatggatccggccttgcttgacgacgtcatacgccggcttctggaggtgaagaatctcaagcccggtaagaacgcgcagctgtcggagtcggagattaagcagctctgcgctgccgccaaggagatcttcctttcgcagcccaacctgctggagctcgaggcccccatcaaaatctgcggtgatgtccatgggcagtactctgatctcctgaggctatttgattatggtggctatccgcctcatgcgaactaccttttcttgggtgattatgtggatcgtggaaagcaaagcctggaaacaatatgtcttcttttggcctacaaggtcaagtacccggagaacttctttcttctaaggggcaaccatgaatgtgcatcagtaaatcgcatctatggtttttatgatgagtgcaaacgcagattcagtgtaaagctctggaaaacattcacagattgttttaactgcttgccagtgtcagcattgatagatgaaaagattctctgtatgcatggcggtctatctccagagttgaacaagcttgagcaaatactcaacctgaatcgccccacagatgtgcctgatactggattgctctgtgatcttctttggtctgatccttccaatgaagcaacaggctgggccatgaatgaccgaggtgtttcattcacatttggtcctgataaagttaatgaattccttgagaagcatgatttggacctcatctgccgagctcatcaggttgtcgaagatggatatgagttttttgctaaccgccaactcgtaacaatattctcagcccctaactactgtggagaattcgataatgctggtgccatgatgagtgtagatgagacattgatgtgctctttccaaatactgaagcctgcaaggaagatgctgggtggttcaactaataacaaatctggcttcaagtcattgagaggatggtgacaatggcctgatggtgagcatgctacgatcgacatgggtacatcttacagcggctgcaactaacaggcatatgaattgttgcggaaacctcatgagcctggaaagggcaaaagcagatgtagaactatgcatcttccatgttggattaacactcttgtaatgtattattattggtttttactatgcggatctcctatgatataagaggatgtgaatgagtactaccccctttcctttgcgtcctaaaattcgaaagattcaggcaggcaagcgccaataaaaaatagccagatcattg

SEQ ID NO: 14193 - DNA, 475 bp, Sorghum bicolor
  Clone ID: LIB3476-022-P1-K1-F10
gaaaaaaaagaagcccagagagaccagctgaccaagcaaaaagcgttgggttgttgagaagtttcgagaagagtgctgtgtgagtgttgaagagctcaagatggatccggccttgcttgacgacgtcatacgccggcttctggaggtgaagaatctcaagcccggtaagaacgcgcagctgtcggagtcggagattaagcagctctgcgctgccgccaaggagatcttcctttcgcagcccaacctgctggagctcgaggcccccatcaaaatctgcggtgatgtccatgggcagtactctgatctcctgaggctatttgattatggtggctatccgcctcatgcgaactaccttttcttgggtgattatgtggatcgtggaaagcaaagcctggaaacaatatgtcttcttttggcctacaaggtcaagtacccggagaacttctttcttctaaggggcaaccatgaatgtgca

SEQ ID NO: 14194 - DNA, 1583 bp, Sorghum bicolor
  Clone ID: SORBI-28MAY03-CLUS13316_1
cacaaaccgcaggttcgggagtactccggaacccgcccccgcatccactcgacgccacgactgacgacggggagccccggtctccctccaccgccaccgccccacataaaagaagggaagagagccttgcagcgagaagccgagaaccctatcgatctcgcctgaagcaatccgcacctatcgtgagcagaaccctacagttcgtctcgcctcatctcgcagcaccagctgcagaagaagaacaagggggatggcgaaggatgggggccccgactggaacggcctgttcaagtggagcatcgcccacggagacggcaccaaaccgccgcgtgctctcagtgaggaagacagaaaatggttcatggaggctatgcaagccaacacgatagatgttgtcaagaggatgaaggagatcactcaggtgatgaaaactccagaagatgtcttgcagtctcagggtgtgaccccagagaacattgaagatatgttggatgagctacaggagcatgttgaatccattgacatggcaaatgatctacattctattggtgggttggatcctctacttggttacttgaaaaattcaaatgctggcatccgagcaaaggccgcagaagttgttagtacaattgtgcagaataatcccaagagtcagcaacttgtcatggaatccaatggactcgagccactgttgacgaacttcaaatcagatccaagtacaaatgcacgcacaaaagctttaggagccatatcttctctaattcgtcataaccagcctggaatttccgcatttcgcctgggaaatggctacgcgggattgaaggatgctcttggttctgatgatgccagacttcaaaggaaagctctcaatctcatacaatacctgctgcacaacaacaaggcagacaggagtgttgctacggagcttggtcttccaaagctgatgatgcaccttgcgtccagtgatgattccttggtgcgcgaagctgctctaagtggcctccttgagttggcacaagacaagacatctggtaacgttctacccgaccaagacaagctgaaagacattctcaagagccgaattgaaggaatcagcgtgatggattctgatgatctccatgctgctcgcgaagagcggcagctggtagactcgctctggaaggagtgctacaacgagccttcgtctctcagggagaagggcctcgttgtgcttcctggagaggatgcgccccaacagctgccaccagatgttgcaggaaagatgtttgagccgccgcttcgcgcgtgggcagctgcaagacctgctcaggaagatgattctgattctggcagcggaaagaaggatccaccattgatgcttaagttttgacggtctccagataccaatcccagttcttaggcctgatggatacctgcctgttgccctgttatgcacacactatcatcgtgtatggttcagtagcggttaatgtgctcagcatttcggttcagagtttgctttctgagacacagacgatgacatatattgtattatgtgatgctcgtaaattaatgctacatgtgaattatcttgcacgatagtt

SEQ ID NO: 14195 - DNA, 802 bp, Sorghum bicolor
  Clone ID: SORBI-28MAY03-CLUS436_1
taccattatagcagatgctgctagcaaagatgatatccaggccagaattgctcagctgaagagagagctttctcagacggactcggcttatgactctgagaagttggcagagagaattgcaaagctttctggtggagttgctgtgatcaaggttggagcctcaaccgaggcggagcttgaggaccgcaagctccgcatagaggacgcaaagaatgcaacttttgcagctatagaggaaggtattgttccaggaggtggtgcagcctatgttcatctctcaacatttgtaccggctatcaaggagacgttggatgatcctgaagagcggcttggtgccgatatcattcagaaggctttggtggcacctgcagcgttgatagcacataatgctggggtggaaggtgaggtgattgtggataaaatcagggaaagcgaatgggagtttggttataacgccatggcggacaagcacgagaacctggtggaggctggtgtgatcgaccctgcgaaagtgacaaggtgtgccctgcagaacgccgcctcggtggctggaatggtgctgactacccaggcaatcgttgtggagaagccccagaaggctcctgcagctgcagcggcaccctaggattcttccacaccatgtaatacttactaggcacggaacaggcactagcgtgcaaaaaagaagaaaaaaaaatgtggtgatccttagagtgacaagggagagaaaactgataaactattttttttgtcatgcgtgggcaagaataaattgaatcaatgtgggatccatggggcgaaa

SEQ ID NO: 14196 - DNA, 1531 bp, Sorghum bicolor
  unsure (1)..(1531): unsure at all n locations
  Clone ID: SORBI-28MAY03-CLUS55592_1
ccacccagtacacggctcgtcaggtggtcgtcgtcgcccccgcatagttttgcggccacaccaggtgcaggaggagcacagcaccatctggcacaccgcaccgtaccggtcgggccgcatgatcgtgagcgggcagctcctgctcagatgggtggacgtccgcgccatggcgcccccgccagcagccgctggtcgtcgcggcccccggcggcagccgctgtccggcaacgctggcgtgctgaaggtcatcgccgagaccgacgcggctgacgtgaaggcgtctcgttcggttttcttgcaccgcacccataactgtggcggtgtgtgtgtagtactctcccacccggtgcttttcgtccacgttcagatccgcgctgattctccgtgccctcttggctatgtcatttgaaagtctgggattgcgagtaccgcagtgctgtggactgcggctatcgagtaccagtatgcaatcttcaaaaatgagggctataacatcactggaaagggctagctgatgcttctgctgatcaaccagattgtaggtttctcgttcgcacttttctaaggatgtctttgcacgcccgaggagctcatggggcgggaagcgctgcaggagctctggcagaagcacaaggtcgacctcgccttctatggccacgtccacagctacgaaaggacatgccccgtctaccagtctcagtgcgtcgtcgacggatccgaccactacagcgggccgttccaggcgacgacgcacgtcgtcgtcggcggcgcaggggccagcgttctcgattctgagttcaccacctcgaagatccggtcgggccgctgcccccaccccggccacgggctcgccagcctcccggccctcctccgccccgccccgccgttcgcgtacaagaagagccgggacggcaacgtgtatgaccatttcaccatctcacgcgactaccgggacatcctcgcttgctccatcgacaactgtccccggaccacactggcttcctgaagttgatcccacaggccacagtagctgcagagaagaaatttagttcgtagtttttggagcgcaccaataaatgaggcattttctgtttaatactatatacctgcattggtgggccccaggggcggcatctccgtcccgatgggccgcttgtctccgtgggtcctcctctccgctccggcccgacctatcgcgtcttcggccccattcttgcggccctgtggtaatcantgagagggattggcctggcactggttcattctacgggaatctcgactccggcggagaatgcggtgtccctgcccaaaccgtgttctacacaccagctgagaaccgtgcaaagttctggtacgcaacagactacggcatgttcaggttctgcatcgcgaacacagaagaggactggaggcccgggaccgagcaatacaagttcatcgagcaatgcctgtcttctgtcgacaggcagaagcagccatggctcatcttcctcgcgcaccgcgttcttggctactcgtcctgcgcctacta

SEQ ID NO: 14197 - DNA, 737 bp, Sorghum bicolor
  Clone ID: SORBI-28MAY03-CLUS4402_4
gccggccgggttccgactcgcgaccagcaccgtctctctcttcctcacgacacgagcgcttgcggcggcggcggcagcggaaggaggcgacgatggggcactccaacgtgtggaactcgcaccccaagaactacgggcccggatcccgcgtctgccgggtctgtgcgaaccctcatggattgatcaggaagtacgggctgatgtgctgcaggcagtgcttccgcagcaacgccaaggacattggcttcatcaagtaccgctgaaatcagctgggctaccagggtgaggtttggcatggaccctatgaggtcgaggtttgacatggaccctggtggtagatcaaggccgcaattttaattccagtaatttagatgttttgttcagaactctgctagtaaagtctgccatatttgtcatattgaacatgagttacctgcgttgtgcttaagctatcttgtgtgctaccatcatatttgtcactcgttgggtatcaggaactctgtaatgtcgaatggttaaggtgccataataatctttgtatgtgcaaccttcaagtgtggacggattaaattttgtagtcaaaaaaaaaaaaaaaaaagctgcgtctgtacagcatcaatatcaggcatcacaccataggattactctgctccatggaaaatattgcccttgttatctgatggatgctgaatagaaataggattccacgacaaaaaaaaaaaagataaaggccccta

SEQ ID NO: 14198 - DNA, 493 bp, Sorghum bicolor
  Clone ID: SORBI-28MAY03-CLUS4402_3
gccggccgggccgggcttctacgcttccatctctctgctgttccttgcgcgccgccgccgccgtgaaggaaggaagaggaggagcgaagagcacgacgcgatgggccactccaacgtctggaactcccaccccaagaactacggccccggctcccgcgtctgccgggtctgtgcgaatcctcatggtctgatcaggaagtacgggctcatgtgctgcaggcagtgcttccgcagcaacgccaaggacattggcttcatcaagtaccgttgaagaatctactctgtgtagtggagaacttcctggatcaaagaaatggatgcttcattagaaggcctaaattatgtgcttaagcattttgttcagaacttgagactcatgtgctagtaaacttgttaaaatttttgatgggtaccatgtgcctgttggaccatctgtaatcagaagattgaaatattttgttacgcacaaaaaaaaaaaaaaaaaaggccccta

SEQ ID NO: 14199 - DNA, 619 bp, Sorghum bicolor
  Clone ID: SORBI-28MAY03-CLUS4402_2
gccgccggggttctacgcttcccatctctctgctgttccttgcgcgccgccgccgccgtgaaggaaggaagaggaggagcgaagagcacgacgcgatgggccactccaacgtctggaactcccaccccaagaactacggccccggctcccgcgtctgccgggtctgtgcgaatcctcatggtctgatcaggaagtacgggctcatgtgctgcaggcagtgcttccgcagcaacgccaaggacattggcttcatcaagtaccgttgaagaatctactctgtgtagtggagaacttcctggatcaaagaaatggatgcttcattagaaggcctaaattatgtgcttaagcattttgttcagaacttgagactcatgtgctagtaaacttgttaaaatttttgatgggtaccatgtgcctgttggaccatctgtaatcagaagattgaaatattttgttacgcttgatatttggtgttcttatcttgtttgtattggttcttacatgtgttattggtgtcaaagatgaatgatggctattacactcaaggatattgaagtgtgaatgtaataacttctggtttgtttggctgggagaaaaaaaaaaaaaaaaaaggccccta

SEQ ID NO: 14200 - DNA, 630 bp, Sorghum bicolor
  Clone ID: SORBI-28MAY03-CLUS4402_1
gccggccgggccgggactcgcgaccagcaccgtctctctcttcctcacgacacgagcgcttgcggcggcggcggcagcggaaggaggcgacgatggggcactccaacgtgtggaactcgcaccccaagaactacgggcccggatcccgcgtctgccgggtctgtgcgaaccctcatggattgatcaggaagtacgggctgatgtgctgcaggcagtgcttccgcagcaacgccaaggacattggcttcatcaagtaccgctgaaatcagctgggctaccagggtgaggtttggcatggaccctatgaggtcgaggtttgacatggaccctggtggtagatcaaggccgcaattttaattccagtaatttagatgttttgttcagaactctgctagtaaagtctgccatatttgtcatattgaacatgagttacctgcgttgtgcttaagctatcttgtgtgctaccatcatatttgtcactcgttgggtatcaggaactctgtaatgtcgaatggttaaggtgccataataatctttgtatgtgcaaaaaaaaaaaaaaaaaggatactatatatgacaaataaggctggtcttgtgtgattgttgtatcttctggtttgtttggctggt

SEQ ID NO: 14201 - DNA, 841 bp, Sorghum bicolor
  Clone ID: SORBI-28MAY03-CLUS13936_1
ccggggtgtcggcccacaacctcagctccgccgcttctgctctctaccggctctcgcctcgcttcgtctacacgctaccgccgaacagccgctctctcctcccgaacccccccgctagttcgccgccgccgttcgcccccacatggccgccgcgtcgtccgccacctccgtccacgacttcaccgtcaaggatgccagcggcaaagacgttgacctcagcacctacaaggggaaggttcttctcatcgttaacgtcgcatcccagtgtggcttaaccaactccaactacaccgagctggcccagctctatgagaagtacaaggaccaaggctttgaaattctggctttcccatgcaaccagtttggtgggcaggagcctggtaccaacgaggagattgtgcagtttgcctgcacacgcttcaaggctgagtaccccatcttcgacaaggttgatgtcaatggtaacaatgctgcgcccatctacaagtttctgaaatctagcaagggtggcctttttggcgacagcatcaagtggaacttttccaagttcttggttgacaaggagggacgtgttgtggatcgctatgctccaacaacttcacctctgagcattgagaaggatatcaagaagctgcttgggagctcttaaagaatatctagctcgaaaactgtataaaaaactgtatgagcattgctctgagcgctaaaatatcgaataatgttgtgttaataaagtagtgctccgtatttgagaggttgcagtacctgttctattttccttgcatgcactctgtacttgtatatgcccttcgaatgaattccaatgctgtatcagttggct

SEQ ID NO: 14202 - DNA, 1807 bp, Sorghum bicolor
  Clone ID: SORBI-28MAY03-CLUS1480_1
gcacgaggagagaacacagggagggaggtagagaggcggaggcggaggaggagggggcgcggggagaaggcgaagaggaggaaccaaatctcggaggtgaacagagagatttctttggcggaggaaggaggaggttagaggtagcccaatagatctgctgctgttgggggagttgatgcaaagctgagttgctgcacgttggattccttcagagatggcttcagctggtgtagccccttctgggttcaagaacagcagcagcgccagcattggtgtggagaagttgcaagatcagatgaacgagataaagattagagatgataaggaagttgaagcaaccataattaatgggaaagggactgaaactgggcacataattgtcacgactactggtggcaagaatggtcaaccaaaacagacagtgagctacatggctgagcgcattgtaggtcaaggttcttttgggattgtcttccaggctaagtgtttggagacgggtgagactgttgcgataaagaaggttcttcaggataagcgttacaagaaccgtgagctgcagaccatgcgccttcttgaccaccctaatgttgttgctttgaagcattgcttcttttcaacaactgagaaggatgagctttatctaaacttggtccttgagtatgtgccagagacagttcatcgagttgtgaagcatcacaacaagatgaaccaacgcatgccacttatttatgtgaagctgtatatgtaccagatatgtagggcattggcttacattcatggtactatcggtgtctgccacagagatattaagccacaaaatcttctggtgaacccacacacccaccagcttaaactatgtgactttggtagtgcaaaagttctggtcaagggggaaccaaacatatcgtacatctgctcccgatactatagggctcccgagctcatatttggtgctactgagtataccacagcgattgacatttggtctgctggatgtgttcttgctgagcttatgctagggcagcctctgtttccgggtgaaagtggcgtggaccaacttgttgaaatcatcaaggtccttggtactccaacaagggaagagattaaatgcatgaacccgaattacacagagtttaagttcccacaaatcaaagcacacccatggcacaaggtattccacaaaaggatgccgccagaagctgttgatctggtctctcggctactccagtactccccaaatctgagatgcactgctgtggaggcacttgttcacccattctttgatgagcttcgagatcctaatacccgccttccaaatggccgctttttgccaccccttttcaatttcaaggctcacgaattgaaaggagtcccagcagacattgttgcgaaattgattccagaacatgcaaagaagcaatgctcctatgtcggattgtgaaatggctgtgccttgagactgaacctatggttgcaattgtgcatttcccctgggatgttggatgatctgaggcatgcgagcccgtcgttgaagatgcaaggttatctacttgtacgacaatgtgacctgtgtagctgagtagtctatgtcgcagtgacatgtaacggcacccccttcctactaactgacgcttactggagattgccatagctgatcttgtaatttgttatagagcagtatgaatgtatttatggtagcttgaatctatgtatggattcacttcgttttttcatgtttccttgtctccgacccagactgctaccgtattttgtttcagaattcctagctacctgttgtctagtgcct

SEQ ID NO: 14203 - DNA, 1343 bp, Sorghum bicolor
  Clone ID: SORBI-28MAY03-CLUS17233_1
cggacgctcgaggcggccgggccggttgctggtgtaattatcggaaggggcaagcagctgcagagctgcagcgaccaaggggacgacgcgaggaagatgagggcggtggtgatcacgcgcggcggcggcggcccggaggtgctggaggcgcaggaggtggaggaacccgcgccgctgggagacggcgaggtcctcctccaggtggccgccgcgggcgttaaccgcgccgacacgctccagcgccacggccgccatccgccgccccccggcgcgcccccttacccggggctcgagtgctccggcactatcctcgcgctcggccccaacgtcccaccgcggtggtccgtcggcgacaaggtctgcgcgctgcttagcggaggcgggtacgcggagaaggtggtggtgccggcgggccagctgttgccggtgccggagggcgtgtcccttacggacgcggccggcttacccgaggtggcctgcaccgtctggtccaccgtgttcatgaccagccacctctctcccggcgaatcgttccttatacatggaggatcaagtggaattggtacgtttgctatacagattgcaaagcacctcggaataaaggtttttatcacagcaggaagtgaagaaaaactagcagcctgcaaagatttgggtgctgatgtatgcattaactacaaaactgaagactttgttgagcgtgtcaaacaggaaactgatgggaaaggtgtcgatgtaattctcgacaacattggaggaccatatctccagcgcaatctgaacagcttaggtgttgatggcagacttttcatcattggcttccaaggcggtgctgtaactgaagtgaacctgcaagctgtgcttgcacggcgtttgaccatacaagctgctggactgcgcaacagaagccttgctaataaagcagagattgttggtgaggtcgaaaagaatgtgtggcctgctgtcgctgctggcaaggtgaagccggtgatttacaagacgtttccgttgtctgaagctgctgaggctcataggttgatggaagctagcacccacatcggcaagatactgctgcttccatgactgtgcctgtagcttttgggctctttagttctggaggagtcagttcaagaacatatgcaacttctgtgacagtctgcatgaatggtgtactggtgtagcatggcctttttatcttgtatactagattggatctttttcccctgagcaattctcttgtcaattggatccttcaagtactgatgatgtttttctgtgagctatgatataataaatctggcagacggacatgtccatgccactacagtacatcaaaaaaaaaa

SEQ ID NO: 14204 - DNA, 1489 bp, Sorghum bicolor
  Clone ID: SORBI-28MAY03-CLUS14215_1
gctctccgccttggcctgtggtgggccttcactagcagaaacgaacagtagaaaatctaaaacttttcacacaagcagcataaaactacaagcactacagtcgtctacaaaccatcagttcccagcacatcgaactccaacgctatggcattattctcaactctccgggtagacacatatcacgccctcaccgacatactcactcccgagcgacggcgaccagttgcttgccgacgttgcggccggtgaagagcccgatgagcgccgccggagccttctctagcccatcagcaatgtcctcaacataggttatctttccctccttgaggtacccggccatctcctgctcgaacttgtggtactggccgtagtagtccatgactatgaagccctccatgcgcaggcgcttagcgacgatctggaacaggttgtgcacgccctctggctcctccaggttgtactgcgagatcatcccgcaggtcgggatccgcccatggttgcgcatgttggacagcacggcttccagcgtgcggccgcccacgttctcgaagtagatgtcaatgccctctgggaagtacctattctacaatacatttatgcccggctttttatcgttgttgagcccttcatcaaaggctactggggctggcgggtgcctcgccctctcgtccggcccgccgcccccccccccctacccgcctgtgagcttagcaaactgaccaacaagctgaccaacggcgcctgatgctgcggatttcagaagactcaccttctcgtctgaaccagcactgccgacaacataacagcctgtgagcttagcaaactgaccaacaagctgaccaacggcgcctgatgctgctgagacgaagacatagtcgccattcttgggcttgcccacatcgaagaatccagcccaagctgtaaggccgggcatgccaagaacacctgtgtagtacgacagaggcagttcagggtgattgatcttgaaaaacgactctggcttcgggacgaaagtgtactcctcccatccggtcatcccccagacaagatcaccaaccttgaaatccggatgcccagatgctatcaccttgcatacaccaaagtttaccaaagcctctccgacgacgaagtccgggacgtagctgggcctgtcgtgcttggtcatgcggccgcgcatgtaagggtcgcacgagacgtagaggttcttgaccaccatggccgccgtccccggcggcacggcgaggcgcgccgtcccggtgaccacctccatgtcgtcctcgctggggaaccccgacacgtagcgcttcaggatcacccgcttgttgggcacctcctgcccgtcggccgacgacgccgccgccgccgccatggctccgatatggtgctctcagtccctgcctccctggtgtgtttgccttggagatgggtgggggatggctcggcagacgcctggagagtgcgggcaggcagccccgcccccacctcgtgc

SEQ ID NO: 14205 - DNA, 390 bp, Sorghum bicolor
  Clone ID: LIB3480-014-P1-K1-F12
cggacgcgtggggatcgcgagtggccgcccttttttttttttttttagaaaatctaaaacttttcacacaagcagcataaaactacaagcactacagtcgtctacaaaccatcagttcccagcacatcgaactccaacgctatggcattattctcaactctccgggtagacacatatcacgccctcaccgacatactcactcccgagcgacggcgaccagttgcttgccgacgttgcggccggtgaagagcccgatgagcgccgccggagccttctctagcccatcagcatcttcttactatatatatatgtggttaggggagcaataataaggattaaggaaccaaccctacatatgactggttcgcgaggatgatgatgatatattta

SEQ ID NO: 14206 - DNA, 2742 bp, Sorghum bicolor
  Clone ID: SORBI-28MAY03-CLUS1637_1
gctcggccgctgggctactctggtgcgatgggagtggcggctgttgtctcccacctgctgatgcagctccagagcaaggctgcggccttcaccgtgctcccccaccccgcatgcgcactgccgctcgagcggatgtatccgctgcttgacgttgcgcggcggggtgtcgccgcgctactccgcgcagtggctatgagcaagataaaggagctgcagcggcagatacagttggaagcaggccagacaaaaggtcagctgatgctgctgaaacagcaggtcatcggattgaaggccaaggaggaagaggcggcaaaaaaggaagtcgaggttgagcggaagctgaagaagctcaaggagttcgaagtggaggtacttgagctaagaaggaagaacaaggagttgttgtacgagaagagagatctcattgtgaagttggatgcagctgaagggaaaataactgagagtgatgtagttgccaatgcaagggaagagataaacaagctgaggcatacaaatgaggacctcacaaagcaagtggaaggcctacagatgaacaggttcagtgaagtagaggagttggtatacctgcgctgggtcaatgcctgtctgagattcgaactccgcaactatcagactccatcagggaaggtgtctgcacgtgatcttaacaggacactgagccccaaatcacaggagagggctaaacaactgatgttggagtatgcaggatctgaacggggtcacggtgacacagaccttgagagtgtttcttcaatgccgcccgcgcctggaagcgaagactttgacaacatttcaattgacagttcttccagcagatacagtttcctaagcaaaaggtccaatctgatgcaaaaaatcaaaaagtggggaaggagcaaggatgacagcagtggtttagcctccccaatcagtggttctccactgaggaaaccaaagggccccctcgaagctctcatgctaaaaaatgctggagatggtacagccataacaacatatggaaagagggatcccaatgatgtcttggacgatgaaaatgttgcgtcctcattccaactgatgtccaagacagtcgaaggttttgctgatgagaagtatcccgcttacaaagataggcacaaacttgcaactgaacgggagaaggtgataaaagagaaggctgggcaagcaagagcacaaaggtttggtggtggacacagttcagctcttatttcctctcctaaaggtgcactccctccgaaacttgctcaaattaaggagagatcccctgcagctaatgctgaatccagtgagcaatccagtgacaaccaaaacaacaccctggtggtgagccagatgaagcttgccaacattgagaagagagcaacaagagttcccagaccacctccccctcgatcaaccactgcttcaggggctactaatactgcaagtggagcacaaacgccacgtgcaccaggtgcacctcctcctcctcctccacctccagggaaagctggtggcccaccaccaccgccgccacctccaggtgctctaccaaggaaccttggtgggggtgacaaggtacaccgtgcaccggagattgtggagttctatcaaagtctcatgaagcgtgaagcaaaaagagagacatctttaggatcaatgtcatccaatgtttctgatgccaggagtaacatgattggagagattgagaacagatcaacctttctcttagctgtaaaagctgatgtggagacacaaggagaatttgttgagtctctagcaaatgaggtccgagcagcaagctttgtaaatattgatgatgttgttgcatttgtaaattggttggatgaggagttatctttcttggttgatgagcgagcagtgctaaagcattttgattggccagagagcaaaacagatgcaataagagaagcagcttttgagtaccacgatctgatgaagttacagagcaaggtttcatcctttaccgatgatccacaacttgcatgtgaagaagctctcaagaagatgtattctttgcttgaaaaagtggagcagagtgtctatgcactactccgtacaagagacatgaccgtctcacgctacaaggagtatgggatcccatttgactggctgtctgattctggagtagttggcaagatcaaattggcatctgttcagcttgcaaacaagtatatgaagagggttgcctcagaacttgacgcattggaaggcactgagaaagagcccaatagagagtttttgcttctccagggtgtgaggtttgctttccgggttcatcagtttgctgggggctttgatgcagaaagcatgaaagcttttgaagagctaagaagcaaaatgaccacacagtcatctgctccacagatatctgaaggctgaagcataagttgaacacaggattcagcatacatctgctcttacttgctggagactgatttttggttgtgtagctaaagtgtacaaaagagaagtttaaattccggtgttgtgtcaagcaagttgtatatgctaagagaatgtacaagttatcaggttctgtgcatacatataacagttttgcatagttatgtagcttaagttatcagcaagttgtatatgttatacctataccttttcttttttaaaggctgtaactgtaaacaggcagttccagaaaatgaagcacattagatgcatagttttgcaactgttgttttcagcggggcatgcttttgttaa

SEQ ID NO: 14207 - DNA, 1006 bp, Sorghum bicolor
  Clone ID: SORBI-28MAY03-CLUS17829_1
gccggccgggccgggatcttggtatggatgtttataagattgatcgtgcctgtacaaatttggaatgcccatgggtcctttcagactggcagatctggttggttttggtgtggctgtagccactggcatgcaatacctggaaaacttctcagagagggtctacaaatcaatgctacttcctctgatgatggaggacaatagggcaggtgaagccacccaaaaaggattttacaagtatgagggcaagaggaaggccactcctgatcctgaaattatgaaatatattgaaaaatctaggagcatggcaggagttgcaccagatcctgagttgctgaagctaagtgagaaagacatagttgagatggtgtttttcccggtgataaatgaagcctgccgagtccttgatgagggtattgcagtgaaggcttctgatctagacattgcttcaatcttcggcatggggttcccaccttataggggcggtgtcatatactgggcagattccatcggtgcaaattacatccatggaaagttggaggagtggacaaagcggtatggtggcttcttcaagccttgctcttacctcgctgagagagctgcgaaagggattcctctgagtgcaccggcaaagaaagctcaggctcggctataagacaaacaccaggtttccttgtggacggaggatactacactgaataatacactccagcgaacgcgcggaatatggagcatccggagtgccctgaagtagaccagcgttgttgcgttgcgagaatgcatggagccgtagatgactgaagtagaccactatcagtcatggaacgcaatatgctactgtgaaataaagtagggaactgtagcacggtggtggtgtcttcctttatattgttgcaagcccagctatagggcacccttcaaaatacaaaaatgttttctgtcacctgtaaaaattaaaacagtttttttttgtgcaatttcatgagattgaggcactgtttcaaattct

SEQ ID NO: 14208 - DNA, 1332 bp, Sorghum bicolor
  Clone ID: SORBI-28MAY03-CLUS21122_1
gccggccgggccgcgacgccgagggagacttgtgagagagaaaagaaacagacgcgctcgcttccttgtccctccaacctcctctcccccaaccgcccgaggcggtcgccgccccccgccgtgccctcgcccgcgcgggagacggcgcagcaacctcgcgtgagatcccccgtcgatcggcaggatggtggtggccacggaggaaatggcggtctactgctttgacaccctcgtcgcccactacaccggcgagcagccgccgcctcccgccttcgaggatggaaaccacccattgtttgtgacctggaagaaggttgccaatggttcagaaccacgcctcaggggatgcataggaaccctggagccccgtcagattgtcagtggctttaaggactactccctaactagtgccctgagggaccgacgctttcccccaatacaatcaaaggaactcccaaccttggaatgcacagtatctatactcactgattatgaaattgcagagggctaccttgattgggaggttggaaagcatggtttaattatcgaatttacagatccagaatacaacataagacgcagtgcaacctatttgcctgaagttgcaggccatgaaggatggacacatgcagaaaccattgattcgctcatgaggaaggcaggttaccaaggtaccatcactgagtccttgaggaagaaaatcaaagtcacccgctaccagagcaccctgtgcaccatgcactatggtgaatatgttgcatacctcaagaagaatagaggtgcagccccgtcaattagtggggtgcctgcagttaatggcttcaagccaggtcattgatttatccgtattgaaaaaagctcaaagaacatattattataattcatctgggagcaatttggggtgtgcaagtgtaaccacccctcacaattgattgatctagcgtcatttctttccaaggaaggccaaataggggcgtcatgacaagcacctagaataatgtcttcctgggatgtatgatgcttatgtatcttgaaaacacatgtgcttcaagaagttcaaattatgtggtggaattaattgattcgagatgccattcctagttccagtgatttgtctcaattcataaatggtgtgcaagtgtaaccacccctcacagttgattgatctagcgtcatttctttccaaggaaggccaaataggggcgtcatgacaagcacctagaataatgtcttcctgggatgtatgatgcttatgtatcttgaaaacacatgtgcttcaagaagttcaaattatgtggtggaattaattgattcgagatccattcctattcc

SEQ ID NO: 14209 - DNA, 1678 bp, Sorghum bicolor
  Clone ID: SORBI-28MAY03-CLUS6405_1
aaattccaaatacttattcctaatctctttgttaatcatcacccgagctacgagcttcgaagtcgagggccagctaccttgagcatcaacacccttgacatcatagcgtggctccatccaagcagatgagcagcaatccagtgaatccgatcatcttcttctttcgcttcctcgtaggaacaatatgtgctgcatactatgttctggtgcctatttatatgtggataaaggaccagatcgtgccaaatggcatgccaatctgagtgaaggggaatgacacgcatggaagagatcgtagcccactctgctcgtcgcatccacccatcccctctccccctgttccccctcgtcgcggcgcgggcggcggcaatggcgatggcctccacctacgcgccaggcggcagcgcgggggcgctcgcgccgggaaagggcagggtccgcggccccgctgggctcggcttcctcagcccatccaaggtcggcggcctcccccgccctctcgccctcgccaagcggagtcccgtcgcggccaggctgcggtgcgcggcgtcgtcgtcctcccccgcggccccggcggcgcggcccgtcacggcgccgcgcttcatccagcacaagaaggaggccttctggttctaccgcttcctctccatcgtgtacgaccacgtcatcaacccgggccactggaccgaggacatgcgcgacgacgcgctggagcccgccgagctctacagccgccacctcaaggtcgtcgacgtcggcggcggcacggggttcaccacgctcggcatcgtcaagcacgtcaacccggagaaagtcacgctgctcgaccagtccccgcaccagctcgagaaggcgcgccagaaggaggcactcaagggggtcaccatcatggagggcgacgccgaggacctcccgttccccaccgactccttcgaccgatacatctccgccggcagcatcgagtactggccagacccacagcgggggatcaaggaagcctacagggtgttgaggtttggtgggctagcttgtgtgattggcccagtgtacccaaccttctggctgtcccgcttcttcgccgacatgtggatgctcttccccaaggaggaagagtacatcgagtggttcaccaaggccgggtttaaggatgtcaagctgaaaaggatcggaccaaagtggtaccgcggtgtccgaaggcatggcctcatcatgggttgctctgtcacaggcgtcaagagacagagcggagactctcccttagagcttggtcccaaggcggaggatgtcagcaagccagtgaatccgatcaccttcttctttcgcttcctcgtaggaacaatatgtgctgcgtactatgttctggtgcctatttacatgtggataaaggaccagatcgtgccaaaaggcatgccaatttgagtgaaagggaatgagctgcattgaagagaggatagccaaacatctgaattagtcttctctatattaggcgcttcctgtctgttttgtattattacctcttgttttcctgctgctatgtacttcttgtactgctcctgtttgtgcgaattaataatattaagacatggatattctccagtttcttgagcatgactgctttcagtgggacctttgtagcaggttattggatttaaattatatgatgtataatttagttggt

SEQ ID NO: 14210 - DNA, 1242 bp, Sorghum bicolor
  Clone ID: SORBI-28MAY03-CLUS8056_1
gcccgtggcccgccaccaccacaccacaccccgcctccctccccgcccgcactccaccacccgcgccgcgccgccgcctctgactccgcctcggccgcctcggatccggaccgagcgccggcgatggcgctcgccttcgacgagttcgggcgccccttcatcatcctgcgggagcaggagaagaagacgcgactgcgggggctcgacgcgcagaaggccaacatcgccgcgggcaaggccgtcgcgcggatcctccgcacctcgctcggccccaagggcatggacaagatgctccagtcccccgacggcgacgtcatcatcacaaatgatggggcaaccatcttggagcagatggatgttgacaaccagattgcgaagctgatggtggagctgtcccgtagtcaagactatgaaatcggggatggtactaccggcgtggtagtcatggcaggggcgctcctcgagcaggctgagaagcttctggaacgtggtattcaccccattagggtggctgaaggctatgagatggcatcaagggttgcttttgatcacctagaacgtatatcccaaaagtttgagttcactgctgacaacattgagcccctggttcagacatgcatgacaactctatcctcaaagattgtcaaccgttgcaagcgggcattggcagagattgctgtcaaagcagttcttgcggttgcagatttggagaggaaggatgttaacttggatttaattaaagtagaaggcaaggttggtgggaagctggaggacactgagcttgtatatggaattattgttgacaaagatatgagccatccacaaatgccaaagagaattgaggatgctaagattgccatcctgacttgcccatttgagcctccgaagcctaagacaaagcataaggttgacattgatactgtcgagaaattccagacactgcgtgagcaagagcagaaatacttcgatgaaatggttcagaagtgcaaggatgctggtgcaaccctggttatttgtcagtggggttttgatgatgaagccaatcatttgttgatgcacagaaatctgccagctgtcagatgggttggtggtgttgaattggaattgattgccattgctacaggaggaaggattgttcctagattccaagagttgagccctgaaaagcttgggaaggctggattagtcagagaaaaagcatttggaacaacaaaggaccggatgctttacattgagcagtgt

SEQ ID NO: 14211 - DNA, 1678 bp, Sorghum bicolor
  Clone ID: SORBI-28MAY03-CLUS9349_1
cctcgatggctgctgccattgggtccccgttgcgattcgctgcgccctcaccaactaccctacacccactccgccagccactctaccagcggatccaccccatgtgcagcggcgagcctctaccagccagcctactcgggacctcgtagtcgcagtagcccccgaatcacgcgcacctttaccgcacgccgagaaggatgtcgtcgtggtcgtcgccctcagccgccgccgccgccaacacgggcgcccgattcggccccttcccttgccgagcgctgcggctcgcgccgtatccgtcgctcgcccggggagcccccgcctcgccgccgctcgtcctcaggtcccacccccacccgggcggccgtggccatggcctcctcgcgcgcaccggcggctcctctccctcctcgcggtgccgcgccgtcgccgccgaggtcgagggcctcaacatcgccgacaacgtcacccagctcatcggcaagacaccaatggtgtatctcaacaacgtcgtcaagggctcggtcgccaatgttgctgctaagctcgagattatggagccctgttgtagtgtcaaggacaggatagggtacagtatgataaatgatgctgaagagaggggcttgattactcctggaaagagtgttttggtggaagcaacaagtggaaatacaggcatcggtcttgcctttattgctgcatccaaaggatataagttgatattaacaatgccttcatcaatgagcatggagagaagagtcctactcagagcatttggtgccgaacttgtccttactgatgctgcaaaagggatgaaaggggccgtagataaggctacagagattttaaataagacacctaactcttacatgcttcaacagtttgataaccctgccaaccctaaggtacattatgagactaccggtccagagatctgggaggattcaaaggggaaggtagatatattcattggtggaattggaacaggggggacaatatctggtgctggccgtttcttaaaggagaaaaatcctggaattaaggttattggtattgagccttctgaaagtaacatactctccggtggaaaacctggtccacataagattcagggaattggcgcagggtttgttccaaggaacttggatagcgatattcttgatgaagtaattgagatatcaagtgatgaagctgttgagacagcaaaacagctggctgttcaggaaggattactggtgggaatctcctctggagcagctgccgccgctgccataaaggttgccaaaagaccagaaaatgctggaaagctgatagtggttgtgtttccgagctttggcgagaggtacctttcaactgtcctctatcagtccataagagaagaatgcgaaaacatgcagcctgagccatgaggaagccgtcactttaaacagcataataaatgtttctaaaataagatgtgtggccagcatcggtgtgctccacttgatatcatttggccatgcccacgctatccttttggctctatgaccggaactatacaggcgtgtgagaaatatccatgactctcccaactgctttccacacttcttaattgtctatacgattcaagctgatttgattggtatttgtaaacaatttgtccttgaatctttgaagtcaaacaaagtcagttggccgaatc

SEQ ID NO: 14212 - DNA, 2095 bp, Sorghum bicolor
  Clone ID: SORBI-28MAY03-CLUS29482_1
gtgcgatgccctcacactcacctgtcgcctctatatgcaccgccccaccggcgtccgtaaaagctctgtactgtttacggagctgaccaggagaaagagagagcgcgcaagcgatcgagcaaggttacggagcttggaagaagaagtcaggcacgtgaatggatcgcgctgtgatggcgccgccgctgctcgtcctcctgctgctcctcctctcgcggtgttcggcggcggcgccacggcacggcgccgagggctggtgggaggagggcgagggggaatggaggccggccgaggaggaagagcagggcaaggggagggggctgttcgtgctggaccggctggagaaggtggtcgagtcggagggcgggcaggtgcgcgtggtgcgcggccagccgtggccgccggccgccgccttcgcgtgccgcgacgggctcatgcacatcggcttcatcaccatggagcccaagacgctgttcgtgccgcagtacctcgactccagcatcactctcttcgtgcagcggggggaagtgaaggttgggtatattcacaaggatgagctcgtggagaggaagctcaagatgggcgacgtgctccacatcgacgccggatccaccttctacttggtcaacaccggcaaagggcagaggctacagatcatatgcagcatcgacgcctccgatagccttggcttctttggacctccttatcaggccttctacctcggcggcgcagggcacccggcgtcggtcatcgccggtttcggaccgaagacgcttacccatgccttcaacgccacctacgacgagttggcaagtatcctgctggcaaaaaccggcggccccatcgtgcactacaccgcggacgtggagcccgagggcggtggcggcgaagaggagcgtgggcagggcgggaacgacgtgctggacaggggaacgcggtgcgagggtgctcgtgctggtgctggcgctggcgcgtggaggccggtcggcaggggagacgaaggcgacgagtgcggcagcgatgacgacgcacggcggccgacgtggtcgtggaggaagctggtgaacaggttcatcggaggaggggcgggcggcggcgacaccgcggagacgaacaagaagggcaagaagaaggggggcgcgacggagccgtacaacctctacgacagcgagcccgggttccggaacagctacggctggaccgtctccgtcgacaagcaccagtacgagcccctcaagcaccccgacatcggcgtctacctcgtaaacctcaccgcggggtcgctgctggcgccgcacgtgaaccctcgggcgacggagtacggcgtggtgctgggcggggaaggcacgatccaggtggtgttcccgaacgggtcgctggcgatgagcgaggtggtgcggcccggcgacgtgttctggatcccgcgctacttccccttctgccaggtggcgtcgcggggcgggcccttcgagttcttcggcttcaccacctcggcgcgccgcaaccggccgcagttcctggtgggcgcctcctcggtgctccgcaccctgctggggccggagatcgccgccgcgttcggcgctcgcgaggaggagttcagtaagctggtgcgcgcgcagagggaggccctgataatgccgtcgttccacgcgtcagggaaggaggaggaggaggagaagcatgggaagaagaaggggaggagggagagggaggaggcaccagtgccgctggtcgtcgagcaggtggtgtaggagtaagctgcttgatcatcctaacgaagcacgcgcgccacgagtgtttcctagactgctgctgcgccttgtcagtgatcgcgttttgttcgtggcgccgtctataaataaagtgctttgtgcgtgtacagctatgaaagcaggattatcatccatgcaggcacgcagattcgaaagtcgagcaatgcaggcatgcttttggtatcagaaatcaggacctgtaattcagcgtcggtattccttctccttcgtcctaaaattcctaaaataactgtcgtggttttggggttttgactatttacataaaaatatgtataatatttatatctttaaataaatatatt

SEQ ID NO: 14213 - DNA, 1610 bp, Sorghum bicolor
  Clone ID: SORBI-28MAY03-CLUS35159_1
cagcagcagcgatcgaggcctcctcctgcttctgcttcagcttgagcttcagccgccccccgccttttataaatcccacgcctgcgcatcctcttttgaaaaagataaggtcaaattgcctgatttgcttgctgcttgaactcgagacttggtgaggagtgagcagccggtcttcctcttctccgtcgagggggggaataattaagccagctgcctgccagggcctcttccccgcggggaagaagacaggggatgagcggaggaggcatggacggagctccggtcgccgagttccggccgacggtgacgcacaacggccggttcctgcagtacaacatcttcggcaacctgttcgagatcacgcacaagtaccagcctcccatcatgcccatcggccgtggcgcctacgggatcgtctgctcggtgatgaactttgagacaagggagatggtggccatcaagaagatcgccaacgccttcgacaaccacatggacgccaagcgcacgctccgggagatcaagctgctgaggcacctcgaccacgagaacatcataggcatcagggacgtgatcccgccgccgatcccgcaggcgttcaacgacgtgtacatcggcacggagctcatggacacggacctccaccacatcatccgctccaaccaggagctctcggaggagcactgccagtacttcctgtaccagatccttcgcgggctcaagtacatccactccgccaacgtgagcccccgggaccgcagccccagcagcctcctccgctccgccatgagctttctgacgagcggcgtcgtcgccatcaagaacatcgcctacgcctgcgacatgatgacggagtacgtggtgacacggtggtaccgcgccccggagctgctgctcaactccaccgactactccgccgccatcgacgtctggtccgtcggctgcatcttcatggagctcaccaaccgccagccgctcttccccggacgcgaccacatgcaccagatgcgcctcatcaccgaggtgatcgggacgccgacggacgatgagctcggcttcatccggaacgaggacgcgcgcaagtacatgcgccacctcccgcagttcccgcggcggccgttcgcgagcctgttcccgaaggtgcagcccgtcgcgctggacctcatcgagcggatgctcaccttcaacccgctgcagaggatcacagttgaagaggcgctggagcacccgtacctggagcggctacacgacatcgccgacgagcccatctgcacggagccattctcgttcgacttcgagcagcaggctctgacagaagaccaaatgaagcagctcatattcaacgaggccatcgaaatgaacccgaatttccgatattagaatgtatatctagatgtatgcttcctcttttatgcacaatgtctgtaaataggcgtaagtataaagattggagagccggggtagacagaacattgcatttgtttgtttgctgatgttcgagcccaccatcctgtctgtaaggctgtgtaatctgttgctgcaggtttcaggcggcgttcctgtaatgggttgtaccaagaataaaaggtttggactctgggtcatgtttctgg

SEQ ID NO: 14214 - DNA, 1656 bp, Sorghum bicolor
  Clone ID: SORBI-28MAY03-CLUS392_1
gtgtgttgtgccgagctggatgcctggattgggcgtattctagttgggagtgcgattcagtttccttggaatgcgaatacggcgtgtttgtttcggtgaaagccccgggcgccgcgtcgcccgcccctttcctggagccgccccgggcctccgctgccttcctcccgtgccgtttctccagcgagccgtccggtccgtcctccacgcccagcaagggggagagagagagagagagagagagagagagcaactgagcaagagagtggacggcgaaggcgacgatgagggggtggcgagaggaggtggaggtggtggctctgtcgctgcggggctacggctacggcaacgaggaggatgaccggccggagaagccgcggcgttacggggtgacggagatgcggagccccttctactccttccgccccgcaaaccaggcgctccaggaaatattggattctcttggtccatttgttgatggtttgaagttttctggaggatgccatagtttgatgggaaaggatttggttagagagatcactgatctagcacacaagcatgacatttatgtgagcacaggtgattgggcagagcatttgctgcgtcaaggaccctcttctttcaagcaatatgtagaggaatgcaaggccttagggtttgacacaattgagctgaatcctggatctctcaacctccctgaagaagctctgttgagactagtgcgcctcatcaagagtagtggtttgagggcaaagccaatgttttcagtgaagtttgacagttctgatattcctgcatctggtgatagggcctttggggcgtacatagctccggtcaaggagaagacctcagaaagagttgaagatgttgacctgctgattaggagggcagagagatgcttggaagcaggcgcagatatgatcatgatcgacgccgatgatgtttgccagcatgctgaatctctgaggacagacatcattgccaagattgtaggccggctcggacttgataagaccatgtttgaagcttccaatcccaaaacctcagagtggtttgtcagacgatatggcccaagggtaaatctcttcgttgaccactccgatgtgatgaatctggagcgcctccggggcttcaacatgctcagaagcaacttgggctcccatgttgcctcgccgttcttcctgatgtaatgggttaatgatcgttcccgtatcctgagctgtgacaagctaagtttctacatggacttgtgagcctcgcacagcttgctatggcctccatgtaaccaccatcgagcaggcatctgttatgttatgagtaacgctactgtaataatcagctctgtggtgtaagtagtgtatgggcgtttgtgttcattgcatcaatgagccagattcttggattcatggttgtgcggttgtatgcgtgtgaatatcggcattttctgtttttcgagcatgagagcacgtctctgcatgaacttcggttatttactggtttcaaaagcaggacacaggtgtacaatagtgaaaatagttttcccagctcggacttcatgtttgccgtcatcttgcagctcgttggatcaaaccaacgtggatcaggagctagcaatttgttcttgacatcgaaacaataaaaaaaaaaaaaaaaaaaaaa

SEQ ID NO: 14215 - DNA, 1287 bp, Sorghum bicolor
  Clone ID: SORBI-28MAY03-CLUS3680_1
tgaacagcaggtcgaggcgacaaataaagccgcgcaaatccatctccgccaccgccgcccagaactcacgcgaacgcgcccgcgcacctcccctcctccaatcctcttcctccttccagatgctgagggtttccccgtccccggccgccgccaccgggctcaaccagctcgctggtgcggccgtagcctcccgctcccgctcccgttcccgtcagggtggccgcgccgcgcggcggcgtctcgccgtccgctgcagctgcgtgcagggccgccgggaaggggaaggaggtgctcagcggggtcgtgttccagccgttcgaggagatcaagggggagctcgcgctcgtgccgcagacgcctgacaagtcactcgcccgacacaagttcgtggacgagtgcgaggccgccctcaacgaacagatcaatgtggagtacaacgcctcgtatgcgtaccactccctcttcgcttacttcgaccgtgacaacgttgctctcaaaggatttgccaagttctttaaggaatcgagcgacgaggagagggagcatgctgagaagctcatggagtaccagaacaaacgtggaggcagggtgaggctccaatccattgtgacgcccttgactgaatttgaccaccctgagaaaggcgatgctttgtacgctatggagcttgctctggctctggaaaagctggttaatgagaagctgcacaacctgcatggtgtagcaacaaggtgcaatgatccgcacctgacagacttcatcgagagcgagttccttgaggagcaggtggaggccataaataagatctcgaagtatgttgcccagctgaggagagtgggcaaggggcacggggtgtggcactttgatcagatgctgcttgaggaagaggcctaaaggaagtatgtactgtgggctgctcaaggactaagggtcctgaaggaaggaaagaagtgtgaaatgataaggttgaggaataattggcggcatggaccaactgaccaagcccttgggtgtaggtgggcttgtagagggttttgcagttgggtaggatttgtagttgtcgggtggtgttgccctcctacagggaacatggtgcactgaaatgcagtagaacatgtggtattattgctaccttcagtttgaagtctttcttgttagaaacaaaatcctttgggattttgcttattcaaaataaaacatggcgatgaacgtgtttgtctcattggcgagatgatcattgttaatacttgctgtgtaaagggatgtggaggattgtttcttatttgt

SEQ ID NO: 14216 - DNA, 436 bp, Sorghum bicolor
  unsure (1)..(436): unsure at all n locations
  Clone ID: LIB3481-039-P1-K1-G3
ggcgtccgagatgctgcttgaggaagaggcctaaaggaagggcagacagctgctgaaggactaagtaaggggcctgaacgaaggaattgtgaaatgatctggttgaggaataatgggcgacatggaccaacagacgaagctagccctgggtgtaggtggaattgtagacgggagtttttttgtgtttcagttggttagggttttagttgtagagcagtgttgccccccccccccctcncncccttctctttacatagaacatgtttgctgcactgaaactcagtataatatgtggtcttattggtgccgtaagcttggggttgccagattttagacacgttacccccttatgggggttaggttgttcaaataaagcatggtgatgaatgtgttctcgggtcctcatcagtactggtttgcacatggtgatcaacac

SEQ ID NO: 14217 - DNA, 1707 bp, Sorghum bicolor
  Clone ID: SORBI-28MAY03-CLUS41_1
tggttcattccccagtcgccgcccgagtcaaaaagagggaagcttcttccaccacagtcccttctcctcgaggccgccctcccatcaacgactagacgctagtcaagcagcaccaaccctagtcaccccacaaccctaggcccctccctcctccacatccccttccccttggcttcccgagaggcgaggaggaagaaaccatggattcctccggcggcggcggcggcggcggcggaggaggagcgcagatcaagggtatggcgacgcacgggggccgctacgtgctgtacaacgtgtacgggaacctcttcgaggtctcctccaagtacgccccgcccatccgccccatcggccgcggcgcctacggcattgtctgcgcggctgtcaactcacagacaggggaggaagttgcgatcaagaaggttggcaatgcgttcgacaaccacatcgacgccaagcggacgctgagggagatcaagctgctgcgccacatggaccatgagaacatccttgccttaaaggacgtaatacgccccccaactagagagaactttaatgacgtgtacattgttactgagttaatggatacagatctccatcagatcatacgctcaaatcagccattgactgatgatcactgccagtacttcttgtatcagttgctaagagggctaaaatatgtgcactcagcaaatatattgcaccgcgatctaaagccgagcaatttgttcctaaatgcaaattgtgacctcaagatcgcagactttgggcttgcaaggaccacctcagagacagatctcatgacagagtatgtggtcactcgttggtacagggcaccagagctgctgttgaactgttcacagtacactgctgccattgatgtctggtcagttggatgcatattaggtgaaatcgttactcgccaacccctgtttcctggacgggattacatccagcagttaaaattgatcaccgagctcataggctcaccagatgatgcaagcctgggatttcttcgaagtgataatgcaaaaagatacatgaaacaactaccacagtttccaaggcaggacttccgcctgcgtttccgtaacatgtctcctggtgcagtcgatttgttggagagaatgcttgtgtttgatccaagcagacggattacagttgatgaggctctgcatcacccatacttggcttcacttcatgacatcaatgaagaacctacctgccctgcacctttcagctttgattttgagcaaccatcctttacagaagcgcatataaaagaacttatctggagggaatctttagcatttaacccggatcctccctactaatttcaaaaggataagttatctgctagaggcatatgaagatctctagctccagcggacgcaataacttgtgtcagtgtgcatcgattatttacgtggggtttgttgggcaaacgggcatgggttgttgctgcaatagcaactgtactagggcttgtgagaacaaacaacgtctgtattcctttcagatgcctgaacccaggcttgtattataccgcttgatttcataaactattcttatgtatctaagcttgtaattttgtagactattacttgaacgccccctgtatatctgagttgacatcacttccctattgtaacatctcaaacatattttatttgtgatcttactaagttacttaagattgacgtttcc

SEQ ID NO: 14218 - DNA, 1969 bp, Sorghum bicolor
  Clone ID: SORBI-28MAY03-CLUS4143_1
gcacgaggccacttcccacctcaccccggtgaccctcgcgggccccacacgccacggcggccaacaccacacgacacttgactccccaagcacacgcgtgagacgcgccgcaccaccccccgccccaaatccccgatccctccctcactctcgccgcgcccgccgggtgttcgacgcttcgccgccacgccatggcctcctccatctccgccgccgccaaggcctccacggccttcgcccacaagaaggagctcgccgcgccggcgcccgcgcagcaccgcgcgggctcgagccgccggaccaagccatgccgcgtgcgcgccgtcgcctcgcctgcgcgcgctccccgcgccccgtcgtccaccggctcggtgaagagcgcgatgacgatgacggagaagatcctggcgcgggcgtcggagcgcgcggcgctggagcccggggagaacgtgtgggtggacgtcgacgtgctcatgacgcacgacgtctgcggccccggcaccatcggcatcttcaagaaggaattcggggaggacgccaaggtctgggaccgcgagaaggtcgtcatcatcccggaccactacatcttcaccaccgacgagcgtgccaaccgcaatgtcgacatcctcagggacttctgtctcgagcagaacatcaagtacttctatgacatcaaggacctcagcaatttcaaggctaatccagactacaaaggtgtctgccacgttgcacttgctcaggaaggccactgccgaccaggcgaggttctcctgggcactgattctcatacgtgcaatgctggagcctttggtcaatttgctaccggaattggaaacaccgatgctggttttgtgttgggcactggaaaggctcttctcaaggtgccacctacaatcaggtttgtattagatggagaaatgccgccttatttacttgcgaaggatctgattttgcaaattattggtgagatttcagtatctggcgcaacctacaaatcaatggagtttgttggatcaactgtagagagtctaactatggaagagcgtatgacactatgcaacatggttattgaagctggtggaaagaacggtgttgtgcctgctgatgaaactacatttaaataccttgagggtaagacatcagttgattatgaacctgtctacagtgatgctcaggccagattttttagtgactaccgttttgatgtatcaaaactggagccagtagttgccaagccacattcgcctgacaaccgtgctctagcaagagaatgcaaagatgtcaaggttgaccgagtctatattggttcttgcactggtggtaagactgaggacttccttgctgctgcaaaggtgttcttagcctcgggaaagaaggttaaagttcccacatttcttgtccctgccacacaaaaggtgtggatggacgtatatagcctccctgtaccaggatctggtggcaaaacttgctcccagatatttgaggaggctggttgtgatacaccagcaagtcctagctgtggtgcttgtttgggtggtcctcgtgatacatatgcacggatgaatgaacctatggtctgcgtgtccactacgaacaggaacttcccgggcaggatggggcacaaggaagggcagatctacctggcgtctccctacactgcagctgcctcagccctgacggggtatgttacggaccccagggacttcctcatgtaattttgaaacaacagagttcatgatgtaacagattgcctgtagcctctgtttttcgtgttgaaccttagtttaggcgtgtctttcgttgaggaataagctgcatgtcgggaggttggcatgtatggttttgcattattacagtgtactaccaattaagaacatacttgagtgttacaagggaaatacattcttctgagtattgatggcagttcctagactcaaaacttcttgctataaggcctgttgagtgatct

SEQ ID NO: 14219 - DNA, 1459 bp, Sorghum bicolor
  Clone ID: SORBI-28MAY03-CLUS3713_1
atttatttcctccgcgcccgcgccctttctccgccaaataaacccccccgaaaagcaggagaggcgagacccggaggtgggaagcctagggttagggtcccagctccgccgtcgcctgggcgagtcgagagatggcctcccctggccccgccggcgcagcgagtgccgcggcctcgccgtcgccgccgatgcagcttccgtcgccgttcgcggagctcgtcaaggccccctccggcctcgagaagatcgtgcttcgcggcgctcgcaactgctgtgccgagatctatctttatggaggtcaagtaacatcatggaagaatgacaatggggaagagctgctttttctcagcagcaaggctattttcaaacctccaaaagctattcgtggtggtataccagtctgctttccccaatttggaacacatggaaatcttgaacaacatggattcgctaggaaccgtttctggactattgacaacaatccacctcctttaccagtaaaccctgctattaaagcttttgttgatctgattctgaagccttctgaggaagatttaaagatctggcctcacagttttgaatttcgcttgagagttgctcttggaccttctggagatttgagtctaacatcacgaatcaggaatacttactcaggcggtagtcctttctccttttcatgtgcgtcccacccattcttctctggctccgaccttcgcgggcttcgtgggcctggtcgggttgctacggactaccttgataacttgaaggcaaaggagcgttccacagagcaaggcggctctcttgtttccgaatcagaggttgataaagtttatcttgctgcaccctccaaaattgctatcattgatcatgagaagaaaagaacatttgttgtgacaaaagaagggcttcctgatgctgttgtttggaacccttgggataagaaggcaaaagcaatgcaagattttggggatgcagaatacaagagcatgctgtgtgtggagcctgcagctgtagagaggcctattactctgaaacctggcgaagagtggaaaggaaggcttgtgctctcagcggttccttcaagttactgtagtggacagttagatccattgaaggtccttcagggttgaaaatcctcactttctgcatcttgtacagaagttcattgcccttactatttgatgctgggctggcgtcaacgccgcaccgtccttttgccattaccacccccctatatttctggtcctttttgtatctagaatttgagtgataggttgattccgaataacagtctgtgctttgagcttaggattgggtcatctcatcggtgaatgataccgctggacaaaatactggcatacgtgtcagttttataaatcatttctgggcagcataaattctttagctttaaaataaaaaaaatcatccccgggggcggccccgttaactacaccattca

SEQ ID NO: 14220 - DNA, 480 bp, Sorghum bicolor
  Clone ID: LIB3481-027-P1-K1-F5
cgtccggttttgaatttcgcttgagagttgctcttggaccttctggagatttgagtctaacatcacgaatcaggaatacaaacacagatggaagacctttctcttatacatttgcataccacacatacttctctgtctctgacataagtgaggttcgtgttgaaggactggaaacaatggactaccttgataacttgaaggcaaaggagcgtttcacagagcaaggcgatgctattgtttttgaatcagaagttgataaagtttatcttgctgcaccctccaaaattgctatcattgatcatgagaagaaaagaacatttgttgtgacaaaagaagggcttcctgatgctgttgtttggaacccttgggataagaaggcaaaagcaatgcatgattttggggatgcagaatacaagagcatgctgtgtgtggagcctgcagctgtagagaggcctattactctgaaacctggccgagagt

SEQ ID NO: 14221 - DNA, 1860 bp, Sorghum bicolor
  Clone ID: SORBI-28MAY03-CLUS2380_1
cgtccgcccacgcgtacgggtgaactgaacccactgcaggatgctgctggtggaaagaaaatatcaattaatgatcttgtcatcaaggctgcaactatgtgctcttcggaaggtcccacagtgtaacagctcatggatgaatgattttattcgccaataccacgatgtgaacatcaacgtggccgttcagactgaacatggattgtttgttccagtaattagggatgcagacaagaagggacttggtacaattgctgaggaggtgaagcagttggctcaaaaagcaccgggtaatagcttaaaaccagcagattacgaaggtggcaccttcaccgtatcaaacttgggaggtccctttggaattaaacaattctgtgccatcataaatcctcctcagtcagcaattttggccattggttctgctgagaagaggagagatgcaagaagccataaaaaacgaggcgcagaagccagaagaaccaactcccaacctcccgcccgctccgatctcgatctcacgggcggcgcctccgctgccgagatgatggagccggagatgctgcggctggcgccggagcagatgcgccgcatgtccccggtcgccaccgcccggatgcaacagcagctgatgtctaaccctaacctcatgaggatggcgtctgagagcatgaagaacatgaagcctgaggacttaaggcgagctgcggagcaacttaatcaaacaagaccggaggatatccgtcatctgactgagaaaatcaccaacacttgtcccgaggagtttgcgggcatgaagactcaagcagatgctaacaattcttatgatagatctggtgcaaaagtgttaaagacctggttccgctgacggtcagtccggggtcagttttcacatgtcggctacactgagctgtgaccacagggttatagatggtgcaattggtgccgaattcctgaaagcattcaagggctacatcgagaacccgacctcaatggtactgtgaagggatggatgacctaacacatttcttgttaagctgttaaataaccaggccagccaaagtggcgtttccaaaccaatagcacagagccgtcttctctgttttgatattgccagtgttaagtaggatcaacgtatacaggccttattgaggtcatttttgggtttgtcctcacggacaattgatgggaataaatatgtaagaagccaacgtgggaaggaactctttgatttttcgaacattgcgactagaaaaactgtaaatttgttgaggttttccttcacagccatcaaggatatgcaagaaaagtgagcagtttggaatgaaactgtcaaaggaggatgctgcaaaagctcaacaagccatgtcgtcattatctccagaggatttggatagaatgatgagatggatggagcgagcgcagaaaggggtagacgtcgcgaagaagacaaagaactggctcctaggccggcgaggcttgatcctcgctattgtcatgctgatcctagccttcatccttcagaagcttgggtttatcggcaggtgatggagtgacctggggagctgcatcagccatcagcatggaaataattgttcacatagcgatacagagttagcccccctgctaacaactgcttgaaagcacttcggggggaaagctgaaatacgagaattctttgtatctgtatctgtatctgttcgaaagtgtaactctgttcataagctgcaacattcatcctatttttacaatcaaaggagtagaaaggaatcgagccgaaactgttgtgataaccagctgacatgtaatatgaatatgataatccttgtggtgttttcagttttgatgagttgcagttttgtt

SEQ ID NO: 14222 - DNA, 1502 bp, Sorghum bicolor
  Clone ID: SORBI-28MAY03-CLUS1830_1
acacctcatcactggcaaacacacaaagacagccagccagccatcgatcctagcatcagatcagcagcttagctagcagtgtacgttctgatcgagccactgcacgcagatggcgagagcggtggcactcgcggcagccgtcctgctggcggcggcgctagcgctgctggcggcggcgccggcaccggcgtccgcggtcgagttcggcgcggaggatctggcctcggaggaggcgctgtgggcgctgtacgagcggtggcgaggccgccacgcggtggcgcgggacctgggcgacaaggcgcgccgcttcaacgtgttcaaggagaacgtgcgcctcatccacgacttcaaccagcgggacgagccgtacaagctccgcctcaaccgcttcggcgacatgaccgccgacgagttccgccgccactacgccggctccagggtcgcgcaccaccgcatgttccgcggcgacaggcagggatccgcgtcctccttcatgtacgccggcgcgcgtgacctcccgacctccgtcgactggaggcagaagggcgccgtcaccgacgtcaaggaccagggccagtgcggtagctgctgggcgttctcgacgatcgcggcagtggaggggatcaacgcgatcaagacgaagaacctgacgtcgctgtcggagcagcagctggtggactgcgacaccaagggcaacgccgggtgcgacggcgggctcatggactacgcgttccagtacatcgccaagcacggcggggtggcggcggaggacgcgtacccgtacaaggcccgccaggcctcctgcaagaagtcgccggcgccggcggtcaccatcgacgggtacgaggacgtgccggccaacgacgagtcggcgctcaagaaggcggtggcgcaccagccggtgtcggtggccatcgaggcgagtggctcccacttccagttctactcggagggggtgttcgcggggaggtgcggcacggagctggaccatggcgtcacggcggtcgggtacggggtggccgcggacgggaccaagtactgggtggtgaagaactcgtggggacccgagtggggggagaaggggtacatccgcatggcgcgcgatgtggccgcgaaggagggccactgcggcatcgccatggaggcgtcctaccccgtcaagacctcgcccaaccccaaggtccgcgccgtcgtcgtcggcgacgacgacagccacgacgagctctgaatcgcatgcgcacacagcaggcacagctggcgcttatttattgattaaaccatttaaaattatcactacacattttacactacagtaccgatgtatgtatgctcggacaggaacatctctgttgcggtctgagaatgtctgaatgacatacgcacattatacaacgtgcattcatgtaataccataccagtcgagagttgatctaccagcagctttcgtttcattcagttattattatattgacctataaaaatgactatgtatgcattgaatc

SEQ ID NO: 14223 - DNA, 1717 bp, Sorghum bicolor
  Clone ID: SORBI-28MAY03-CLUS15636_1
gcaccgggcgccacggacgctccccttccctcgcttatttctttggagtcccttccttccttccttacttattgttagttgttgtgttggcggccccttgctctgctctgctctcctctctgcttctcttgtcactgagtgagggagcctagcaaagcaaaaggagccttcccttccatacttgcttccttggcctctttctctctatctgcagtacgtgcaataatcacacttgcatacttcatccagcttcaattcctttgagcaactagaggaagctagaagaagatagcacataggtggagtagtggagtgcaaatcaaaaatgtcgatcaagtactgcgaccagcacaaggactgcgagcggcagcgtctttaccggcggttctgcgcggcgctggtgggcatcatcctgctgctcctcctcatcgtgctgatcgtgtggctcgtcctccgccccaccaagccccgcttcttcctcaacgacgtgagcatcgtgtgcatcaacgtcagctccgcctcctacctcaccgtcaccatgcaggccacgctcgcctcccgcaacaccaacgaccgcgtcggcatctactacgaccgcgccgacgtgtacgccgagtaccgcgccatgcagatcaccgtgcccacctcgctgccgcccttcttccagccgcccaacgacgccaccgtctgggcgcccttcctctccgcgtccaacgtcccgctcccggcctacctcgccaccgcgctcacccaggacgagacggccggctacctcctcgtcaccatccgcgtcgacgggtggatccgctggaaggctggggccttcatcaccagccactaccacctcagggtccgctgccctgcgctgctcaccgtcaacgatggacagggaagctacggatccaacgccggtggcgggctcggatacttcaagttccagcgcgcagcaccctgcatcgtcgacgtttgattcaactgcttattcgttctctcagtttctcatcagttatactacatatatattagcacgcatcatcacttcacactcccaccctcttctactactaatatatatgtacaccatcgtgtctctcgtcatccatcgatgcaaatgcaagcgcccggtccaaaatcccattccgagtcgtttgttggagcttcagtactcttccaatccgggctgatgaactgaagatgctctttttcgtaataaataagaagatcagatatatacatgagctagctacactagtttatttgtagacaaccaatgaaataatttgaccctatatatgtaagttttttgtttgttgtttgttgggtttttttttattttgtttgtgtggatgggaattgggaaaagatgatgaggagcggtggtatgtacctatagaggatgcatatggatggatatatgaatgaaagggctggccgggaaacctcagctacctttgagtgacatctacttctgcctaactctatgttgagtgtagatggacagggattacttcacttttgtaatcagtgaaattcagagggacaaatccagaaaatatgcatgtgtctacatgttccgtaagttgctgttgtaaatatacttttcattcatgcatagtatggtcaaatagttgttgtccatcatatttgattaactcaattatgtactcccctgatctgacatatgtattagtgttccttctaatctattactatatac

SEQ ID NO: 14224 - DNA, 2252 bp, Sorghum bicolor
  Clone ID: SORBI-28MAY03-CLUS44665_1
accgcctgcccctagattcacgacggagatggcgtccgagctcacctaccggggaggcgggccgtccgcggccgccagcgccggcgccgggggatactccccgaagccgtccaagccgctggcctggctgccccgcgccgcccgctacgccgtcgcgcacgagggcccgctcttcgcgctcgccgggatgctcatcgccgccgccgtcatctccatcgcctccccgtccgcctcttccacctccaccaccggctccgccgccgccgtctcgtcctactccaacaacaacaacaacaacccgctcgcccgcttctccgtcgagcccgcccaccaccgcgacgtggccacgcgccacttcgtcggcggcaaggtgccgctcggcctcaagcggaaggcgctccgcgtcctcgtcaccggcggcgccggcttcgtcggcagccacctggtggaccgcctcctcgagcgcggcgacagcgtcatcgtcgtcgacaacttcttcaccggccgcaaggacaacgtcctgcaccacctcaacgacccgaacttcgagatgatccggcacgacgtcgtcgagcccatcctgctcgaggtcgaccagatctaccacctcgcctgcccggcgtcccccgtccactacaaatacaaccccatcaagacaatcaagaccaatgtggttggcactctgaacatgctcggattggcaaagaggatcaacgccaagttcctcctcaccagtaccagtgaggtctatggtgatcccctccagcacccacaggtggagacttactggggcaatgtcaatcccatcggtgtcaggagttgttacgatgagggcaagcgtacagctgaaacgttgaccatggattaccaccgtggtgccaaccttgaggttaggatcgcacgtatcttcaacacatatggccctcgcatgtgcattgacgatggccgtgttgtcagtaactttgttgctcaggctctgaggaaggagcccttgacggtttatggtgatggaaagcaaaccaggagtttccaatatgtttctgatctggttgagggtctgatgaagctgatggaaggcgaccatgtaggaccattcaacctgggtaaccccggcgagttcaccatgcttgagcttgccaaggttgtccaggacaccatcgaccccaatgcacagatcgagttccgtcagaacacccaggacgacccacacaagcgcaagcccgacatcagccgtgccaaggagctccttgggtgggagccgaagatccccctccgcgagggccttcccctcatggtcagtgacttccgcaagcgcatctttggcgaccaagacgccgccgccaccactggaaaccagcaaggttaggatgaagccgcacgatacttgggaagtttttggtggcctgcttctagcctgcttggtcgctctccttatactgacaaaagctatggccacgtagttcgttgggaatgtgttactgaaataccttggttgatgctgtaatgctattctttttcctgtattttttttctcagttctctcagtccttagctatacaaaaaaatttcagttgaaccgttggagataaacccggatgatctaattctttgttgattgagagcatagcatcatatatatggtataaatcccggtttctgcaagtgttatgtatgcctgctttgatgtgtggtccgtttctttgttgaaacgcagaggatgcctaccctgctctcataaactagactagaacaaagaaacaaacaaacagttctggagatgaaacaagatgacatctttttatttcattcactgtcagtgtcaggcttgtttcttatgccaatgtacagttctttatcaacaactgaataaagaacaagtgttttccatgtctactacatcctacactgttgctggtgtggtcgaccgcctagtccgcagaggcagctgccgcgccgctgactctcggtgccgccactgctgctggtaacgcgtgtgattttggtggtcgccgcctggcggtgcttgttctcaggctccggtggagtccttgcccgctcgtcttgctcccagtggcgactgcgcttgtcgagccacgagacgatgtcggagaacaccagctccacgttctcgtcaggctcgccggcggtgaggccgtgccacatcccagggtacagcttgatggtcttgtcggtgctggcggcgcgctcgtagagggcgcggctgacctccgggtcggtcaccgtgtcggcct

SEQ ID NO: 14225 - DNA, 1828 bp, Sorghum bicolor
  Clone ID: SORBI-28MAY03-CLUS56131_1
caaaatttcacatcccaagtccccgacctcggcagacacggcggcagcagcgtctcttctctctctctctgtctatctcgggacaagtttgggatatttatatacaaatattcgatcttgcgttgatcggtgcgcgcggtggccatggccgtctgagccattgatgagagcaccaccagtaccgttggttgcggcggcggcggccggacgcgatgtccgttgtggcggccgtggggcctggcgccgccgcggcggcggcggcggcggcgggggcttacgggcacgggcagccgctgtgcggtggcggcggcggcggggcgaggaagaggaaggacgtgggcgtggtccaggaccaggaggcggggttgcggggtagtcacgtcggcgccgcggcgccgcggcgtggcgccgggctgttcgtgctggagacggtggaggaggaggccgaggcggatatgtggtcctcccgcgccgcggtgcccgtggccgtggtagtggacggggtgcagggggaccccgcccggccgtcgtcgtcgacgacgaagggcgccgcgctcgcgtccatggacatggacgccctcgacgacgcgctccccatcaagaggggcctgtccaacttcttctccggcaagtcgcgttcgttcgcgaacctgcaggacgcggcgtcggcggtgaccagcgcccgggacctggccaagccggagaacccgttcaacaagcgccggcgggtgctgcggtgctgctccatccggagggtcgcgtccacctcgctcaccgagctgccgccctttttcctgccgcccaccacggaccccggcagcaccggggacgacgacgacggctgtggcgccggcggtcgtcgccacagtggctgatgaagaacgggccggacgccgggtatacagtacagaccaaggaggactactactatatatacactgcaagcaggacggatgaaatatatgaaacgcgcgcgccatggatcccttgtcctttgtagtaaatagtttgcattgggatccatcgtctcaccatttcatctttcatcagcatcaaccaagcatgcatgatatactatggtaggcgttaatttcttcatttagctagcaatcaaacactccatccatcatcgtagattgatgtgcatcgcatgcattgacctgagtaccagatcaaatacgcactgtgatccatgcattcccggcctagctagcagctgctcctggctggcctcctgctgtgtgatgccattagaaagagagcttgctagctagcgagctcagggggctcagccaacaacaaattaattagaggcagcgagctaaccttttttttttgaagatcacaaggcgtgcagatgatgcactaatttatacattgagcaagtttcatcacacaatctgttcatttatttgatatactcttatgataggagcatatatatattctactagtgcactttggatatatatgctctgatggcatgcatggattatggaaagttttatatactctactcatcactagctctcgccaacaaaccacacttggaagcaccttgctgtatgctgcggtgcatgcagtaggttgatcgatgatgccttttgccaaagagcaaagatatcgatgaagtgcatgcatgcaatttgtactttaatgtcctcctttttgtttacttctttttaagaaactcctcctttttaattattttacttattagtacttacttatctgctctaggctatactaacggtttcatttacaacattctgttcatttgagtttatctactaaatttattggccatttaataataatattctttttt

SEQ ID NO: 14226 - DNA, 1214 bp, Sorghum bicolor
  unsure (1)..(1214): unsure at all n locations
  Clone ID: SORBI-28MAY03-CLUS4359_1
gcacggcgccagccgcacgacgctcatcctccgtcactctccggagcaccccaccctttcctcacccagccatggcggagcgcggcggtgagcgtggcggcgagcgcggagggttcggccgtggcttcgggcgcggtggacgcggcgaccgtggcgggcgccgcggcggccgtcgtggcccgcgtcaggaggaagagaagtgggtacccgtcaccaagctcggccgcctcgtcaaggagagcaagatcaacaagatcgaggagatctacctccactcgctccccgtcaaggagcaccagatcatcgagaccctcgtcccggggctcaaggatgaggtcatgaagatcactccagtccagaagcagacccgcgccgggcagcgcacccgcttcaaggccttcgtcgtcgtcggcgatggcgacggtcacgtcggcctgggagtcaagtgcgccaaggaggtggccacagccatccgcggcgccatcatcctcgccaagctctctgtcgtccccgtcaggaggggttactggggtaacaagatcgggcagccgcacacagtgccctgcaaggtcaccggcaagtgtggctccgtcaccgtgcgcatggtgcccgcacccaggggttctggcatcgtcgccgcgcgtgtgcccaagaaggtgctgcagttcgctggcattgaggatgtcttcacctcgtcccgtggctccactaagacccttggcaacttcgtcaaggcgaccttcgactgcttgatgaagacctatggcttccttactcctgaattctggactcagaccaaattctccatgactccattccagcagttcacagaccttctgggaaagcccaccaagggtcttgtgcttgaggctccaactgagacagcagaggcttaggatgggttgagtgaaaagctctactcattgagagttgtctaaatgcgctttcaatatagttaagaactgtgggagtcaactttgggttctgttttgccctggatgttgttctttactgtcaattttttgattgtggtacttactatggtactatttatgaatgctacataattatctcatgatagtcttttcacggtgaaggcctttggaggctgaacttgaggcactgaaggctgaggccgttatggtgcttgactgcctactgttccattataatttgttgcagtttacgaaaaaaaaaaaaaaaaaagcccctan

SEQ ID NO: 14227 - DNA, 390 bp, Sorghum bicolor
  Clone ID: LIB3476-015-P1-K1-E7
caaaccctcatcctccgtcactctccggagcaccccaccctttcctcacccagccatggcggagcgcggcggtgagcgtggcggcgaccgtggcgggcgccgcggcggccgtcgtggcccgcgtcaggaggaagagaagtgggtacccgtcaccaagctcggccgcctcgtcaaggagagcaagatcaacaagatcgaggagatctacctccactcgctccccgtcaaggagcaccagatcatcgagaccctcgtcccggggctcaaggatgaggtcatgaagatcactccagtccagaagcagacccgcgccgggcagcgcacccgcttcaaggccttcgtcgtcgtcggcgatggcgacggtcacgtcggccctggagtcaagtgcgc

SEQ ID NO: 14228 - DNA, 913 bp, Sorghum bicolor
  Clone ID: SORBI-28MAY03-CLUS5772_1
ttctgcacgaggctgagaggccacctcggaggccctatgaacgccatagcggtactggccgtgggtttgaaatgaagcgcgagggttcaggccgtgggaactggggaactaccactgatgaatttatcgcccgggaaactgaggaaggcctgaagctggaagagaaggcccctgttcctgagaagcagggtgcactggaggatactccacaggcagaggagaacaaggagaacaaggatgccacagctaatgaggaagaagagaaggaagaggataaggagatgactcttgaggagtttgagaaaataagggaggaaaagcggaagtcacttcttgcccttaagactgaagagaggaaggttgaagttgatagggacctgcagtctatgcagccgcttgcaaacaagaaaggaaatgatgaaattttcgtgaagctgggttctgataaggatgctctgaagaagaaagaaaatgctgaacgtgatgaacgcgctaagaagtccgtgagcatcaatgagttcttgaaacctgctgaaggagaaaggtactatggcgggcgcggccgtggcaggggccgtggagaccgtggaggtttcagagggggatatggtgggggttatcatgccccaccagctgctcctgcaattcaagaccaatcccagttcccttcgcttggtgggaagtgaaacatctggtacctgaaaatccatatcgtctttgctgtcaaagtcgggttctgctttgcagattactgtgtcactgctaatcagacataatggtgtcgcatgttgtttattccctgctgtgagtcgactttgtatatcagagttgtctgtcagaattttgttaggctatttgccgttttactcgagaaccagtcatgagttaccagctttgtctctgttttgtggct

SEQ ID NO: 14229 - DNA, 977 bp, Sorghum bicolor
  Clone ID: SORBI-28MAY03-CLUS515_1
gccggccgggccgggaggctagtttcactaccctcgtctcaccctccctcaccaaataaggtcctgccctttcccgacattcacaggggggcagaggggaaaacacattcatccggcggccatggcctcgattctggtgacgacgaccaccgccaccgccatcctcttatgcgtcctcttctgtgccgcggcggctaacaccaccgtcgccaacgaccccaacctccccgactacgtcatccagggccgtgtctactgcgacacctgccgcgccgggttcgtgaccaacgtcaccgagtacatggcgggcgccaaggtgcggctggagtgcaagcacttcggcaccggcgaggtcgagcgcgccatcgacggggtgaccgacgcgaccggcacctacaccatcgagctcaaggacagccacgaggaggacatctgccaggtggtgctggtgcagagcccgcgcaaggactgcgaccagacgcagccgctcagggaccgcgccggcgtcctgctcaccaggaacgtcggcatcgcagacagcctgcgccccgccaacccgctcggctacttcaaggatgtcccgctgcccgtctgcgctgcgctgctcaagcagctggactccgacaatgacgacgatcagtaaagatcacatactgttgacgacgaccaccgtggtcgtcgctgacaggctgcgcaaaactacaaatcctcttcagtcttcacctgctggcctacaaatataatggtacagagtcgaacgcatggatatagcagtatctgagaaaagaaaagaaaaaaggaaaagaaaaatgttaactgctgtatctgagaaaagaaaaaagcaaaagaaaaaatgtaacttacagtcctgtggctcttctgagtgctggattcttgcaaaatacaatcccagtaccaggaatataaaataacaaaaaaaggcgttagtaacaaaaaaagcacaatcaaatgggcgg

SEQ ID NO: 14230 - DNA, 551 bp, Sorghum bicolor
  Clone ID: LIB3480-042-P1-K1-D12
tgcctctagaaggtactcaagagaaaatttcagtagcctcagtcgaaggctgtgcaaagatactttatgaaacaagaaagtagtttccaagcagcaattactgactgatagtaccacgccctcaactaaacagcaagcatcagaagacaatgcaaaagcaggattactggatctgatggaaataagggttaaaggagatcccatataccagttgcatgcttgacaaacttcgtcaagtagcaagccctctggcattgtcctttgttctggaagtaaactttactgttcctaggatacatatcaatgacttagacatagagagatgtaaaggaagccccagcatccatgcaatccactaaccggattttgacgttttactactgtcaaaaaaaaaaaaaaaaaaaaaaaaaaaaaaaaaaaaaaaaaaaaaaaaaggggcgccgctcgcgatctagaacgcgccatcgacggggtgaccgacgcgaccggcacctacaccatcgagctcaaggacagccacgaggaggacatctgccaggtggtgctggtgc

SEQ ID NO: 14231 - DNA, 440 bp, Sorghum bicolor
  Clone ID: LIB3480-007-P1-K1-H7
ctaccctcgtctcaccctccctcaccaaataaggtcctgccctttcccgacattcacaggggggcagaggggaaaacacattcatccggcggccatggcctcgattctggtgacgacgaccaccgccaccgccatcctcttatgcgtcctcttctgtgccgcggcggctaacaccaccgtcgccaacgaccccacaaagcaagaaaaccccgcgcaaggactgcgaccagacgcagccgctcagggaccgcgccggcgtcctgctcaccaggaacgtcggcatcgcagacagcctgcgccccgccaacccgctcggctacttcaaggatgtcccgctgcccgtctgcgctgcgctgctcaagcagctggactccgacaatgacgacgatcagtaaagatcacatactggtgacgacgaccaccgtggtcgtcgctgacag

SEQ ID NO: 14232 - DNA, 494 bp, Sorghum bicolor
  unsure (1)..(494): unsure at all n locations
  Clone ID: LIB3480-038-P1-K1-E5
gngaattgaagaagatgtgtcgcgtcgtgacatggccatggctgcctatacttagggaggtcgcagcggcgaggacgccaccgccagtgccggaaggaggaatcccagcggccgttccgggtgcaccggaagccggggtcgaggaacgggcactcctccgtgtaggtcgtcacgtcggcagcatcgtccctcgattctggtgacgacgaccaccgccaccgccatcctcttatgcgtcctcttctgtgctgcggcggctaacaccaccgtcgccaacgaccccaacctccccgactacgtcatccagggccgcgtctactgcgacacctgccgcgccgggttcgtgaccaacgtcaccgagtacatggcgggcgccaaggtgcggctggagtgcaagcacttcggcaccggcgaggtcgagcgcgccatctacggggtgaccgacgcgaccggcacctacaccaatgagctcaaggacagccacgaggaggaca

SEQ ID NO: 14233 - DNA, 1239 bp, Sorghum bicolor
  Clone ID: SORBI-28MAY03-CLUS5818_1
gcaaactccatttctccctgagaaacctgccaaaggccaaagcgtccctaactgctgctagaacagcagcaaatgccatttatgttccacctgcccagcaaggcactattgatctccagagtggaatcctccatgctgaagaaaaggattacaagactgcatacagctacttctttgaagcatttgaagctttcagtgcactggaggacccgaaggccattttcagcctgaagtacatgctgttgtgcaagataatggttaaccaagctgatgatgttgcagggataatctcatctaaggctggcctgaagtacctgggtcctgatgttgatgctatgaaagctgtggccgatgcctactccaaaaggtctctgaagtactttgaaactgctcttcgtgattacaaagctcagctggaagaagatcctattgtccacaggcacctttcttcactgtatgatactctcctggagcagaacctctgcaggttgattgagccctactcaagggtggagattgcccacatagcagagatgattgagctgccaatcaaccatgttgagaagaaactgtcccagatgatccttgacaagaaattcgcagggacactagatcaaggtgctggctgcctcatcatctttgaggacagcaagactgaggagatcttccctgccacgcttgaaacgatcacgaatgtcgggaaggttgtggacagcctgtacatgagatcggccaagatcatggcctgaaaaatgcagtggaaggcctaggtgttgtcaacttcttttcacggtctactgtcagtccagttgaccatacttgagctctccaagtgtcatcttattctggagtttttctttttctttttcgggtggcagactgtttgggttacaattagccatgttgctcatggatactcttgtttcggatgatggaagtactgtttaacgctattttatttttcctactttatgttattttcactggcgtgaaaatccaggttagctacctctgcacctgttgtgaacaggtaacatgttagccattggttagatgtcgtataatcactgttctgtgtcgatgtcctcagacatttagtccttcatcaatatttgacagtttattgtgcatgttgcctctcaatttagttcaaccaaacatactgtcttgcttgctacttactgctaggaacaagacagtttgctgtttctgcgtggtgaaagtaactgtgaacagttg

SEQ ID NO: 14234 - DNA, 2075 bp, Sorghum bicolor
  unsure (1)..(2075): unsure at all n locations
  Clone ID: SORBI-28MAY03-CLUS5825_1
aggtcgcggcgggcacgagggttccttcccttaccctcccctgctccatcgcaagctcctggttacggcggcaaccatccttctgccgcatcgtcctccctctcgcgacgctgcccaaggtccatcgcgcctagggttcgcccagtccggcggcgcccagacaatggctggtcaccgaaacagtcatggaaagcgccactctgattatactgaaaatggaggcggtaagagaagaaatcctggtgatgatacctatgcccctggtcctgatgacactgtgtatcgctacctctgcgcctctagaaaaattgggagtatcattggcaggggtggagaaattgcaaagcagttgaggactgagacccaagctaagatcaggattggcgagagcgtccctggatgtgatgagcgagttattgccatatctagctcaagctggaaaactactaccattgatgatgctgtagataccctttccccactcccggatgcccacctgccaagacattgaagtttggaccctgcttattggtttgccttccaaaaccacatgaccaagagagcccatcctggaagctttgattaagaggacctatgtggatgccatagaccacctgatattcctcacactacattactcatgtcttcctctgggcctatgtttttagccctgccgtaaatgtttcgaaccccttcttgtgccatgggcgccgttgagcctccccggatttcctggtttgaagccggtgtcagaaaggctcttcatcaagtgtcatctcgcctccatgacaacccatccaagtcacagcatcatcttgcatccagcttgacccaaccttatccagggagcaccacccaccttggtggttcctctactgcacctgttgtagggatcactccagtaattcctccttatggaggctacaaaggtgatgcggcaggagagcgcgccgctttataccaaccacgaagggatgagagctctgcaaaggagtttagcttgcgtttactttgtgctgctgcaaatgtggggggtgtaattgggacggacgcgtgggttatcaaacagattaggcaggaatctggggctttaatcaaagtggctagctccaattcggaccctgatgatgactgcataattacagtttctgcgaaagagttctttgaagatcctgtatctccaacgattgatgctgcagttcgtttgcagcctagatgcagcgagaaaagtgattcagaatcagccgagcagtcatatacaacacgcttgctggtgtcaacatcacgtattggatgcctaattggcaaaggtggttcaatcattactgagatacgaagaacatccagagcaaatatacgcattctttcaaaagaaaatgttccaaaggtagcagcagaagatgaagagatggttcagatcagtggaggccttgatgttgcaagacatgctcttgtgcaaatagctacaaggctgaaagccaatttctttgaaagagagggctctttatctgcatttccatctgtgatcccttaccatcctttgccttctggtgcttcggatgaaccaaaatatctaagcagagacactaagcctgttgggcattatctatattcaagtgcttttcgtacatcagatgacatgattccttctgacagctatgcaggttatggtggctcccaggcacttggaggaggatatggggcttacagcggatacagtgctcgctcctctggtagtgggttatctggtcatagttctcttcactatggaaagcgtcatggttattaggatttagattgcttgataaagcagccaagacattgaagtttggagcctgcttattggtgccccttcccaaaccagatgaccaagagagcccatcctggaagctttgattaagaggacctatgtggatgccatagaccacctgatattcctcacactacattactcatgtcttcctnctgggcctatggtttttgccctgccgtaaatgtttcgaacctatgtattgaaaggtcgcatttgagactgcatgtatttgcttgtttgaaacctgctccagtttagcggt

SEQ ID NO: 14235 - DNA, 432 bp, Sorghum bicolor
  Clone ID: LIB3480-016-P1-K1-C10
gcaagttatggtggctcccaggcacttggaggaggatatggggcttacagcggatacagtgctcgctcctctggtagtgggttatctggtcatagttctcttcactatggaaagcgtcatggttattaggatttagattgcttgataaagcagctctgctatctgatggacctgttcttttcacctttgccccccccttctcccctcccgtactaaaaacagccaagacattgaagtttggagcctgcttattggtgccccttcccaaaccagatgaccaagagagcccattctgtaagctattattaagaggacctatgtggatgccatagaccacctgattttccttacactacattactcatgtcttcctctgggcctatgtttttagcccttcccataaatgttctaaccttattatttgaaaggttt

SEQ ID NO: 14236 - DNA, 1376 bp, Sorghum bicolor
  Clone ID: SORBI-28MAY03-CLUS7079_1
ccgggaggttccagtttccccgaggctctaggattccgctcccccccgccgcatccgtcgagatccctccccccacatccttcccctccgcgccctcgccgccgccgacgcgagcgcgcccccgatccagatccaggagatatgcctcgctatgatgatcgctatgggaatacacgcttgtatgttggaagattggctccccgtacccgttcccgcgacctagaatatcttttcagcaaatatggaagaatacgtgaagtggagttgaagcgcgactatgcatttattgagttcagcgaccctcatgatgctgatgaagctcagtacaacctagatggcagggaagttgatggaagccgcattattgttgagtttgctaaaggggttccacgtggttcaggtggttcacgtgaatacatgggaagagggcctccaccaggaacaggtcgctgttttaactgtggaattgatggtcactgggcaagagactgcaaggctggtgactggaagaacaaatgctaccgctgtggagaaaggggccatatagaaagaaattgccagaacagcccaaggattctcaggcgtgagagaagctattcacggtctccatccccacgccgtggacggggccgcagccggagctacagcagaagccgtagctatagccgatccaggtccccatctggatctcccaggggtggacgccgcgaacgtgacgagaggagatcaaggagcctgagctacagcaggagtgcaagccccaggcgttctgtgtcaccagcgaaggaaaaggagcgcagccgcactcctgatggcagtaggagcccaaggagccccagcccaagggatgatgtgagcccaccaccaaaggataatggtgcacacaacggctcagaccgtgaagacagccctggggccagggagaacagcaagaggagtcggagcccatctgacggctaccgtagccctgcggccaatgggcgcagcccgagccctagagatgaccgtagcccaagccccaagggcaacaatggtgatgacgagcgccgtggctcaccaagaggaagtcagtccccttgaactgaaaagctcccaaccaatttggggcgcagtgtgccgattcggttgtaacagttatattttcagtttgagacagcaaacagtatttgctcatttctcagacttgcgctttttaccctagaaaacttgtgtaagaatttgttgccctcgggctatgcctggtttgtgatatggtgatatttgatctatttagcctgccaaatcttaatattgaactaccaagtatcttgagtttgttgtctgcttggtaagccgcaacgtttctctaactgtcttggaatgtatgtttcgaactt

SEQ ID NO: 14237 - DNA, 1447 bp, Sorghum bicolor
  Clone ID: SORBI-28MAY03-CLUS7480_1
aggctctcggcccgcacgccgcaccccctcctccgcgttgatctccccgatccggccaccgctcccccacctctctcgcatctcacgccaacgcccaccggcgtcctcgtccctccgtgccggcgagcggcggggagggagctttccacctcgtctcaggcaggcaccctctggcgtcctccctccgtgtcggcgagcggcggagatccgccgttctgacctcgtctccttccctctgctgacttgtgaacaaggcagcagcatagttcagtttagaaacatgtcatcaaagaagatagagttggatcacaaggacattgtccatgattctgccattgactactatggcaagcgccttgccactgcttcctcagactctaccgtgaagatcgtcaacattggtgcagcaaatgccccatcccaggtccttgcaacgcttagtggccactgtggtcctgtgtggcgtgttgcttgggcccatccaaagtatggtgctatccttgcatcctgcagttatgatggtcgtgtcattatttggaaggaggatgcacggggcaattggtctcaagcccatgtgttcagtgaccaaaaggcatctgtcaactccattgcttgggctccatatgaggttggcctgtgccttgcatgtgcatcttctggtggcagaatatccatcttgacgatgcgagccgacgggggttgggatacttcaaccattgagcgagcacatcctgttggtgcgactgccatatcctgggctcctgcaacagcttcactagctggtgcaggggagcttgtttacaagctcgtctcaggagggtttgactctgtcgttaaggtctggggattcaacgatggtagctggaagctggagggtgctcttatctctgacatgcacacggattgtgtgagggatgtcgcgtgggcaccagttttgggattggccaagtctaccattgccagcggttcacaagacgggaaggttgtcatctggaccaaggcaaaggatggagacaagtgggagggaaagctcatgcgtgactttggtgcccctgtctggagggtgtcctggtccttgactgggaacatattgtccatagccgctggtgagaacaacataaccctctggaaggaagggtcagatgggcaatgggaggaggtgatgaaggttgaaccataggttgctggtcaaggtttctgagtttcttgtagatccatgttccgataaagataaagtttgccattgtgttttactagtgtctcgataaagacaatttgccagtgtgttttactagtgcttcctgcagatcaatgttttgataaagacaaagtttaccattgtgttctgataaacactgaattcacttattctagtactttctgataagcaattactctgttggatggacccagtgcgctttagaatgacaatttctgattggtttac

SEQ ID NO: 14238 - DNA, 824 bp, Sorghum bicolor
  Clone ID: SORBI-28MAY03-CLUS37047_1
gaccgccggtttcacacgcacgcactccattgctgccttcctcatttcgtcgtcgtctacctctatccaattccaacacggccacctataaatacacatccctctcgtcgagctgagctcagctagttgcatgccagcctgccaccattggagaggattggagctcggccgagcagagcacggtgtgtctgacatggcagcgctatggctatcgagggcgtcgacccagctggcgcgccgtgcagcgaggaggcttcctgccggccgcggctccggcgaacccaccaccagtccatggttcttgggagcggtgccgccgccggctcttggatcgacggcggcggtggagacaagccggcgccggggcttctgctccgtacgaagattcgcaggggagagcagcgctgctgccgccactgtcgtcgacgaggaggagccggagaacggattcgtcgccggcgatcagcaggcagttcacttccctggaggcaaagtttctttcgtggctgaaatgaacttccttccagactcgatgaaggaaaggataaactgctaccgtgtgcttgatgatgacggcagaactatatcaggcagtagattccaagaggtcagtaaggagttggctgtgaaaatgtacagcgagatggtcacactccagatcatggataccattttctatgaggctcagaggcagggtagaatctcgttttatctcacttccaatggcgaggaagcaatcaacatagcctctgctgctgcgctcagtatggatgacattgtgctgcctcagtacagggaaccaggtgttcttctatggcgtgggt

SEQ ID NO: 14239 - DNA, 1788 bp, Sorghum bicolor
  Clone ID: SORBI-28MAY03-CLUS41856_1
cccccccccccagcccaaccctcccaatcccccactcgccgtcccaccgaaccctactcaccaacagacccgcaggagaagggaaaaaaaaaataatcctctcgaggcgacttcgccgtcatggcgggcgatcccccgacggccgcggagaaggagaccctggtctcatccttcctcgagatcgccgccggccagacacccgagactgccacccagttcctacagatgacgagctggcacctggaagaggcgctgcagctgttctacatcgacggcgagtccgccctcggcgccgcgcatccagcggtcccgccgcctgcggccgcggctgcgtccgcgtcggcgttggcggcggcggctggggtggaagaggcgatgaggttcgctccacccccggcggctgccctgggcgatgcaatgtcacatggatttggggttggggaggacgatgacgtccgcgcgcctctgcctgtgaagagggagactctctacggcgagggcatcgtgtctgtcatgcgacctaatgcatcagctgcatttcgtaattttgaacaagaggcaagacaatctgctgtctgggactctgaccagaatgctacatctagttctggtgttctgcctgcttctttgtgccgcccgcctggggcggtgatgttcaatggaccctttgacaaggcaaagttagaggcttcttccctggacaaatggctattaatcaatttgcagtcgacagaggaatttagctctcacatgcttaatcgagcccccgggggaaatgaagcggtggctcagttgattcggtcaaattttattttctggcaggtttattatgacaccagtgaggggaggaaggtatgcacctactaccatttggtgtccatgcctgctattctcctaattgaccccgtcactgggcaaaaaatgcatgcttggaatggaatggttcaccccgaccgtttactcgaggatttactaccttacctggataaaggtccgaaggagcaccatgcagctcaacctcagaagcgcccaaggaaagttgatcaggaagcttctacaggcaagcaaggcaaaatagctgtagaggatgaagatgaagaactagcacgggcagtagcagcttcgctagaggagggtaaagaaatcattgaagcatcagacgctagtgatgacatggctgaagctgaacctcaggtggacaatgagccaagcttaaacatcaagcctgattatcctcctctccctgaagaacctacaggaagcagggaccgtctctgcagggttgcgattcggctaccgaacaatcggaggatccaaagaaacttccttcacacagatcctatcaagctcttgtggtcattctgcgctcctcaggttgaggacggtgagaagagggcgttccacttcgtacaggccattcctggagcatcccagaagctggagttcagaagcgaccaaacattcaaggaagccgggctggccaactcgatgatcaacctcttgtgggactgagccgctcccatctcgttcgggtcgtgtttggggatggacttgaagatggcttactagttattatctttcctggaggatcaactcttttatctttttgctccacttgagcttgagccgaggacaaaaatctgctgtgccctgggctgtgtgtggaaatgctccttttgccgttcgttcttgtgtccatatacatccccgtccctggtagggcttagctctatttaatgcacatatttatcacggattcaagtctggtgcattgcatgcattgcctgc

SEQ ID NO: 14240 - DNA, 2130 bp, Sorghum bicolor
  Clone ID: SORBI-28MAY03-CLUS6179_2
agtgcgccgctatagcggcgcattatttgattaattaaattaatacataggtttctttgcagggaatgcggggtcagactcgccgcccgccgctctcgcctcgtctcgtccccggagcgcacgcacgtcagatcaggtgcgccgcgcgcccctcaccgacgagcatcgacccgtccaccaggaaagatgacgggctccatggatctcccggccaagggcgggttcaacttcgacctgtgccgccggaacaacatgctcgagaagaacgggctcaagctcccgggattcctgaagaccgggacaaccatcgtcggcctcgtctttcaggatggggttgttcttggggcagacacaagagcaactgagggccctatagttgctgataagaactgcgaaaaaatccacttcatggcgcccaatatatattgctgtggagcaggaactgctgctgacgcagaggctgttacagatatggtaagctcccagctacagcttcaccgctatgcaacgggcggtgcttcaagagttgtaactgctcttacactactgaagtcacacctcttcgagtaccaaggccatgtcagtgctgcccttgttcttggtggagtggattgtactggaccacatctacacactgtttatccacacggctccaccgatactcttccttttgcaacgatgggctctggttctcttgctgcaatgtcagtgtttgaatcaaaatacaaagaagggcttactagggaggacggaatagaactggtgtccgatgctatccgcgctggtatcttcaatgaccttggcagtggcagcaaggttgatgtctgtgtgataaccaggggaccctcagatgtcgggcgattcctcccgtgccccagtccctgatctgctgcttcctccaacccattttgcgtcaccgtggccctgaccgcactactgccctcgtagcgcacacctctgaagcagaaggttgaggttgccgagggcgggcctgcgagggcgccatgttcctgggtgctccctttcggcctgcgttccagtgctgttgctgggagctctggtgctccgagcacctgtgctgattcaaacaagttaggaccatctacatggatcgtctctccaagaaatttgtagacagcaggatttttccctgcccggagggcacctgctgggttccaactgaatgggtgggctagtgcggtgtttataggcaagtgggttgtttgctgcagctggagatggcaatccaccacagtaagatgtaaatgtctttatttttccctttcgagcatgagcttcatcaatcatcttcattgacatcaagtgatctatgccaggatctaggcccatttcacaaagtatagttacacctgcacctttagcagcttggctcaagtttgacatggattcatcaacatagcttgccgttaccatgtgcttcttgagctctatgcatactcttgcaatggcagcatgaaaactagtaggcagcaagctaattacaacctcaacctgagaaacaagatctgaaaggcttccaatatcagaaacatcaagctgggtagcagttgtattttcaataccatcaactgtctcttctgcatctttctgatacaaagatgccacaataacatgaatttgatctgtcctcgggccatcaacaccataggtacatatgtttgggtaagatgccagaaactcagcagctggtcgacaaactcttccagctccaagaattaaaacctttggacctcctttatcaactgtggcatcagtttcacactcattgacttttcctatcttcagagctaattcagtttctttcccggcatcgtgatctccaccatgttcattagctagagaagtcaaggaatcaataattttatccaatgtggcagtatcatctgctcctacttcaagctctgagtatgacatatcatccatgctctgtccaacttgacatctaaccaagtgaaatgaacctccacctgtctcaatgatgtccaaagcttcatttataaggaacttatcaaataggtgcccactgagagataccagggtgctgtacttcttgtcaggcaatggatttgtttttgtgggggccaaatctatcatagtattctcattcta

SEQ ID NO: 14241 - DNA, 775 bp, Sorghum bicolor
  unsure (1)..(775): unsure at all n locations
  Clone ID: SORBI-28MAY03-CLUS6179_1
ntaggggccttttttttttttttttttgatagatcatatatatacataggtttctttgccgggattatttggtcatatatacagaggtttctttgctctcttacgacaggtaatatactatgtacaaaagatatatgtacccagctatactatcatatacatcgcagccatgtcactgtagctaccttgcagccgtttcactgtagcttgcgtttgatgaacttatgggagttgctacggctgcagcgcagcgcagccacagccacagcaagttgatccgaacggaactatcaaatctccacactctcaatcagcttgatgcctgacgactccaagatctccaatgctggaatgtagatctccggttgcagaggcctgatcactccttttgtctggaccttattctgtagcaatagcagggctcctactgctgctggaataccaacggtcagggccatggcagtggtggatctgccattttcaaccttcccgaactccagtagcgtcgcttggtgcttctcggtgggttgcccgtctgggtattccacctcaacttcgtggtggagcagtaccatgtcttgctcattgtggccataggccatcctctgttcctttcgttggcaaatcacatcaaatgcacttgaacaacccttaggaatttgagtctcttcatgtagtcccaagaacttgatggttttgactgtcttagcagctatttccttatctctgcaacacccgagcttcgacagtctggcaatgacccgacccggccggc

SEQ ID NO: 14242 - DNA, 683 bp, Sorghum bicolor
  Clone ID: LIB5049-005-R1-XP1-E1
gccgggccggaaagagtagagtatccacccgcgccgcctgggttccggcaacaacttcgacgtctcctcgcctccggccgctctcgccagcctcgtatccgacctcaggtcaggcacgccgtgtgcgcccctcccctagctgcgacgagcatcaccaggacagcaggaaggatgacgggctcaatggatctcccggccaagggcgggttcagcttcgacctgtgccgccgcaacaacatgctggagaagaacgggctcaagctccccggattcaggaagaccgggacaaccatcgtcggcctcgtctttcaggatggagttgttcttggggcagacacaagggcaactgaggggcctatagttgctgataagaattgtgagaagatccactttatggcaccaaacatctattgctgtggagcaggaactgctgctgacactgaggctgttacagacatggtcagctcgcagctacagctgcaccgttatgcaacaggccgcgaatctagagtcgtaactgctcttacactgctgaagtcacacctctttaggtatcaaagccatgtcagtgctgccctttgttcttggtggagtggattgcactggaccacttcttcatactgttttatccacatggctccactgatactcttccctttgcccccaaagggttctggatcccc

SEQ ID NO: 14243 - DNA, 871 bp, Sorghum bicolor
  Clone ID: SORBI-28MAY03-CLUS9446_1
gcttcaaaatcgaaatatacattgcatacaaccaaagaaaaagcagccaacttgaaccaaccaaagtgcagacctgactagctatatgtgaattgtatattgcagacatattgtataccaacagagtaggaacaaaggtggtccaccatagaagatagaaccctcggatttttcagataaaatcacaggagacaacactatcatggaacccactgacgtttaagtgagatttataaccaagacaaacattcaaatgatgatcattcttaacaaaggttcagactttcgacaaaagtaccactaatatagcaacttcacacacccatgagtgaaaactcagaaactgattaggccagaagacttcacacggtccaatggctaaacctatgggcgagcagcaactggtgctggagctggagcagcaccagcaggaccaggaccagggcgggggcctccttgtccaccagccggcctatcctccctgcgcctgaagcgttccggcggcttgcggtccctgcgcttctcacgggatcggacgcggacgatgtgagcgtggatcgcgcacgagacacagtggtgcaccttggcgtacagcttcgggaggacgtacccatcatgaacacacgcttcctggacatccctgatagccgcctgctccacgatgttcctcacctgaaacctcttgatcgccttgtccttggggcagcacttggcgcagttagagcagcggatgtacttgacgtgaccgcggccatgcttgttgcggccgccgttgcggcgcttgaaggtcatggcggcggcgcaagatgtcgagttctgaagccccactccgggcccggccggctaaactacagcccccgacccggccggc

SEQ ID NO: 14244 - DNA, 701 bp, Sorghum bicolor
  Clone ID: SORBI-28MAY03-CLUS10614_2
gccggccgggtccgggagcagcccaccactcatttcaccaaaccaagctaagggaggagaagaagatcaggagagaaagagagagacgaaacccttgctcactcatcagctaggttacttcaccaccacagctttggctcgcaaccgcaaggcagcaggcgaagaagatgtacaacgcgccgtcagcccaggagatgtcctatttcgagcacgtgcagaggcgccacgaggagaagggctgcctctacgcctgcatcttcacggcgctgtgctgcttctgctgctacgagacctgcgagtgctgcctcgactgcctctgctgctgctgcaactagcctgacatccggctccagaggaggatcgacatgcagatcgatggagatcgcctccgtctctcttctacctacctagtgatgattcagtagcctgcttcctttagtcgcctggttgtgcagacataataataaagcatgcatgtcgtagcgaaagagagatttactactctgtcagtttgagcattcgtaaaccaaccatggtttgaaccaccgcatcttttgttactgttgttgttatcagttcatccaattccgattctcaacacaacgcattcgtttcgcgcaatttatctgcaactgtactgctgctatgcgttacgatccgatggaatttattcataaaaaaaaaaaaaaaaaaggccccta

SEQ ID NO: 14245 - DNA, 663 bp, Sorghum bicolor
  Clone ID: SORBI-28MAY03-CLUS10614_1
cagcgccggccgggccgggtcagctgtgcacaaggtaggaagacaactgaagcagaagcagaggtcggtgaacacctgctgctgcttcaccaccgtgcctgaagaggagaggagaagccagccaggcagcgagccaagatgtataacgcgccgccgccgccgcaggacatgtcctactacgagcactgccagaagcgccacgaggagaagggctgcctctacggatgcatcttcacggcgctgtgctgcttctgctgctacgagacctgcgagtgctgcctcgactgcctctgctgctgctgcaactagcctgacatccggctccagaggaggatcgacatgcagatcgatggagatcgcctccgtctctcttctacctacctagtgatgattcagtagcctgcttcctttagtcgcctggttgtgcagacataataataaagcatgcatgtcgtagcgaaagagagatttactactctgtcagtttgagcattcgtaaaccaaccatggtttgaaccaccgcatcttttgttactgttgttgttatcagttcatccaattccgattctcaacacaacgcattcgtttcgcgaaaaaaaaaaaaaaaaaaactccctctatgcgttctgatccgatggaatttattcttcatgttctcctttt

SEQ ID NO: 14246 - DNA, 1120 bp, Sorghum bicolor
  Clone ID: SORBI-28MAY03-CLUS1077_1
cagggctatcgttccctcggcgtcttcacaaacgccggcgcttccactctcgatcgatcgatcctcgaccattccccattccgtcctcccccgatcgatcctcgaccattccccttcccgtcctcccccgatcgacgagcggttgtctgagagaagaggaggaagatgagggagtgcatctccgtccacatcgggcaggccggcatccaagtcggcaacgcgtgctgggaactttactgcctcgagcacggcatccagcctgatggccaagtgcctggagacaagactgcgggacaccacgatgatgccttcagcaccttcttcagccagactggtgcagggaagcatgtgccccgtgcaatcttcgttgatcttgagcccactgtgatcgacgaggtgcgcactggcacttaccgtcagctcttccaccctgagcagctcatcagcggcaaggaggatgctgctaacaactttgcccgtggccactacacaattggaaaggaaattgttgatctgtgccttgaccgcatccgcacgcgccctgccgcctgctctgccgtggcgacgtggtgcccaaggacgtgaatgctgcggtggccatcatcaagacgaagcgcaccatccagttcgtggactggtgcccgacggggttcaagtgcggcatcaactaccaggcgccgacggtggtgccgggggctgacctcgccaaggtgcagcgcgccgtgtgcatgatctccaactccaccagcgtcgtcgaggtgttctcccgcatcaacagcaagttcgacctcatgtatgccaagcgcgcgttcgtccactggtacgtcggcgagggtatggaggagggggagttctccgaggcacgcgaggacctggctgccctggagaaggactacgaggaggttgctgcagagggcggtggtgatgacggtgaggaagacgaggagtactgatctgcttgcatgaatctctttggctgtcgagcgaggttgcggtgtcgaaaaactttttccgtttgcgtcctgggtagtgttgttttttgctttcatgtcacttgctgaactgctgtagtagttgcatgtcataattgaagtatgtcgcttaagcactgttggttccg

SEQ ID NO: 14247 - DNA, 1294 bp, Sorghum bicolor
  Clone ID: SORBI-28MAY03-CLUS10671_1
gcggcacgttccaagggccttgtttgtcgacttggagcccactgtgattgacgaggtgaagaccggggcataccgtcagctgggcgatcctgagcagctcatctcacacaaggaagatgctgcaaacaactttgcccgtggacattacacagttggaagagaagtagtagatctttgccttgatcggataagaaaattggcagacaactgcactggtcttcaaggttttctggttttcaatgctgttggtggtggaaccggctctggccttggttcgctacttttagagcgtctatcagtagattatggtaggaagtcaaagctcggtttcaccatctatccttccccacagatctcaactgctgtggtcgagccttataacagcgtgctctccacacattccctgattgagcacgaggatggtgcaggccttttcggccctcaggcttcttcccttcctttccctgcttcggaactcccgaggctgcataacctgattcagaggcagagcgagagagcgtgaggaagggagggagatgagggagatcatcagcatccatatcgggcaggcaggcatccaggtggggaattcttgctgggagctctactgcctcgagcacggtatccagcctgatggcctcatgcccagtgacaactctgttggggttgcgagggaggccggcaacacattcctcagtgaaacgagcgtcccgaggcgcgtcctggccaaggtgcaacgagcagtctgcatgatcagcaacaacacagctgtggctgaggtcttttcccgtattgaccgcaaatttgatctcatgtatgcgaagcgtgcattcgttcattggtatgtcggtgaagggatggaagaaggggagttctcagaggcaagggaggatcttgcggcactggagaaggattatgaggaagtcggagctgaagttgaagatgatgatgaggaagctgagtattgagtcatcccatctggatgcatggttattttcctttggtatcagtcaaccaggagtgcttgggttgcatggttgtacctcccatttgtttccctgtttgctattgcattacacctgttcatgattgccagagtagaactgtgaagattggttgaactggtgtgatggtttgagataaaataaaataagtattaaaaatgtcatatgcaagaggtcccttgacattgagcgtccaacatacaccaatctgaacaggcttatatctcaagttatatcatctctaaccacgtcactgaggtttgacggagccattaatgttgacataactg

SEQ ID NO: 14248 - DNA, 3149 bp, Sorghum bicolor
  unsure (1)..(3149): unsure at all n locations
  Clone ID: SORBI-28MAY03-CLUS1107_1
cgcaaactcctttccagcctttcctctccccaaccaccgccaccgcgcgcgagatcacgagcctccacgccgtgaccaccaccggcgccgctgcggcgtccggagcaggcggcgagcgagcgtcgtgcacggggatacggtaggctcggctcgccggggcggacgagatgagcgggcacgactccaagtacttctccaccaccaagaagggggagatccccgagctcaaggaggagctcaactcccagtacaaggacaagagaaaagatgctgtcaagaaagtgattgctgctatgactgtaggaaaagatgtctcatcattgttcactgatgttgtgaactgcatgcagactgagaacttggagctcaagaaactagtatatttgtatctcatcaactatgctaaaagtcaacctgatcttgccattcttgctgtgaacacatttgttaaggattcgcaagacccaaacccattgattcgtgctttggctgttaggacaatgggttgtatccgtgtggacaaaatcacagaatatctctgtgatccacttcaaagatgcctcaaggatgacgatccgtatgtacggaagactgcagctatttgcgttgctaaactttatgatataaatgctgagctagtagaggatagaggatttctggaggccctgaaggacttgatatctgacaataatcctatggttgttgcaaatgctgttgctgcactggcagagattcaagatagtagtgttcggccaatctttgaaatcaccagccatacactgtcaaagcttctgacagctctgaatgagtgcacagagtggggtcaagtcttcattttggattctttgtcaagatacaaagcagcagatgccagggaagctgaaaacatagtggaacgagttacaccccgtctccaacatgcaaattgtgcggttgttctttctgctgtcaagataatccttctacaaatggagctcattacgagcacggacgcgggcaggaatctctgtaagaaaatggctccccctcttgtgactctcttgtcagcagaacctgaaattcagtatgtagccttgaggaacattaatctgatcgttcaaaagaggcctacaatactcgctcatgagattaaggttttcttttgcaagtacaatgaccctatatatgttaagatggaaaaactggagattatgataaagctggcctcagatcgaaatatagatcaggtcctcttggaattcaaggagtatgccacagaggttgatgttgactttgtgcggaaagctgttcgtgcgattgggagatgtgccattaaattggagagagctgctgaaaggtgcatcagcgttttgcttgagctgattaagataaaagttaattatgttgttcaggaagctataattgttatcaaagacatcttcagacgctacccaaacacgtatgagtctatcatcgctacactttgtgaaagtctggacactttagatgaaccagaggctaaggcatccatgatttggataattggagaatatgctgaaagaattgataatgctgatgaacttcttgagagcttcttggaaacgttccctgaagaaccagcattagttcaactgcagctgctaaccgctactgttaaattgttccttaagaagccaactgaggggccgcaacagatgatacaggctgttctcaataatgcaacagttgaaacagataatcctgatttgagggacagagcttacatatactggcgacttctgtctactgatcctgaggctgcaaaagatgttgttttggcggagaaacctgtgatcagtgatgactccaaccagcttgactcatcacttcttgatgagctactagcaaacatttccaccctttcatcagtttatcataagcccncagaatcatttgtcacgagtgttaaggcagctcctagggctgatgatgaggagtttgctgatacagctgaaacagggtattcagagtccccatcccagggagttgatggtgcatcaccttcgtctagtgctggtacttcttctaatgtacccgtgaaacagccggcagctggatccccacctccagctgcaatgccagaccttttaggtgatctgatgggtatggacaatgctattgtccctgttgatgaacctgcagctccttccggccctgctctacctgtcttactaccgtcaactacaggccaagggctgcagattagtgcacaactaacgcggcgtgatggccagatatactatgatatatctttcgagaatggcacccagggtgtcctagatggatttatgattcagtttaacaagaacacatttggtcttgctgctggtgaagcacttcaggttactccactgcaaccaggccaatcaacaaggacacttttacaaatgatcccgttccagaatatcagccctggtgcaccaaactcgctgttacaggtcgctgtgaaaaataatcagcagccagtgtggtacttcaatgacaaaattccactgcatgttttctttggtgaagatggaaaaatggagcgagctggttttcttgaggcctggaaatctttacctgatgacaatgaatttacaaaagaattcccaggctctatcatcagcagcatagatgctactgttgagcgccttgcagcatcaaatgtgttctttatagccaagcggaaaaatgcaaacatggatgttctgtatctgtctgcgaagatgccccgtggaatccctttccttatagaagttacagcttcggttggtgttcctggtgtgaaatgtgcagtcaaaactccaaatagggagatggttcctctcttctttgaagctatggaggctcttaccaagtgaggacaaagttaatggatcggtggttctacaaaaattcatcagtcgatgagctgctataggtgtttggacgcggcatcttttttcacggaagctggtgtggattgtagtgtttttgtattagattacagtatttaaactgctagtatcctggttccaaagtttttcgccagaaatactggagatgttcttgtctcgcataatttgtacatcttaccttgttggacctggaaattttcatcttgttatgcatagcgtttgaaatatgactagttttctacatggctaatg

SEQ ID NO: 14249 - DNA, 1076 bp, Sorghum bicolor
  unsure (1)..(1076): unsure at all n locations
  Clone ID: SORBI-28MAY03-CLUS866_1
gccggccgggccgggacttcgcgttccgtgtttccaactccggtgactccaccagcaacccagcaacccgcgcagcgatcccactccggccaccgccatgtcgaggcgcggcgactgggtctacgagaacaacggcgggacctgcgtggccatcgccggcgccgattactgtgtcgtcgccgcggacacccgcctctctgtaggatacagcatcctcacgcgcgaccactccaagatctgcgacctggctgacaaatgtgtactggcatcttctggctttcaaggtgacattaaggctctgcacaagaacctagctgccagagaattgctataccaacaccagcataataaaaggatgagctgccctgccatggcacagctcctctccaatacactgtactacaagcgcttcttcccatattacgccttcaatgtgctcggtgggcttgacagcgaggggaaaggatgcgttttcacctatgatgcagtaggttcctatgagagaaccggttacagcgctcagggaacaggatctactttgatgatgccagtcctggacaatcaactaaaatcaccaagtcctctattactccctgccagggatgctgtcacaccattgtcagagtcagaggccatcgatctagttaaggatgtgtttgcatctgcaactgagagagacatctacactggagacaagttggaaattgttgtcattaacaaagccgggactaagcgtgagtacatcgagctgaggaaggactaagccaacgcttcagtaatgctgcagctgccatttgcttcgaacttgttccctagcctggagatttatgtctaaagctgttgcttcatagaagcagttgtgtttacttgcatatgtactgtaccaggattcagtcagcttgtttttttgttgaaacaaattccttggatactgaagcggtacttattggcggaaaggctatttggttgggagcttgacatgattggcttgtgtcacaagcctctttagatgtcttatatactcactccgatttcanaattgtcttttgtctttaaagtcaagccttttaacttct

SEQ ID NO: 14250 - DNA, 814 bp, Sorghum bicolor
  Clone ID: LIB5049-008-R1-XP1-H9
gccggccgggccggacttcgcgttccgtgtttccactccggtgactccaccagcaacccagcaacccgcgcagcgatcccactccggccaccgccatgtcgaggcgcggcgactgggtctacgagaacaacggcgggacctgcgtggccatcgccggcgccgattactgtgtcgtcgccgcggacacccgcctctctgtaggatacagcatcctcacgcgcgaccactccaagatctgcgacctatctctctttgtgtgtagggccgacaaatgtgtactggcatcttctggctttcaaggtgacattaaggctctgcacaagaacctagctgccagagaatcgctataccaacaccagcataataaaaggatgagctgccctgccatggcacagctcctctccaatacactgtactacaagcgcttcttcccatattacgccttcaatgtgctcggtgggcttgacagcgaggggaaaggatgcgttttcacctatgatgcagtaggttcctatgagagaaccggttacagcgctcagggaacaggatctactttgatgatgccagtcctggacaatcaactaaaatcaccaagtcctctattactccctgccagggatgctgtcacaccattgtcagagtcagaggctatcgatctagttaaggatgtgtttgcatctgccactgagagagacatctacactggagacaagttggaaaatgttgtcattaacaaagccgggactaagcgtgagtacatcgagctgaggaagactaagccacgcttcagcaatgctgcagctgccatttgctt

SEQ ID NO: 14251 - DNA, 2314 bp, Sorghum bicolor
  Clone ID: SORBI-28MAY03-CLUS12337_1
atttcgtacagatagagcatggagtactatagaggatagagcgttattaagtcaaagcccaagctccagtagcgaaggaaaccctgtcaatccaccgtaacccctgcccttaacctattccacgtcgcaactcgcgcatcccgtccaaaggcacaaacgcacgacgcacggcggcggctaaccccgactccccgcggacggcggcggcgggcggcgcggctccgcggctgcaccggtcaagcatatataatctagctagctagctcatcacgcccaaagaaaaagacacatcaagatccatctttgtatagctactgatagctagttagtttcagcctgcttgcggctcgtgaatacctcatctttttagccactttgccaccagcaggccatctcgatcgatcacgaggaacccacggccggcgtcgccattgttgctgtaacttgcaagctttccctttcgcctttttccttccacctccctcgctcgtcctcgtgtgcgagctatatatatatatatatataaaagcgcgccgatggagcagcagcaggtgagggggaggaggaggagaaacggcgtgctgcaggtgcaggacggctcggagatccgttctctcgtggagaacaaggaggcgttcactaggttcgtcgacgaccgattccagaagctcgacgccgatggcgacgggaggctgtcggtgagagagctccagccggccgttgctgacatcggtgccgccatagggctgccggcgagagggtcgtcgccgcaggcggaccacatctacgcggaggtcctaaacgagttcactcaggggaagcaagactcggtgagcaagccggagttccagcgggtgctgtccgacatactccttgggatggcggctgggctgaagagggacccgattgtgatcctgaggataaacggggaggacctgaatgagttcgtcgagagtccgagggatgagcctgaagccctggccatcttttcacaagtcggagtcgccgtgggagccggcgcacctcccccagcgcctccaaagctggcccagcggcggcgggccgctcttggtcagcccacggtcgaccatggcatgccaccagcttctgattcctgggtcatggagaatgttgtggagcctgcgttgcaagagctgtctgctaatcagctcgatcagcctgtttcccaggaagtcttcttccaagaattcaggaaatttctgggcatcatggctctaagactgcaacagcaccctgtgatcgtcgcccatacagagaacacctttgacgggagtggtatcaggaggctactgtcgaacaagttcgaattagacaagctgctggattctgtatggagagacgttccgaaagaacacaaagataaaacgtcgaaggagtacctccggattgcgcttgataggattgccgattcagcgagtctgccaccttttggagccgtcgatcaggttgatgctgtggtgaacgaagcattcaagatggcgaaagctgacgaaatgaaggcggtggacgaagcagagttcaagaagctgctgacggagattcttggggccatcatgctgcagttggacggcaacccgatcggtgtctcaaccaacaccgtcgtccatgagcccatgtccacctcctccgcgctgttgtcaccgacgccgctgtctccaatggtgtcctcaccaagtgaataaggaggaaagtcgacaactgacgaaatgatggagacgaagaatctccattgagcaccggcccgtgtgatgctgagttttcttctgtggtcacaggataataataataacatgttagattgctagtaacttgtggattgttcatcttgcatgtaacttgtgtctgtgttgaaataaggctttcccaagccagacgacgtgcatattactaatggctgatgttcggttctttcttgttaaaaaaaaaagatgggcgtgcagcggtctgcttcttccctctgcgattggcaatctatctgcagttctgcactgacccccgccgaggccatgctcggtctgactagcggcactgcaagtagaccacccactgcgttccatctcccttctatgttcctatcctctgagttcaccacaaactcggttctatttcgtggtttggggcaagaggacacttgagctctagatttcatttatttcttattgatcgtagtagtagtagtagcgagatgagattcaagttctgcattacgcaaaattgtaatgtctgcatgccatgtggttgtcaaaatgcctgtatgacaagctcaatagatttacctatcgatcggttgtcc

SEQ ID NO: 14252 - DNA, 678 bp, Sorghum bicolor
  Clone ID: SORBI-28MAY03-CLUS6324_3
ccgcgagaaaccagccgtgctctgctcactctctgtagtgtctctctctctctctctctctgagcccagtgctgcgcatcagactctcacgagcctcacgaacaggatcaagaaaccaccaccatgtcgacggtgagccgtgcgtccctcgaccagaagcttgccctcgccaaacgctgctcccgagaggcgaccatggcagggtttaaggcagcagctgtagcaaccgtcgcctctgcagttcccaccctggcgagcgtgaggatgctgccatgggcgaaggccaacatcaaccccaccggacaggcactcatcatctccacggttgccgggatggcctacttcatcgccgccgacaagaagatcctgtcgctggcgagacggcactcgttcgagaacgcaccggagcacctcaagaacacctcttaccagggcaccggcaggccacacccggccttcttcaggccttgattgaggataaacaaagcaaaccatgcaagattatttgttctactgttgtatgtgtagtaatccagctatttcatgcaataatcaggcccctgcaatgcagaccagcaggtaggtagcttgctctgcgagcttattagcatagcttactagctagttagcttctgcatctgccgcaggttggttgcagtctgcggggaactgcatgga

SEQ ID NO: 14253 - DNA, 701 bp, Sorghum bicolor
  Clone ID: SORBI-28MAY03-CLUS6324_2
gccggccggccccgggatcccatcttcttcatcggcagttttatatatactcgtcagtcacaacgacgacgacagagatcgagcgaatagctagctctgcgtgcatctcaggatcgatcgatcaccatgccgaacaccaccgtgacctccgcgtccgtcgaccagaaccttgccctcgccaagcaatgctcgcgagaggccgccatcgcagggttcaaggcagcagctattgggaccgtcgcctccggaattcccaccctggttagcgtcaggatgctgccatgggctaaggccaacatcaaccccgctggccaggccctcatcatctccacagttgctggcatggcctacttcatcgcggcggacaagaagatcctcgcgctggcaaggcagcactcctatgagaacgcacctgatcacctcaaggacacctccttggagggcaccggccgtccccacccagggttcttcaggccgtgagcgagcaagataccctggaagcactaagtttctcagccgtcgtcgatatgatgcagcatgtccaacaataacctactactactactagcctatatactactactagctagtagtagacatcggcgatcgatgtggctccagagaatctgtaatagcttagtgctccagtttactgtatcaaccttccatcatatattaatatatcctccaatttaagagcg

SEQ ID NO: 14254 - DNA, 787 bp, Sorghum bicolor
  Clone ID: SORBI-28MAY03-CLUS6324_1
gtgcggcgctggcccggctggcaagccccttcatcgtcctcactcctcacatcctccggcggtgctgacatactgtatctgcttcttttcactagccaagccaagtcggcaacctcagagagatccgagagatgtcgacggtgagccgtgcatcccttgaccagaagcttgccctcgccaagcgatgctcgcgagaggcgacccttgccggagccaaggcggcagctgtggcaactattgcctccgcgattcctactctagcgagtgtgaggatgctgccatgggcgaaggccaacatcaaccccaccggccaggccctcatcatctcaacggttgccgggatggcctacttcatcgccgccgacaagaagatcctgtcgctggcgaggcggcactcgtttgaggaagctcctgaacatctcaggaacacctccttccagggcacaggtcgcccgcacccggctttcttcaggccatgagcctatgagacatcatccgtcgacctacttcttcttcatcgtcgatcagtacaagcaccagacgatgccgtcgatgtctggctgtctgaataattgaactgctaggctctgacgctagtagcgtactgtagtaaccatcgtgcgtgtactagtaataggagtctagtactatatatcgcgctgtaattagtttctactattggtgctcatttcagaatgaatgcaaatttaatttctgtaaccaatgacacataaacaatcgccatcaaggaaaatatgaaatactagcccttattggcatggtgtac

SEQ ID NO: 14255 - DNA, 722 bp, Sorghum bicolor
  Clone ID: LIB5121-011-A1-PF1-D11
atcatcgtcctcacatcctcgctcactccttgtatactttcagagtttcagtgcccctcacctcactgctgagagtgccagctgacgacagagctgcatcttttcactagccagagaatttgttttgccaagtctgcaaccgcagagagatccgagagatgtcgacggtgacccgtgcatcccttgatcagaagcttgccctcgccaagcgatgctcgcgagaggcgacccttgccggagccaaggcggcagctgtggcaactatcgcctccgcgattcctactcttgcgagcgtgaggatgctgccatgggcgaaggccaacatcaaccccacaggccaggcactcatcatctcaacagttgctgggatggcctacttcatcgccgccgacaagaagatcctctcgctggcgaggcgccactctttcgagggcgcaccggagcacctcaggaacacctccttccagggcaccggtcgcccacacccggctttcttcaggccatgagaatgagatgagacatgcatgcgccgagttaattacctcttcaattcgtcgtcagtacgagcaccagagatctcgtcgatgtctgaataaacagctgctaggctgatgatgctctagcatcgcactaaaacatcgatgaactagtaatagtacttagtgttgtaattacccttgtactattgttgctcaattcaaaaaaataatgaatgccaatgg

SEQ ID NO: 14256 - DNA, 1100 bp, Sorghum bicolor
  Clone ID: SORBI-28MAY03-CLUS8064_1
ctactggaacgcatcggtatcgcgacggctccccaaccccacccccaactccccctccccgactctctggccaggtctacctctcgggccggcctctgtcccttcgccccccttccagtcccccccgcacgcgagaggagatcgccaccgccccgggtgggccctagatcccgatggcctcgcgccgccgcaccctgctcaaggtcatcatcctcggcgacagcggggttgggaagacgtccttgatgaaccaatatgtgaacaagaagttcagtaaccagtacaaggctacgattggcgcggatttcctcaccaaggaggtgcagttcgaggacaggctcttcacgctgcaaatatgggacactgctggtcaggaaaggtttcagagtcttggcgttgcgttctaccggggagcagattgttgtgttctggtctatgatgttaattctatgaaatcatttgataacctgaacaactggcgtgaagagtttctaattcaggctagcccatcagatcctgataatttcccttttgttctgttgggtaacaaagttgatgtagatggtggcaacagccgagtggtatcggagaaaaaggcaaaggcatggtgtgcttctaaagggaacatcccctactttgagacatctgctaaggatggaacgaacgtggaagatgccttccagtgtatcgtaaagaacgctctgaagaatgaaccagaggaagaattgtatgtgccagataccgtggacgtggtgggtggcaaccgggcccagagatcatctggttgctgttaaggcatgaggcatcacgagggcgttgtgatcatcaccggctatgcagtaaccaaacagtacctttgacattgctgggcctccatggttatctacggatccgtattccatttgttacctttccagtctcctgctatgtacccaagggcgcctgtcccatgctgtcaatccgtggactttgtgcagtttcatcagtagcgtcatatcttgtgaatacaattgggcaaaataagaggaagtgtaaactaaagttcatcctttatggttttgtgtgggacgagtatgaatttgtttgggcaatcgccgttt

SEQ ID NO: 14257 - DNA, 1252 bp, Sorghum bicolor
  unsure (1)..(1252): unsure at all n locations
  Clone ID: SORBI-28MAY03-CLUS8069_1
gcacgaggggcacgtccaccgcccccggcccccgcacgcggggcgcaacaaggccccccggccccccctgctcgtcggcccgcttcgaccgcgcgacccccaattggactcccagttcagatagaagcccctcgccggacgctcgctctcgccggcggcgactaaatcaggaggccaggaaggatggcacgctacgaccgcgcgatcacggtgttctccccggacggccacctcttccaggtcgagtacgccctggaggcggtccgcaagggcaacgccgccgtcggcgtccgcggcgtcgacaccgtcgtcctcggcgtcgagaagaagtccacacccaagctccaggactccaggtccgtgcgcaagatcgcgagccttgacacccacatcgcgctggcgtgcgcggggctcaaggccgacgcgcgcgtgctcatcaaccgtgcccgcgtcgagtgccagagccaccgcctcaccgtcgaggaccccgtcaccgtcgagtacatcacgcgctacatcgccggcctgcagcagaagtacacgcagagcggaggggtgcgccccttcggcctgtccacgctcatcgtcggcttcgacccctacacccagaagcccgcgctgtaccagactgacccctcgggcaccttctccgcttggaaggccaacgccaccggccgcaactccaactccatgcgtgagtttcttgagaagaattacaaggagacgtctggcaaggagaccatcaagctcgctatcaaagcactccttgaggttgttgagagtggcggcaagaacatagagattgcagtgatgacacacaaggacggccttcgcgaactcgaagaggctgagatcgatgagtatgttgcggagattgaagcagagaaggccgctgccgaggctgcaaagaagggtgcgccaagggagaactgattcagcacaagtttagatcgtgcctcttgttccacagcatgtcttatgattcacttcttttagacggatgcccggctgttcggatacagggatattttataagaaaagttcagatgaagccgcttggatgaaactcatgccatgtgatgcatggtagtacatctaccatggtggtttgtggcttgtgtgactgttgtcgcagtggtctgttgcctgttggtctgtcagaattattattattttctgaaacctgacaatgctagtcagttaagagacttttattgttgcattattttaattnttttaatttatttaattt

SEQ ID NO: 14258 - DNA, 1218 bp, Sorghum bicolor
  Clone ID: SORBI-28MAY03-CLUS69248_1
tgttggcgcatcgatccaccatccaactctttttctagctagacgacatggccacattcacctgcaggtccatggccttcctctccctcgccgccgccgtcctcgttgccctactcaccgccggcgccgcggacgcgcagaagctctcccccaacttctactccaagacgtgcccgaacgtggccaccatcgtgcggcagcagatggcgtccgccgtcgcggcggagaagcgtatgggcgcctccattctccgcatgttcttccacgactgcttcgtcaatggctgcgacggctccatcctcctcgacgacacgtccaccttcaccggcgagaagggcgccggccccaacgccaactccgtccgcgggttcgaggtcatcgacgccatcaagacgaaggtggaggcctcctgcaaggccaccgtctcctgcgccgacatcctcgccctcgccgcccgtgacggggtcaacctgctgggagggccgacatggagcgtgccgctgggccggaaggactcgcggacggcgagccagagcctggcgaactcgaacctgccaggcccggggtcaagcctggccacgctcatcaggatgttcggcaaccagggcctgtcggcgcgcgacatgacggcgctgtcgggggcgcacaccatcggcaggtcgcagtgccagttcttccgcagccggatctacaccgagagcaacatcaacgccagcttcgccgcgctgcggcagaagacgtgcccgcgctccggcggcgacgccacgctcgcgccgttcgacgtgcagacgcccgacggcttcgacaacgcctactaccagaacctggtggcgcagaagggcctgctgcactcggaccaggagctcttcaatggcgggtcgcaggacgcgctggtcaggcagtacagcaccaacgccaaccagttctccgcggacttcgtctccgccatgatcaagatgggcaacctcatgccgtcgtcagggacgcccacggaagtcaggctcaactgcaggaagacgaactaaaaaccatgcatggtcgtcatggtctgcaggtttattacagtacatgaaaggataatgccaaatgtgtactagtgcacacttgtccgtccgctcaagttctccggccgggtgagacattatacatgtacaatactgtatgccaggtcacacaaggttacatataattaatacaaaaggctggcaaatatatttc

SEQ ID NO: 14259 - DNA, 1988 bp, Sorghum bicolor
  unsure (1)..(1988): unsure at all n locations
  Clone ID: SORBI-28MAY03-CLUS6146_1
tcccactcccctccccgcccccccgcaccgttcgcttcctttcgccacccccgcaccccttcgtctcggtctccgcatcgccgctttgcgctccccggtgacccaggacccagccggagaagccgccgtggtgacgaggagtacgacgtgatcgtcctgggacacgggggctcaaggagtgcatcctcagcggcctcctctccgtcgacggcctcaaggttctacacatggatagaaatgactactacggaggagattccacctccctaaacctgaaccagctctggaagaggtttagaggggaagacaagccaccggcacatctaggtgcaagcagagattacaatgtagacatggttccaaagtttatgatggcaaacggtactttggtccgtactctcattcacactgatgtgacaaaatatttgtcattcaaagctgttgatggaagctatgtcttcagcaaagggaagattcacaaggttcctgccaccgacatggaggctctaaagggcctattcatggagcgctgtgcgaggcgctgcgccaggtacgtccttgtttacgtccaagatgaccatgaagctgatcaagggacacatctaactattgtgacacacaaagattacaactagagaattgatctcgaaacatggacagagtgatgacactgacatgcacttgctcttcatagagatgatcgatatcttgatgaaccggcactcgatacagtgaaaagaatgaaactatatgcagagtctcttgcacgcttctcaggagcgttttcaaggagccatccactatatttatccattatatgggctcgggtttgcgcccgcctgcgtgttctcgtctaagtgctgtttatggtggtacatatatgttaaataaaccagagtgcaaggttgaattcgatatggagagggaaagtgtgtggtgttacttcagaaggtgaaacggctaaatgcaaaaaagttgtctgtgatccttcttacttgcctagcaaggtaaggaagattggaaaagttgcacgtgcaatcgctatcatgagccacccaattccaaacacaaatgagtcccactcgattcagattattttgccacagaagcaacttgggcgcaagtcagacatgtatgtgttctgttgctcatatacacataatgttgctccaaaagggaagttcattgcatttgtgtctgcggaagctgagaccaataatccgcagtccgaactaaagcctggaattgatctacttggtcaagtagatgaactgttttttgatatgtatgacagatacgaacctgtcaatgaaccatctcttgataattgctttgtttcaacgagttatgatgctactacacactttgagacaactgtgacagatgttcttagtatgtacacagcgattactggaaagaccgttgatctcagtgtcgacctgagcgctgccagcgctgctgaagaatactagctagagattatccttattaaacaatgtatttcctcaagatatcatactttaaagaacggtgtaagacaggccctgcctggtggcttgccaggttaccacagtactgtgctgcaggtgcagccgattaaacggacagaaacagcatatcaccgtatatcatttatgtggtgtttaaacgggctgaagaccgtctctgtgaacagtggatgctgatagatgatggtggttcctatgttccttacgtgattgatcggatggttaactttaaacagtgttcatgtttgctagaaccagctcgttcttgtcactgatgtatcgtgatcacttctcagatatgcatcagcatttccgtttcttgctcgctgctaaatgcctcggtagttgttaatgggagaggggagacccagagcaccctagttccgcttcatgagttcaagatgattttgggacgacttgtatcgcaaagatgttgtgggtcttttctaaaaataaaataaaataaaataaaggccnaag

SEQ ID NO: 14260 - DNA, 740 bp, Sorghum bicolor
  Clone ID: SORBI-28MAY03-CLUS981_1
gccggccgggctgcggagcgcagaagcgagagagggagccggagcagccgcagtcccaccgacccccgccgatcccgccgccggtcgccctcatctcctcgccgctgcctctcgtttctcttttcaataatcaagatgagccgtggtggtagcgccggcggtggtcaaagttctctgggatacctctttggaagcggtgagccccccaaaccagcagtggcaccaccagctgcatgtgctccacctgctgagaaaccatcggctgcaaagcctgatgccaccaaacaggttgctgctggggtcaccagccaaaccaataactaccacagggctgatggccagaacaccgggaacttccttacggatcgtccttcgacgaaggtccacgctgctcctggcggtggctcttccctgggctacctgtttggtggcaattgatgcccacgtcggagctcaccaagttatcctcccctgccccgctgcatgttatgccatgtctgaatcatgaacaactggtgttgtcgtttcatgtgtgtgtgtgcccccgtgcaatgctttgtgcgcatggttgatttctctgtggcaaacctcccgacccgcatggggccgtaatctgtctctaaatttcagggcaaatcgtgtgcctgaaccctcatcataagtcgtcgttgtaccaagcttgtttcgtttacacctctgtgatggtatggcttggttgctgcccactggatctatttgtc

SEQ ID NO: 14261 - DNA, 1589 bp, Sorghum bicolor
  Clone ID: SORBI-28MAY03-CLUS10043_1
gacgatcgtcaccacgcaccattacgcactagctatctcacctgctgcctgcctgcctgccttctctctgctcaatctcttagccatccatccatccatcatgcgccatatcctccaccaccatgcattatactatgtgctctatgctagcccaactacccaagtggacctcatataaaggggaggccagctgagcccagggaatcaagcaagctatagcaagctgtttccccctgttgtttcttcttcttcttcctcagctccttcttcctctcgatcgatcgatcgagcatccaagcttggtctttgtttctgtcgctggaggaggtgtagatagctagctagcaaccgaccgatcgatcgaccatgtcgtcgtccttgttgtgtaggcgcaggaaccacaagaaggacggcgatggcgagcatcagatcatcatcagcaccagcacgccggcggcgatgaggaagggcccgtggacggacgaggaggacgagcagctggtctgcggcgcaccggcaagagctgccgcctccggtgggtgaactacctccacccgggcctccggcgaggccgcatcaccgccgacgaggagcgacgcatcgtggagctccacgcgcagtggggaagcaggtggtcgcgcatcgccaggagcttgcccggacgcaccgacaacgagatcaagaacttctggaggacaaggaccaggaagaaggctctcgagcaagctgtttccccctgttgtttcttcttcttcttcctcagctccttcttcctctcgatcgatcgatcgagcatccaagcttggtctttgtttctgtcgctggaggaggtgtagatagctagctagcaaccgaccgatcgatcgaccatgtcgtcgtccttgttgtgtaggcgcaggaaccacaagaaggacggcgatggcgagccgtccacggccaccaccgcggcagggacaaccaagcagcagcaacagcaacagcagccgttgccgcaggagtactacgacggttgctccaccatggaccagctgtggaacgagatcgcggcagccgacgctgcggcgatgagctacgtcgtcgacgcctgctggaacggagctggtcattattactatggcgctgcggccgctgagccgccgccggcgtcgccgccgtgggagtactgcggcccagacttttcgctctggaggatcgacgaccaagagtactacaagaagatgctcgactcctcctgatatccgattcatggcgtatccatcaatcatctacacgcgcttgtgtgctctgtgaatttccaagcgaggaacgaattacttaacggtagggatggtagattatcatctatcgtcttagactaattaattagtaagagcttatgaatctatgatgagagcgaagtagatcatgcatggtggtgagatgagagcgctttgtattaatggtggttaaactagtgtgatcgactgatgaatataatatatatgtagtttgcatttgtcttaatcgattgatcgatctctgatcgacggtacttgtatattatgtaacctagctttacttattggttatattactacttggggtggctt

SEQ ID NO: 14262 - DNA, 476 bp, Sorghum bicolor
  unsure (1)..(476): unsure at all n locations
  Clone ID: LIB3478-009-P1-K1-E6
gttgtttcttcttcttcttcttcttcttcttcttcttcttcttcttcttcctcagctccttcttcctctcgatcgaccgatcgagcatccaagcttggtctttgtttctgtcgctggaggaggtgtagctagatagctagctagctagcaaccgaccgatcgaccatgtcgtcgtccttgttgtgtaggcgcaggaaccacaagaaggacggcgatggcgagcatcagatcatcatcagcaccagcacgccggcggcgatgaggaagggcccgtggacggacgaggaggacgagcagctggtacggttcgtgcgcctcttcggcgaacgccgatgggatttcttagcaaaggtgtcaggtttgcgcggtggcgggtgcgtcgatcgatcttnctncatccatgcctgccctgccatctgcaattctgcatgcatgcgtgcatgagattgaagaggatcggtcgacacagtgagatc

SEQ ID NO: 14263 - DNA, 2179 bp, Sorghum bicolor
  Clone ID: SORBI-28MAY03-CLUS11023_1
gcccgggccgccccccccccccccccccccggcgccgactctaccgccgctcccggccaagcttccggtccacgaatcaacggcgcctccgcgtcgtctcctccccggaggtaatcttgcgccgattcgcgcgctccgcgaccggtggctccgccgggtcccgtgttcttgctgggcggggggtcaggtcaacctggcctctgcttgattggattcgagcggtcggcgcctccacctcgggatctttcctgccggtttcgtcggccgctggtcaactcggccggttggtctccgggggcctggctcttcactttcgtgcagccaccgtcgctttagttcggtataatagagccgcaaccgcaacctctcttttacttgttggattggatccaccggtgtctgtctcctgccaggtcacggcctaattcggggaatttggtttggtacatctctcgagtcaaatcctgcccaagattttagctatctccggtcaaaaagctttaccgattcttggattggttttcttgggggcaagaagccggttcttgtttcgtctctggtgctccagcatgttctgtagcacacaggtcctccatctctagaggagttcgtctgttcttggtttgggggctcccggaagctttccctgaaagctgcttttggcagctgaggcgatggcgtcgagcaccagcgcgatgcccgaggcgaaggagaagctgaagaggtccggcagcttgggaagcaacgatacgtatgtgcgtgcagacaagattgatcttacgagcctcgacatccagctggagaagcagctcaccaagacctggggcaaagccaatctcaaatcccaggggccaaaggaggagtgggagatcgaccttgcgaagctggagatccgctatgtgattgctcaggggacgtatggcacagtttaccggggcacctatgatggacaggacgtcgcagtgaagcttttggactggggagaagatggttttgccacggaagctgaaactgctgctttacgaacatcattcaagacggaggttgctgtttggcataagctcagccaccctaatgttacaaagtttgtgggtgcatctatggggaccacagaccttaagattccagcaaacaattccaatggtggtgcacgtacaaattttcctgcaagagcatgttgtgtcgtggtagagtatctcgctggaggaactttgaagcaatatttgataaagaacagccgacggaagcttgcttacaaagtcgtggttcagcttgcattggatttggctagaggattgagctatctgcactccagaaagattgtacatcgggatgtgaaaagcgaaaacatgctacttactccacaaagaaaccttaagattgctgattttggtgttgctcgtgttgaggctcagaatccaaaggacatgactggtgcaacaggcacacttggttatatggctccagaggttcttgatggtaagccatacaacaggaagtgtgatgtttacagttttggcatttgtttatgggaaatctattgttgtgacatgccttacccagacctaagttttgctgatgtctcatctgccgttgttcaccagaatttgcgcccagacattcctcgctgctgcccaagtgcatttgcgaatgttatgcggaaatgctgggatgcaaaccctgataaacgccctgatatggatgaagtggtgcagcttttagaggctctggacacgagcaaaggcggtggcatgataccagatggccagtcatcaggatgcttatgcttcacaaaggctcggggtccatagattcttttcacggtattctcttccctcggcaacattttcctcatgtaaatgactaggccagggcatgcttctcattgcgcgacctgtgcagtcggcgcttacagttctccctacttgccaccattgtgtgtcaacagtagctctcatacgatttttgctgtccactgtcgacaatcttttttataccactatggtgctgtaattgtgattctaaagagatttggtatacgagttacactcttgaaactgctacctctcctatgcccattttggtgccattgatcagtataaatctttaccctgtgattattatttccatttgtgctaagaattgagtacaagaatggactgaaataaatttgtgttta

SEQ ID NO: 14264 - DNA, 925 bp, Sorghum bicolor
  Clone ID: SORBI-28MAY03-CLUS6741_1
gcacgaggatgaagcgcctgctagaaattagggtttacgagcacgcccccggtataaaataggcgaggccgcgagccgcttggcgacgctcgcagcgccggccgggcccgcagccgccatcccaaccccggaacagagcaacgcgacgccgcggcacctcatctccggcgaagggaaatggcaaccgttcctggggatctgatctggcaggttgtgaggaagaacaactccttccttgtgaagcagtttggcaacggcaatgctaaggtgcagttcaccaaggagcccaacaacctctacaacgtccactcctacaaacactctggcttggcgaacaagaagactgtgactatccagccagctgctggaaaggactcggctgtggtcctctcaactaccaagaccaagaagcagaacacacctgctaagctcagtcacaagtctgtgatgcgcaaggagttccgcaagatggctaaggccgtgaaaaatcaggttagcgacaactactacaggcctgatctgaccaagccggctcttgctaggctgagctcagtgtaccgcagcctccaggttgccaagtctggtgtcaagaagaagaacaggcagcccaagcactaagcttgttctgtcaaggggctgttggtgctcatagtcccagcttatgtttatctatgttccaacagttttgagacttgaagtgagacttgctagaactagaacaaaccatgttaagatgctgccgtgtgtcatttcataacaaaaaattgcttggctcttgattactgctttgttgccgtgtcattgcatgtcaaaaattgcttggcacttgattgctgctttgtttgcaaacttttgctggttgtgattagcctccctgttattggattctgtttcgttccttaaaaaaaaaaaaaaaggccctaag

SEQ ID NO: 14265 - DNA, 259 bp, Sorghum bicolor
  unsure (1)..(259): unsure at all n locations
  Clone ID: LIB5050-003-R1-XP1-A7
ccgggagataaagcctagcggaagagggagccgccatcccaacccncggaacagagcaacgcgacgccgcggcacctcatctccgttcatattgattgtttaggcgaagggaaatggcaaccgttcctggggatctgatctggcaggttgtgaggaagaacaactccttccttgtgaagcagtttggcaacggcaatgctaaggtgcagttcaccnaaggagcccaaacaaacctctacaacgtcccacttcctacaaa

SEQ ID NO: 14266 - DNA, 1637 bp, Sorghum bicolor
  Clone ID: SORBI-28MAY03-CLUS15691_1
gcacgaggagttgcagttattggtggtggtctgatgggctctggaattgctacatcacttcttgttagcaacatttctgtgctcctcgaggaagtaaaccctcagtttctgcaaaggggagagaaaatgatagcaggcaatcttgagggcctggtcaaaagaggttcgcttacaaaggataggatgcacaaggccatgtcgcttctcaagggtgctttggattattcagatttcaaggatgttgatatggttattgaggctgttatcgagaagattcctttgaagcaatcaatattttctgacattgagaaaatctgtccaaaacattgcatacttgcgacaaacacatccaccattgatttgaatgttgttggcgagaagacaaattctcaagatagaattataggggctcactttttcagccctgctcatattatgcctttgcttgaaattgtccggacggagaagacatcaccacaagctatccttgatctcatcaccgttgggaagataataaagaaagtcccagttgtggtcggcaactgcacaggatttgcagtcaaccgtacattttttccttacacacagggttctcatcttctagttagtcttggtattgatgttttcagaattgatcgagtaataagtagcttcggcatgccaatgggaccttttcaactccaagatgtggctgggtatggagtggccttggcagtaaaaggtatctacgctgatgcctttggagaaagaaatttgaactctaaccttgtggacttgatggtaaaggatggacgacagggaaaggtgaatggcaaaggttactacatttatgagaagggcgggaagccaaagccagaccctagtgttaagcatgtgcttgaggagtaccaaaagcaggcaaacacaatgcctggtggaaagcctgttactttaacggatcaagatattttggagatgattttcttcccagttgtgaatgaggcatgcagggttatggatgaaaatgttgtaattcgagcttctgatcttgatattgcttctgttcttggaatgggctttcccaaatacaggggtggtcttgtcttctgggctgacactgttggagcaccttacatacattcgaagctaagcaagtgggctgaaatttatggtcccttcttcaaaccatcatcgtatttggaacaacgagctaaaagtggtgtaccattgagtgcaaaaggagcatcacagcaaggttcagcgaggtcacgcatgtgaggtgcttcattgggcagaagaagaatacagaatactggtgggatgagccgtcgacggctgcttcgcagatcaaaacacctccgtgagcacaaaaggaggcacagaaacgatgaaaaaaataactggatttgcatagctgtaacagttttggtgccttgaactgttaactttggcagagtttctgtgaacagagtggcatgccgcatgcattaattgtacctgatcactctgtatgtcgctgtcatgtgtacaatgttcaatagtacgcacgtaataaagaatggaaatatatgccgctatcagtgcgcaaaaaaaaaaaaaaaaaaaaaaaaaaaaaaaaaaaaaaaaaaaaaaaaaaaaaaaaaaaaaaaaaaaaaaac

SEQ ID NO: 14267 - DNA, 2016 bp, Sorghum bicolor
  Clone ID: SORBI-28MAY03-CLUS14480_1
accctctccctgcccgtgccgggtccttgcgtttccaacttcgatccaacccaagcaccggagaccgcaccgcgccgcgcgagcacgtcgggcgccggtgcggcaggcgagatccgagagcactcctcccccgcgcccccgcacccgcatggccgccgctggccgcagatagagaggcgcaggcgggggcgtgcagatccagatccggtgggcggcgaggacgatatcgcccccccaccaccatggcgggcgccgtgtcggcgctcttcctgctggacatcaagggccgcgtcctcgtctggcgcgactaccgcggcgatgtctccgcgctccaggccgagcgcttcttcaccaagctcctcgacaaggagggcgactcggaagtgcactcgcctgtggtctacgatgacgctggcgtcacttacatgttcatccagcacaacaatgtcttcctcctcaccgccgctcgccagaactgcaacgccgccagcatcctcctcttcctccaccgtgtcgtagatgtgtttaagcactacttcgaggagctggaggaggagtcgctcagagataacttcgtcgtcgtgtatgagttgcttgatgagatgatggattttgggtacccacaatacacggaggcgaagatcttgagtgagttcatcaagacagatgcatacaggatggaggtcacgcagcgtccacccatggccgtgacaaatgctgtgtcatggagaagcgaggggatccggtacaagaagaatgaagtcttcttggatgtagtggagagtgttaacattctagttaacagcaatgggcagattgtgagatcagatgtggttggtgcactgaagatgcgaacatatttgagtggaatgccggagtgcaaacttggcttgaatgatagggttcttttggaggctcaaggcagagcaactaaaggaaaagcgatagaccttgatgatatcaaatttcatcagtgtgtacgtttggctagattcgagaatgacagaactatatcgttcatacctcctgatggatcttttgatctaatgacatacaggctttccactcaggtaaaacctcttatctgggtcgaagcacagattgagaaacattctagaagccgtatagaactcatggtgaaggcaaggagtcagttcaaggaaagaagcacagcaacaaatgttgaaattgaagtacctgttccttcagatgccacaaacccaaatataagaacttcaatgggttctgctgcatatgctcctgagagagatgcaatggtctggaaagtaaaatcattccctggtggcaaggaatacatgtgcagagcagaatttagtcttcctagcataacagcggaagaaggggcccctgaaaagaaggcgccgatacgagtgaaatttgagataccatatttcaccgtatcaggtattcaggtccgttatctgaagataattgaaaagagtggttaccaggcactcccctgggttagatatatcacaatggctggcgaatatgagctgagacttatatgagttttctcctttctggctgctggaagacatttatgaagctgcaagatacatatttgctctgagacacagcaaccagttggcatttgtatgctagcctggaagtcttctgccgaccatacaaggttttcccccttggggcttgttcatcttgttaggctcaccttaccttggttattgtaagttacccatcaagtatagttttggaaaaaagagaggataattttaattttcagttcacttgtattattattgatttatttttgtgggtaccaaacttggatttgtttcattctgtatttacacgggcagatttgagttcaacaaaacactgccataactgggtgatgattctgaactgcaggttgaaacgattttgcccttctttactgtaaatgtcgttgtcatgtatccaggcaaaagaaagaaaacctaccgaaacgggcggccccgtctttagtttcaactatttttgtttccgagaggt

SEQ ID NO: 14268 - DNA, 1674 bp, Sorghum bicolor
  Clone ID: SORBI-28MAY03-CLUS20018_1
gccggccgcctctggactccaaggcatcaaaccgagctcgagctcttaaacaatcgtctaagatatatagcatcattttcgtttgattattaaccagctctcgaagccatgggtacaaatgatagagcggccatttctctagtattcttattccttgtgtgcatggctagccgctcatcctgcagcttgggtagctctgaagtgcagaggcgctcagtagtcccatcgatctacgtgtttggtgattcgttagtcgatgtcggaaataacaatttcctgccgccgcctgcgccccgtgcgctatctccgtacggcatcgacagcagcttgacagggcggttcacgaacggctacaaccttgccgatttagtcgcgcgacgtctggggttcacgaagagtccacctgcttacctctcgttgacaccatcatcaaaacttgacctactaacgtgccgagttggtgccagttacgcatctggcggatccggcattctcaacaccacgggaaatgggaccctcacaatgcaaaaacagatcatgttgttctccaaaactaaagcaaggatgtggtgtggccggaagctcaactatatgatatcaaagtcgttctttcttattagcgctggaggcaatgacttttctgccttcagtgaaatgggcatgagtccacaagatgccccagcctacatcagtagcatggtctcaacctatgtcgagcatatcaacgctttgtacacgttgggggcgcggagattggggatcctagacgtgccagcaatcggttgtactccaggttcgagagtccccatggccaacggcggatgcaacgacgccgccaattccatggcacagaacttcaacaaactcctaagggttgaggtggcaaaagccgttgaaacctccatgcccgacatgaaatactccatagcaagcacctacaattttctcactgacttgatggacaatcatctcgtggctggcatccgggtgatcgagagggcatgctgcggatcaggaaaattgaacgcggcagtaatgtgcagcaggccaaacacgacttattgtttggatcgcaatgactacatgttctgggacatgttgcatcctacacaggctacatatgaacgaggggtggtcgcaatcttctacggcccgcaggagtatgcggatcccatcaactttgcaggattggtcggcatcgccacagagataaatactactatggcccccggcgtctatgccgccatatgataaactactatctcggccttgcaactgcaacatatcactaccagaatactatcggcttttggcaggccttattatttgagaagaaagtaatccagtcgaaataatgtgtagtgtatgttgtgtgtatctatcatcagtatttgacaagtaattcagtcgaaataatgtaatgtacgttgtgtgtatcatcagtatgatggcagtctctctatgtatatgtgggaaaataaggacaacgccaacaagtgtcagttagctgcatgcatgagaaggagttggtgttagaggcttgccgcaagctgcagaatgcgggaatgtgcttcttcgtgtcttatggacagtcttgtacttccagaattgagttttcagtcagttttgtagtcatcgcgtggagttattataataaaggggtcggataacggg

SEQ ID NO: 14269 - DNA, 793 bp, Sorghum bicolor
  Clone ID: SORBI-28MAY03-CLUS56095_1
gcacgaggtagcgatcgatccaagtgccaaccagtagccagcagccatgttcaggtgccccagcaatggcaatggcaatggctatggctacggccaacagcactccaccacgaactaccaccgcacccactccggcgagcacgtcaccaaggtcgcccagaggcccggcgtcgtcctgcagcaccacgttgtccacaaggagtcgttcaaggaggtcgacggcggcgcggccccagccaacaaccgccgctgcttcgacaactatcccatgaaggctaacaacgcgatggcagtgaaccaccatggcggaggctcccaccaccgctacgaggcctacgaggaaacctacgaagagtccagctgcgaggaggagacgtacgcatacggcgccggacgccaccacgggcacggcggcggcggccgccgcttcgagtacgagacccacgaggagacctacgaggaagaggaagaggaggccgtcgtgggcggcggcggctgcgcccagctcaggcgcccctactgccgcccatgagcaggcccccagctggatcgtggtgtgaatgtgtggatgccatgccagagtccggattggtagacgtcatgttggtttcatatgggtacaaataataacctgcaggtgacaaacctagctaatctcgaacgtaaataaattgtactcccattcccaatcccattcatatatcgatgctctgcatccaccgtatgtatgtatgtatgtactcctgtatggctgtgacttcagtaaaacccaaaaaaaatcgtgagatcgcgt

SEQ ID NO: 14270 - DNA, 1470 bp, Sorghum bicolor
  Clone ID: SORBI-28MAY03-CLUS4856_1
gcacgagggcgagctcttactcttggaatggcgcgtccagctgctgaagcacttattgccaaacttctgaaggaggcatctgaagaatgtttaataagctctagtcagatgatgaaaggattctatcgggttgctgagagtcttgatgatctcattcttgatataccgtctgcaaagtctgaattccagctgttggtctcaaaagccatttctgagggatggctagattcttcatatgtgaagtcaggtgtcaacggaagcgttgaagatgatgaacatgagaagctggcaaggtacaagagggaggctgtatctataatacacgaatactttctatctgatgatacaacagaggttattcgtagtgtcaaagagctcggttatccagaatataatccaatcttcatcaagaagctcataacaactgctatggaccgcaagaacagggagaaagagatggcatcagttcttctatcctcattaagcatggagctgttctcgtctgaagacatcgccaagggattcataatgctccttgaatctgcagaagacaccgcacttgatatattggatgcctcagatgagttgggactgttcctagccagggctgtgattgatgatgttcttgcacctctaaacttggatgagattagcagcaagcttccaccaaactgcagcggggctgaaacattgaacatggcacgctcccttgtgtctgcccggcatgctggtgagaggcttctgaggtgctggggtggtggaaccggatgggctgtggaggatgcaaaggacaagataacaaagctcctggaagagtatgagagtggaggtgatttaggagaagcatgcaactgtatccgtgaactgggtatgtctttcttcaaccatgaagttgtcaagaaggcgctcgtgatggcaatggagaagaagaatgagaggaccctgagcctgctgcaggagtgctttggtgaagggatcataaccatcaaccagatgaccaaggggttctcaagggtcagggatggactcgacgacctggctctggacattcctgatgccagggagaagttcatttcctatgtggagcacgcaaagaagagtggatggctcctgcccgggtttggtgttgcatcttcagtttgaacagctggtcagagaagtacgaagctgaagcagaaggcaggcgtaggccgtaaaatgtggctcagcaaacccagtttggctgtgttttcatcgtttgtcgttgctcttgcgcataggtagcggagcgagcccctcctggttgcggtggtggtggcttgtgtgtctagatcttgcatctgatgacatgctcatgctgttcttgtttcatttcattttaactccccatagaccctttttacatcaagcgaaaacagagaagagaaaaaaaaagaccatgttgtaaaagatctggcgccatgctccgcctgcattatggctgttctttct

SEQ ID NO: 14271 - DNA, 1901 bp, Sorghum bicolor
  Clone ID: SORBI-28MAY03-CLUS56158_1
cgatcgcgctgctcacccggccgataccctcgtgtccggcttctgtccggggcgcgacccgcgagcagccacacaaaccgaccaggtccgcgcccggccccaccccgaggcccggcccgtgacgacggccgactacatgatgacgggagccgccgccctgctcgccgcagccctgcccgaccacgaaccccacaccctcgggcatgccgcaaacacctccgggccccccgccgtccggccggccgactgctaggcacgggtgacgaccctccccaagggctagagcgaggctcagtgcacgccggaccagacgccggcggagtgccacaggtgcctcgagaggatgctggaggctaccctggaggcgttcaacggcagcatcggaggcagggtgcttggggttgattgcacctaccggtatgagaccgcgcccttctacaacggacaggccatggtgcggctggcgacaaccaagctctagtagagcgccggcgccagcgccggctctgcagccgacggccgccggagaagggggacgaaagcaccgtgtgtcttgggtggttcttgcagttgtgctaccaactctagccgccatgaaccttgttgcctgcctctatttgcggcggcgccggcgactactaattggacaggccaaacaccaaaagccgcccatgtattacactgaagcagaggacaccgaaatggtggactccatgatgatggacgtctccaccctacgagccgctactggggatttcaatgagagcaacaagctcggcgaaggcggctttggtgccgtgtacaagggtgtcctcccgcacggcgaggaaatagcggtgaagcgtctgtctagcagctcatcgcagggagtggaggagctaaagaacgagctcgctctagtggccaagctgaagcataggaacctcgtcaggctcatcggcgtctgcctagagcagcaagagcggttgctcgtgtacgagttcgtccccaaccggagtctcgatctgatactcttcggcactgataatcgtgagcagcagcttagctgggagcagaggtacaagatcataaacggcatcgctcgaggcttgcagtacctccatgaggactcccagctcaaggtggtgcaccgtgatctcaaggccagcaacatcctgctagatgagagcatgaaccccaagatctcagacttcggcatggccaggatctttggccaagaacagacgcaggccgtcaccagccgcgtcgtcggcacctatgggtacatggcaccggaatacatgatgcgggggaactactccgtgaagtcggacgcgtttagcttcggtgtcatggtgctggaaatcgtaacgggtcggaagaacagtaacgaaggctgcaatctcttgaccacagtatggatgcactgggaggccagaaagatggcagagttggtcgaaccgagcatgggcaacagtttcccggagggcgatgtgctgaggtgcgtccacatcggcctgctgtgcgtccaggcagaccctgcggcccggccggtgatgtcgtctgtcgtgatgatgctcggcagcgatacggtcaccctccaggttccatccaagccgggattcttcgccaggaacaacagcgccaacacagccgcgtcgacagtgtgactgaatggtaacatatatgtaccgttaccctgttaccaaaatgtatgcatgatatcaactaataagccgcgtaagcttgattcaacatgaaattttgcatacgcttactataaaatgtgcaaacacatggttgatatgtgtccatgtataagtgatgaatgattgtagtgtgcgtgagactaactatggcctgagatgtgtgtgcaatatatgcctcttggcttgtgatgtacaggagttaagtgttggtac

SEQ ID NO: 14272 - DNA, 3052 bp, Sorghum bicolor
  Clone ID: SORBI-28MAY03-CLUS5626_1
gcacgaggcccgatcgaaccataaaagcacgtggggggaaaataaataaaaatacgcgcgacgaacagagctgaacacaaacacccgcatcgatccaaagccgagccacacctcggggacagcccacgagagcgagatccaacccaagtcccgacgcagcgggcgaggccgaccagatccacctcctcagccgtctcggatggcggcggcatcggcggcggtgcggatgctccccgacggcggcgctgacgacgaggagcggtggctcgccgagggcatcgccggcgtccagcaaaacgccttctacatgcaccgcgccctcgattccaacaacctcaaggacgcactcaagtactcggcgcagatgctctccgaactgcgcacctcgcgactatcgccgcacaagtactacgagctttacatgagggcgtttgatgagatgaagaagctggagatgttcttcagggaggagactcgccggggcagctgctctgtggttgatctgtatgagcttgtgcagcatgctgggaatgtcttaccgagactctatctcctctgcacagtgggatctgtgtacatcaaatcgaaagaggctcctggcacgagggttcttaaagatcttgttgaaatgtgccgaggcattcaacatcctctccgtggccttttcctgagaagttacctttctcaaataagcagagacaaattgcctgatattggttctgagtatgaaggggatgcggaaagtattaacgacgcagttgaatttgttcttcagaatttcatagaaatgaacaaactctgggtcaggatgcagcatcaggggcctgtccgagaaaaggaaaagcgcgggaaggaaaggaatgaactgcgtgatctggtaggcaaaaaccttcatgttctaagccagattgagggcgttgaccttgatatgtacaaagaaactgttcttccaaggatattagagcaggtggttaattgtaaagatgaccttgcacagttctacctgatggactgcataatccaagtctttccagacgaataccatttacaaacactggaaacattattgagtgcatttccccagcttcagccaagtgttgatatcaaaacagtactctctcaacttatggacagattgtctaactatgctgcctcaagtcctgaagtgttgccagagttcttgcaagttgaagcttttgctaagttcagtagtgctattggaaaggtgatagaagcccaacctgacgcgccaggtgttggagccgtaactctctatgtgtcacttctgacttttactctccgtgtacatcctgatcggcttgattatgttgaccaagtgctgggtgcatgtgtcaagaaactttcaggcaaagcaaaacttgaagatagcagggcagcacggcgaatcgttgcacttcttagtgctcccctgggaaaaatatagcaatattgttactgcattagaactttcaaactatcctcgggttatggattatcttgataatgctacaaccaaagtgatggctgtggtaataattcaaagcataatgaaaaacacgacctgcatatctacttctgacaagattgagtcactattcgatttaattaaggggctgataaaggatatggatggggctcaagatgatgagcttgatgaagaagacttcaaggaggaacagaactctgtagcgcgtctaattcacatgttgcacaatgatgatcctgaagagatgctgaagatcttatgtactgtacagaagcatatacttcagggaggccccaagcgtttaactttcactgtgccttcgttagtattctctgctcttaagctggtcaggcgattacaaggtcaagatggagatgtcactggggaggatgttcctgcaactccaaagaaaatattccagatattgcatcagactattgaagcactttcttgtgttccttccccagagttagctctgagactatatttgcagtgtgcagaggctgccaatgactgtgatttggaaccagttgcttatgagttctttactcaagcgttcatcttatatgaagaagaaattgcggattcaaaggctcagatcactgcaattcacctgataattgggacccttcagcggatgaatatatttggggtggaaaatagagacaccctcactcacaagacaacagggtactcagcaaaacttctcaagaagcctgatcaatgccgagcagtctatgcgtgttcacatcttttctggactgatgaccaagatgggataatggatggtgaaagggttctcctttgtttgaagcgtgccttgagaatcgcaaatgctgctcaacagatggctagcgctacaaggggaagcagtggatccgtaaccctatttattgaaattttgaacaagtacttgtacttctttgagaaaggcattccacagatcacaaatactgtgattcaagatttgattgaattgattagaacagagaagcaaagtgataactctgtagctgatccatctacagaggcattcttttctagcactttgcggtacattgaatttcagaagcagaaaggtggaagcataggcgaaaaatatgaacaaataaagacaagttcatgagtcagaacaggcatggcataatgactggtttcgattttgttaagagaattgggtcgtttgtttggcatggttcagtgaaatagaaaccatcagttttagctgcctccaactaaaagatgtttatatgagctgttattctcaaatctcacggtctgagcgggtctgctcgcccatcggcaatactttcagatttagtcaggtggcaataagctgtcctttggggagcacaggtctgtacaggattacttgtgttcgtgatcagttctactgctacctgagtttcattgttgtatatttccgccccttatgcaaagcttatggattttagatttctgtaacatttggagtacatggcctccatttctgagttctgactggacattgatgattgtttcatagtggtcagtgaaggacttgaacattatggctgccgttcgttg

SEQ ID NO: 14273 - DNA, 1831 bp, Sorghum bicolor
  Clone ID: SORBI-28MAY03-CLUS6038_1
gcacgagggttgccccggatggggtttcttcccacctgccgaggagtacatgattcatgctgaaaggtcaaatgagagtttagtggaagcttctagagatctgcgtgcgcgtgaagagatggctccgggtgggagtgtgcttcatctacaataattcttcatggcggcttaattactgtggagtcaagaagatgctgttgagggtgatgcagaggatgacggagtagaagaagaaagtcaagacgaagctgttgaggttgaggctgagggttcagcaattggttgtttccgggtgtactttactccttagtttgatcgagtataaaacacttgtaatcagtggggaattaaatcgcgggaatgatggtttatcatctatacctaggaaagaatatgacagtgtgtctcgagtcttggaaagacggtgaatgtgggaggaagccctcgagagaggaactgacagttatgacaaatttgacatggctttgcaccgtggttgactagaaattcagaagtgggttgcaaccggggtgcaaagtgagaccaagttgacgcgaagagcagagtttgagatgtcaaatggatattttgagataggcagagaagtgtcctctatatgctatgcagcgctgtggtttgtgaccgttgcagtcttctcttgcgggtgccggcgagccgtagctcttcgcacttcgactctgtgacctatgagagatcaatggttctttcctttgtttcttcatgcgatgaaagctggaagagtgtcttcaattgctaatagaaagcaaccgtattccggaagcagcattgatggcaagatcttatcttcctagcaaagtccctgagattgtagcattgtggaaaaaggatctccagaaggtaaacccaaaagcagcagagtcgctggctgatcctaatgagtacccaaacttatttgaagactggcagattgctctcaatgtagaagctgttgttgccccgaaaaggggtatctatccacctgccgaggagtacatgattcatgctgaaaggtcaaatgagagtttagtggaagcttttaaaaatatgcatgtacatgaagagatggtaccagatgataatgaagatactgttcatgaggttattgaggatggtggagtagaagagagtcaagaagatgctgttgagggtgatgcagaggatgacggagtagaagaagaaagtcaagacgaagctgttgaggttgaggctgagggttcaactgatggtgctgtccttgtgaatggaaacagtagtgaggaacagtggggtacgaaaaatgaagaaccatcagcataaaagctgtagttgagcaagttgctgactcctgagcaatagtggatcaatgggacggcaactttgcttcagtggtttagtttgtaaaggttgctgactgctatctagagtacatgcaagccatttttcttgagcggtattaagcatgggatgtgctctaggattggcttatccacatacggagttggaccgcaattaatcaacacttcatctttgtgccctatataggaaattttgtgctaccttttttacatgtagatcagatctttaggtctcgaagacattttatagcctatcatcagaggtactcttgtttcaccgagatgggatatgactggtgatcggatgagtgatattttacagggtacatagagtagtagcttgtcgaactgagaatgttttacctgtgatatgtacatcggacttggagctttgtatcattgtgttacaccttttcaatggtagcgattagcgaataataagtttagagcagatgctttcagtagcctgtttagtt

SEQ ID NO: 14274 - DNA, 1699 bp, Sorghum bicolor
  Clone ID: SORBI-28MAY03-CLUS2473_1
cgtccgatctggaattccacgaagctctcctagtcgaaagggtcagctaacaggtgcttgcgttcctcgaattgatgctattgattttaccatcaaacaggatgatggggcacagccaaacaacctcaaccgtgcggacattgtacttgccggcgtttcacgtacagggaagacaccattgtcgatatatctagcccaaaagggatacaaggtagcaaatgtcccaattgtgatgggagtgaatcttcccaaggccctttttgagctcagccagcacaaggtttttggacggacgatgaagccaggggttcttcaagcaattagaaagactagggccaaagctctaggttttgctgatgggcagagcaattatgctgaaatggatcatgtgaggcaggaactgctccatgcaaatcaaatttttgctcaaaatccaatgtggccagtcattgcggtcactgggaaagctatagaggaaacagctgctgtcgttgtgaggatttcccttgacaggaaacacaagtactccatgccacgcatatcaaaacggtactagcattgtgttctagcccttctattacaccttgtaatgtgtgcgatgttgataagctctgtgtcaagcaccatagcctttatgtttttttttgtgggttaggacagcttggaggtggcacagcacggtgaaagccacgctcggataactacctccctgttgcgtcattcgaggttgcgatgtcaacacctacctcgtctccatgattaacgacgtggctttttttcttgagccaagaaaggaagtttgaattgacagtaaacccggtggttcttcaagcaattagaaagaattgggccaaagctctaggttttgctgaggggtatcagagctattatccacaaatggaactcgggctacagttgaagccacatgcaaatcaaattttgttgcaaaatccggaattccacgaagctctcctcactggaaaggctaactaacagaggactactttcgacggattgatgctattgattttaccatcaaacaagatgatggggctctgccacagaacctcaaccgtgcagacattgtacttgctggtgtcccttgtacagcgcgcatgccgtggtcaacacctctagcgcaacagggatttaagttggcacacctcccggctgtgatgtgagtccaaatgccaaagacccgtttagcgcggcaccaacgaacgtatttgctctggccggattcgaataagtacaataatagtcttatagccaagcaaatgctcatctagaggagagaagagaggagacaagagaggagagtttgactcttatgcaagcaacacgctaggcaagcgagactaggaagtggtgggccgtcgaccgcccaaacattacgtgaatgtgagaaggattagaaaatagaaagtaggacatgggtaaaagtaagagaaaaaaaatccttatagcgaaataagagactactattgtaagtttggtttttacaacttagctctactacttgaattgctcttagtgccatagtgcatagagggtcccaaattatcttgcatcaccccttgtgattcgcatcattctctgttcattgaggttaggttcagcaaagatctgtatatgtaccactgttgaataaacggcatccgagcaaagacaattggctatcgctcttgagatatgtacc

SEQ ID NO: 14275 - DNA, 444 bp, Sorghum bicolor
  Clone ID: LIB3480-030-P1-K1-B11
gccgccgtgtggggctggaccgcgcggcgctctcctcggcctcggcgccgccggtgaccaagccgtcgcggcccgaggacgctgcggtggcggtggaggatggcgaggacgacgacgacgacgtgtgcgaggccgagagggacgatgcggccgggaaggccatctacatagtgtccgacgggaccgggtggaccgcggagcactcggtgaacgccgcgctcggacagttcgagaactgcatcgccgaccgtggctgcgctgtcaacactcacctcatccccttgatcgacagcatggatcaacttcttgacgtaataaagcaagcagcaaaggaaggggcactggttctatatacccttgctgatccttcaatggcagaggcagctaagaaggcctgtgatttcttgggtgttccatccactgatgttcttcggcctacagttg

SEQ ID NO: 14276 - DNA, 308 bp, Sorghum bicolor
  unsure (1)..(308): unsure at all n locations
  Clone ID: LIB3480-016-P1-K1-H8
tgggatcactggaaaagctatagaggaaacagctgctgtcattgtgaggatttaccatgacaggaaacagaagtgctgcatgccacgcatatcaaaacggtactagtattgtgttctatcccttctactacaccttgtattgtgtgcatgttttgataagctccgtgtcaagcaccacagccttttttttttatttttttgttggaccaccttcttggtggcgtttgtatcttaaagataacttgaagttttgcacagcagaaacaaatgtatattgcgtttatgaccaanntaaaaaaataaattta

SEQ ID NO: 14277 - DNA, 456 bp, Sorghum bicolor
  unsure (1)..(456): unsure at all n locations
  Clone ID: LIB3478-033-P1-K1-H8
gtaaacccggtggttcttcaagcaattagaaagactagggccaaagctctaggttttggtgatgggtatcagagccattatgccgaaatggaacatgtgaggcaggaactgctccatgcaaatcaaatttttgctcaaaacccaacgtggccagtcattgggatcactggaaaagctatagaggaaacagctgctgtcattgtgaggatttaccatgacaggaaacagaagtgctccatgccacgcatatcaaaacgggtggctccagtcctagtctacaattttatgtcagttggttaacactcatgccgagtattacaaggtctttgctacggagttntaagtctatatactccgcttcggtgaagtgatttcaaatgccgtaaacctattcaattcggcaatttttaaacgagtctatctggccagattagaataagtacaataatagtctta

SEQ ID NO: 14278 - DNA, 746 bp, Sorghum bicolor
  Clone ID: SORBI-28MAY03-CLUS7155_1
cccccaggcacgaggcacactagcagcagcagcagcagctcgagctagcttagctactacgtgtgtgcaatcagctcgatcgccatggctgcaagagcggcgctcatcctggctgtcagcctggtccttgctgcagtggcgagcgcgacctactgcccgccgccaccggccccaaagccgccgacgcccacgcccagcgggcaccactgccccagggactctctgaagctgggcgtgtgcgccaacgtgctgggcctggtgaaggccaagatcggctcgccgccgtaccagccgtgctgctcgctgctggatgggctcgtcgacctggaggccgccgtctgcctctgcaccgctatcaaggccaacatcctcggcatcaacctgaacctccccatcgacctcagcctcatcctcaacaactgtggcaagaactgccccaacgatttccactgcgcatagatgatcaattgatcgtcatccatcgctggccgcagttcatcaatcatcattccgtggcatgatatgatacgatgctttgcttaatttgtggttgagatcttcctgtcagttccagcttaattatttattttgattatttgtctctttatacgtgtgcatgtatatgccttgcctggggtgatcagttaattactgatcgctgttacaatgtattcttgatttgttctcatgagtcatgatctgtttgtaatggttcggtcaataaatgaagaagtagtttctttttg

SEQ ID NO: 14279 - DNA, 1946 bp, Sorghum bicolor
  Clone ID: SORBI-28MAY03-CLUS65_1
ggcagtggcacacctatataaacacacccgggactccacactcccccccgcatcgccgccccccccgtcccgacgaatcggaatacggaaaagctaaagacgatggatctcgccgacatcccgcagcagcagcggctcatggcgggcctggcgctggtggtagccaccgtcatcttcctcaagctcctcctgagcttccgctcgggcggcggcaagaagcggctgccgccgacgatcccgggggcgccggtggtgggcgggctggtgaagttcatgcgggggccgatcccgatgatccgggagcagtacgcggcgctggggagcgtgttcacggtgcccatcatcacccgcaggatcacgttcctcatcgggcccgaggtgtcggcgcacttcttcaagggcaacgaggccgagatgagccagcaggaggtgtacaggttcaacgtccccacttttggccctggcgtcgtctttgatgtggattactctgttaggcaggagcagttcaggttctttaccgaggcgttacgggctaataagcttcgtagctatgttgaccagatggttgctgaggctgaggagtacttctcaaagtggggagaaagtggcactgttgatttgaagtacgagttggagcacctcatcatactgacagctagccggtgcttgctgggaagggaggtgcgagaaaagctgttcgacgatgtttctgctctcttccatgaccttgacaatgggatgcagccaatcagtgtcctcttcccatacctcccaatccctgcacataagcgccgtgacaaggcacgggcacgtttggcagaaatctttgccaccatcatcaagtcccgcaaggcctctggacaatctgaggaagacatgctgcagtgcttcattgattccaagtacaagaatgggcgccccaccactgagggtgaggtaaccgggctacttatcgcagcactctttgctggacagcacaccagctcaatcacctcaacctggaccggcgcgtacatgcttcggttcaagcagtactttgcagaagctgtagaggagcagaaggatgtcatgaaacgtcatggtgacaagattgatcatgacatcctggcagagatggatgtcctctaccgctgcatcaaggaggcccttcgtctccacccgccgctaatcatgttgcttcgccaatcacacagtgacttcaccgtgacaacaaaggaaggcaaagagtatgacatccccaagggccacattgtcgcgacatcgccatcctttgccaacaggctgccccacatctacaagaaccctgactcatatgaccctgaccgctttggtcctggtagggaggaggacaaggctgcaggcgccttctcatacatctcctttggtggcggcaggcatgggtgcctcggtgagcccttcgcctacctgcagatcaaggcgatctggacgcatctactgaggaactttgagtttgagctggtgtcgccgttcccagagaacgactggaatgccatggtggttggcatcaagggtgaggtgatggttaattacaagaggcggaagcttgttgtggacaactaagattgtggctgcaatctcttagatgcttcttcttgttgattcgattgttttcgcatgtttgtcagcatttgttcggtgcaatttctgcagtacgcacggcagctttgtaggggtgtttctattgtttaggattctgtaatttgcttcactatgggtctgccatgatctgcaacttctgcctgttagctgcctagctaagcattcctcttcgtcaaatctgtaacttgtagcatctttaagtgtgtggctatattgttgaaatcctgatgtttatcattctcttagatggatgtaaacacaaaaactgaacaaataacctctctgtaatgaataaactcaggtgttcagtgtgaaaaaaaaaaaaa

SEQ ID NO: 14280 - DNA, 1746 bp, Sorghum bicolor
  Clone ID: SORBI-28MAY03-CLUS3782_1
gcacgaggcccctggttaagctgccgcggttccactagcaaggttagatgatttagtgaaggacaaaattgagtcgcagaaggaagaaagagccaaagagaaggaggagaaagatcttgtggctcagcagaacatgtacgcccaactgcttcctcttgctttgcccgctccgccaatgcctggcatgggcggccctccacctccgatgggtggaatgggcatgcctccaatgggtggaatgggtatgccgccaatgggccctggtccgctgcccagaattgggagttctatatgctagatccccccctgagttgtttatggagcacatgaagcttttctccacccgtcgtaatattcctaagcttattcgagcttgtgatgaacagcagcactggaaagaacttacctacctgtacatacagtatgatgaatttgacaatgctgccaccaccattatgaaccactctgcagatgcatgggatcatatgcagttcaaggatgtttgcgttaaagttgcaaatgttgagctatattacaaggcagttcacttctatttgcaagagcatcctgatctcattaatgatatgctaaatgtgcttgcacttcggttagatcataccagagttgtagacataatgcgcaaggctggccaattgcatcttgtgaaaccatatatggttgcagttcagagtaacaatgtctctgctgtgaatgaagccttgaatgagctttacgttgaagaggaggactatgagagactccgggaatcagttgatatgcacgacaactttgaccagataggtcttgcccagaagcttgagaagcatgaattgcttgaaatgaggaggattgctgcctacatttacaagaaggctggcaggtggaagcaatccattgctctatcaaagaaagacaacatgtacaaggattgcatggagacatgctcacaatctggcgaccgtgaactgtcagaggacttgcttgtctatttcattgagcagggtaagaaagaatgctttgcatcctgcctcttcatttgctacgacttgatccggccagatgtcgctcttgagcttgcatggatgaacaacatgttggactttgccttcccatacctgttgcagttcatccgtgagtacactagcaaggtggatgatttagtgaaggacaaaattgagtcgcagaaggaagaaagagccaaagagaaggaggagaaagatcttgtggctcagcagaacatgtatgcccaactgcttcctcttgctttgcctgctccgccaatgcctggcatgggtggtccacctccgatgggtgggatgggcatgcctccaatgggtggaatgggtatgccgccgatgggccctggtccgatgccagcattcgggatgccaccaatgggaagctactgagagttgttttgcagagagcttagatgatctgaattgttccaatgtaagcaaaagtggaacttctttggaattgtatgtagatgattacagtttgcaatcaatattctttatggcaccaggaaatttttggcgagtgaaatcttagccagagtttgagatttgtaacctgttataccgtacgatgggataggatgaggatggttgagcaagaggtaccatttgtatagtgtgataatctttgtagacacattttggttgtattaatacttgaaggacaaacaaatgtatgtcacgacccctgttgatttctattgttaggccttgtttagttcacccc

SEQ ID NO: 14281 - DNA, 1246 bp, Sorghum bicolor
  Clone ID: SORBI-28MAY03-CLUS3835_1
gcacgagggtgctctggtcccgtactacttggaagaagaggctaactggagccttgactttgtaaatatccgaaaaacagtggcagaggcacggtcgaagggaatcactgttcgagcaatggtgattataaatccaggaaatcccactggccaatgccttagtgaaccgaatataaaggaagttctgcaattttgctaccatgaaaacttagttctgcttgcagatgaagtgtatcagcagaacgtctttcaagatgagcgcccatttataagctcaagaaaggttatgttcgacatgggcccgccactaagcagggagcttcagcttgtttctttccacactgtgtccaaagggaactggggagagtgtggacaacgtggtggatactttgaaatgacaaatcttcctcccaagacagtagatgagatctacaaggttgcatcaatagcactgagtccaaatgttcctgggcaaatttttatgggagtaatggttaaccctccgaaacctggagatatctcataccccaagttcgccgctgaaagcaagtccgtccatgaatctttgaggaggagagcacgcatgatgacagatggtttcaacagttgccgaaatgtcgtgtgcaatttcacagaaggagctatgtactctttcccccaaataaggctgccaccaagagccattgaggcggcaaaaagagctggcaaagcagcagacgttttctactgtctaaagctcctggaggcaacaggaatttccactgttccgggctctggttttgggcaaaaggaaggggtgttccaccttcggacaactatccttccagctgaggaagacttccctgccatcatgtcgagcttcaagaagttcaacgactcattcatggagcaatacgagggctactccagaatgtgaacaagaacagaaacaagatatactgaaggatcggctgagagattcgttgttccagtctcagcacaaatggagcgtttctgaagatattcaattgaaagttgattagttgtaactctcttaaaaagaagcaattgctgcctttgaagatatgtatagggaacggaagttctgtgggttattattgaataacgatctgccattttcttctactgccatagtatagtcttgtacctgctggaagatgtacgctgctgctgctgttggaccactatgccatacaaatatacaactatcacagttgacaacagtctatatgcctgcaaagcttgt

SEQ ID NO: 14282 - DNA, 753 bp, Sorghum bicolor
  Clone ID: SORBI-28MAY03-CLUS37958_1
atggaacagactacaatacaaaggatggaactggggtgcgtgattacatccatgttgttgacctggctgatggccacatagcagccctaaggaagctctatgaagactccgacaaaataggatgtgaagtatacaacctggggacaggaaaggggacatcggtgttggaaatggtggctgcattcgagaaggtttctgggaagaaaatcccactggtgtttgctgggcgaagacctggagacgcagagatcgtctatgccgcaactgccaaggcagagaaagatctcaaatggaaggcaaaatacgggatcgaggagatgtgcagagatctgtggaattgggcaagcaagaacccatacggctatgctggatcacaagacaacggcaaatgaatcaccgatccatgcatcctgcagtagtagcgagcagcaaactgagcagcagcagcctataccaccataattaataactcatcatatgtaatagtcactcagtcagtcagtcatctaattaggggatggtgcgatgggcctcgtttcttcattgtatagagggaggagtaggggggtccatttcatccattatcttgttattctttttttatcattcctgtaagattattagaccagcctggtattgcttcatggttggttgctagaaaaggaataaactccttgcataccaaattattatagatatattatatacatgcatacactgatgtatctttatattatgttgatacttgactcg

SEQ ID NO: 14283 - DNA, 1761 bp, Sorghum bicolor
  Clone ID: SORBI-28MAY03-CLUS8171_1
gcacgagggcctccactccgactccccccatctccccacccagatctcgccgcgatgggcctcgccgccgccgcccgcgcggtcctcctcctcctcgccgtcgccggagtattcctccgcccggcggcggcggagatcaagcaggagtccttcaaggacgactcccgcccctccatcctcttcgagaagttcggcttcggcctcaaaggcatggtgtctatctccgtcaccggcgccaaggcctcctccacgctcgctaagcccgaccccgtacagctcggcttcttcctcctctccgacgagtcgctcttcgaggccatctacgatcagccggcgcccacggatctgaaccccgaaccggagtcctcccccacctgcgtcctctccagcccctacgtcagtccgctcttcaccttcgcggacctcgacgacaagggccactacaacaagactttccccatcacccaccccgacgagtacagcctcttcttcgccaactgcgcgccggagaccagcgtcaccatggaggtccgcaccgacatgtacaacaccaacccggacggcaccaaggactacctctccgtcggcatgtcctccgtcccggggatctacgccttcttcgccgtctgctatgttgtgttcctggccggttggctctacgtcaccctctaccgcaaccgcctctctgcccaccgcatccaccacctcatgtcgggcctgctcgtggcccgaatgctctactgcatctcggcggccgaggaccagcactacatccgcaccgccgggacatcgcacgggtgggacgtcatgttctacctgttccagctcgtgaagggtgtcatcttgttcgctgtgattgcgctgattgggactgggtggtcgttcctgaagccattcctgcaggacaaggagaagaaggtgctcatggtggtgatccctctgcaggttgcagctaacatcgctgctgctgtggtcggcgagactggcccattcttgcagggatgggtgacatggaaccagatcttcttgtttgttgatgtcgcttgctgctgtgctgtgctcttcccagttgtgtggtcgatgcgttctctgcgggagtcatccaagacagatggcaaggcggccagaacccttgccaagctcacgctcttccgccagttctatgttgtcgtgattggatacttgtacttcaccaggatcattgtgtatgccctcaagacaattactaactacaagtacagatgggtgagcgttgcagctgaggaggtggccaccatggcattctacatgttcatgttctacatgttcaggcccgctgagaggaaccagtactttgcacttgacgaggatgatgaggaagctgcagagatggcgctccgtgaggaggagtttgagctctagacgaccacgtggatgtccaatgacatgggaatacagccatatcacattcagtttctcctcgatgtgatgttgatcatactatacagattcagggtttagctaatatttgtctatgtgttgtggtaaatcttctcctactccttttagtttcggaagctgccaatgagacttgtgataactagatttcttgtgttgcaaaagtaagggggaattcaatcaatattgccattttgccaagtctcaggtttcaattcttgctttttcagtgtttctatttccactatgaatggatgattttatttagtgtgtgtgggactggggatggcactgataagcatcatgttgccgtgacctgtaaag

SEQ ID NO: 14284 - DNA, 1275 bp, Sorghum bicolor
  Clone ID: SORBI-28MAY03-CLUS8612_1
gcccgcagcaagcaagcgtcttctgcctcgtcgacctcaccctgtcctcacccttcgcgtgctctctccgctgctgcagcacactccctcgcttgctgctccctgcgccaggtgtgggactcgatttcggacggcatggctgaggcgttgtgcaacggcgtcgtggcgtcgccgtacggcggcggggacgtgggcgtcgccggccgggccaggggcgccgccaaggccgcgctcgcggagtccctgccggtcggcgggtacgccaccaagagctccttctccgccgggaggatgtcggtgtcggacaggaagccgaggcccctgtctcggaacctcgaggccgccgccgcgcctggacagatgaacctgtcgtttcccaaggccatgcggtggtgggagaaggggctgcaccccaacatgcgggagatcgagtccgcgcaggacctcgccgactccctcctcaacgccggcgacaagctcgtcgtcgtcgattttttctccccaggctgcggcggctgccgcgctctccaccccaagattgcccagttcgccgagaagaacccggacgtgctgttcctgcaagtgaactacgagacgcacaagtccatgtgctacagcctccacgtccatgtcctcccgttcttcaggttctacaggggagccgagggacgggtcagcagcttcagctgcaccaatgcaacgatcaagaagttcaaggacgccctcgccaagcacggggctgacaggtgcagcctcggccctgcacgggggctggacgagtcggagctcatggccttggctgcgaacagagacctgcagttcacctaccagaagccgggcctcgtcccgcttgcggaagccattgccaaggaggctgctgcaccgggaggcccgtggcttcctctgcctgcgtccgcgactcaacaattgctgggtcatcatggatcggataactcattgctatcatctggaagatagaccgtagtactagttagtttcatcggaggtggttcgtccatctttgtatagatttgattctttcgtggtctgattctgaagtgacagacaaattgagatgcggatgcgcaggctgaagcttttggaaagtctgctgctctgctctgactattgcgtctgtatttgttgcatctagaccttttgctcacttgtttagatcgcaaaaattttcaagattccccgtcacatcgaatctttgttacatgcatggagcattaaataaagataaaaataaaaactaattacgcagtttacctg

SEQ ID NO: 14285 - DNA, 2598 bp, Sorghum bicolor
  Clone ID: SORBI-28MAY03-CLUS869_1
gcgcgagaaagggtgagacagaggtgcgcggccaacctgcgtggtgcgggtggtttcgagcacgggcgagcgctcgctgccgatcccaatccggccagcagcggccgccccgccccgcaccgccgggcctccctccggccgttctccccgcccgccggcccgccagcatcacaccatggcgggctccatggtggaccgtgccaccagcgaccatctcatcggcccggactgggctaagaacatggagatctgcgacatctgcaaccgcgaccccgggcaatcaaaagatgtcgtcaaggcactgaagaaacggattggccacaagaatccaaaagttcaacttcttgcattaactctgttggaaactgttataaaaaattgtggggatatacttcacatgcatgtcgcagagagagatatattgcatgagatggtgaagatagtgaagaaaaagtctgatcctcgtgttaaagagaaggtattggtgctgatagatacatggcaagaagcatttgggggaccacgtgcaagatatccacaatactatgcagcataccatgagttggtgcgtgctggagctgaattccccaagagacccgagaaacctgcacctttgtttaatggtcagtctcaagcagcaaggaatatgcgtagtcctgaccaacaggatgaagcagaatcttctgctgccaatgattttcctgctttgagcatgtcggagattcagaatgctcgtggtattatggatgtacttgctgagatgctgaatgctttagaccctggaaacagagagggactaaggcaggaggtaatcgtggaactcgtggatcaatgccgcacttacaagcagagagttgtgcagctagttaattctaccacggatgaggaacttatgtcgcaggggcttgcattgaatgatgatttgcagcgtgttctggcaaaacatgatgcaatagcagcaggcattgcagttcgagtggagaaaaaaccaaagtctttgcaagcacttgtagagactgaggattcggcaaaccaggattccaaaaaggagcagggactcatagctcgtggggaacccacaagccaagatgctgcaaaagaaccaaatcaaagtacaagtgaccaatctccttttgagcaattagctcttccagcaccaccagtgtcaaatggcgcagcaacctcagcaccaaacccacgcgtccgcattgatcttctgagctgggatgatacccctgcccctgctacagcacaaaattcacttgctcttgttcctgtcacagatcctcttgctgattctacttcatcaaatcaaaatgcgctagcaattgtcgacacattttcacaaaacagcaccgctaacagcaatgctcaaccagctgacccctttggtctcaatccaagttctgttattccaggatcgcagccatacaacactccaactcagcagcctttccagtcgcaacagcctccgcagcaggcggccctctatacaaatgggggtgctgtgaaccctggaacgtcttacgatcaggcatctcagtttaacaatgttagttctgggtggaatggtcaaactgccaacccggcggcgtccccaccagagcaaacactgaattatgatgatcaaagtggaaaccttccgccacctccttgggaggctcagtcagcggcgagcaatgaagtgccaaatggccatttgggaggcatgcaacctctcacagggccaggccagatcggcggcatgcagcagccactgcaaccacaagttaaccacatgggagttccacaaagccagccaatgtacagtaaccaaccaggagtcgggctgcctcagcaagcgatgcaacctggtcaagttgccgcaacacagatgcagccaggttttgcaaaccagcagttcggttcgctgccaccaacatccatgatgggtgtgcagttcggtggcatgcagcctccacaaatgtatggcggatcgcagccagtcatgatgtacccgcaacaaatgccagtcgcacagtatggagcaatgccgcagcagcagccgatgtatggtggtcggttggctgggtacatgcagcatcctgctgtggctgctgcacactactacaacaaccaggggacggcgggaatgtatgggtaccctggcgcgaacgggctgtctcagagcatgtatggcctcacggtgcaggacaactcgtccatagggatgacctcattgtaccagactacgacggcgccaacccctgcggggcaaccaatgaagccgacgaagcctgaagacaagctttttggtgacctcctgagcattgccaagacgaagaaagcatcatgagacgagcaggagcatcggcttgggccttcatatatattctcccatatttttgtgatttttcatgttgtttgatcttacacttgtaacattatcagaatgtataagctttttggggtcctttttttttattcccacgctgtgatcctgatcctattagattcgttattataccgtgtgcgtgtactgatcacgcgcaagaggaaatgttggccgtaaatgatgattcaataaagggtgtgccgtacgtacgtacgtacttactt

SEQ ID NO: 14286 - DNA, 1769 bp, Sorghum bicolor
  Clone ID: SORBI-28MAY03-CLUS12164_1
caccccgggagacgcgcctcaccagccccgccaactacccaaaccccaagcaaggccaagccagcgagcgcttctacgcgcccttgtcctcgccgcccgcgcggcctcccccctcgccccctccccggccctctcggccgcccgcccccgcggccgcctcctgcacgcccgccggagcccccaccccgtccgccgacagctacctagctcccgccccgctcgcctcgcccctcgactccccaccttctccattcttccctcccttcgccggagatccaagaaacctagtgggggaagccagccagggggggaaggaacgagggcgggcgatgggaggaaggggcgcgatgctcgccgtgttggcggtggtgcttcttgcggcggccggcggcggcgccgcggcggaatcgagtgaggcgtcggccaaggggatgtaccacgcgctcttcaactttggggactcgcttgccgatgccggcaacctcatccagaacggcaccccggagatcctggccaccgcgcgcctgccctacggccagacctacttcggcaagcccaccggccgctgctccgacggacgcctcgtcatcgaccacctcgcgcaagagtttggcctgccgctgctgccgccgtccaaggccaagaacgccagcttcgcgcacggcgccaacttcgccatcaccggcgccaccgcgctcgacacgccctacttcgaggccaaggggctcggtgccgtcatctggaactccggagcgctcatgacccaaatccagtggttccgtgatctcaagcctttcttctgcaacacaacggaggcatgcaagaaattctttgccaaggcactgtttgtggtcggtgagtttggcggcaacgactacaacgcgcccctctttgccggcatgggcatcccagaggcctacaagttcatgccggatgtcatccagggcatctctgacggtatcgaggcactgattgctgagggggctgtggacatgattgtgcctggtgtcatgcccacaggctgcttcccagtgtacttgaacatgcttgatgtgcccgaagagggaaagggctcccgcagtgggtgtgtccgccagtacaacacgttctcctgggtgcacaatgcacatctcaaggccatgcttaagaagctccgggctaagcaccccaatgtgaggatcatatatggcgactactacactccagttatccagttcatgcttcagcctgaaaagtttggttttgccaaacaactgcctagggcatgttgtggggctccatctactcctgagagagcagcttacaacttcaatgtcacggccaaatgtggcgagcccggtgcaactgcctgtcctgatccgacaacccattggagctgggatggcattcacctgacggaggctgcttaccgccatattgccaaaggctggttatatgggcctttcgcggaccaaccaatcatccaatcttcatgatcacaccactcctgttgtagagtttgtcaaagtagcgcactgaaagaaaatggagcggggaaagtagttcttccgtacagttccaatgtttgcatacatgtacatctccatttgattgtattcatttgccattgggggtacaaaggtgggataggaggctacacaaaggcctgattttcttgatttgtcaggtgggtataaatatgaaaaatgtaacgcacagataatcatgtatattgtgtcccggaaatgtgatacagactgtctgcttgaggagcttctgattctctgatt

SEQ ID NO: 14287 - DNA, 1783 bp, Sorghum bicolor
  Clone ID: SORBI-28MAY03-CLUS12662_1
gcacgagggtctcttcctctctctcctccttctcccacccaccccttctcccttgttgtgggtgtgctgtggagaggagaaaggaaggagagcaagaaccaacaccaacaagagctgctgccaactcctgcacagcctgggctctcatcactgattgcccacctattaccttcctcttttgtgatttagaatcacccatctatcccttatatatctaccttttctcggtcctctgtaaactctctcgtcttctaggtttcacaggcctcaagataggcctctggacctaagcttgcaagcagctgctgttcttggttttcttgattcttggttttgtggttcttggatttttgggttcttaggtttcttgtatcttcccccaatcttgcaaaatcttgtgaagtttcttttcgctgtttggggaccatggacgaaaggattccgccgccgtccctcttgcaatactcgcagtcccctgttcattcttcccctcaccccctcaattctatgaggtattcttcctctgaaagagaaagatatctggctgagttgcttgcagagaggcagaaattggccccatttgtgcaagttcttcctttctgtaccaggctgttgaaccaagagattttgcgcgcatcttctatggcgcctaaccataactttgttgatcctgagagaattgagcatggtagcccattaaggttacctggccacccagtgaatggtcagccaatggatctggagggctggacagggattcaaacagaggcttctcagcatatgggggttctacaagcatcatcaatgggctggaatggtgctcctgtactcgctgccactcctgttgtcaagaaagtcatgaggctggatgttccggtggacaagtatcctaattacaactttgttggtcgtttattggggccgcgaggtaactccctgaaaagagttgaagcttcaacccaatgtagagtttacattcgaggacgtggttcggtgaaagactctgttaaggaagacaagctgagggataaacctgggtatgaacaccttaatgaacaactgcatgtacttgtggaagcagagtttccagtagatatggttgatgcgcgcctaaatcaagctgtctccatcctagaggatctcctcaaaccaattgacgagtccatggacttctacaagaagcagcagctgagggagctggcaattctaaatggcacgctgagagaggaaagtccaagccctcacctcagccctagtgtgtcccccttcaactccaccgggatgaagcgcgcaaaaacagggcggtaatctctgttccgaaagctccatcccccaaaatcaatcatggttcaatgcccaattacaagcaactgctgtactgctggagatgattggtgaagcatatgctgggatcatcagtgctgctggcctatgcctgtcatgatctatgctttttatcaacacacaacatgtctgtgcttggacgaatggtctctgggcttgttgtttgactctattattatttattctttgtgcttctgactgcctaagtattattaacattattggtttgggtaagttaacaaggcccggttggccagtcactatagaagctggggggttcgatgtgtcggacaataataaggtttcgttggtgtagctgagatagttgtaatatgtcactgtgctgatgcttttgtgtggtgctagtacaagacaaccagacagctatagttgaggcaatgattatttttcattcataaaatgtttcgttgtcgtgcct

SEQ ID NO: 14288 - DNA, 886 bp, Sorghum bicolor
  Clone ID: SORBI-28MAY03-CLUS11015_1
cttaccaggtccagacatagcaaggattgacagactgagagctctttcttgattctatgggtggtggtgcatggccgttcttagttggtggagcgatttgtctggaagagatcaagagacagggggagattgagaagaacaagcttgcgctggagaggaagaagaggcaggctgagaagcaggcagcaaaagccgcggcccgagcacagaaggaagctgagaagaagctgaagaaagaggagaagaaagccaaaaagaaatctggtgcagctgacaccgacgagccctcagaatcggatgccaagtctgatgaagccatagaagccccagcggaacaagaagtgatccttgcttccaccacggtaaagaaagaacagaaggagagtgcccggcacaggaatgtggtcagccggagcaaggccccgccacccaaggcgatcctgaagaggaagaaggcgcagtcctactggtcatgggctggcccagctgccatagtggctgcggtgctggttgccctcctcgcggtgctgggatactaccagtactacctcccagcgaatgtcagcaactgagtggatgaggcccgtgcactccgccgccaggccatttgatgacgtggagaccaattttgcaggtgagaagaaagagtgcaaggtctgcttttgagacgtgaaggaccggaggaatgtcttgttcacttttgatgttagtttatatatattctatggagccgaagatacagttgattttggttgcgactttgctagatctctctaaatatatactgcgactgatatatcccgtgtacttttgaagtgaagcgtatattgacatctggaataatgcctttcgctttaggaatctcaaataatggccctgtctacgc

SEQ ID NO: 14289 - DNA, 1991 bp, Sorghum bicolor
  unsure (1)..(1991): unsure at all n locations
  Clone ID: SORBI-28MAY03-CLUS13314_1
gcacgaggtccagctgcgccgcgccgccccccgccgctgcctgtcgcctccgcctccggtcgcggccgagccagccaccgcgcctcctgtcgtgctggggcacgacccggacccggaggctgcagcggcgccggatcggccgcacccacccaccacagtctgagcgcgcgtgagggactgaccggccgaccgagacactgattgagcactaaagcgggcgcggcagggcatggcgacggcgctggcgcggcggggcgccgcggccctggcgcggtggcgcgggatgtgctcgagctcggcggcggcagggcgcgccgcggcgctgtcctcggaggagctcatgcggatggaacgggactgcagcgcgcacaactaccacccaatccccatggtgttttccaaaggagaaggttcacacatagtggaccctgaaggcaacaaatacatcgattttctctctgcttattccgcagtcaatcagggtcattgccatccaaaagtcctgagagctttgatagaacaggcagaaaggcttacgctcagttctagagctttctacaatgataagttcccaatctttgcggaatatctgacaagcatgtttggatatgacatgatgttgccaatgaatactggagctgaaggagttgaaactgctatcaaattggctaggaaatggggttatgagaagaaacggataccaaagaatgaggctttgcttgtctcttgctgtgggtgtttccatggtcgaactcttggtgtcatttccatgagctgtgacaacgatgcaactcgtggttttggtcctttggttcctggccatcttaaagttgattttggagatattgatgggttaaagaaaatctttgaagagcatggagatcggatttgtggttttttatttgaacctatccaaggtgaagcgggggtagtaatcccaccagatggctatttgaaaggtgtcagagacttgtgttctaaacataacattttgatgattgctgatgagatccaaactggcatagctagaactggtaaaatgctggcatgtgattgggaaaacatacggcctgacatggtgattctaggcaaagcactcggtgctggagttgttccagtcagtgcagttcttgcagacaaggatgtcatgctgtgtattagaccaggggaacatggaagtacattcggtgggaatccattagctagcgctgtggcagttgcatcactgaaagtggtcagagacgaaggtcttgttgaaagggctgcaaagttaggacaggagtttagggaccagttacagaaggtccagcaaaaattccctcaaatcataagagaagtgcgcgggaggggtttgctgaacgcagtggatttaaacaatgacgcgctatctcctgcttctgcatatgacatctgcatcaagttgaaggagagaggcattttagcgaaacccacacatgacactataatccgacttgctcctcccctctcaatcagtcctgaggagcttgcagaagcatccaaggcgcttagtgacgtgctggagcatgacttgccacagttgcagaagcagataaaaaagccagaatctgaggcagagaagccagtctgtgacagatgcggccgggacttgtacggatgagtgaagcctccgaacagagatagctgcattttcgtaggtacccatctcgccccaaaagaaataaacagagcaggggattctagctacttaggtcactgtagtgttatgcgacttgttgcatcgtatattaagggtatgagctatgctaccttgatgaatatcaaataaatgggtagcattcccttgcactgtgaatgtaccgtcaagccatatgatttcgcgttccccttctttgcaatgttttattaagtaatatctgaaagttccgacagagagttggtcagaagatgtgcaatcttaacaatggataatcattctgaggaaagaagaatgtatgattgttcggtcnana

SEQ ID NO: 14290 - DNA, 953 bp, Sorghum bicolor
  Clone ID: SORBI-28MAY03-CLUS1292_1
ccggggagagagagagagagagggcggcgcgtccatcccacgcgactctcccacacaaatacccaccaccctggccgggccgggaccagttcaccaccacccagcgccagcggctgcagctcagacctcaacctcatcagaggctcctgccccgccgccgatcccgtcctgtctcttccccgctgcggagccgtctccagccctgcccgcgcagatggcgaacgcggcgtcagggatggccgtggacgatgactgcaagcgccggttcctggagctcaaggccaagaggacccaccgcttcatcatctacaagatcgacgagaagaagaagatggtggtggtggagcaggtgggtgagcctgtgctcaactacgatgacttcgccgccagcctccctgccaacgagtgcaggtacgccatcttcgactacgacttcgtcaccgaggagaactgccagaagagcaagatcttcttcatcgcctggtctcctgacacggcgcgcgtgaggagcaagatgatctacgccagctccaaggagaggttcaagcgggagctggacggcattcaggtggagctccaggccaccgattccgccgaggttggccttgacgtgatccagggccgtgcaaactgaggaaggccagcaatgaactgccgctgcctgagcatgagcatcatcagtttcagatgactaatgtaaaggatatgggctatgtcaactgcatccactgggcactgcagtgatgaaacaatcaatctaccccgtgttccgcgtgcgtgttcgtcaaagttctgctatagcttggtcatgcttgccatgaccagcaactttctgatgatggcattctagtattcagaaatgccctgtgatactgtttaccttgtgctttctcaaaaccgggttgaaggatgctgaggctgaagtttgaacaagacctactgttgaaaatgcc

SEQ ID NO: 14291 - DNA, 1470 bp, Sorghum bicolor
  Clone ID: SORBI-28MAY03-CLUS7822_1
ctactggagtgctgccggtgcgggtgcgggtgcccagccaggccctctgctctgctccacctcccctccccctgccccccctccccctccccccccccctcccccccccggcccgcgcccgcccgcgggccggtggtgcgccgcgccccgtccgtgtcggacctggcgagcctggcggcggcgtcgccgccgcggtcgccgacccggcccggccccgcacgaggctctgctccacctcccctccccctgcgccaccaccaccactcgccgaccctcgctcgcccagggaggaaccgggagcggggcggagatgatgcacgccaagtcggagtcggacatgacgagcctggcggcgtcgtcgccgccgcggtcgccgaagcggggcggcggcgggggcgttgccggcggcgcgggcaacggcgggtactacgtgcagagcccgtcgcgggagtcgcacgacggcgggtacaagtcgtcgtcgatgcaggcgacgcccgtctacaacagccccaacgagtcgccgtcgcacccgtcctacggccgccactcccgctcctcctccgtcagccgcttctccggcaacctccgcaagggcggcggcggggaccgcaaggtgctcaacgacaagggctggcccgagtgcaacgtcatcgaggaggaaggcccgtacgaggacctcgcaggggacagcggcctctcccgccgttgccagatcatactcgggttcctcaccttcgtcctcctcttcaccaccttctgcctcatcatctggggcgccgcccggccgtacgagcccgaggtcgtcgtcaagagcttggtgatggacgacttctatgctggtgaaggcacagaccacagcggtgttccaaccaaattggtcacaacaaactgttctctgcacatagctgtgtacaaccctgccacaatgtttggaattcatgtcacttctggccccatccatctgatctattcagagatctcaatagcagtcggtcaggttcgcaggtactaccaaccgaggaagagccaccggacggtgacggcggtcatccacggcgagaaggtgccgctgtacggcgccggcggcagcctgatgctgtcaacgagcacgggcgggacggtgcacctgacgctggacttcgacctgacctcccgtggctacgtgatcggcaagctcgtgcgggtgacgcacaaggtgcacgtgacgtgccccgtcgtcgtggacgccaagaagaccaagcctgtcaggttctccaagaaggcctgcgccgtgtacaaggcctgaacttgaatagcattttttttttcgtgaaactttgatcgacgatcggagcattagcgatacgtgtggccttgcaaaggatgtctgcctgtatttagctattttgtgttaatggtggtgaagaacaataagcgcacacatatggtttgtttttgagcctcttggttttgtcgataaaatcgcgctgt

SEQ ID NO: 14292 - DNA, 1466 bp, Sorghum bicolor
  Clone ID: SORBI-28MAY03-CLUS7151_1
ccttccggcggtccgtttctcccctgctgctgctcctcccgatccagcccacccaggggcgccctcgcatgtccctgcgcgggggtcaccgccggaatctgttgagcccgattctctcggcgtcgcatccgtctccggcgtttggctcggaggcgcggaccttccctttgcctccgaggtctcagaggccgttcggaggtttacgattcgcccctgccttttcttctcccgctgtcccctccccgcgtgcgctccctctcgtggcggcgactgggtgaccgccgccgtacgccaggcgctcaggtctcgtcgacccctccttcgccggcgaatatcacccttcagggcaatgatgggaggctggggggtttcggatgggtacgagggatcaaagaggccacgaatgatgatggaatcgaatccctacttcgcagtgaacgcagggagtccattggatgtctcaaagaggtctaggatggtggaaccaggcccctattttggggctatgggaagcaacgctggtggtgccagtggtggcttctaccagcccttcaacagcaacttagctggtgcaggggctagcactggcatccaaaactttccaggtgtccggctgcgtggtctcccttttgattgcaacgacattgacatctgcaagttctttgtgggactggacatagtggactgcctcctggttaacaagaatgggcgcttcactggtgaggcttttgtggtcttcccaacagctatgcaagcagaatttgcgctgcatcgcaacaggcagaacatgggccggagatatgttgaggtgttcagatgcaagaagcaggagtactactgtgcaatagccaacgaggtgagccagggtggttactttgagtcagagtaccgccgctccccacctcctccaaggtctaagaagccggctgaagacaagggcagtatggagtacactgaggtgctgaagctccgtgggcttccctactctgccaccactgaggacatcatcaagttcttcctggagtatgagctgacagaggagaatgtgcatattgcataccgctcagatgggaaagctactggtgaagcctttgttgagttccccactgctgaagttgccaagacggccatgtgcaaggataagatgaccattgggacgaggtatgtagagctgttcccgtcgaccccagaggaggcgagcagggcgagaacccgaggcaggcattgaagaagcgaatggctcaatgatctcttgttgcatgtgtttgcgatcaagtttagttttcacttcgcatgcttacctgtatcgctgttagattgtgttagtcgtatcgtcatgctgctactgcttgtgtatttgagtgtttgacttcttatatgcgaactgaactgtaacattttttcttttctggatgcacatgtttggtataatcatttatggattttgcttcattttggtttatcaa

SEQ ID NO: 14293 - DNA, 1414 bp, Sorghum bicolor
  Clone ID: SORBI-28MAY03-CLUS9330_1
cccgcagccttatgccttggagactgcaggaactatgaacttgtgtgcttcatcggtcacaaaagaagtagaacctttgcttttcaaagcttggaattgattcttctagttctcggtggaagcttctagaggaattgcaaaaggtgctccctccaactgtgatggtgcctgagaggaggttagaaaatttagttgagcaagcacttactgtacaaagggatgcttgctatttctataattctgttgatgggttgtccctattcactgaacatcactgtgggaaagacccgataccgtctcgcacattacaggttttgcatgcacattatgatgaagtcttgtttatccagttttcaacattcggacagtatttggtcactcgggcacagtcaactgcgtaaattggatccctacgagtcccagctggattgcaattactggggactatcacgcagggccaatatggggggctaagaaggccagtcttaagcgcaaggatgttgggagcagccactgcaacagtaacggtttccactcgaatggcaatgctcatggcaacggtttcgttcaccagtgcaatgggaacagcaccaaatgattggccagggcaatgtatctccatggatggttaactggcatctgtaaatccccctttcttttgcatttgggatttagatggtaatgaagtagattgctggaaagggcagagatcaacaagaacatctgattttgctgtagcaaaagatggaaatcttataataagcatgagtagggagagcacaattcttctatttgatagggagacaaaacaagagaggttaattgaagagggtagtacaattacttcattttctctatcagaagatggtgatttcctgcttgtaaatcttataagcgaagagattcatttgtggaacataagaaatgatcctgttcgagtcaaccggtacaagggccataagcgcaaccggtttgtgataaggtcttgttttggtggatctgagcaggcgttcattgctagtgggagtgaagattcacaggtctacatatggcatcgagccactggtgatctcattgagactcttgctggtcactcgggcacagtcaactgcgtaagttggaaccctacgaatccccacatgcttgcatcagctagtgacgatcacacagttcgtatatggggggcaaagaaggccagtcttaagcgcaaggatgttgggagcagcaactgcaacagtaacggtttccactcgaatggcaatgctcatggcaacggtttcgttcaccagtgcaatgggaacagcaccaaatgattggccagggcaatgtatctccatggatggttaactggcatctgtaaatccccctttccttttacttccctcctggaagaagaatcgccaccgccataggg

SEQ ID NO: 14294 - DNA, 1773 bp, Sorghum bicolor
  Clone ID: SORBI-28MAY03-CLUS2189_1
gcggcggaggctgttttcgctcgccgtgcgaagcaatccgcggcggcggcgatggcgacgacggcggcggcggacgggcccccggtagagccgcagtccctgaagaagctgagcctccggtcgctgaaacggtccctggacctcttcgcgcccgcgcacgccctcctcttcacgcccgatgccgagagcaagaggattcgtaccgggtgtaaggtgagggcggagtacggcgcggtgaaggacctgccgcccgagcaagggcgcggagggcagggcaagggttctgcgccgacgtcgtcgacggcgttggcactgccaggaacacaggatacaaaagatggtcacagagaaggcactagtaatgccattgtccctgtgccacttatgctgccaaaagcacctgagtctaccatacctggcaaaaatacaactatgtcaattcctggatcatctgacagattttctacatctgcactgatggaaaggatacctagtagatggccacggcctacatggcatgctccttggaagaactatcgggtcatcagtggtcacttgggatgggttcgatctattgcatttgatccagggaatgaatggttctgcactggttctgctgataggacaataaagatatgggatcttgcatcaggaaccctgaagcttacactgactggtcacattgaacaaattcgtggacttgctgtcagccaacgtcacacttatttattttctgctggtgatgacaaacaagtaaaatgttgggatcttgaacaaaacaaggttattaggtcataccatgggcatctgagtggtgtttactgcctagctctccatccaacaatcgtccgcttactgactggtggtcgagattcagtttgcagggtgtgggacatcagaacaaaagcacatgtttctgctttaacagggcatgacaacactgtctgttcagtgtttgctcggcctacggatcctcaagttgtcactggttcacatgatacaactattaaattctgggatcttgtagctgggaggactatgtgtactcttacacaccataaaaagtctgtccgagctatggcacttcatccaaaggagaaagcatttgcatcagcgtcagcagacaacataaagaagtttagccttcccagaggcgaatttctgcacaacatgctgtcgcagcagaaaacaattatcaattcaatggctgtcaatgaggatggtgtcttggcaactggaggggataatggaagcctgtggttttgggactggaagagtggccataactttcaacaagatcagactatagtccagcctggatcactggagagcgaggcatgcatatatgccctggcctatgacgccagtggatcaaggcttgtgacctgcgaggcggataagaccataaagatgtggaaggaggacttaacagcgacgccagagactcatcccatcaatttcaagcccccaaaggacatccgaagatattgatcaacactcaaatcccacaagctagcaaactagtggggatcgttggaggcttggagcctccccaattgtgcccgaccccaactcgctgcttccctgagcccaattgaaattcgcagtacacgttcacctgtatgctattcctgggaaacactgtatggatgactagttcaacattagctgtatgataggtgcatatgcagcgatgggtgtattgatgccgaatttgaaccagttgacgttgccaaattcgttttgagcaagaattgagtgttgttttgtccc

SEQ ID NO: 14295 - DNA, 1863 bp, Sorghum bicolor
  Clone ID: SORBI-28MAY03-CLUS2324_1
gcaccacggggggacgaggcgcgccaccggccgagccgaatcgagcagcagcagcagcagcagcgccctcccaccttgccatggcgacgcaggctgctttcctcgcggggttatcgcagctcgccgcacagccgggccgggaccgcgccgtggcgccggcgcgggtggccgtggcggcggtgggtgtgggtagcgccaaggtgggtgtgcgggtgggcgtgaaggcggggaccgccgaggccaaagcggtggcgcagcgccgcggggtgcggtgccgggccagcctgatcgagcccgacggcgggcggctggtggacctggtggcgcccgaggagggcgggcggcgcgcggcgctgcggcgggaggcggccgagctgccgcaccgcctgcgcctcagccgcgtcgacaaggaatgggtccacgtcctcagcgaagggtgggcgagcccgctgcaagggttcatgcgcgagcatgagttcctccaagcacttcatttcaatgccatccgcggcgcggatggcaggatggtcaacatgtccgtccccatcgtgctctcccttggggacgcacagcggagggccatccaggccgacggcgccacgcgcgtcgcgctcgtcgaccaacgcgaccgccccatcgccgtcctcagcgacatcgagatctataagcataataaggaagaaagaatagcaaggacatgggggacaaccgcgccgggattaccttatgtcgaggaggcaattaccaatgctggtgactggttgattggtggggacttggaggttatagaaccaatcaagtacaatgatggtctagatcagtatcgcctgtctccagcacagctgcgtgaagagtttgccaggcgcaatgctgatgcggtatttgcctttcagcttcgcaatcctgtacacaatgggcatgctctgcttatgaccgacacacgtaaacgcctccttgagatgggttataaaaatcctgttcttctgctccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaaccgaggttcagtggcatgctaaggctcgtattaatgctggcgcaaatttctatattgttggaagggatcctgctggtatgagccatcccacagagaaaagggacctctatgatgcggatcatggaaagaaggttttgagcatggctcctggtcttgagaggctcaacatccttccattcaaggtggctgcatatgacacaaagcaaaagaaaatggatttctttgatccatcaaggaaagatgatttcctcttcatctctggcacaaagatgcgcactcttgccaagaaccgcgagaatcccccagatggttttatgtgcccgggtggctggaaagtactcgttgaatactatgacagcttggtgccatctgagggcagcagcaagctgcgagaaccagttgcagcctaaaatctgggaagtgcttcagataaggaatcctattatatcagcgcaagcggttctttgcgacatagaaccgatgttatatgattgtataccggctgtaagacttaaaaacactgggcttggttcggacgttaatgtgtgcttttgtgactggtgtgccctatctgctggcagtgctgcacatgcagtagagcacatcaaatgtttggtgttaataaggacaggctatgtatcgtctgccagattgtacatatacattgtggtgatataattaaaaccctgtcttctgccgttcaggctccgtaaaaaaaaaaaaaaa

SEQ ID NO: 14296 - DNA, 621 bp, Sorghum bicolor
  Clone ID: SORBI-28MAY03-CLUS2040_2
gtctgcgcctacgatgtgtcggactaccagaatgatatcactaggggcacgggcatgagctactgcgtctaccatgcgcccatgggggaggggactcaagtggctgtgctgagttcctacgactaccgtccgcagggccaaaagacttacagcttcgacaacatgatggatggtttctacatatccaagagcttcatggacaagctcgtggtccacctctccaagaacttcatgagcctgccaaacatcaaagttcccctgatcctgggtatctggggaggcaaaggtcaggggaagtccttccaatgcgagctcgtcttctccaagatgggcatcatccccatcatgatgagcgccggcgagctggagagcggcaacgccggagagcccgccaagctcatcaggcagcggtaccgtgaggctgccgacctcatctccaagggcaagatgtcctgcctgttcatcaacgatctggacgccggcgcaggtcgcatgggcggcaccacccagtacacggtgaacaaccagatggggaacgccaccctgatgaacatcggcgacaaccccaccaacgtgcaacttccggggatgtaccacaagggggacaacccccgggtgccc

SEQ ID NO: 14297 - DNA, 1632 bp, Sorghum bicolor
  Clone ID: SORBI-28MAY03-CLUS2040_1
cccagagcgtggcagctagcagagctttgcattgcattgttcatcatcatatcctccgatttccgagtccgatctcctcagcggccggctcgatcgatcacttgcaattaattaattaatactattatggctgctgctttctcctccacctccgtcgtcgtcgctgtgccggtaactacttccacggcggcgaacagcttcctcgggagtaataataataacaagcagaagctcactgtcagcagcatcaggaagaagaagcagcatcagcagggcggcagggggctcatcatcatcagagccatggcggcggtgaacaagcaggaggtggacgagacgaagcagacggagcaggacaggtggaggggcctggcctacgacacgtcggacgaccagcaggacatcaccaggggaaagggccgcgtggacccactgttccaggcgcccatgggggacggcacccacgtcgccgtgctcagctcctacgactacatcagccagggactgaggcaatacaacaccatggatcgccactacatcgcccccgcatgcatggacaacctcgtccttcccatgaccacggccgcctgctcccggcggagcatcagggtgcctcggatcctgggtatctggggaggcacctgcccaaggcggcgctcggcgacgccaccgactttctacggcaaggcggcgcagcaggtgcacgtgcccgtgctcgtgccggaggggtgcactgatcccagggccggcaacttcgaccctgtcgccagaagcgacgacggcagctgcgtctataactgaactgatgcaagagacgatggatatcgtcgtcgatccagaatccaataatagcagctacctagccaacattttcgtgacctgcttgaaactactacttagttatgctagctgattatttacgcgataatcgatctctctcatgtaactaattattactcaatgcaaaacaaattattattgagccctcctggacgtatggagaagttctactgggcgcccacccgcgaggaccgcatcggcgtctgcaagggcatcttccgcaccgacggcgtcgacgaggagcacgtcgtccagctcgtcgacaccttcccgggccagtccatcgacttcttcggcgccctgcgtgcccgggtgtacgacgacgaggtgcgccggtgggtggccgagaccggcgtcgagaacatcgccaagaagctcgtcaactccaaggagggcccgccgacgttcgagcagcccaagatgacgatcgagaagctcttggagtacggccacatgctggtggcggagcaggagaacgtcaagcgtgtgcagcttgctgacaagtacctcaacgaggctgctcttggtgcagccaacgaggacgccatgaagactggcaacttcttcaagtagagcaacgacaatagcgcacctcttgctattgtttttttattttttatataagtacgaccgggggtggcgtgtgggggagggggggatatgatgatcccccacctgtttgattatatattgggtggctctcaaacaagtagccatatgtttgaggttacaaatagttcatcgaaagttcataaagataaaatttacacaacttctttgtcctcgtcggtt

SEQ ID NO: 14298 - DNA, 1388 bp, Sorghum bicolor
  Clone ID: SORBI-28MAY03-CLUS25597_1
gcccgcggctgcagcgaggcccggctcgggctccgcgtgctcccggcggcgctcaacgccgcccgctgcgaccccggctgcagccgcgccacggcgctccgcgcccccccgccccccctcctccccgtccgcgccctcctccgcgtgccccgccacctctcgcccgccctctcccgccgccgctgccactcctgcctccgccgcggcgtccccgcccgcgcccgcccggcccccctcctccccgtccgcgccctcgccgccgcggcccagcccgccctgcgccccgtcccccacctcctcctccgcgccggccgcccccgccgcgtccgcgcctgggccgccctcccgggcccccccccggccgcccggggcggccgccggcgcctccccggcgggccgcccaaccagcgcaccctccgcgcccgcgcccccgcccggcgccgcgtccgcgcgggcgccacccgccggcgggcgggccgccgccggcccccgcgcgccgcgcccaccgggggcacgcgggcgcggggcacgacggcacgtgggcggcgcacccggggctcatcccggcggtccggctccgccccgcgggccacctcggcgggaggccgaaccagatcatcatcggcgacggcgccgccgccggggggcacgagcacgagggcgccagcgtcagagaggaggacctcatccagccgccgcggggcgcgcgcacggtggacgcactgcggctcaacgtccgcgtgggcgtgcagtacctcgcggcgtggctgggcggctcgggctccgtcccgctgtacaacctgatggaggacgcggccacggcggagatcagccgcgtccagaactggcagtggctgcaccacggcgcggcgctggacgccggcggcgtggaggtgcgcgcgacgccggacctgctcgcgcgcgtcgtcgaggaggagatggcgagggtcgaggcggaggtcggccacgagaggttccggaaggggcggtacgaggaggcaggcaggatcttcagccggcagtgcaccgcgccggagctggacgacttcctcacgctcgacgcgtacaacctcatcgtggcgcaccatccaggtgcttcaccgtgcaagctctgaatagctttttgttggcagtgcggtcagctttcagaaataacgcctcgctgtctaatgcagccaacgaaataaggacggatgaccaacaagcatgatagacacgaacagcctaagcacactgcatattttgtctgttttgggtgcttttagtcgtgcttatgataatacatggtggtctatatgtaataataaactaaaggttaagatgctgtttggttcgtgacagcactgaatgagtgtaagtgattccgagctccaagaaattgattactc

SEQ ID NO: 14299 - DNA, 1178 bp, Sorghum bicolor
  Clone ID: SORBI-28MAY03-CLUS214_1
gcgctttttttttttgtttgggaacaaccctacaaaagcgtttattcaactgtgtgcaacctgctacgagaagtttccagtacccaccacctccgtccgacacaatccccggcttcgcctgcaacacaaacccctcccgcttccccgtccgtatggatacaccccagtcggtccccgggtgttccttccttcctgcttctcctctccatccagttggattgggttcgttgggctttcggatagctgtggtgtgcacggcacggcacggcagttcggctactagcgaggaagagaggaggagaccggatccatggcgtcgaagcggatcctcaaggagctcaaggacctgcagaaggatccgcccacctcatgcagcgcaggccctgttgccgaagatatgttccactggcaagcgacgattatgggtccatcagatagcccatactctggcggcgtatttttggtctctattcacttcccaccggactacccattcaaaccacccaaggttgcattcaagacaaaggttttccatccgaatatcaacagcaatgggagcatctgtcttgatatcttgaaggaacaatggagccctgctttgacagtttctaaggtcctcctatcaatttgttcccttcttacggacccaaaccctgacgatcctttggtcccagagattgctcacatgtacaagactgatcgcgtgaagtacgaatctactgctaggagctggactcagaaatatgcaatgggctgatgatattgctggctgccgggaagatgatgacccagttatttgctcgttacgcaagctgtgggtctgtcctagatctaatgcactgccttctgtaactgaaaaaacaaaggtctaaattgaacagtccattcattcatgcatcgaactatattggtctataatggaacgcgaaacattgatagtcaaaaaaaaaaaaaaaaaaggcccctaagcagccagcaagtgaatccaaggttccttcgcttcttgtttggcaacaagtttgtgttgcgctattactgtagttgtgttgctgctgcacttatgttccagcaagttgaaatttgagacttgagacttatctaatgtgcaatgaattggtggatggatgtaatggtattgaatttgaatctgatttagtatgtgttaaaagttaaagaca

SEQ ID NO: 14300 - DNA, 580 bp, Sorghum bicolor
  unsure (1)..(580): unsure at all n locations
  Clone ID: LIB3481-036-P1-K1-D11
cgtccgccgacgttggcatatctcttcaggagactgcttgaagacgcggcctcatcacctgccctcactcgccgagctccagatcgacncggggtagaggtgatccacttgggctagatccatccaagggcggcntggtggaagtccccggcctggatccagccaagggcgacgcggaggaggtcgcccgtcttggatccgtccttgcccgcgatgcggaggaggccgcctagcctcgttccggcctctgtctctcatcctcccggaactgctcgctgcagcggaccacctcgcccttaggcagtaatgctcaaaggcttatgttgctgaaccaacaaaagaaggtaaagatccgaacactcctccaagctatagctcatgttctgccgaaatcaacgattcttcgcaatgtccgcctgcagtccacaaagatgtgctgctactgtcgtgggtgttgtgctgntactgggggttgtgttgcttctgcaattatgttccagcaagttgaaatttgagacttaagacttatctgatgtgtaatgaattggtggatggatgtaatggtttaaaatttgatcat

SEQ ID NO: 14301 - DNA, 1446 bp, Sorghum bicolor
  Clone ID: SORBI-28MAY03-CLUS2951_1
ctcgaggccggccgggccgggccccttccctctcctccgcctccgattgagtggctcaccttcttccccacccagcaatcctttctctctcgatcgagagagagattccagctcggttctcctccagaggtccgtcgagcagaccagcctcctccgaggaccgaagctctctctgcccaggtcgtcgccagtcaaggaactgctgctgttcttggcagatcttggccggagatccgaacaaacttgcgcgttggggggttcgccggggttccttgcgctggagggaggtttcgttctcgccggccatggtttggctgggaagcaccagcagcaccgccttgatgccaaatctctgagctttatgaagatcgccactcacctgcgccgctcctgcttcctccactccttctccgttgtcttcctctactggttttatgtgatctcataacttgccctcccccggatccgccattccttcccccgttctgctctctcccttctcccacccccttcgtccttccttgctttcccgaacaataaatagcagtagctgcagcagcggcagcggtagagaatcctttttggaggtaagcttgatgtcgtcgtcgtcgctgtctccggcggggacggggaggacgtccgggtcgtcggacggcgactcggcgtcggcggcggacacgcaccggcgcgagaagcggcggctgtcgaaccgcgagtcggcgcggcggtcgcggctgcggaagcagcagcacctggacgagctggtgcaggaggtggcgcgcctgcaggccgagaacgcgcgcgtcgcggcgcgcgccgccgacatcgcgtcccagtacgcgcgcgtcgaccaggagaacaccgtgctccgcgcccgcgccgccgagctcggcgaccgcctccgctccgtcaacgatgtgctccgcgtcgtcgaggacttcagcggcgtcgccatggacatccaggacgagatgatgcccgccgacgacccgcttctccgcccctggcagctgcccggctaccccgccgccgccatgcccatcggcgccccgcacatgctccactactgatgattgcttggagtcaggcaggcaggcagctggggctggttggttggcaacaagacaagaagaattggctgcgtctctgcacatgatcacattcaccctggctgcttttgagaattatacataggctctactatctgctgctgtgttaaatctaccacctcctggtttctcttctccaataattcttgctcttctgtcagtgtgtatgagatgatgctcatcttatatgttatgtaaggcttaattatgtgtctggttgtaacttcctgtcttgtaatgttatatgaacaataagtgttatgtaatcttctactgttaagtgttaattcagatctgatgatgtcacaaaaaaaaaaaaaaaaaaggcccctacggc

SEQ ID NO: 14302 - DNA, 1765 bp, Sorghum bicolor
  Clone ID: SORBI-28MAY03-CLUS3411_1
gcacgagggcggaacggaacgcgactcgcctcgcctcgcctggggccgccctcatgcacctggccgcctttccctccagctccaccaccaccaccacccttgccacgcccgcgacgctcccatggcatgagatgccattaataaattcctccgccactacctcgtcattgctgctccgccgctcgctctgcgcgtcgctccggaggatctcccacatggcctcctacgccgcctcccccacctccgcgcccgccgccaccgcctccaccgagaacggcgccgcgaaggcgacggagcagcggcccgtgcaggtcgcaaagcggttggaaaagttcaagacaacaattttcactcagatgagcatgcttgccatcaagcatggagcaataaaccttggccagggctttccaaattttgatggcccagactttgtgaaagaagctgcaattcaagctatcaatgctgggaagaatcagtatgcaagagggtttggtgtgcctgaactgaactcggctattgctgaaaggttcctgaaggacagtggattgcaagttgaccctgacaaagaagttactgttacatctggatgcactgaagcaatagcttcaacaatactaggtctgattaatcctggcgatgaggtgatattgtttgctccattctacgattcatatgaggccacactgtcgatggccggtgccaatgtaaaggccattaccctccgtgctccagatttcgcagtcccgcttgaagagctggaggcggcagtctccaagaacaccaaagcgataatgataaacacaccgcataatccaactgggaaaatgttcactagagaggagcttgaatttattgccaccctctgcaaggaaaatgatgttttgctgttctctgatgaggtctatgacaaattgtcgtttgaggctgatcacatatcaatggcttctatccctggcatgtatgagaggactgtgaccatgaactctctggggaagacattctctcttacaggatggaagattgggtgggcaatcgcaccgccacacctgacatggggtcttaggcaagcacactcattcctgacatttgccacctgcacaccaatgcaagcagcagcggcagcagctctgagagcaccagatagctactatgaggaactgaagagggactacagtgcaaagaaggctatactgttagaaggactagaagctgcagggtttattgtttacccatcgagtggaacatacttcatcatggtggaccacaccccattcggtttcgacaatgacatagagttctgcgagtacttgattcgtgaagtcggcgtggccgctataccaccgagcgtattttatctcaaccctgaggaggggaagaacctggtgaggtttaccttctgcaaggatgaagatacgctgcgtggcgcggtcgagaggatgaagacgaggctcaggaagaaatgaagggcggggaaaattccatgtggcttggtgattgctgaataatctgctactaggtttcaactgctcccggatgcgtgtactaccttttttctagcaatagttatccctgtcagtgacttcatgcctagtgtctttactatttgtctgtgtgtaagcagattgtgatggatcaggatagctgccggtacacttttgtaacctactgagcaatctgtggctgctatgtgttcacccttgtttttcacagccagtcctaaaatcagagtcacagcggccaataaactgatcaaaccaattcctgc

SEQ ID NO: 14303 - DNA, 1214 bp, Sorghum bicolor
  Clone ID: SORBI-28MAY03-CLUS34339_1
gcacgagggcacactcgtcgtctgctctttaacgccgctaccgccgcagctgcagattgaaacgaagacgcacgcggctactacaggctgcaagaagaggcagcaggtttttgcttgcgttttttgagctttttttggcggcggcgacatcatgagcaccggcgcgcggccggggcggcggttcacggtgggccggagcgaggacgccacgcacccggacaccatccgcgccgccatctccgagttcatcgccaccgccatcttcgtcttcgccgccgagggctccgtcctctcgctcgggaagatgtactaccacgacacggcgagcacggcgagcgggctggtgacggtggcgctggcgcacgcgctggcactggccgtggcggtggcggtggccgtcaacgtctcgggcgggcacgtgaacccggccgtcacgttcggcgcgctggtcggcggccggatctcgctcgtccgcgcggtcttctactgggtggcgcagctgctgggcgccgtggccgccacgctcctcctccgcctcgccacgggcggcgcccgcccgcccgggttcgcgctggcgtccggggtcggcgactggcacgccgtgctgctggaggccgccatgacgttcggcctcatgtacgcctactacgccaccgtggtcgacccgaagcgcggccacgtcggcaccatcgcgccgctcgccgtggggttcatgctcggcgccaacgtgctggccggagggccgttcgacggcgccgggatgaacccggcgcgggtcttcggccccgcgctcgtcgggtggcggtggaggcaccactgggtgtactggctcggacccttcctcggcgccgggctcgccgggctggtgtacgagtacctggtcatcccgtccgccgacgctgcgccgccgcacagcacgcaccaccagccgctcgcgccggaggactactagctagtcaagtcggccgggtggccggcgccggtggcgtcgtctccttagttggacccagtacgtcctgttgtcgtcatgttttgttatgtatgcacgtgtcggaaattatgtttgtggtgtcgtgtggagtggttaataaggggggcatacgtgttgtttggtcgccccacagcgttggagacggtgaatcagatgatgtacatctcaacttgttactagtgtgtatgtaataaattccaggtaaaaatggcaggacttgtat

SEQ ID NO: 14304 - DNA, 2402 bp, Sorghum bicolor
  Clone ID: SORBI-28MAY03-CLUS1439_1
ctgttggcctctggatcctccacccctccgccgccgccgccgccgtcgtcgctccggagccccggactcaccgctaggttccccaaaagacaatgccacgttgccacaagtgccggctcccgcgcgggggccgcgatgccgacggtgagcgtcggccgggaccgtctcttcgccgccctcggtcggacctacacacaggaggaattcgaggcgctctgcttcgagttcggcatcgagctcgacgacgtgacgacggagaaggctattatcaggaaggagaagcacctcgaggacgacggcgaggtggacgacgatgacgaggtcatctacaagatagaggttgccgccaacaggtatgatttgctatgtcttgagggattagcaagagcactccgtgttttcacggggactgaagcgagtcctgtattccaagtttcatccatccctcgtggttcaattcttcagatgcatgttaaaccagagacttcaaaaattagaccatacgtagtttgtgctgtgctaagaggggtaacttttgatgaagcaagatacaacagcttcattgatcttcaagacaaactccaccaaaatatctgccggaagagaactctcgttgctattggcacccatgatctggacactctgcaaggacccttctcatatgaggctctaccaccacatgaaatcaactttgtcccattaaagcaggagaaaagcttcagagctgataagctgatggaattctataaatcagacatgaaactgaagaagttcttgcatataattgaaaattctccagtgtacccagttatctatgatagcaacaggactgtattatcattacctcctatcatcaatggtgcacattcagctatcacccttgcaacaaggaatgtctttattgaatgtacagctactgaccttaccaaagcaaatatagtgctgaatacaatggttaccatgttctctgagtattgtgagactaaatttgaagcggaacctgttgaagtggtacatcctgatggcaggaaaacagtttaccccgatctttcatgttacaaaatggatgtttcactatctgacattcttgggcctattggcatctcccaggacgagaaacaggttgtctgtcttttgaataaaatgcaactgcaagctgaaagtcactcattgaagggggagcctcgcatttcagtgtctgttcctccaacaagaagtgatattctgcatgcccgggatttgtcggaggacgttgctatagcttatggattcaacaatgtgccaaaatccacgccgaagtgtatgacaataggaggaaggcaaccattaaacaggttctcagataaaattcgtgccgaggttgcaagagctggttatatggaggtgctcacatttatcttgtcttcacacgaagaaaactttgacatgttaaacagagcagacgacaaaagtaaagcagtcattatcgcaaaccctcgcacttctgaattcgaggttgttagaactagtctgatgtcgtgtttattgaaaacactgaaacataatatagatcatccaagacctataaagattttccaagttggtgatgtcgtgatgctggactcgtcacgtgatgttggtgcctctaataatcgcaggcttgcagctttgtactgcaatagggtttctggatttgaggaaattatgggattggtggatagtattgtcaaagttgtcagagctccgcatgtcaactttggcaagaattattatgtacctacagatgaacctgagttcttcccaaaaagacaatgtaaaattgttacaagtgatggcaagcaagttggctacttaggaattgtccatgctgaggtgctaaggaaatttggcattccggatccctgcactttcgttgagatggaccttgaagcactgttgtaatgcccgtcaacctgaaacaaaagaatgcttgaagctgatacctgccacatcggttttgttcagtgaaaatgcatggggtaccagcatgaagtgcatattacccaagctgtggaatgtctcattgtgcttctcaattgcatgtgattttgccatgggaaagtaagttacaacgatacggcacataccctgccaaaaattagttaagggctattttcactatgtttccattgtaagagctcattcctatccaactttctatgaaaggtatacattatatcctttttgtaaaccatcgggtgtccaaaagttatttctgcaactctttgcacctctactctacatgagatcaacatgatgtaaagcagcctcagaatattagacttgtaatgtctctttgttgaaacacattggacaaggttcccgtgaaaaccatctcttgtgatcgtgattgacattaattaaaatcgtgatgtgtgtgtgct

SEQ ID NO: 14305 - DNA, 462 bp, Sorghum bicolor
  Clone ID: LIB3478-018-P1-K1-H5
tcgccacgcgtccggtaaagttgcagagctccgacgtaactttggcagaatactatacctacagatgaacctgagttcttccctaaaagacaatgcaaaattgttacaagtgatggcaagcaagttggctacttaggaattgtccatgctgaggtacttactctgccttgcttttgaatgcagttacaacctgtgctgcttaagtaccagtagtttagctgccctaattaatgaacaaagttagtaccatattatatatttctttgtgttaggtagcaaaatcttatataattatatgcttgaattatgagctactccaatatcatatttgatttatactaagagatggtactgggatgaataataacttaggaacacaaatgatattatctgagaataagaaaaccataacatggatacacgtggggattgtttttgcaaattaatagcactattccttga

SEQ ID NO: 14306 - DNA, 1404 bp, Sorghum bicolor
  Clone ID: SORBI-28MAY03-CLUS17300_1
gccggccgggccgggaccctgcttccccgtccgtccgctgcatcctacactcctcctctctctctctctctataccctctcgctcgcagatgactgttgggccgccgccgccctaggccaggtgctgaggcttttcttggtctcttcgccggcgacgaacacccaccaggactgatctacacacaagccgcgtagaggtgaagaaaaaacttgacaatgagcagcataggcacaggctacgatctgtcagtcaccaccttctcccctgatggtcgtgtcttccaggtcgagtatgccaccaaggccgtggacaacagcgggactgttgttgggatcaagtgcaaagatggcattgtcctgggtgtcgagaagctggtagcctcaaagatgatgctggaagggtcaaaccggaggatccattcagtgcaccgacactctggcttggctgttgctggtttagcagcagatggcaggcaaattgtttcaaggaccaaattagaagctgccagttatgaaaaggtctatggagaagccatttctgtgaaggaattggcagatcgtgtggcaagttatgttcacctttgcacactgtactggtggctcaggccttttggcggctggcaaattcttggagtctatgatcgctgtactggacagctctacatgatagaaccctcgggagtttcctataaatacttcggtgctgcattggggaagggaagacaggctgcaaagactgagatagaaaaattgaaactttcagagcttacctgccgggaaggcattgttgaagttgcaaagataatttatggagtgcatgatgaagcgaaggacaaggctttggtgttggtgctgagctggttctgggagggctcgacccgcccgcggccgaagctcccgagtgggcggtgggcgcgggccgtggcggctcctcgcgccgccctgggggggttccatgccgcctgtgggacccggccattgcccctgccctcgctgctgatccctttggagtgacccactggacatggccaatttgtcacatatattttgattccatgccatgtgaaaccccggtcccggttgccggtggcagtctggacatggccaatttgtctgattttagtttgatgtcaggtaaaacacgggtcatgtaagtgcggttccggttacgcagactgaagtactggattgtgtgtgtttcggaatcgtgctctagacttttagctgtgagagatttacatgtatggccctaaaaaaaaaatccctattgtatggtttttttttgaacttcctcctgtggccctcaaaggaaatttcatgggaaattttattccttttatgccctccggtgttaagtggcgggttaggcgactataatccctctagcgtcaaattttctttcgc

SEQ ID NO: 14307 - DNA, 1552 bp, Sorghum bicolor
  Clone ID: SORBI-28MAY03-CLUS3873_1
aaattgctcgccgcgagtgaattccggaatccccattcaatccgacgccacacacgaaacgaaacaaaacacaagacgagagagagagaggggaaagccgaagggcgacgacgcggtcccccgattccaaattcgcccctctcgcggccggccgagcgagcgagagacctcccgattcggatcccatctccttcctgctcggagccggagcctcgattcgattcgattcgagcggcggcgggggcggcgattcgaccgggccggtagctacccaggcagagagagagagagagagagagagagagagagagagagagaggcagggggaaggagagaagaggatgagcttccaggacctggaggcgggccacgtccggggggcgccgctcggcggcggccggaggaacggccggggccccgcggggggcgccggcgcgtcgcaggccgtggcgtcgggcgtcttccagatcaacaccgcggtcgccacgttccagcgcctcgtcaacacgctcggcacgcccaaggacacccccgacctccgcgacaggatacataaaacacggcaacacattacacaactagtgaaggatacatcagacaagcttaaacaagctagtgaggcggatcatcgcgttgaagtcagcgcgaccaagaagattgctgatgcaaagctagctaaagatttccaagcagtcctaaaagaattccagaaagctcaacgattagcagtagagagagaagctgcatatgcaccttttatttctcaagcgggcctgccacagagctacaactcaagtgaagtgaataatggtgctgataagttggcagagcaacgcacgcagcttctagaatctagaaggcaggagttggtcttcttggataatgaaatcgtgttcaatgaggccatcattgaggagagggatcagggaatacaagagctcgtccgccaaatcactgaagtaaacgaaatcttcaaagatcttgctgtgctagtccatgatcaaggagcaatgatagatgacattgactcccatatagagaatgctgttgtggcgacttcacaggctaaaggacagctttcaaaagctgctaaaactcagaagtcgaactcttcgctgatatgcttgttgctggttattttcggagtggtccttctcatagtgataatagtacttgcagcctaaaagcttggaaggcagctgaggttccaaaatctgatcgagcttattgtgacaaattccttcataagttatttttgctgtgcagccaggaatgaatcctggtatccgcctggaggtatccatgtggtgattggcgatctgcctgtggtatggtggtgtgtgtatgtggtgatgatgtatctggaatgcatgggtggtttacataaaagtattactctttcctgccagtgtagtgcctcttgtctcatatgcccgctttgtttatatattgtaatgtgtgagtgcgtgctgtagaacaaggttggattatctgtggtatgaagtttctcgattccatcagaaacgcttttctatatgtgaacttcgttttc

SEQ ID NO: 14308 - DNA, 1240 bp, Sorghum bicolor
  Clone ID: SORBI-28MAY03-CLUS4569_1
ccatccatcatccattcccagcaaacactgaaaagttcgctagcgtacgactcgaccagagccaaccaaaccaacaagcaagcaagtagagagacaggcgcagagcgaagatgtgtggtggtgcgatcctcgccgagctcatcccgagcacgccggctcgccgcggtggcggtggcggtggcgcggcgtggcccggcggcaagggcagccagaggaaggccgacgacttcgaggccgcgttccgggagttccacgaggactctgacgaggacgaggagatgacggaggtggtggagagcaagcccgccttcatcttcagcgccccgtcgtccccagcgacgaagcccagggcggcgcgccaggagcagccgatccggcgccggaaggccgcgcagcagtacaggggcgtccggcgccgcccgtggggcaagtgggccgccgagatccgcgaccccgtcaagggcgtccgcgtctggctcggcaccttcccctccgccgaggccgccgcgctcgcctacgaccacgccgggccgcacgtccgcggccccagggaacttccccacctcctccgccgccgccgctggggccccagccagccgcaagcgcgcccgcgcctccgacgccgccttcatcgacctcgtcgaccaagaggaacaagagcagctcacggcggcggcgacgacggccttgaagcacgaggccgccgaagaagcagccggcgagagctccggtgcactcccggacttctcgtggcagggcgtgctgtcggcgtacgacgagtcccccgccgtcgacgtggaggccggccagagcggcgataagaagcggccgaggaccgagccggagagcaccgaagacgaggcgtcgccacgggcctcctccggctccgagccggacgcgctgttcgacgcgctcctcttcggcgaccagttcgccttcttcgacgccggcgcgtacgagtcactggacagcctgttcagcgcggacgccgtgcagagcaacgcggcggcggaccagggcatgccgctgtggagcttcgatgacggctgcctcgtcgaggacaacctgtcgttttgaagagtttcgactgttgctgtgtcagttttgtaaattacgacgttttgtggagtttctgctgtaccagtacttggcagcctgtatatgaggagttgaatgaaatcatcgttctcgagaaaaaaaaaatctgtctatccatgaatacaatgaggactttttagtc

SEQ ID NO: 14309 - DNA, 2223 bp, Sorghum bicolor
  Clone ID: SORBI-28MAY03-CLUS2898_1
gcccccgtggttctcctctctccccctacgcgttggcccaaaccgctcccctaccctctcccctctcccctccttccttgcgtcgctgcgtgtttgtcttttctctcttcgcttcctcccctcctttcctctccggtttggatttctcagcggatggtttcttccccggttgtttcatctgccctggggcgcgttgacctctcctgtatcgcaaactacatgagggctttcgtttgcgtgcgccgtgggggggggtcctcagtttattgtcccgtgggtgttccgataagccgtttggggatgtcgttttcctcccttcttcgctttcttgctgaatgcgcctcggctgtcccttcttccccttcgtcgcatttgcgcgcttgggctttccattacttggctctgttggcctcctattctgttttcagatctgatcaagtatgttttttgtcacgttcggtgcttcactatttttcctgcgtggccatccgcttcgttgcggcaagtcgattttgtgtgtcctagtgtggttccctgggttggtccggtaacctccgtactgttcaaggtttttgtggaatcgtcgactgttttcttattttgtgttttgacctctcattgtttgcgtggaagttccagaccacccgtttattcaggttattgaggtgttatttgaaggtttgtggagcccatctttgggccttaattgtctcagataaggcataaggctgttgggatgtttaaattttggtggtctaaatttcatggtcacacttatcttaattgtaaattttgctgattggtcaacttgtgttagctgtagttgcggatgctagtgaggttgtgtgtaggtcgttggctggtctggggttggttcgttctggtgacagccgttgtgagtttttcaactagccattgccctgtcctgagttttcgcgaacttctatgctgtcttttgactgcacatcactttccagttcacttggttgatttggattggtggtggtttgcttggtttccagttctttgagagcgttaatgcttggaatcttggatgttaggagtgatggggcacaccttacaatattcttccatctaaccagattggagctaaggtgtggatgggatggttaggccttctgagttctagacgtttccacctatggagtcttccttccagtgataaataatcctttgcataaactttattttgaagctgcccttaacccacatgcctcaactgatggtgcaggtccactatttgtgttgatttccaatccaatctgctgtttgtgacattggtcctccctttttttgaacttcgttctgcaatttcctcactttgggcttccatctggtgcatctgctgtggatcaaaaccgagaaaggatgttgctccttttgttcctcccaaagaaaatctgtctgaacaaacttgtttggttgctcttgactatgccagcttatatgcccatcttggtgacgcagtgcaagcttctctgtactttggatggaactggagtcttctgtttgcttgctgtttggccatttctgtcatggactagcagcttacatacatggattttcaatttcacattcggtttcacaagtttgggttgaagttgagtcatcctggttcagattattcaggctgttgcattgatatgcagtgtttgaagtggaagatctttaggattggagtgtagcaacaaaaactcggtggaagcttcagtgcttgcctaaattcattacgattgggtttcttgaccttaaatgattagtgaactggttggttccatttgtcacctgtacatgttggtgtttggtcaacttgaatgcaagctaggctggaattggttctgtttgtgtagaatctccaaattagtatggttcatcttgttatgtggtggtttagtagttaggttaacttcgcactaggattggtttgatttggttaggttggaaacccaactgcctgccttgcaaagtggtacaagcaacataggccatggcaatagtatcgtaacatctaatgtaccatgtttgtgtagtatctgcatttattggagctgacagctgagaaatggggatgctaaaatgaagaatatcagtttaatcaaattattagccaaataaaccatatggtttacttgactgcctcagcttcaaatggtgatgcaccctatctcagaatagaacctgtcaccaccgtaacttgcactc

SEQ ID NO: 14310 - DNA, 429 bp, Sorghum bicolor
  Clone ID: LIB3481-015-P1-K1-E12
cgtccggtcctatccagttacttccttgaaccagtaactctttgaagtttgtgcagatgcgacaaacagaagctgagatagaatttccaaccattggtgccgtctccaaagcccatccctgttccactggccatttgatttgccttggatttgaaggttttttaatcctatcctgaaccaaaatagacagaaatcatggatgagctttttggtaaatataggttttgcacttaccaatttgaagttcaatctgatcgtgatcataaaatgtgcctatctttcgaattctgctaccttcacttttgctaaccagggagtttctggatagagtgcattaatgtcaaacttgattacttcgactgacctgctgttcagatgctttgcactagttagtaacctgcccagagttgtgctaactactattctgac

SEQ ID NO: 14311 - DNA, 932 bp, Sorghum bicolor
  Clone ID: SORBI-28MAY03-CLUS5487_1
aaaggccggctcccacacaacaccagaaaaccaaaatccaaaagatagcaacaggaaaagaaaaagcgtagagacacaaacgatagaaagggacgctcgtctcgtcacgtcccccaccgccgccgccgccatggctgctctgggccggggcatcggcctcctcttcctcggcgtcctcctcttggccgtcgccggtgccgcctccgcggcgcccggcggcatgtccatcatctcgtacaacgaggagcacggcgcgcgggggctggagcggacggaggcggaggtccgggcgatgtacgagctctggctcgttgagcacggccgccgcgtctccaacgtactcggcgagcacgacagccgcttccgcgtgttctgggacaacctccgcttcgtcgacgcccataacgagcgcgccggggagcacggattccgcctcgggatgaaccagttcgcggatctcaccaacgacgagttccgcgccgcctacctcggcgccaggatccccgccgcccggagtggaaacgccgtgggggagatgtaccgtcatgacggcgccgaggagctgccggagagcgtcgactggagggagaagggggctgttgcgcccgtcaagaaccaggggcaatgcggaagttgctgggctttctctgcagtaagctcagtagagagcattaaccaaattgttactggtgagatggtgacgttgtccgagcaggagcttgtagagtgctctactgatggagggaacagtggctgcaatggtgggcttatggatgctgcctttaacttcatcataaagaacggaggcattgatactgaagatgactacccttacaaagcagtcgatggaaagtgcgacatcaacaggagaaatgccaaggttgtgagcattgatgcctttgaagatgtgcctgaaaatgatgagaaatcat

SEQ ID NO: 14312 - DNA, 789 bp, Sorghum bicolor
  Clone ID: SORBI-28MAY03-CLUS575_1
gtggcaaagggaggcagcaagcttgagacaaccaggatgggacaacctgcttgcagtaattcctggtggttcatctgttcccctcttaccaaagcacatatgcgatgatgttttgatggactatgatgcactgaaggctgtgacgtctggattgggtactgcagctgttattgtgatggacaaatctacagatgttgttgacgcgattgctaggctgtcctacttctacaagcatgagagttgtgggcagtgcacaccttgccgagagggcacaccctggctctggatgatcatggagaggctcaaggttggcaacgctaagctagaggaaattgacatgcttcaggaggtcacgaagcaaatcgaagggcatactatctgtgcccttggggatgctgcggcatggcctgtgcagggacttatcaggcacttcaggccagagttggagaggaggatccgcgagcgagctgaaagggagctgttggcggcttctgcataatgtgccagccatgttgcccctgtactagttttctgatttcttcctatcgaaataatacaaactgatggagctcctttctgtgtaaggaaatgcagccttcctgatttctttaaaccatttatgtggatgtttatttgatgcactcaagcagctgtgaattttgatggactagataaacttttcaaagtagaaacaaacttgagggttgtcctgtgtatgctacatgatccatcataacattatttgtggatgtgtatgtctacctgctttctctttaatgctgaactatg

SEQ ID NO: 14313 - DNA, 1269 bp, Sorghum bicolor
  Clone ID: SORBI-28MAY03-CLUS58145_1
ctacccggcgcagtacacgttgggtgcaaaaaacgtacacggtgcaacgtatatatattacacggcgaattgagagtatggcctccgtgcttgccgccacggcattgctcattggagccttggccttggcgtccatcccaacagcggtgcaatccatcggcgtgtgctacggcacccagggcgacggcctaccgtcggcagccgacgtggtccagctctaccagtccaagggaatcggcgccatgcgcatctactccccagacgccaccattctgcaggccctgcgcggctccggcatcgacgtcatcgtcgacgagaccaacctcgacgcgctcatctccgacgccggcagctgggtgcaggccaacgtgcagccgtacatcggcgacgtgaagttcaagtacatcgccgtcggcaacgaggtggaaggcagcgacacgcagaagatcctcccggccatgcagagcctcgccggcgcgctctccgcggcagggttcggcgacatcaaggtgtccacggccgtcaagatgagcgtgctcgccacgtcctcgccgccgtccagcggcgcgttcaaggactcctccgtcatgggccccgtcgtcaggttcctcgccggcagcggcgcgccgctgctggccaacgtctacccctacttcgcctaccgggacgccggcggatcgatcgacctcggcttctcgctcttcgagcagagctcgacgacggtgaacgacgacggacatgtctacaccaacctcttcgacgccatggccgacgcgatctactcggccatggagaaggaaggtgagtccggtgtgcccatcgtcgtgtcggagagcgggtggccgtcggacggcggcggcttgggggcgtcggtggacaacgcgcagacctacaaccagaacctgatcaaccatgtcggcaatggcacgcccaagaggtccgggccgctggaaacctacatattcgccatgttcaacgagaacaagaagcagggggacgagacggagaagcactttgggctcttcaacgggcaggacaagtccccggtgtaccctattagtttctcatgaaaaggacgatcgacggggaaattaaagctgaaaaagacattcttatatgatcaaactatatatagtatgtgatttttagcttcttgtacgggctatgtactatacgtaagattaaccccaggaaataataatactacctggcggtggcattcttatatctcgatcaataaaatattaagcgagtgttgttacattccaa

SEQ ID NO: 14314 - DNA, 1017 bp, Sorghum bicolor
  Clone ID: SORBI-28MAY03-CLUS5444_1
gccggccgggccgggcttgttcctacacgacctgatcaaatcgatcaggcacttgccatctatcttcattgttcaactctttggtgaaaagaaaagatgaaaaaaccaaaaaaaagctctgcccttccatctcttggataaatagagagggagggcagagtcctagggtccttcgttcctcccactcgccgccgccgccgccgcctccccagcaccaggcgctccagcacccggagctcgccctcccgccgcccaccatgatcatccccaagaagaaccgcaatgagatctgcaagtacctcttcaaggagggcgtgctctatgccaagaaggactacaacctggcgaagcacccgcagattgatgtgcccaacctccaggtgatcaagctcatgcagagcttcaagtccaaggagtacgtcagggagaccttctcctggcagtactactactggtacctcaccaacgatggcattgagcacctccgcaactacctgaacctcccgtctgagatcgtgcctgccacgctcaagaagtctgccaggccaccgggccgcccattcggctctggccctcctggtgaccgcccaccaaggggcccaggtcgttttgaaggcgacaggccaaggtttggtgacagggatgggtaccgtggtggtcctcgtggtgctcctggtgactttggtggtgacaagggtggagctcctgctgagttccagccatctttcaggagttctggtggcaggcctgggtttggacgtggtggcggcagtggctttggtgctggcccgacctcttcttccatggagtgaagttgcccttagtttggacatgatgtttctgttcgcgtgatgcgtttaaattttgaaggacagctattatgtactagtaatgttatccggatcggccagtgctgacaatatgcaaaaagaattggtccatcgtaatacattggttccagtataatagtctttgcaaaacgtttgtgttttcaagtcagtactttttcgctaagca

SEQ ID NO: 14315 - DNA, 125 bp, Sorghum bicolor
  Clone ID: LIB3476-012-P1-K1-E9
gcaggcgcattgattcgatggatagcttttcaaatgcagcgcgcaaggggcgtgtcttctctgttgatctttgaactatgagaacaatgagattttgttttactgagctgttgccgtgccttgac

SEQ ID NO: 14316 - DNA, 1374 bp, Sorghum bicolor
  Clone ID: SORBI-28MAY03-CLUS6698_1
ctcccctccggggccttgttcagttgcgcttcgtctcctcctcctcctcctcccgcgcagatcgccaggcgaggaaccaggaaggctaagtgcagggcaggatgcagtacaagaacctgggccggtcggggctccgcgtgagccagctctcgtacggctcgtgggtgaccttcggcaaccagctggacgtgaaggaggccaaggcgctgctgcaggcgtgccgggatgcgggcgtcaacttcttcgacaacgccgaggtctacgccaacgggcgcgccgaggagatcatggggcaggccatccgggacctgggctggcgccgctccgacgtcgtcatctccaccaagctcttctggggcggcccgggccccaacgacaagggtctctcccggaagcacatcgtcgagggcctccgcggctcgctccgccgcctcgacatggactacgtcgacgtcgtctactgccatcgccccgacgcctccacgcccgtcgaggagacggtgcgcgccatgaactgggtcatcgaccagggatgggccttctactggggcacctccgagtggtccgcgcagcagatcaccgaggcctgggctgtcgccaaccgcctcgacctcgtcggacccatcgtcgagcagccggagtacaacctcttctccaggcacaaggtcgagtctgagttcttgccactttacagcacctatggcattggtttgactacatggagtcctctagcttcaggagtactaaccggcaaatatggcaaagggaacgtaccagctgatagcaggtttgccctagacaattacaagaacctggcaaataggtccctggttgacgacacgcttcgaaaagtgaatgggctaaaacctatcgctgatgaacttggtgttacattagcccaactctcaattgcttggtgtgcatcgaaccccaacgtctcatctgtgatcactggagccaccaaagaaagccagatcgtggagaacatgaaggctctagatgtcattccactgctgacgccggaggttctcgacaggattgaggcggtggtccaaagcaagcccaaacgtgccgactcatacaggtgaatgtggtacagcctacggcgtgcagattgagtgacagggagggattcggcttcatccagatggagtttaggcctccccagtgacttgatttcacgaaactatatccatgatttgtgtattctgggcgtcccactctgtgttgctgtgtcccaaacattttccttgtgaacccacctagtggtcacaatactagtctgtctgtcctgtgtgtattctgctttccgattcagattttggaccaatcctgcattgttgcttgcgatcagaaagattgtcgagaaacctg

SEQ ID NO: 14317 - DNA, 793 bp, Sorghum bicolor
  Clone ID: SORBI-28MAY03-CLUS21422_1
gtttaaactttgttaaaaaacgaaattttacgtgtacaagatgtggggactgagacctgtctactggatgtagccacaaagctaagcctccagtcctagataccagtactagtgctgctctccctacactcgctcccccctacgtgctagagagatgtctcgtgctcctacgctcgctgccgctgccgcggtggcggccgtcgtcctcatctgctcctcctcaacggctaccgcggcggacggcaacgcgaggcagccgccgctggccccgggcctgtccttcgacttctacaagcgcagctgccctaaggcggagtccatcgtgcggagcttcgtgcaggacgccgtgcgcagggacgtcggcctcgccgccggcctcctccgcctccacttccacgactgcttcgtgcagggctgcgacgcctccgtgctcctcgacggctccgccaccgggccgggagagcagcaggcgccgcccaacctcacgctgcgccccaccgcgttcaaggccatcaacgacatccacgaccgcctccacaaggagtgcggcggcaccgtcgtctcctgctccgacgtcctcgcgctcgccgcacgggactccgtcgtcgtgtccggcgggccgagctacaaggtgcccctgggtcgtcgcgacagcgcgagctttgcgacgcagcaggacgtcctgagcgggctcccgccgccgacggccgcggtgccggcgctcctcgccgtgctgtccaagatcaacctggacgcgacggacctggtggcgctgtcaggcgggcacaccatc

SEQ ID NO: 14318 - DNA, 1081 bp, Sorghum bicolor
  Clone ID: SORBI-28MAY03-CLUS207_1
tgcggcgctcgcggccgggagccgggagccagcagcaaacagcctttaaccgttgccaaaatagcaaagatggggggccgcagaacgatcgtgttgagcctaatccttggcttactggcagctgccaatgcggtgccctttgatttcttttaccttatcctcatgtggcctggagcatactgcgaggacagcgacaatggctgctgcgtgcccaagtacggctacccggcggaggatttcttcgtcgagttcttccaaaccttcgacgtgtccattaacaagcctatagtccgttgcaggaacggcagccccttcgatgctaaaaagctggacaagatcgagaacaacatcaaccactactggaccaggctcaagtgcccgccaaccgacggcgtgaacgcgtggaagagcgcctgggacaactacggcgtctgctcaggcctcaagcagctggactacttcaaggcggcgctcagcctcaggaagcaggccgacatcctcggcgccctcgccgaccagggcatcctgccggactacaagctgtacaacacggcgaggatcaaggcggcggtggccgcgaagctgggcgtcgagccgggtctgcagtgccgggacgggccgttcggcaagaagcagctgtaccaggtctacctctgcgtggacacggacgccaagaccttcatcaagtgccccaaactgccggcgacgctgatctgcccggcgtccgtcgtcttccacccgttctacacctggatgctcaactccacccccaccttcgactccaagatcctgctccccactcagaccatgctgaactgatttgaccggatcgatcggactcgattccacaagcgttagctagcctggtttgcaatcctcaacagcttaatttaatctgctctgtcaaaccagccggccgagagcaccatatggatcggtgcttttttattgtccccctaaataataaaccatcatgtaatggtatatgtgtaagatcttccagatcgttttttttagtgtgtgagctacatgcatttgcatatacatgtgcaaatgtaatcccaataatgaataaacaagg

SEQ ID NO: 14319 - DNA, 640 bp, Sorghum bicolor
  Clone ID: LIB3481-051-Q6-K1-E4
gcgtccggttcttccaaaccttcgacgtgtccattaacaagcctatagtccgttgcaggaacggcagccccttcgatgctaaaaagctggacaagatcgagaacaacatcaaccactactggaccaggctcaagtgcccgccaaccgacggcgtgaacgcgtggaagagcgcctgggacaactacggcgtctgctcaggcctcaagcagctggactacttcaaggcggcgctcagcctcaggaagcaggccgacatcctcggcgccctcgccgaccagggcatcctgccggactacaagctgtacaacacggcgaggatcaaggcggcggtggccgcgaagctgggcgtcgagccgggtctgcagtgccgggacgggccgttcggcaagaagcagctgtaccaggtctacctctgcgtggacacggacgccaagaccttcatcaagtgccccaaactgccggcgacgctgagctgcccggcgtccgtcgtcttccacccgttctacacctggatgctcaactccaccgccaccttcgactccaagatcctgctccccactcagaccatgctgaactgattaccggatcgatcggactcgattccacaagcgttagctagcctggtttgcaatcctcaaca

SEQ ID NO: 14320 - DNA, 1911 bp, Sorghum bicolor
  Clone ID: SORBI-28MAY03-CLUS1867_1
gcgccggccggctccctctccggcagggctcaggcagcatcctttggaagaagaagtacctcttctccctgaggcctgagcccctccccgcggcgagccaacaagccggcgcacgtcgccacccggggctcacgctcaccaccgatcgagccccaacccatttaataactatatagagcagctagctaggatcgatcattagaaatggcggtcaccgtcgtcgtgaccgccagacccctgtccatcctcttctacatcatcaacgtcacctccgacgaggtttactgggcggagcgcgccgagccggcccagtcccgcaacgacgccgcctacgcgcagctcgtcatcgtcaccatgaaccacgagaactgcgcggagggcgccaagggggacgcccgcgcgcaccaggaccaccgtgcgagagcgaccacgtcgccgggagggatcattataaagacggccttcttaagcccgtgcggaggtcggagcgaacgcgggcccggtcccggtccctggcgcacaaggaacggggtggcccctgcacggcgaccaacccgatcgaccagtgctggcgtgtccgcggcggctgggcgcgcaaccgcaagcggctcgccaggtgcggcatgggcttcggccaccggaccaccggcgggctcgccggcaggatctacgtggtgaccgaccccagcgaggagcccgccaacctcgtcgtccccaggaaaggcacgctccggtacgccgtgatccaggaccgcccgctgtggatcacgttcgcgcgcgacatggtgatcaacctctgcagggagctgctggtgaccagcgacaagaccatcgacgggcgcggcgcgcaggtgcacgtcgtgggcgcgcagatcacgctgcagaacgtgcggaacgtgatcctccacaacctccacatccacgacgccgccccgcgcggcggcggcgtgatcagggactcgaagcaccactggggcctccgcggggagagcgacggcgacggggtctccgtgatggggtccagcgacatctggatcgaccacgtgtcgatgcggagctgcgccgacgggctggtggacgtggtggacggctccaccgccgtgaccatctccaacggccacttcaccaggcacgaccacgtgatgctgttcggtgccagcgacgccgccgtcaaggacaaggcgatgcaggtcaccgtggcgttcaaccacttcggaaaggggctggtgcagcggatgccgcgctgccgccatggcttcttccacgtggtgaacaacgactacacgcactggctcatgtacgccatcggcggcagccagaaccctaccatcatcagccaggggaaccggttccgcgccgtcgacgacgggaggttcaaggaggtgaccaagagggagtacacgccgtacagcgagtacaaggactgggtgtggaagtcgcaggacgacctgttcctcaatggggccttcttcaaccagtccggcggcgagaacgagcgccggttcgacaggctcgacctcatccaggccaagggcggacagtacgccgagttgctcacgaggtacgccggcgcgctcaactgccgcgtcggcaagaagtgctaggccggccgggggtggccatgtgtgtgcatgctagattattattgctttgatttgggggatcggggcgggcgatcgatgcttcgatgcaggcgcagggagaggcgtaagaatcgaattaatgcaaaaggttgtgttgtgtataaactcttgtatttggaaaataccatctgtaaatggtcgtcaacgtactatatactgcttgcctgctagcgacataatcgtccatgtggaaaggatgatggtcgtcaactatcccttcctgattgcatggatcggcaacaacaatggcaattccatcatgttgatt

SEQ ID NO: 14321 - DNA, 580 bp, Sorghum bicolor
  unsure (1)..(580): unsure at all n locations
  Clone ID: LIB3480-017-P1-K1-C6
cccacgcgtccgcttcggcagaggcctcgtgcagaggatgccgaggtgccgctgggggttcttccacgtcgtcaacaacgactacacgcactggctcatgtacgccatcggcggcagcaaggcgccgaccatcatcagccaggggaaccgctacatcgcgccgcccaacctggcggcgaagctggtcacaaagcaccatgacgcgccggagtcggagtggaagaactgggtgtggcactcggagaacgacctcttcatggagggagccaacttcaccgtcagcggcggccagaagatcaacaggaatttccacaagaaggacctcatcaagcccaagaacgggtcctacgtcaccaggctcacgcgatacgccggcgcgctcgcctgcaggcccggcaagccctgctagtactacgtgctacccacaccacgtacacaacagctagctatatatggacggctgacagaagaccattataagcaccgatcgatcgatcgttaagaaacctgtggngtgaattattaacgaccctgtaggttgttgtaacatattagtaacatgcattcgccggccggtctc

SEQ ID NO: 14322 - DNA, 2347 bp, Sorghum bicolor
  Clone ID: SORBI-28MAY03-CLUS662_1
gctcgagctgctccttcccccagctcgcgctcaggctcggtcccgagatcggatcttccgcgcgtcggcggctccctctcggcggcgtccagcgacggaggggcagtcccaggctcggcggccgcgcccgcgcccccccccgccgtcgcccgcccccccccccgcccctcgcccctcgcctccccccctcgcctccgcccgccccgccccgccccccggccctgcggaggagcgcagtcttcttcagtggaatcatcataccttcctgctacaactgagtcattggccaaggctcaagaggctaaggatgccacagagtccatttcaatcctttaccgtgtcattcaggatccatcttcttctgctgatgctctgagaacaaaagaagttgcaatgacaaagcgtccaacctacctcactgtggtgtcccgcgcgctgcagccgcgggggctttggtccctgctccggccactggccgcggtttctcctaaggcaaagactgcaaaaattgtccgtggaataattgatgctgtcgccaagatgccgaggacagcaagatcatgccattattgtctattcaagcgcaccttccaaaaaaacaagttgcccatgggtggttatacaagtatgacttgcaatacaatattgctgttattgaaaccaggttcttccctggccttcgagcaataaatcttgagcatcagctgcaaggtgggccgcacgcttggggacttgctgcggcgcgcggcctctggcctgccggattagcggccccatgtcgccctctgactcacgatccaagcggagtttatcggaaagaactcatggtctccacatgtgaaatcaccatgattggggtgcgcgggcctcttattgatttggatgggaattatgttggcatgaacttttatgcgaagaaaaggacgccattcctgccaaggagtactattgccgaattattgggtaatttcaagatataccggggtgagcttaagaaagttgatagcacaactggaaggagcacaaaaaagatacccacgcgtccggcaacctccaagtcctatttggaaggtggatgttcagactcttttgagctaggtaactccagcagggaagatgagaatgagcgggagtcgtcttcttctagttattcagaagaaaacccaattgagaatgatccattttttcccgagctggcctcccctttcttgccagttgctgatggagatgaatttgggaaatttttaatcaagaaactaacgtctcaaggttatcctttgccagctgtccttgatggaggcatgcgtttggttaatacttttgaaaatgaatttcctgatgatatctggagtaaactcaccaaaaaagttgctgcaaacatgtctcgtattgttgtctctcttgcttcattcaatggagaagaacggatttttgcttgcacaggaatatttgtaggcaatcaatctgacacaaggatcctgacttcagcaagtttggttagaatttctgatgatgaaaacaagattaatgataacttgaagattgttgtacaccttccaaacaaacaacaaactgtagggacattgcaacattatcatctgcattacaatgttgctattgtcagcatcaaaggtttccgttgtcttcgtacagaagaatttcatgatccagggcaaattaagcgtaaggaggtattatctgtaggacgtatcttcaagtcaggcaaattaatggccacaggtgggatattgattgacaaacccagcaaacttgactgcaaagaacttatggtctcaacgtgtagaatcagtaaggcggggattggaggacccctgattgattgtgatgggaatttcattggtatgaacttctacggtaggaaagagactccgtatttaccaagggatacaattatgaaattattgaactattttgatggaaaaggggacgtctctcctgagattatggacaaccaaaacagaaacagatggcctgtgcccaagttgcgttggcactatcctaccttctcccgccatcgcaagatagagccacgtggtcaatatataaaatattaataatttatatccatgcctatctagtcttgaacatgttgaattggttgctatctactatggggtagctaatggcttgattagcttgaactcctcgattgaactcctgtgtgtggtgcaagggcagatctgacaaagcactcttgaactctacgaagttacagattgatttgatctctatgatctatatgttatatatgtctatttatttagaattatatcactctctgtgttccctgttggcaagtcccatacgagaaatgcttcttaacctc

SEQ ID NO: 14323 - DNA, 371 bp, Sorghum bicolor
  Clone ID: LIB3480-029-P1-K1-B12
ccgacgctcatcgcaaggatctgatcttccgcgcgtcggcggctccctctcggcggcgtccagcgacggaggggcagtcccaggctcggcggcgtcgtcggcggctccccccaccttctctcgccagtcgcctcgcgccctcgcctgcgtcctccgcgcaccggccgacgaccctgcatatagagcagagtgttttgtgtgagactaccaaaacttgaaaatgaacaagggaaagatttttaagctagctaagggattcagaggaagggcgaaaaattgcataaggatagcaagggagagggtggaaaaggcactgcaatattcatacagggatcgacgcaacaagaagagggacatgcgatctctttgga

SEQ ID NO: 14324 - DNA, 792 bp, Sorghum bicolor
  Clone ID: SORBI-28MAY03-CLUS990_1
gtcttgtgcggcgcgccgggccgggcagagcgcgtccccacttccgtgtctgcgtgcagtgtgtccgctcctcagcttctcaagcggtagcgtgcgcgcggagatggcgactacggaggcggcggcggcgacaccggtggcgccggcagaggggtcggtgatcgcgatccacagcctcgacgagtggagcatccagatcgaggaggccaacagcgccaagaagctggtggtgattgacttcactgctacttggtgtccaccatgccgcatgatagctccagtttttgctgaactggccaagaagcacccaaatgttgttttcctgaaagttgatgttgatgaaatgaagaccattgctgagcaattcagtgttgaggccatgccaacattcctgttcatgagggagggcgacgtcaaggacagggttgtcggcgcagcaaaggaagagctagcaaataagcttcaactgcagatggcccagtagaccagtaatgctgtaatgaagtagtattcgcctaaataagaagacgcctcaactctgggagaactgtgcttctgtgatggtacttcgtgtgagaactagtgcctctgtgatgttacttcgtatgtagtattaactcttatcctactatgttgtttagtttctggatactgattgcataatgccctgcttgatccagcttttgcttttcataccatgttttatctttcagctgatgtgctataatggtgaatcagagtcatttaatatcttgttatttgccttaatattagtctaatattttttatggg

SEQ ID NO: 14325 - DNA, 2059 bp, Sorghum bicolor
  Clone ID: SORBI-28MAY03-CLUS8168_1
gcgcgggggcgtggcgccccgtccccccggccggccgcccccatcctcgcgcgcgcggctcccgccgcccccctctccccccgtccgccgccgtccgccgcccagctgccccgcccgccgctggccggagcgcctcgcccacgccccgctcccccgcgccgccccgcccccgccgggccccctcgtcccgggccccgcgctcggcggccgcacggcgcacgcggctcgttcccctggaaacagccgggcgacaccgtccgccgagcactatcgaaaaaaaaaaagaaaaccctagccagcggagcggcagaaagcctctgtgatttttcaggtgctatcaacttggaagatggcagatgaggaacaagccccaagctctaggaagagggttgcaggtacccaaatcaacaaggataatcctgagcctgatgatgatggaccagagccagagatgggtgcatttaagaaagccactgaggaagttatggcaacccggagaattgtaaaggttcggcgccagcagacttcatcagctccttcttctaatcctttctctgcaatcagatttgcccccactgattctggtgctcaaacaagcgcccctgtcccaatggcactcaaggacatggtcaagaagggcgtgacatgtgcctgcatggacagcattgcggtgtcgccgcccggcctggccacaggcgctcgggtgttcaaggacacagccaccagggaggaattcaaggatccgccggtgtctcccaagacaagcaaggcaccggacgtggccgccgaagacgacgcctgagaactctccggaggccccagaggtcggagcctcctcccggctcacgctgacgcctcctctgtaggggcccaggctggagccgagggatgcgctctggtagccggaagtatggcgtgtctgacctggtgtcatgaattgtgtttgcatacggttccctgatgctgtttttggaacagtgggtagcctgtcgtacttttgtcattacatacggtcatataatcttagaatcctggagatgagactcgttagatatgtgtgcctgtcctcgaggggcaggcatcatcagcggcaccccttttctcatttaagaatctgtcaagtggtcaaaatgcttttacaggtctgaccggaactggattttcaagcacctcattctcgtttggctcagcctctaaagatggctcaagttctgcccccctatttgggctgaaagctgatggttcttcgttcccttcttttaatcttggtgctgccaacaacgggagttctgctacagcacttgctacttcagcagaggcacccaagaaatttgctatgacagagggtcctgttgaaaccggtgaagaaaatgagaaggctgtatttactgctgattctgctttgtatgagtacctagatgggggctggaaagaaagaggaaaaggtgaactgaagctgaacgtccctgtatctggcagtgagagagcccggcttgtcatgaggacaaaaggcaactaccggctggtcctgaatgcaagcctctacaacgacatgtcactcaaggacatggacaagaaaggcgttacatttgcttgtatgaacagcattggggagtcaccgagcagccttgccacatttgctctgaagttcaaggacacagccaccagggaggaattcaaggatgccgtggagtttcgcaagacaagcaaggcaccggatgtgctgctgaagacgcccgagaactctccaaatgcagcagaagtctgaagctgcactcgggtcacgcttactcgtcctttgtacgtgtcgaggaaggagctgagaaatactttctgttctgttattgcggaattcttaaagaatgtggtgtcatgacaggatgtcctgagttgtgtttgcatacggttccttggtgctgttttttggaacagtgggtagcgtgtcgaactttcattattacagtcataatcttagaatcctggagatgagactcgttagatctattcgctcgttttgtgctccgttatgtttgttctatcggttatcagttaagctaaa

SEQ ID NO: 14326 - DNA, 1047 bp, Sorghum bicolor
  Clone ID: SORBI-28MAY03-CLUS13536_1
gcacgaggcacactcccatcagagcctcgggcgcactcgacatccgtacactgtatagtgctgtctgtcatcctgccaaggcgatggcgaggcggcaacggatggcgtgggtgtcgggggcggccgacgcctcttcgctctatgccgccattttgctgattgcgcctcagcgaacaacgggccctggaggaagccaatggtgatattcttgttttcacttcatcattcaacccaatgaagaacagcatatccaagcgccaggagaagactgtcatgaaactggtagttgatgctgaaactgatagagtacttggtgcatccatgtgtggaccagatgcacctgaaattatccagggcattgctattgcgcttaaatgtggagccaccaaagcgaacttcgacagcactgtcggaatccacccttctgctgctgaagagttcgtgaccatgcggactgtgacaaggcgcgtgagcccgacatccaagccaaagacaaacttgtaagcaagagttgatgttctggggaatgttacacaacacaaatattctggtttcattttggtaattctacgtcattcaaactggaacactgtatattgaaggaatagggtttttgcatgacagtccacacaaaataatgaaagctcaagctgaggcctgaggatgttcatggttgcaaaaaaaaaaaaaaaaaaagatcaaaaaaagaacaaaaaacaaaagaaaaagaaaaagacctcgggttccccggcctcgtcatccggatcacgccgtccaagccaaggtagagtagagtactagagcgatgatccatcggtcgtcggaaagtgtttgttggtgttggatcgagtgggtcaaacagagctcgttgctgtgtatcgtctctgcgaactgcgtacgtgccgcagtgcagagggagcgtagcagtgcaggggatgccatgcactcgtacggagtagtgtagcagctctgaacgaggcgtgtgtgtggctaacttgaaggcctgtcagcctgtgtataacttgtaagggacatcactgccgttgt

SEQ ID NO: 14327 - DNA, 2253 bp, Sorghum bicolor
  Clone ID: SORBI-28MAY03-CLUS1452_1
gcccgacgctcatctcctcttaccagtctctcaaggacactgggcgtggtactcagattgtgagctcaatcatcagcactgcaagacagtgcaaccttcgcacggatgccccactgccccagcaaggggaggagctcccaccctcggagcgtgacctggtcgttggaaaggtgtactccaagatcatggagatagagtcacggctccttccctgtggtctacatgtgatcggtgagccaccgagcgccatcgaagctgtggccacactggtgaacatagctgctctcgaccgcccagaggatggcataatctcgctgcctggcatacttgctgccacagtgggcagggagattgaagatgtgtacaggggaagtgacaagggcatactggctgacgtcgagcttttgaggcagataactgaagcttcgcgtggcgccatcaccgcctttgtagagaagaccacaaacagcaaagggcaagtcgtgacaggtaaattgatttgccagatttcggtcggtcggttccagcgttcaaacaataacgagcttcggtccccgccctcgctccgcggcgctggcacagagaagctgagggttttgtttggattcctgggggaatgcttgaagctcgtcgtgcaagacaatgagctgggcagcttgaagctcgcccttgagggaagctatgtcgagcctggccctggtggtgacccgatccgtaacccgaaggtgcttccgactgggaagaacatccatgctcttgacccacaggccatcccaaccacagctgccttgaagagtgccaagatcgtcgtcgaccgtctcctggagaggcagaaggccgacaatggcggcaagtacccagagacagttgcacttgtcttgtggggcactgacaacatcaagacctatggtgagtcactggcccaggtgctgtggatgattggtgtacggccagttgctgacaccttcggccgtgtcaaccgtgtggagcctgtcagccttgaggagcttggacgtccaaggattgacgtcgtcgtcaattgctctggtgtcttcagagaccttttcatcaaccagatgaacctgctggaccgggcggtgaagatggtcgccgaactggaggagccagcagagatgaattacgtgcgcaagcatgcccaggagcaggcagaggagctcggcgtctcgctgagagaggcggcgacgagggtgttctcgaacgcatcaggctcctactcgtcgaacgtgaacctggcggtggagaacgcgtcgtggacagacgagaagcagctccaggacatgtacctgagccggaaatccttcgcgttcgacagcgacgctccaggggcaggcatgaaggagaagcgcaaggcgttcgagctcgctctggcgacggcggacgccacgttccagaacctcgactcgtcggagatctcgctgacggacgtgagccactacttcgactcggacccgacgaagctcgtgcaggggctgcgcaaggacggccgggcgccgtcgtcgtacattgctgacactaccacggcgaacgcccaggtgaggacgctgtcggagacggtgcgcctcgacgcgaggaccaagctgctgaaccccaagtggtacgaggggatgatgaagagcggatacgagggcgtcagggagatcgagaagcggctcaccaacaccgttgggtggagcgcgacgtctgggcaggtcgacaactgggtgtacgaggaggcgaactccacgttcatcgaagacgaggcgatgaggaagaggctcatggagaccaaccccaattcgttcaggaagctggtgcagaccttcctggaagccagtggcagaggctactgggagacatcggaggagaacctggacaggctcagggagctctactcggaggttgaagacaagattgaggggattgacaggtaaattgatttgccagatttcggtcggtcggttccagcgttcaaacaataacgagcttggaactcttctgtctcatcgagacacttgtacaatgttgtacaaatatgtgtgtgatttatataaacttgtaacatgcaatactggaggatacaatctttaacagagagggtgattggaaagaagcatgagttgaagaagcgaaagcaatgatgtttcgtgtagagagggtttttttctctcacttgtaacttgtttcattcacaaagatgagtatatatatcagcgtcgtgacctgcctttgaaatttcacttgttctttcacttc

SEQ ID NO: 14328 - DNA, 1532 bp, Sorghum bicolor
  unsure (1)..(1532): unsure at all n locations
  Clone ID: SORBI-28MAY03-CLUS10148_1
gcccgcggggcccgcggcagtgtccgcctgatggtagctgcctctatggcactgcgaccgggtccgccgggatgcgccccggctccggggggtgcgttgagcttgcgagcgtccctaccccccgcatcatctcgtggtgcgatgtcagcgctgggatccccgggatgcgcgtgtacagagagatcgcagttcaagtcttccatcgtccccagcttgcggcggagctggtagtaggcccggtcgacggcggccaccggctccgggtggtcctcttctcccagacggccatgggccgcccccgcccaccgcgtgcggccctcgcacgcgctcaagttcctcgcgaggatgcagcacgtcatgcgcgcggcccccgcggggggctcctcgcggacctacggttcgttcggtgcgtcgccaacaacaggggcggcggagagtacgggatcgactcaaaaaatcatcggcgagtcgccggatagctacacgttctcggcgactttattggcagtctcttggatcgcttcacctgaggcaacaccggcccggcgaaactgtgcggcgatggcggcagcgtgaaagtggacgagcgagctagctgcatgaactatcggtctgatctgtatcggtgcaccctgtaccatgtgggagtgatggacatgctacggttccacaagttcaccataggtcgtgcatggacttgcgactttgggtgttcggacaacgaggaagagttccactggcttatcaagtactcccccctccacaacgtgcggcggccgtgggagaaggagaagtgggcggctgccaccggcggcgggcagtaccctgcaaccatgctgctgacggcggaccacgacgaccgcgtcgtgccgtcgcacacgctcaagttcctcgcgacgatgcagcacgtcctgcgcgcgggcgcggagggcggcagcccgcagacgaaccccatcatcgcccggatcgagcgcaacagcggccactgctgcggccgatccacgcaaaaaatcatcgacgaggcagcggatcgatacgcgttcgcggcgaagatgatgggagtctcttggatcgattgatatgagtaacccgcgtggcgtgaagtcggcggcagtcttttccctgtgagaaattcgagcgcgaatggccaagtacgcgaggttatcggtctgtattgtaaccgggcactttaccaaaatggcatgacatgtacatatagcttgccttttttttttctttttatttacttcgtcaaagtttcgggtcagcgatccagcgtcattgtgatgctacgacggtagccggtaggcacgctaacgccgcaaccgtgtgatgtttgtgtttgcctttcttgtgacaatgcgtgatgcaagtgagagtagatacaactttggcttgacatacatgtacaaactggacaactggttgcatatttttgctcgggtaatacttgtgtccanaataaattaatttctagaatatgtcataggtcaaactatattaaatttaagagcaacaatatctacactttc

SEQ ID NO: 14329 - DNA, 509 bp, Sorghum bicolor
  Clone ID: LIB3478-055-Q6-K1-D11
gactagttctagatcgcgagcggcgccctttttttttttttttgtcaaaggcaaaaaccaaagttgtatatctactctcacttgcatcacgcattgtcacaagaaaagcgcaaaacaaacatcacacggttgcggcgttagcgtgcctaccggctaccgtcgtagcatcacgatgacgctggatcgctgacccgaaactttgacgaagtaaataaaaagaaaaaaaaaaggcaagctatatgtacatgtcatgccattttggtaaagtgcccggttacaatacagaccgataacctcgcgtacttggccattcgcgctcgaatttctcacagggaaaagactgccgccgacttcacgccacgcgggggttactcatatcaatcgatccaagagactcccatcatcttcgccgcgaacgcgtatcgatccgctgcctcgtcgatgattttttgcgtggatcggccgcagcagtggccgctgttgcgctcgatccgggcgatgatggggtt

SEQ ID NO: 14330 - DNA, 1376 bp, Sorghum bicolor
  Clone ID: SORBI-28MAY03-CLUS16227_1
gccggccgggccggcggtacgttgctcaactagagaactccgcctcgtcctccgagagcaggccacaggccaggctctggctcacccgctcccctcctcgcatcttcgccgccggcgatcataatggcggcgcccatgtccgccatcgagtccgcgtggcaggtcctgatcgccaacttcaccgagttccagctcgccaccgtcgtcaccttcctgctccacgagaccgtcttcttcctctccggcctcccctccctcctcttcgagcgcttcggactcttcgccaagtacaagatccagaagaagagcaacacccctgcttaccaaaacagatgtgtcttgcgtcttattctgtaccatgtctgtgtgaacctgcctgtcatgattttctcataccctgccttcagatttatgggtcttaggagctctcttcctctaccacattggacggttgttgtatctcaagttcttttctactttgtccttgaggattttatattctactgggggcacagggcactgcatacgaaatggctatacaagcatgttcacagcgtccaccacgagtatgccacaccctttggtttaacttccgaatatgcccacccagctgaaattttgttcctgggattcgccacagtggttggtcctgctcttactggccctcatctgttcaccctgtggctgtggatggtgttgaggatattggagacagttgaagctcacagcggctatcacttcccatggagcccatcaaatttcctgccactgtatggcggctcggacttccatgactaccatcaccgtgtgctgtacacaaagtcagggaactatgcctcgacatttgtttatatggactggttgtttgggacggacaaggattatcgcaaggcaaagaccattgaggagaaagaagggaagaatctgtagattgtggaagctgctcagtgaagacatcagcaagactggcaatagagttgagctcatggaaaaagagatggacgcaccctagaaacactcagtcagttattgcctgacgatccatactataggttgagattttgatttcctgtgtttgctatgatcaagaatgaggtcctggcgaccttggtctgtcatgaactgaatctgataatttgtaatctcctcttgggtttttgctttgcgtttgtttcgactcgggggtgtatacatatgggaatgggatggcctggcagcagtactgaattgaaccatcagagacggcgggagtagctttgcaccctagaaactgtccatgaaagtctgggatggcaaggattgattgcttgtgtactttgttggtaagggatttcggatttgttcttctcgtttatataattttccgggatctcggt

SEQ ID NO: 14331 - DNA, 1312 bp, Sorghum bicolor
  Clone ID: SORBI-28MAY03-CLUS16460_1
gcgctccccccccccgagccccagatgtccccgggccggcccccctcttcacccgtccgttcttaaaccctgcgtaagcctcgtctcgtcctcgttccccaacacaggcccctcctccttcggcaggtcgctgcctccctgcagcctcttcgttctcctctttccgtgtggtggcgcggctccggccgggggaaaaggaaggcgtgggtgcacgtacgccgggaaggagaagaagcgcacgccccgctcgctctgccgctggttcggtcttccccgccggtgacacagacagctcgtgccgtctccaccgcaatcgatccccctgttgctcgatcgctctccttccgcacgcagtggactgtcgccgttgatcctgcaggaaaaaccgggtgggcaaggaagctagtgagcccagggtgaagaagatgatgatggctgaggtggccaaccacagcaaaaggaaccacaccgacagctacttcagtggcactgccgccgccgccgcccccccgccctcccccccggaggagttcgcaagcatgtcctcgaagaagccgaggaataccagcccgagaatcgcgcccgtatcaccaaaggagaagaaggacaagatcggcgagagagtcgcggcgctccagcagctagtgtcaccatttggaaagaccgatacggcttctgttctgcaggaagcatcgggctacatcaagttcctgcaccagcaactcgaggtcctgagctccccttacatgcgtgctcctccggctcccggcgctgtgcctgaggaccccgagcactacagcctccggaaccgcgggctgtgcctggtgccggtggacctgacgctgcagctgacccagagcaatggggccgacctgtgggcgccggcgaacacgaccaggcgcaggtgaggagaagcctgtcggcctcgctccttcaccatcaccaggaggagccggcctgggcctggtctgcccggaggaaaccaagcaagtactactgcatctgcatgtgcgccgtggagtagaatttccaagcgcctgacccgattcgatctcctaacaagaaactaagcaaagcgtcatcgtccgtatcagccaccttgtattatactcctgtactagtgacctgtctggtctctctctccttgtcgccgtatatgtgtgatcatcagctgatcacatgtggaaatggcccagaactgcatgcgtctctgtgtggtactagtactatgtaactatgtgtttagtgacatgtgaattttagcagtctgtggctgtcagcaagtaaagcggcagtttaatgcctgttcctg

SEQ ID NO: 14332 - DNA, 897 bp, Sorghum bicolor
  unsure (1)..(897): unsure at all n locations
  Clone ID: SORBI-28MAY03-CLUS4980_1
aaaccagcaagcaggaacactcacctagctactctctcgcttactagaaggtccaagaacactagagcgacaatggcgccgtcctcctcctcctcgtcggcggcggccgtgctcctcctggcggtggcggtggccgccatgctcgccgcctcgtcgacaccggtgctcgcggacctgacgcacgccaactgcgccaagaacaagaaggtgacggtgcagaacctgtgcagccacgacgtgacgctgacgctggagccgctggcgaacagcccggcgctgttcgccggcgcctacacgctgcacccgcacagccacgccgagttcccggtgtgctggtggacggggcggctccgggcgggcgccgacgccgccgtggtggagttccacgtcggcgtcgacggcgggtccttctacctggccccgaacgcgcagcccgggcagcgcgtcccggtctccgtcacgccgcacgggtcgccgctccaggggagatgccccgccgtcgggtgcgccgtccaggggaggtgctccgtgcaccaggtgcccagcggtgactgccggaacgtgcaggagatgaagatcatctactgcaacccgcacgtgtgatctatctatcctccattgttatgcatgctagctgcgactggtgatgtcgtcgtcgtcgtatgcgtgcagattgttgttgctcagatcgatgtgagccactgcacggcgttagtgtcaggtgtgtcgtcgtcgtgctcgtctaggatctcatgtgtttggaggcactagacagaggttcaagatgtgcgtgtctctttgttcgggttcactgtcaccgagttcaataaatgagtagctttgttttatctcacatnnnnnacacttgcgtatacactgacaaagaaaaaagctaag

SEQ ID NO: 14333 - DNA, 1740 bp, Sorghum bicolor
  Clone ID: SORBI-28MAY03-CLUS46679_1
tctgggcgaccgcgaccatcgcccgccgcacaagtcgagggcaccgccccgcatcttcttcctaagcaagtcgagcgcggcggccacaaaaccccctcccacacgcacccctccgttccgcgcgatcagccgaccgatgtcgtcgtcggcgcccgcaccggccgccatggctgtggacgacgcggaggacgaccagctcgcctccatgtccacggaggagatcatcagggcctcccgtctcctcgataacgagatccgcgtccacaaggacgaactgcagcggtcgaacctggagctggagtctatcaaggagaagaccaaggagaaccaggagaagattaagctcaacaagcaactaccatacctcgtcggcaacatcgtcgagattttggagatgaaccctgaggatgaggctgaagaagatggtgctaacattgatctggactcacaaaggaaagggaaatgtgttgttctgaaaacatctaccagacaaaccatattccttcctgtaattggattagttgaccctgataagcttaagcctggcgatttggttggagtgaacaaagacagctacttgatactagacacattgccctcggagtacgactcacgggttaaggcaatggaagtagatgagaaacctacagaggattacaatgacattggaggactcgagaaacagattcaagagcttgtggaagcaatagtgttgccaatgacacacaaggaccgatttcagaaattgggtattcgtccccccaaaggtgttcttttgtatggaccgcctgggaccgggaagacactcatggctcgtgcgtgtgctgcacagactaatgccacatttctgaaacttgctggcccacaacttgtccagatgttcatcggtgatggagctaagcttgttcgagatgcttttcagcttgctaaggagaaagccccctgcatcatctttattgatgaaattgatgccattggaacaaagcgttttgacagtgaagtcagtggcgatagagaagtgcaaaggactatgttggaattgctgaaccagcttgatggatttagcagtgatgagaggataaaggtgatagctgcaacaaatcgtgctgatattcttgatcctgctctgatgagatctggtcgtctggatcgtaagattgagttccctcatccatcggaggaagcaagagccaggatcttgcagattcactcgaggaaaatgaatgtgaatccagacgtcaacttcgaagagttggcacgttcaactgatgatttcaatggtgctcagctaaaggctgtttgcgtagaagctggcatgcttgctctacgccgagatgctacagaggttacacacgaggatttcaacgaggggatcatccaagtgcaggcaaagaagaagtccagcttgaattactacgcataaggggagcacccagtccttcgtgatcgttcagttgtttgtgacactgccattgtctggataggctaacttatgatttgtattaagcaagcactgtcctgctttgcttttgtatcttactccgtacgagagtatcatattttatctattatattaatcaagtggcatccagatgttttttttctttgcctgccgtttttggtttgtttcttctcctggagagtactcgggccagcatgtttactctggtccagattgttgatgcatctgcatctctgttgcatactccgctctcactgaataattgggatgatttacta

SEQ ID NO: 14334 - DNA, 855 bp, Sorghum bicolor
  Clone ID: SORBI-28MAY03-CLUS16888_1
tgtgcggcgctgccggccgggccgggctcaactcttccaacccaatagagctcactagtagcagaataataatcctgaactgaggagcagtatccatggcgtccccggcggcctcgtgggtcctcttcctcctcgccgccatgaccggttgcgccagtgcagccaccttcaccatcaagaacaactgcccctacacggtgtggccagcggcaacccctgtcggcggtggcacgcagctgaacccggggcagacgtggaccatcaacgtgcccgccggcaccaagtccggcagggtctggggccgcaccggctgctccttcaacagcggcggccgtgggcactgcgccaccggcgactgcggcggtgccctctcctgcacgctgtccgggcagccgccactgacgctggccgagttcaccatcggctacaccaacggcgccaatgattactatgacatctcagtgatcgacggctacaacctggccatggacttctcctgcagcaccggcgtgaatctgcactgcggtcgccctcgctgccctgacgcgtacctctacccgaccgatgacacgaagacccatggctgccgcggcaacagcaactacaaggtgaccttttgcccgtgagaaagggaccaaagggacggcacggtggttgaacgatagtgcctatagtgctgcgtattggccaccatacactttatatggactggtggggaatataataagttgatggataaagagatgatcgtgaatcgtcaacacgcatgtatgtaacgtaatatatacatgcattatctacttacattctaaaaaaaaaaataaatgccctaaaattttaaatacctcttccccc

SEQ ID NO: 14335 - DNA, 801 bp, Sorghum bicolor
  Clone ID: SORBI-28MAY03-CLUS17480_1
tactggaaaaaaaaaaaaaactactggaaaaaacaagccggaaagggaagcaaaaacacggcagttctagttttttttcgatctcgatcgcaggcgcaggcgcaggcagtgcacacacaactcgttcttctcctctcccctcccctcttcccttcctctctctctcttgcatccttcctcgacgggcgatccgccgcaggctagtagaagaaccaaacaaaggaagggggcgcgatggtgtccgccgtgctccggaccatcctggtgacgggcggcgccgggtacatcggcagccacacggtgctgcagctgctgcagcagggcttccgcgtcgtcgtcgtcgacaacctcgacaacgcctccgaggtcgccctcgtccgcgtcgccgagctcgccggccacaacggcgccaacctcgtcttccacaaggttgaccttcgcgacaggcacgctttggaggaaatcttctcgtcccacaggtttgaggctgtcattcactttgctgggctcaaagctgttggcgagagcgtgcacaagcccctgctttactatgacaacaacctcatcggcaccatcacccttctcgaggtgatggctgcaaatggctgcaagaagctggtgttttcgtcatctgcaactgtctacgggtggcctaaggaagttccatgcaccgaagaattcccgctttgcgccaccaatccctatgggcggaccaagcttgtgattgaagacatctgtcgcgatgtgcaccgttcagaccctgattggaagatcatactgcttaggtacttcaatcctgtt

SEQ ID NO: 14336 - DNA, 1443 bp, Sorghum bicolor
  Clone ID: SORBI-28MAY03-CLUS18990_1
caacacccaaggacaaggagtagccgacgcgccagctagtgcccagtgccgcacccagatctccgggagggacttgttcagctactgcagcactgcccgcaatggccaccacggcgaccgaggcggccaaggccgcgccggcggagcaggccaacggcaacgccaacggcgagcagaagacgcgccactccgaggtcggacacaagagcctgctcaagagcgacgacctctaccagtacatcctggacacgagcgtgtacccgcgggagccggagaggatggatgggccaagctagcaacacccaaggacaaggagtagccgacgcgccagctagtgcccagtgccgcacccagatctccgggagggacttgttcagctactgcagcactgcccgcaatggccaccacggcgaccgaggcggccaaggccgcgccggcggagcaggccaacggcaacgccaacggcgagcagaagacgcgccactccgaggtcggacacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgaggggcagttcctcaacatgctcatcaagctcatcggcgccaagaagaccatggagatcggcgtctacaccggctactccctcctcgccaccgcgctcgctctcccggaggacggcacgatcttggccatggacatcaaccgcgagaactacgagctgggcctgccctgcatcgagaaggccggcgtcgcccacaagatcgacttccgcgagggccccgcgctccccgtcctcgacgacctcatcgccgacgagaagaaccacgggtcgttcgacttcgtcttcgtggacgccgacaaggacaactacctcaactaccacgaccggctgctcaagctggtgaagctggggggcctcatcggctacgacaacacgctgtggaacggctctgtcgtgctccccgacgacgcccccatgcgcaagtacatccgcttctaccgcgacttcgtgctcgtcctcaacaaggcgctcgccgccgacgagcgcgtcgagatctgccagctccccgtcggcgacggcgtcaccctctgccgccgcgtcaagtgaaaaaaaacatgcctggccaccgacggcgccgccgccgccgcatcccccatcccaatcatatcgtagacgacgcgcagcattaattattcaccggcttttttttttggctctttcttggccctgtaatcttttcttgtccttctgcttcttcttgggaattgtcgccatctccatacgtaaatctaaatctcgagatggataatactagtatcaatcaattttactactatatactgctcctaccgtggatgatttcgtcc

SEQ ID NO: 14337 - DNA, 446 bp, Sorghum bicolor
  Clone ID: SORBI-28MAY03-CLUS17002_3
gccggccgggccgggacgccttcaatcacaaacaccacatcatccacagaaaaaaacacacacacacacacacacacacatatcatcatccacgcaacactacgtacgtactagcgcgatggcggcatccaacaacaagtccggtgtttcgatgcctgcacttctgttcgtggcactcatgttgacgacggcgcctgcttcttcagtgcgagcgcagcagtcacctagctgtctctagttctactactatatatacactagctactacgtacatgaataacttactcccgtctgtgtgtgcatgcgttgtatgcatgcggagactaattcacatgttacgctgctatacagtggcatgtaaggggagttaagcccacaacctactatatattatatatgcgcaataaagacagttgatgcaaaaaaaaaaaaaaaaaaggccccta

SEQ ID NO: 14338 - DNA, 537 bp, Sorghum bicolor
  unsure (1)..(537): unsure at all n locations
  Clone ID: SORBI-28MAY03-CLUS17002_2
ggccggccgggcctggacgccttcaatcacaaacaccacatcatccacagaaaaaaacacacacacacacacacacacacatatcatcatccacgcaacactacgtacgtactagcgcgatggcggcatccaacaacaagtccggtgtttcgatgcctgcacttctgttcgtggcactcatgttgacgacggcgcctgcttcttcagtgcgagcgcagcagtcacctagctgtctctagttctactactatatatacactagctactacgtacatgaataacttactcccgtctgtgtgtgcatgcgttgtatgcatgcggagactaattcacatgttacgctgctatacagtggcatgtaaggggagttaagcccacaacctactatatattatatatgcgcaataaagacagttgatgtaatgtgtgtgttttgtgttcgtgttgttgtaagtgtgtgctccaaatatgaaatatatactggaaccatattgatttaaaaaaaaaaaaaaaaaaggcccctaaaaaggcccctan

SEQ ID NO: 14339 - DNA, 607 bp, Sorghum bicolor
  unsure (1)..(607): unsure at all n locations
  Clone ID: SORBI-28MAY03-CLUS17002_1
gcggccgcctctaggccggccgggccgggacgccttcaatcacaaacaccacatcatccacagaaaaaaacacacacacacacacacacatatcatcatccacgcaacactacgtacgtactagcgcgatggcggcatccaacaacaagtccggtgtttcgatgcctgcacttctgttcgtggcactcatgttgacgacggcgcctgcttcttcagtgcgagcgcagcagtcacctagctgtctctagttctactactatatatacactagctactacgtacatgaataacttactcccgtctgtgtgtgcatgcgttgtatgcatgcggagactaattcacatgttacgctgctatacagtggcatgtaaggggagttaagcccacaacctactatatattatatatgcgcaataaagacagttgatgtaatgtgtgtgttttgtgttcgtgttgttgtaagtgtgtgctccaaatatgaaatatatactggaaccatattgatttaatgttttccttatattactccaaatattattaagtatatttcgtgcgaaaaaaaaaaaaaaaaaaggcccctaaannnnnnnnnnnnaaaaggccccta

SEQ ID NO: 14340 - DNA, 1203 bp, Sorghum bicolor
  Clone ID: SORBI-28MAY03-CLUS19823_1
gcacgaggcctcgacgtcgtcaccacaagctcaacaagcttcttccacctctcagttcctctcactcgatctcatccctgcttgcagttgcagtatacgtcgtcctcgatcatcaacccaaaagtaagtacatacatccatccatgcccgctagtggctaaccttcctcttcctcccttcctcatctcctcgatcggagcagcacctcgacgtcgtcaccacaagctcaacaagcttcttccacctctcagttcctctcactcgatctcatccctgcttgcagttgcagtatacgtcgtcctcgatcatcaacccaaaatgggctcggagaccaagaccatcacctttgaaggcatcccgttccccgcagagatcaccgccgccggcaaccctctctccctcctagccaccggcatcacggacatcgagatccacttcttgcagatcaagtacaacgcgatcggagtctacctccacagcaacgacgactccgacctcctaacaacccacctgggcgcatggaagggcaagacggcagaggacctcctcgccgacgcggccttctggtcggcgctcgtctcatccccagtcgagaagctgctccgcgtggtggtcatcaaggagatcaagggctcgcagtacggcgtgcagctggagagctccgtccgggaccgcctcgccgccgtcgacctctacgaggacgacgaggaagaggcgctcgagaaggtcgccgagttcttccaggccaagtacttcaagcctggctccgtcatcactttccattttccggcgacgccgggccccgccgacatcaccttcgtcacggaggggaaagcggatgcgaagatcacggtggagaacgagcacgtcgccgggatgatccagaagtggtaccttggcggcgacaacgccgtgtctcccaccaccgtccgtagcctcgccgaccgtttcgccgcgctcctcgccgcgtgatatgctctgccccttttccgatccggctgatggaatcgcagtgcgttgagttcttgaatgtggccgtacgtcctgtagtacgtggtgtctctgtctcgtgtgtcgtttgatttgcagcaaatttgcaagtaataataactaaggctggttttgattcattttgaacgaactcatgctctacactcctgaataaacgcttttcatcactttgccaaaaaaaaaaaaaaaaaa

SEQ ID NO: 14341 - DNA, 1455 bp, Sorghum bicolor
  Clone ID: SORBI-28MAY03-CLUS19921_1
gcacgaggcacaaaaacactggatttgcgttggctactgcgcgcccaccagcctttctgagctagctaactgttcgttgggtgtcctcccctggaccgcgcgtgaaggagtccagtccactaccccctttcttccacctctgctcgatccatttaggtttcaggccagcagcagagagggttcaggccagcgataagcaaagcacaagttgaagggccggccgtaatccgagatggagcatatcgccaggttcttcttcggagtttctgggaatgtcattgcgctcttcctcttcctgtcgcctgttgtcaccttctggaggatcatcaggaagcggtcgacggaggacttctccggcgtgccctacaacatgacgctgctcaactgcctcctatcagcttggtacggcctgccgttcgtgtccccgaacaacatcctggtgtcgacgatcaacgggacggggtcggtgatcgaggccatctacgtggtgatcttcctcatcttcgcggtggaccggcgcgccaggctccgcatgctgggcctcctcagcatcgtcgtctccatcttcgccaccgtggtgctcgtctcgctgctggcactccatggcaacgcccgcaaggtcttctgcggcctcgccgccaccatcttctccatctgcatgtacgcatcgccgctctccatcatgaggttggtgatcaagacgaagagcgtggagtacatgccgttcttgctctccctggccgtgttcctgtgcggcacctcctggttcatctacggcctcctcggccgcgaccccttcatcattatcccgaatgggtgcgggagcttcctgggcctggtgcagctcatcctgtacttcatctaccgaaaaaacaagggccccgccgtgccggccggcaagggagaggccgctgcagccgcggacgtggaggacgcgaagaaggtggccgctgccgtggagatggccgacgccacgacgaccaacaaggccgccgccgacaccgtcgtcggcgacggcaaggtcgtcgccagccaggtgtaggcggccggctgcacgcgcgcgcgcgtgtgctgatcaagcggtcgaagcttcgctggttgggaggatgaacagcctaaaactgaggctgcctactgaattagtttgccggtgaatcggattggtgttgatttctatgagcttttacggttgtcactctgatctcgatctctctcccggaggctcccttaacaatgtagcttctggaacagagctgtgtcacagagctctcaagttgtgtgtgtctctgcaaagtgtgaatttcttttttgctccacctataaaaaaaaaaaactctctctgactgcttatctgccccagtttaatttctctagaaatgcagtattaaactatctgaggaattgctccaactgctagtaatgtgcgtaagcaatgcatcttttgcgtgctcggtg

SEQ ID NO: 14342 - DNA, 1705 bp, Sorghum bicolor
  Clone ID: SORBI-28MAY03-CLUS2073_1
gcacgaggcttggagacaccgccaggcgccagccatcttccggccgctgcccccccaccgggaggcatgaagatgaagttcgttgttggaagttggaacatgatggtctgtgaattagcttttcttgctgagtaacatgggataatttctgcttctcttgtattcagtatattgataggaaatatgttttggtcggttcattcagcaacagtgctcatgcttaacttatgatacgctgtgtgagaaagagtattcattttgcttgatttggacgcattccacctatgccactaaatttgggagattagcagactgcttgttataattgagcataatttaagcatgcaaaatctgaggtgctcctacttcttcttggtgattgacggcatcatactcactcccagcttcttggagacaccgccaggcgccagccatcttccggccgctgcccccccaccgggaggttgaattgccttctggagtcctctcctgttttcagaggaatgtgcatatagcttggagtctgatgagtaatcagtcatgctgatgctacatgaaactgttccttttgtgaggcctagttcttgccgggacctaaaactctctgaaaagagtgcctctgcttttcattgtaaattaggatgcagtgcagtttgcagttcagcagaaggccatcatgtacagaagccacacattgttcacagccacaaagttaacttcactagaaccagccatcttctgtgtaaaagcttaaataaaagaactacaaggcactggctgcatcgattccatgttaatgcttcgcccgatgatgaattccgctcatcacgtaacatagcgatcagtttattcaagcgatataagaaaattattgatcgaggaggaggtggagaaaacctaaaagagtttgtcagtgctggagtgaccgcatatgcactagggtgtacagatgaggggcttagaaaggaacttatggatcttgaagattctggtctagagattgaaggcttagggtccttaggggggaccagctcgaagttcaaagtccactcctttgagattcgtgagtgcattatgtggctcagtatagtgttcatcacaatattgtgcacaccacaactaacagttaccaggtggtctactaacccaccggtgtcagctgacgtcttgcatcagtggaaaggattttgtgctataatcgcaaacgcttactatgtcaaaggaatggcatggttaccagtgaaaaccttgcagctggaacagatggctgtcacaggaaattcagaggaaccatcagtagttgctagccgcatgcagttagttttcagcacattagaggtagtcagcccacagtggccaagagtgtgattatatgaaagcaatacgatcaaacaaaggtctgcagttttattctgaccagaaagatatgcatgttcaagttcaaacctctgtcatggtgcaacaaatgatactcccctatgtaaattttaactcaaatgtcaaataaaaatgttagtgtactttattgtgaagtatttgatttgatatacatatacaacaacttctatgtgcatcaggagttctagtaagtaaataagtattccctactgctccaatagagagagagtcgaaactggggcatggtgatgctgctgcctgtgatgtggcattgtggcttggtatagctgtgaattgcacagtttta

SEQ ID NO: 14343 - DNA, 1409 bp, Sorghum bicolor
  Clone ID: SORBI-28MAY03-CLUS23536_1
aattccgcggtgccatcgatcgagcgatcggcttctcggctcctgcttccagtgcccgacgaggccgacgatggcgcagcgcaaagttgccatggcggccgcagcgttcttcgcccttctcgccgtggcttcgctcctgtgcgcgccggccgccgcggggctggtccgcatggagcacccggccaagaacgacggctccctcagcctgctcgtcgtcggcgactggggccgcaagggcacgtacaaccagtccagggtcgcctatcagatgggcaaggttggggagcagctcaacatcgactttgtcatttccaccggggacaacttctacgagaacggcctgacgggcacggatgatcaagggttcgagcagtccttcaccgatatctacacggcgaagagcctgcagaagccgtggtacctggtactgggaaaccatgactacaggggtgatgcgctcgcacagctgagcccagtcctgcgaaagattgacagccgattcatttgcatgaaatcatttatcgttaatgcagaaattgtggacttcttctttgttgacaccactccgtttcaactcaagtactggactcaccctaaagatgatcactatgactggagaggagtggcacctcgagaaaaatacataaatattttgctcaaggatttggatgaggccatgaagaaatcaactgcggcgtggaagattgccgtgggccaccataccatgaggagtgtcagtgatcatggtgacactaaggagctactgcaactactgcttccagtccttcaggccaacggcgtcgatttctacatcaacgggcatgaccactgcctggaacacatcagcagcagagacagcccaatccaatacttcacaagcggaggcggttcgaaagcatggagaggagtgcaaaataccaacgaagatgacctcaagttcttctatgatggacaagggttcatgtccctccagctagaccatagcgaagcccatttcaccttttacgatgtcgatggagaggcactgtaccattacacgcggccgagcctgaggaaaactgcaggccacctccaagcctccggctatgtcaacgaggaatgaagcaggagcgagaataatcagctagcagcagctggagaatagtgatcgattctgatcagtgtgaaattcgaatgtgactgatgagcgggcatacgtggtctacagaggaagtgtattattagtagcatttatttaagtatgagatgtggttcatctgtcactgccgttggaaactatttggcccatgccaccggttccaaaacatgccctgcaagtttgcacggcggccccatcgctccagtatctagttgctcggtcatattgttcgcggccctcgccatcactccatttgatcatgtaagtcttt

SEQ ID NO: 14344 - DNA, 1333 bp, Sorghum bicolor
  Clone ID: SORBI-28MAY03-CLUS10267_1
gcacgaggcccgcgttcacgagagaagggaggcaaggcaaccaccgcagcagctgcgacctgcgagtgcgagcgaggaggcagcgcaccacgtcctgggcgggcggaggagttggagccggcggcgcggagatttgtgcttgcccggcttggggttgggggtgtgagagagacaaccggcgatggcggcgtccgcgaggccaggggagagagcgaccagcttcaccgtcgcgtgcagcctcctcagccgcttcgtccgccagaacggcgccgcggctgccgagctaggcctcgggatcaaaggcgaggtcgagcagcagaggacgccggcgacaattagcttgctccccggagcggagggcgaggaggccgagaggacgaaggagaccatggagctgttcccgcagagcgccgggttcggcgtcaaggatgctgctgcccctagcgagcaagaaaataaagagaagcctaagcagctcaccatcttctatggcgggaaggtgctggtgtttgacgatttccctgccgacaaggcaaaggacctgatgcagctggccagcaagggcagccttgtggtacagaacgttgttttgcctcaaccttctgcacctgctgctgtcaccgacaaggccgtgccggccccggtcatcagcttgtctgctgctcaggctgatgctaagaagcctgctcgcacaaatgcttctgatatgcctattatgaggaaggcgtctcttcaccgcttccttgagaagagaaaggatcgtctcaatgcaaagacaccatatcagacttctccttcagatgcggcgccagtcaagaaggagcccgagagccaggcatggcttggattaggaccgaatgccgtgaagtccaacctgagcctgagctagtacacaacaacaacacagccaaataagacggcacagcaacctcaccaagcccttctgcagaatgatctgaaatttgctttgccactagaccgagtaccaaaatcataaatatctctcgttgtcgtgttttagtatttcgtttaggtcgtggttttacgccctcttgtcacatagttctggatgtaaagaaaagtagccagccagtcatgaccatcaccgttgagtccgagagcagtttttgtgggggtgttttaacacacggcagactctgaattggccatgctaagtaaaatgatagcgcaaagagaagtatatgtattattttctgaaagccagatccatttggctctagccttgatgtattcagaacaagtgattgtaacggatcgtgagtatcctcatcttgttattgttgttgttttaaaaaaaaaaaaaaggccccta

SEQ ID NO: 14345 - DNA, 1434 bp, Sorghum bicolor
  Clone ID: SORBI-28MAY03-CLUS10013_1
caaaaacctaaaaaagaattagatacggaagaagaacagcccccgccgccgccgatcccataaaaccaaaacctactccccctcccattcccgagcctgccagcccgaccattcggctccgtccgtcgccacgagccgcaggcgaagaagcatcgccagattggtatattgattgatcgatcgattgatcggtggcggaggaaggggaggagggcggcagatggcggcgtgccggggcttcttcgagtgcctgctcaggctgctcaacttcatcctcaccgtcgccggcctcgccatggtcggctacgggatctacctgctcgtcgagtggacgaagatatccgaggacggcagcggcgggggattgacggcggaggtgctcgtctccgcccggccgttgttgggggctgtcgctctcggtgacagcttcctcgacgacctacccaaagcatggtttatttatttgttcattggtgttggtgctatcgtcttcctcgtgtctctgtttggctgcattggagcagggacaagaaacacatgctgtttgtgtttctatgctttcttggtcatattgttgatccttgctgaagctggagctgctgcattcattttctttgaccaaagctggaaagatgtaattccagtggacaagacacataactttgatgttatgtatgactttctgaaggaaaactgggagattgcaagatgggttgctcttggtgttgttgttcttgaggcagtgctctttctgttagctctggttgtcagggcaatgaacaaacctgctgagtatgacagtgacgatgaaattattgcaattggccgaagccctaccatgcggcagccactgatccatgcccaaaatgtgcctgccactggtgttcctgtcccaacactcgatcagcgtgcaagtagaaatgatgcctggagccaaaggatgcgagagaagtatggtctggacacgagccagttcacatacaacccttcagacccaagcaggtaccagcagaatggcacgccacaggctgaagaaaggagtcgatgcactataatgtgaagaatccttcatgaggtcctaccgagataatgaccaatccttcatgaggtcctacgagataatggttttcttgaacgggctacctcagcttgtgtagtttggtgttatggtgttgttcagacttcatagcggtgtgtggaatagaagaatgccgaccatattgtttgtcacgcttgatatgtcttctctgcaaatgttctatgttactgtaattttattgtggatgaggaactgttagccattgacaccatcatctattctgtatttttgggggtttgtttcttgtttgctaatccccttttttcatgtagctctgtttaatctaagatttggttgtgccgtgagactggtagaatctgttttgctttgtgtct

SEQ ID NO: 14346 - DNA, 621 bp, Sorghum bicolor
  Clone ID: SORBI-28MAY03-CLUS7122_3
gccgggccgggaaaaaaaaaacaattaaattccccccgcttcctcccaaacccaaattaccactccccccaaatcctcatttccctccacgagcaccctcgactcgactccatggacggcggcggcgcgaaggcgaagaaggcggcggcggggcggaagctgggcggcggagggccgaagaagaagccggtgtcgcggtccgtcaaggccgggctgcagttcccggtgggccgcatcgggcggtacctgaagaagggtcggtacgcgcagcgcgtgggcacgggcgcgcccgtctacctcgccgccgtcctcgagtacctcgccgccgaggtccttgagctggcgggcaacgcggcgcgcgacaacaagaagaaccgcatcatcccgcgccacgtcctcctcgccatccgcaacgacgaggagctcggcaagctgctggcgggcgtcaccatcgcccacggcggcgtgctccccaacatcaactccgtcctcctccccaagaaggcccccgagaaggctgagaaggccgcctccgctaccaagtcgccccagaaggccgccgccgccaagtcgcccaagaagtagtggtgcccgtctcgtctcgtctcgtctcgtctcgtc

SEQ ID NO: 14347 - DNA, 778 bp, Sorghum bicolor
  Clone ID: SORBI-28MAY03-CLUS7122_2
gccggccgggatgcgatcaccagtcaccaccattcccaccactcaacttctcgcgcccagagcccccaaatttttctccactcgaccgcagcagcagcaagcagccatggacgccagcggagccggtggcaaggcgaagaagggggcggccgggcgcaaggctggcggccccaggaagaagtcggtgtcgcggtccgtcaaggccgggctgcagttccccgtcggccgcatcggtcggtacctcaagaagggccggtacgcgcagcgcgtgggcaccggcgcccccgtctacctcgcagccgtcctggagtacctcgccgccgaggtgctggagctggccgggaacgcggcgagggacaacaagaagacgcgcatcatcccgcgccacgtgctcctggccatccgcaacgacgaggagctcgggaagctgctggccggcgtcaccatcgcgcacggcggcgtcctccccaacatcaacccggtgctcctgcccaagaaggtggccgagaaggcggccagcggcggcagcaaggaggccaagtccccaaagaaggccgccaagtcccccaagaaggcatagagtccagtaagtagggagttcattagcgctgtgtaacatggtagtttagatctgtgatgggatgtgttgtggtctagtttactaccctctgccttatggtatgttcattttcttgctgctaattggaatggttatctagtactcagagctcgttgcatagtaatgttcacccaaaaaaaaaaaaaaaaaaaggcccct

SEQ ID NO: 14348 - DNA, 827 bp, Sorghum bicolor
  Clone ID: SORBI-28MAY03-CLUS7122_1
tgtgcggcgctcggccggccgggtcaggatcacacgcactattctgctccctcgcatccgcagcctctcgagctcgaagcgccgcagcagcaccagcccagcagccatggacgtgagcggagccggatccggcgggaaggcgaagaagggcgcgggcgggcggaagaccggcggcgggccgaggaagaagtcggtgacgcggtccgtcaaggccggcctccagttccccgtcggccgcatcgggcggtacctgaagaaggggcggtacgcgcagcgcgtgggcacgggcgccccggtctacctcgccgccgtcctcgagtacctcgccgccgaggtgctggagctggccgggaacgcggccagggacaacaagaagacccccatcatcccgcgccacgtgctcctggccatccgcaacgacgaggagctcggcaagctgctggccggcgccaccgtcgcccacggcggcgtcctcaacaacatccacattctcctcctgccgaaggaggtcgcggagagcggcgcgggcgcggccaacgagcccaagtcgcccaagaagccggccccgtccaccaagaagacatagaggggtccccatggagtttttcagttgatcgtttgtaggtctgtagatggcacgttctctgagctgtagttccttcatgccttttgctgtttgttcgtgtttgtttgtatgtagtgatgcgtcgcctcatgtgtcgtgtgcctcgatcgatctaagtctaggtggtttgttatgggatctcagtgttatctaagatttaatgagaacaagaggaagtgccttgctttctttgatggtttgc

SEQ ID NO: 14349 - DNA, 308 bp, Sorghum bicolor
  Clone ID: LIB5050-011-R1-XP1-G8
ctccggacgaggagctcggcaagttgctggtcggcgtcaccatcgcccacggcggcgtcctccccaacattcacagcgtgcttctccccaagaaggtggccgagaaggcggccaaggagcccaagtcgcccaagaaggccgccaagtcccccaagaaggcatagagtgctctccagtctcctctcttaagagggaggtccctacattaccattagcgccgtgctggtagattagatcatgtttagtgttactacctctgtaacgttcttgttcttgctgctaattggaatggtttatctagtactagg

SEQ ID NO: 14350 - DNA, 1893 bp, Sorghum bicolor
  Clone ID: SORBI-28MAY03-CLUS2601_1
cgcgtgggcagtccgcccgaggcgcagctcgaatcccggcacgtgagcggcggaagaggggacggacggccatggcttgcggcgggtgcagctgcgaggcggcggtgggggcgacggcgtcggaggcgtacctggagggggagccggtgcgggaggcgcgggagctggtggcggagctctgtcggcacttctacgcgcagggatgggtcacgggcaccggcggcagcatcaccgtcaaggtcaacgaccccgccgtgccgctcgccgaccgcctcatcgtcatgtcaccctccggtgtgcagaaggagaggatggtagcagaggacatgtatgtgatggctgcagatggaaaagtgctttctgcgccagtagcaaagccatggccaaacaagcctccaaagtgtacggactgtgctcctctgttcatgaaggcgtatctgatgagaggagctggggctgtcattcacagccatggaatggagacttgcattgcaacaatgctcaaccctggtgcaaaggagttcaggatgacccacatggaaatgatcaaaggaatcaaaggtcatggctaccgtgatgaattggtcattcctattgttgagaatactccttatgagtatgagctcaccgactccctaagtgaggcgattgcagcatacccaaaggcaactgctgtgcttgtaaggaaccacggaatatatgtatggggtgactcttggatcaatgccaagacacaggctgaatgctatcattaccttttagatgcttgcatcaagctctatcagctgggtattgattggacaactcctgagcatggtccaataaacaatgcaaagagacagcgcagcattttgagctctgaaattcctaatggatgtcgtgctgctgattcatcaaagtgtgttgtactagatattgaggggacaaccactccaatatcattcgtgactgatgttatgttccccgtccgccgtgataatgtacgagaacatctgacttctacgtttgattctgaggaaactaaagacgacatcaaactattgcgcatccaaattgaagatgatttacgaaatgggatttctggggctgttccagttccacccgatgaggctggcaaagaagaggttatcaattcattggttgccaatgttgaatcgatgattaaagcagaccggaagatcacaccattgaaacaacttcagggtcatatttggaggactggatttgaaaagaaagaactacagggagttgtctttgaggatgtgcctgtggcgctaaagaactggcattctagtggcataaaggtctacatatactcaagtggaagtagagaagcacaaaggctgctatttggcaatacaacatatggtgacctgcgaaagttcctgtgtgggtattttgataccaccactggaaacaaaagagaaacaaggagttattttgaggtctctcaatcacttggggtggacagtccatctcaaatcttatttatcaccgatgttttccaagaagctgttgcagcaaaaaacactggttttgaggtgataatctccattcgcccaggaaatgctccacttcctgacaatcatggtttccgcactatcaaatcattcagtgagatctgaggaatatggtgatctgcacatgtctggatatatgtaataagcaggtgcttcctgggttataatattagcccgcggaccagttcatgcagtggtaacagtataacgccgcagcatggcatgtaatactaagttggaatggcgaaataaaaactttggtccgttgtataattgtagctaagctgcaaccggagagtttgcatttccttgttcatcgtctgtaggttgtgactgtgatcatttttattagttactatacgtttctgcctct

SEQ ID NO: 14351 - DNA, 796 bp, Sorghum bicolor
  Clone ID: SORBI-28MAY03-CLUS28860_1
gcggccgagcccgaggcagcagcgccggcagagaccgagaccaagtaagcggaggcagaggctgcggcggctccggttgaggccgaggtggccgtgcccgtgccggctgaggaggccaaggaggaggaggaggaggcagtagcgccggctgctgccgctgtcacagaagccgcgccgccggccgcgcaggaggaagcaccggccgccgcggcgaccgaggagacggcgccggcagaagcggcccctgctcccgaggcggccgccgccgacaagtccgacgagtgagtccagtggcggacgatctagctgtgtcagcctgtcatatgtcgccgcgctggtgcgcagcacggcatggcggcggcatataggtcagctgctttttcgtggactcgtcgtcgcggttcggcgggttcatgttgtgtcgtacttagctacgtggcgcggtgggaccctctagtacctgttgtgttgtgtcgtgacgaataatgtatcagtgtgttattacttgtgtgtcgggttaatgggcccagtgtcggtgctgatgtggcctggctttacagcacatcggtggggccggggctctatgtcgtttaaatatgttggttaatacgtgtaccgtaccatctagtatgtgtttttcttttcgaaaacatctagtatgcatgtgtgtgttgagcgtgtagtatatctgtgtaccatcttttgaagatctctctttatttttccacaatcaaggctgttgttgaagtatgaacttgttactaactagtattaccatgtgggtcatatttgagct

SEQ ID NO: 14352 - DNA, 1827 bp, Sorghum bicolor
  Clone ID: SORBI-28MAY03-CLUS3396_1
gcacgaggcttggttcttgcacaatgaagctaaacgctactgttgagatgatgcctgttacgtatccccgcggcgcgaacctccacccatttgccccaactgatcaggctgcagggtaccatgaaatgtttgacgacttgggcaacctgttatgcacgatcacaggttttgattctttctctttgcaaccaaatgctggtgctgcaggagagtatgctggattgatggttatccgtgcttacctcaactcaagaggagaacaccaccgcgatgtctgcatcattcctgtctcagcacacggcacaaatcctgcaagtgctgctatggttggaatgaagattgttgccgttggaaccgattccaagggtaacataaacatcgaggaattgaggaaagctgcagaagcaaacaaggacaacttggctgctctgatggttacctacccttcaactcacggagtctatgaagaaggcattgatgagatctgcaggatcattcatgaaaatggcggacaggtctacatggacggggctaacatgaatgctcaggttgggttaacaagccctggttttattggagctgatgtttgtcaccttaaccttcacaagacattttgcattccacatggtggaggtggtcctggcatgggtcctattggggttaagaagcatttggcaccgtttttaccctctcacccagtgattcccactggtggctttcctctccctgagaaaaccgaccctctcggtaccatttctgctgctccatggggatctgccttgattctgccaatttcctatgcatatatagccatgatgggttcacaaggactcactgatgcttcaaagatcgcgatcttgaatgcaaactacatggcaaaacgtctagagaaacactacccagttttgttccgtggagtcaatggaactgttgcccatgaattcatcattgatttaagaggatttaagacgactgctggtatagaaccagaggacgtggcaaagcgcctgatggactacggatttcactcaccaaccatgtcatggcctgttcctggcacacttatgattgaaccaactgaaagtgagagcaaggccgagctggacaggttctgtgatgctcttatctccatcagggaagagatcgcagagatagaaaatggcaaagcagatgtgctcaacaatgtcctgaagggcgctcctcacccaccgcaactcttgatgggtgacacatggagcaagccgtattccagggagtacgctgcgttccccgcggcatggctccggggcgccaagttctggccaacaactggtcgtgtggacaacgtctacggcgaccgcaacctcatctgcacactgcagcaggcgtcccaggtgaccgaggaagccgccgcagctgcaactgcgtaatctcgtcgtgaaaccacgatcggcagtgtgcgaaacagcctcaagaagaaactgtaatgcatgcttcctctcggagggaagcagcatttgctcctcgtcctttctgcaatgtatatacttgctcatggaagctcctgattccccccataaagctgccaccttgtaattctgcacttcattgcttctccattcccatgtaaattaaagatagctttttattgactagaattgaatagcttctcttttccgaacagtcaagtagttgacacggaagtatgtcttgatatgttcatatcaaaactgggagaaatggaggtggttggaaatatgcctcagtcccaataaattggattcagtttggactcaaattagacttcagattgggcctcaaactgattgagaccccaatttattgtgt

SEQ ID NO: 14353 - DNA, 1500 bp, Sorghum bicolor
  Clone ID: SORBI-28MAY03-CLUS32714_1
gcacgaggcacttccgctacaaataaaccccccggcatttcctggcctaccatgctcttccccccacttcctgcgagcgtcccgaattaaggtgctcgtgccggaggtggtggttggtggcgaggcgatggccttcaagctgggcaccaaggccgcggcggcggcgtcgcccgcggctgctcaccggggaggtctcgcccgcgggccgcagggcgcgagccgcgtcgccttcggaccagcagcgtccaggaccaaggggctgcgcgcggccaacaactccgtcacgcccatgaggggagctctcgcccgcgggccgcagggcgcgagccgcgttgccttcggaccagcagcgtccaggacccaggggctacgcgcggccaacaactccgccacgcccatggccaaggaagagagggttgatcgaagtgaaacattgacattggatagcattagacaagttttgattagacttgaagacagcatcatattcggcctcttggagagagcccagttttgttacaatgctgagacatatgatagcaatgctttccacatggatggttttgaaggatctttggttgaatatatggtcagagaaactgaaaagctccatgcacaggttgggagatacaatagcccagatgagtaccctttctttcctgaggatctgcctgagccccgcttgccacctatacaatacccaagggttttgcatcccattgctgattctataaatatcaacaaagagatttggaaaatgtatttcgatgaacttcttccaagattggtgaaagaaggaagtgatggtaatgctggatccagtgctgtttgtgacacgacctgcttgcaggcactctctaaaaggatccactatgggatgtttgtggcagaggccaagtttcaggaggcccctgaatcttacatgccagccataatagcccaggaccctgatcagctcatgcaccttctcacatatgaaacggtggagcgtgctatcgaacacagggtggaagccaaagccaagatcttcgggcaagaggtgaacatcggtgctgaggacagcggcagcccaccggtttacaagatgaggccgagcttggtcgctgagctgtacagctacagaatcatgccgctaaccaaggatgttcaagtcgcgtacttgcttaggaggctggattgagcgtgcttatatagctgtaaactgccagatccgaactcgtggcattaagtcagaacatcggtaagtacccattttggcgacaggatagaaaatataccatgtgtggaattgtggcgagaaacaggcagaatatcatgtgggattgtcggttactcgcacctcgtgcgtaatgccagtggttgtagcctgtatggaatgatgggtgggtcactttcttaggcggggtgcccttttgaatcggagtaaattctctcattgtcgttggattttatacagatcctctcaagtgccatctaaattttcaacttgctttgattccc

SEQ ID NO: 14354 - DNA, 2470 bp, Sorghum bicolor
  Clone ID: SORBI-28MAY03-CLUS2418_1
ctactggaccccagcacgaggctcacctcacgacgtctcctcactccacgcgggaagaggcagcgcacctcgctctcctcctcccctacacacccacacccacacccacacccgctcgccctttccattttcgtctacctgtctcccgagacccctgcgccttcttccaaagctctgatctcctgttcgtccttcgaattcgacaatctatctctcttctctcgcgcggtcgtcggcggtcgaccggctccgtccatcgatcctagctgcctgccagggcgatcgtcgtctagctcggtggtggtggtggttgcaccgacgaccggggtcgtcgtcccgtacgtgtgctcgcgtccgccatggctcgcggcgacggcgagctggagctgtcggtgggggtccgcggcgccggcggccgggccgcggcggcggaccacgtggcgccgatcagcctcggcaggctcatcctcgccggcatggtcgccgccggcgtgcagtacggctgggcgctgcagctctccctcctgacgccctacgtgcagactctggggctttcacatgccctcacttcattcatgtggctatgcggtcctattgctggcttagtggttcaaccgttggttggcctgtacagtgataggtgtacagcaagatggggaagacggaggccattcattctgacaggatgtgtgctcatctgcattgctgtcattgttgttggcttttcgtcagacatcggagctgcgctaggggacacaaaggaacattgcagtctctatcatggtcctcgctggcatgctgcaattgtatatgttctggggttttggctccttgacttctccaacaatactgtgcaaggtccagcacgtgctatgatggctgatttgtgcggtcatcatgggcctagtgcagctaattcaatcttctgttcttggatggcgctgggaaacatcctaggttattcctctggttccacaaacaattggcacaagtggtttcccttcctcaaaacaaatgcctgttgtgaagcctgtgcaaacctgaaaggtgcatttctggtggctgtggtgttcctagtcatatgcttggctataaccctcgtcttcgccaaggaagtaccatacagaggaaacgagaacctcccaacaaaagcaaacggcgaggttgaagctgaacctaccgggccacttgctgtgctcaagggcttcaagaacttgccccgcgggatgccatccgttcttctcgtaactggcctcacctggctctcgtggttcccgttcatcctctacgacaccgactggatgggccgtgagatctaccacggcgacccaaagggcaccaatgctcagatctcggcattcaacgaaggtgtcagaataggcgcattcgggctgcttctcaactcgattgttctaggattcagctcgttcctgatcgagcccatgtgccggaaggtcgggccgagggttgtgtgggtgacgagcaacttcatggtgtgcgtcgccatggcggccaccgcgctgatcagcttctggtcgctcaaggactaccacggatacgtgcagaacgccatcaccgccagcacgagcatcaaggccgtctgcctcgtcctcttcgccttcctgggtgtccctctcgccatcctgtacagcgtcccgttcgcggtgacggcgcagctagcggccagcatgggcggcgggcaggggctgtgcaccggcgtcctcaacatctccatcgttatcccccaggtgatcatcgcggtgggcgcaggcccgtgggacgcgctgttcggcaagggcaacatcccggcgttcggcgtggcgtcggggttcgccctcatcggcggcgtcgtgggcatgttcctgctgcccaggatctccaagcgccagttcagggccgtcagcgcgggcggccactgatcgagcacggcccggcccgccggagcacggcacggcgacacaaacccaaccgtgcaagatcgagctgtatgttgaaagttgaacagaataagaagcaggcgaaacgagaaaccattgtgtgcttttgttgtgtgtggttgataggcgtggcgaggtggagtggaggtgaagccgtgaaggtgagcatccagcaccagctggttaccaaggtctggtcaggtctctgtgctagtgctattagctagtgtataaggagcgagtaggtcagttaaggctggtgcgttgtgagtgctcctgtaatctttgtgtccctgtcttgtgtgtgtagctacagcagaccgatcatcaggagaagaacaaaaggattattcgatcaatcaatgtgcagtatagtatagtacagctagacgatcgatgatgttgatgattggtctagagctagagcctactgctactactcctactgtgtattgtccgccgtttgagatttttggtcccagcaatgcaaccgccttgttttgctcccaaaaaaaaaaaaaaaaaaaaaggcc

SEQ ID NO: 14355 - DNA, 473 bp, Sorghum bicolor
  unsure (1)..(473): unsure at all n locations
  Clone ID: LIB3478-054-Q6-K1-C12
gcggcgtcgtgggcatgttcctgctgcccaggatctccaagcgccagttcagggccgtcagcgcgggcggccactgatcgagcacggcgacacaaacccaaccgtgcaagatcgagctgtatgttgaaagttgaacagaataagaagcaggcgaaacgagaaaccattgtgtgcttttgttgtgtgtggttgataggcgtggcgaggtggagtggaggtgaagccgtgaaggtgagcatccagcaccagctggttaccaaggtctggtcaggtctctgtgctagtgctattagctagtgtataaggagcgagtaggtcagttaaggctggtgcgttgtgagtgctcctgtaatctttgtgtccctgtcttgtgtgtgtagctacagcagaccgatcatcangagaagaacanaaggattattcgatcaatcaatgtgcagtatagtatagtacagctagacgatcgatgatgt

SEQ ID NO: 14356 - DNA, 1597 bp, Sorghum bicolor
  Clone ID: SORBI-28MAY03-CLUS45575_1
gcacgaggagcagcacgaggcagcagtgcagcattagaaacagaaaggtagtaggccaaggagagccagtgcttgcggtgacaatgacgggcggcgccaatggcaggagccagcagagctccaggggcaaggcgatgctgctcgccttgggcaagggcttccctgaccaagttctgcctcaggagaaggttgtggagagctacctccaagacagcagctgcgacgatcccgccaccagggccaagcttgagcgcctttgcacgaccactacagtgaggacaaggtacactgtcatgtccaaggagctactggataagcacccagagctgaagatggagggtactccaacactgacaccccgccttgacatctgcaatgctgcggtgatcgaccttggtgcagctgcagctcgtgctgcccttgacgattggggccgccctgcagctgatattacccacctcatctacatctcatccagtgagcttcgtctcccagggggagacgttcacctggctgcccgccttggccttagcccaaacaccgtgcgcacttcccttctcttccttggctgctccggtggcgctgctgccctccgcactgccaaggacattgctgagaacaacccagggagccgtgtcctagtaacggctgccgagaccactgtgctaggtttccggccaccaagttatgaccgtccttatgaccttgttggtgctgccctgtttggtgatggtgcctcagctgtgattataggagcaggccccatggcaccagcagaagatcctttcttagagcttgagttctccacacaggagttcctgcctgggactgataaggtaattgatggcaagattgcagaggaaggaattaattttaaactagggcgtgatttgcctgagaagattgaaagccgcatagaaggtttctgcaggactctcatgaaccaggtagggataaaggatttcaatgatgtattttgggctgtgcatcctggaggaccagcaatattgaacaggcttgagttctgccttgaacttcagccagagaagctcaagattagcagaaaagccttgaagaactatgggaacgtgagcagcaatacaatcttctatgtgctggagtacttgagggacgagctaaagaaaggggcaataagcgaagagtggggattgatcttggcttttggcccaggcatcacctttgaaggactgctagtccgaggggttaagaaaaccttcacaagctaatataatggagggaaaatttacatggcaagcatgaagattaattatatatacacagaaacatcgcataaagagcatagatgtcttggtggcagctgtgcaccacatagtacatcgctagcattttactgtatttatgtgtttctctatcaaacagtgtaaggtacttgagtttgcttcctagacattgtagaaataaggcactatacagcctgttgttccactgtactatgcactgattgcaggattacttcaatactgattgtatgcacgagtgcactaattacagtgcaactatcatattctcaaaggaaaaacagagttattatgcgatgtggcatcaaacacacatt

SEQ ID NO: 14357 - DNA, 1295 bp, Sorghum bicolor
  Clone ID: SORBI-28MAY03-CLUS45699_1
gcacgagcatcatcttatctctttcgccctcgaggtcaaaatcttcagccgaggggagcagaggagcagcaggtggaccaagaatggcagcgccaggctccctgggacttctccacgcgccttccttcgccgcggctaagtgccagccggtggcgagccgggcatccgcgcggcgagcgccgcgggcactgttcgccgtgcgcgcctcggctgctgacgccgccaacaaggacgccgtcctcaaggccttccgcgagaacagggctctcaagataatttctgggcttcagaactttgacaggagcagtgttgcatctgttgtcacagctgcagataagggaggcgcaacccatgttgacatagcatgtgacaaggacttagtaaagcttgccatggatcttaccaaccttccgatctgtgtctcatctgtagatccttcagcgttccattctgcagtagaagcaggagctaaaatggttgagattggaaactatgattctttttatgagatgggcattgagttctcctctgagcaggtactgaagctaacaagagaaacaaggaagatgcttccagagatcaccttatcagtaacagttcctcacacacttagtttgccagaccagatgagacttgcagagctacttgaagaggaaggagctgatataatccaaactgagggtggaaaatgttctagcccgacaaagcctggagttcttggattgattgaaaaggcaacaccaacactcgctgcagcatactccatctctcgggctgtcagcattccagtgatgtgctcgtcagggttaagttcggtgactgcaccgatggcagtaactgcaggagctgctggagttggagtcggttctgctattaacaaactcaacgacgttgtggcgatgattgctgaggtgaggagcattgcacaagcaatggggcttgcgccaagaatcgtctctgaaaacttgagaacagttcgacactagtggccaggaatactgtcactagtagaggctaggaataccttgccatttctgagcaaacttgagcaatcaataagaaagtcttttgacgtggcagtgagtagtgcgaagcaaatggcatcatagaagtgtgatcttgatcaatggaagttgtaagaccccaattttcatgtgtttcttcattaagtgttgttatcttgtcgaactcacaataagcttcagataggtgctgggttttgtgggaacatcgtttgtgcaagtgtgcaacacaaatgagatcttgcacttgcaaatacgactctttcgtttatg

SEQ ID NO: 14358 - DNA, 1641 bp, Sorghum bicolor
  Clone ID: SORBI-28MAY03-CLUS3727_1
gctccggcacgaggctgtaatgaaacatggctcctctgactcctagactggtagttcccatagatgtggaggcgctgccggagatactgtaagaaacatggctcctctgactcctagactggtagtgcccatagatgtcaagaagcagccatgggagcaaaaggtccctctccacaaccgctggcatccggatatccctcctgttgctgatgtaaccgaaggggaattgttccgtgtcgagatggtggattggagtggagggcgggttagggatgataactctgcagacgatctgaaattcatcgagtgctctgctgcccgtagaaatcggcggcctcggcccactgccgggtctggaggggggccagcctcccctggtggtctgcgcgcggtagagatctgcaaccttggcccacttcctggcgacgagtggggttatactgcaatacttgaaagggagaatggaggtggattcttaactgaccacttccctagcacaagaaaagccatttggtatttcgaaggaatttacgcatactcccctcatataccagtggaatgaaagggagaaaagattggctgagacaaggccagatactcttaaactgtgtgaagtcttacaccagaggccccttgctaatttaccgactcctgagaactgcttacttggaaagattcaggaagggactgctgaatggcacaaaatggcaaatgaagcagccagaactattccaggaagggagaatggtggtaattgtgacataaaaaatctaagcagtggttccaaagtttatctaccagtatttgttgaaggagcaaaccttagcactggtgatatgcacttctcccagggtgatggtgaagtttctttttgtggagcaattgaaatgagtggattccttgagctcaagtgtgagatcataagaggggggatgaaggaatacttgcccccagttggtccgacaccactacatgtgaaccctatctttgagatcggtcctgttgagccacgtttctcggactggttaggtgtttgagggcataagtgtcgatgaatctgggcggcagcatttccttgatgcatcagttgcttataagcgtgcagtcctgaatgccattgagtacctttccagatttgggtactccaaggagcaggtgtatctcttactatcatgctgtccttgtgagggtaggatctctggaatagtagactctcctaatgcagtggcaactcttgccatccctacagcaatatttgatcaggatataaggccaaagcacttgagaggaaggctgagaccaaaattgataagacttccagatctcctgagctgctcaaacaatggtcttcctgtcacccaagaccaaagtagtacaagggcgccctaggggcatatatgatctgtaaattgatgccgtatccttctactttatacacaaaaataatcatcttgatatttccaacttccaaggatcatcatgtacttgacctggaatccataatgtagacctttgatttgtcaggcagtcatcatgtatgaggacagagacacctgagtggtgccatattgtctgtgtctgtattgctacaaagttgtgcattaattttactctctagaaatttccttttgccctccttgg

SEQ ID NO: 14359 - DNA, 1104 bp, Sorghum bicolor
  Clone ID: SORBI-28MAY03-CLUS16150_1
gcccgcggcctctcttgccccgggccccacgcaactcccatcccaagcggcggaaagagaaggagagagagagaggagttgcaagttggtgagatggatctgttggagcggaacattaagaagggggacacgacggaggaggagaaggcgcgcaaggaagacgagcggaaggaggaggaggaagtcggtgagaggaagacgaagacccaggaccaggagccgcagccgcaaggccaagtcctcagcctctcgctcgccaacggcagcgccaggtctggaatgttgccgatggcgaacccgtcagctaatcctgcacagcttacgattttctatggtggatcagtatgtgtgtatgactcagtgcctccagaaaaggctcaagcaatcatgcttatagctgcagctgcagcggctgcggcagccaccaaaggcagtgctgccactgctgttaagcctcctatgatgcctgcagccactgttgccccagcagcagttgtttctcctgtgcttacaaggtctccatcactgcagagcacttctgtagcaaatgggcaacctcaggttgttgctgaccctagctcaatatgcaaacttcaggctgatctccccattgccaggaggcactctcttcagcgcttccttgagaaacgccgtgacaggatcgtgagcaaagctccctacagccccgccaagtcgtccgacggcatggagtcaccggggatggaggtgactgcggagggcaagacccagtaacttgaaatgtagggttgccgcggagtccgaacacacgtgaaggctgacgtttgtgggaaggggcagggacgtgctgctgttggctttgtgttatgtggtggcagcagcagcagcagcagcagcagcctggaactgcactaataatgggaccggaacctgtattaccgttgttctgttgtcgcgtgctaggtttattctgaagtgggattcctttactacgcataccgaactgctacgatatgtctgttgtacatcatgccggtcgtttggtctgtctgactttgttacattgatcgtctactagtaatggaggaatgcagtaccacgtatgagtatgtgtttcgtgtgctg

SEQ ID NO: 14360 - DNA, 863 bp, Sorghum bicolor
  Clone ID: SORBI-28MAY03-CLUS17581_2
gccggccgggttgcgaccacacaagtcacatacacacacactagctagctagcaggaccatggcatcaggaaggatgctactcggcgtctgtgccgtgctgttggcggtcgccgtcgcaaacgcggcagacggccaggtggcgtcggtagtcgtgggtctggcaaggtgcgccgactgcacgaggaagaacatgaagtctgaggcggctttcaaaggtcttcaggtggcgatcaagtgcaagaacaccaacggcgagtacgagaccaaggccgtgagtgagctccaaagcaccggagctttcagcgtcccactcgctgccgacctccacggcgccgagtgccacgcgcagctccacagcgccgcgaacgcgccttgccccgggcaggagccgtccaggatcgctcccatgtctggcggcaccttcgtcgccatcccgggcaagacgcactacaacccgtccgcggagtgcgcgtccgcgtttctgtgctccccgatcaagaagcacttcttagaccacttccacaaggcacccgtgccggagcacaagccagtgccggagcacaagccagtgccggagcaccaccccacacccgagtaccaccctcccacgccggagtaccacccatcaacgccggaataccactctccaactccggtgtacgggcagccaaagccaactccgatctaccatcctcccgctgagcactgaatacatcattcagttcctgtgaattcagcatattttgccacggacgccacagctcccacggcatgcatcaggcttgtgttagttcttaataattttattactgcatgtgtgttattagtagttcgcccatggagaataaatgttaaatagttg

SEQ ID NO: 14361 - DNA, 1061 bp, Sorghum bicolor
  Clone ID: SORBI-28MAY03-CLUS17581_1
gcacgaggagctatgggagcagtattgcggttcgttcgctcctataaaagccatggcgcagccggccgggccgggacacacacaagtcacatacacacacacaagctagctagcaggaccatggcatcaggaaggatgctactcggcgtctgtgccgtgctgatggcggtcgccgtcgcaaacgcggcagacggccaggtggcgtcggtagtcgtgggtctggcaaggtgcgccgactgcacgaggaagaacatgaagtctgaggcggctttcaaaggtcttcaggtggcgatcaagtgcaagaacaccaacggcgagtacgagaccaaggccgtgagtgagctccaaagcaccggagctttcagcgtcccactcgctgccgacctccacggcgccgagtgccacgcgcagctccacagcgccgcgaacgcgccttgccccgggcaggagccgtccaggatcgctcccatgtctggcggcaccttcgtcgccatcccgggcaagacgcactacaacccgtccgcggagtgcgcgtccgcgtttctgtgctccccgatcaagaagcacttcttagaccacttccacaaggcacccgtgccggagcacaagccagtgccggagcaccaccccacacccgagtaccaccctcccacgccggagtaccacccaccaacgccggaataccactctccaactccggtgtacgggcagccaaagccaactccgatctaccatcctcccgctgagcactgaatacatcattcagttcctgtgaattcagcatattttgccacggacgccacagctcccacggcatgcatcaggcttgtgttagttcttaataattttattactgcatgtgtgttattagtagttcgcccatggagaataaaatgttaaattagttgggaggttctactttggtgatcgttgtttagctctactttgtaaaagcggattgtgcatcttgtcttctcgtcactgtaagcaggttgcgctcagtcctaggtcgtttgttctgtttcaaaatgtcagtggattacagtaagcttttttgcgcg

SEQ ID NO: 14362 - DNA, 2049 bp, Sorghum bicolor
  Clone ID: SORBI-28MAY03-CLUS2045_1
agcctccaaaaaaatcccagccaccaattcgaaaccctagatctgttttgctccctcgaatcgggaagccgccgcatcgccggagcgccgctaccgcacgcctcttgccgcctgcccctcctctcttctcgacggccggcagcccgcctacttctccgtgggtcgccatgtccgcggccatgtctgccgccgccgcctctgccgccgcctcccccccccaagtgggtgatgctggagcgcttcgtcttccgcatggacgaggccttcccggacgaggacaagttgcccatcagggcttccggcatcacccggtgggaggcccccttcgacatcgccttcgagctcgccgagcccccggcgatctcccgcctctacgcgcggctgccgggctttccggatcccttaaaacaggtgcccttagccatcctggcgagccaccaacatctcgtcctgtttcgcgtctgtatcgaggacgatacatttgatttgcggcaggagctcttcatctacagcgcctcagatgccgacgacccttccaaactcaaagcactgcccgcttgcatggattatcccctccatggtggtggtcgtggtggtcgccgtcgccgtcgccgtcgccctccccctagccaggaccagcgaccgcgtcccacggcggtcagatccatgggcatcttgtgccgagaccaacaggagttcgtggtagcagaactacgacttttcaggcctggccgctgccctgaccctaaggtctgtgcccctgaggtctttgctgacatcttttggctgcacaaactagctgtacccactggtgccatcgagggcaaatggaactcctgccgcgtaccaatccgcagcttctgcaagaagcccgatggtaatggaatccttggcttcgagaaccccgaccctgatgatacctggcaactctgcatctggcagaccgacactgtcattcctgttggccgctggctgtgctggatcgactactaccgtggcatcctcttctgcgatgtgttcggagatcccacccctactgtttccttcctccgcttccctcttgacgagtttcctatccggggcaaaccatccagctggctgtatcgtggcgcgtccgacgtcggtggcagaaagctcaagtttgttgacatcgcccgccatgatggcgttggctatggggcactcaaaaccagtgttggtggcttcaccatcacctgccacaccctctccttagaatccatggagtggaagaaggactacacggtcacctccaaggagctgtggtctgcaaacgccccaaaggacctccctcgccacattctcatgttccctcaggtggacatctacaggccacatgtggtgcacttcctttgctgcgactatgagtacgtgatgatgaagatgtgggtggtcaccattgacatgagcaccaggatcgtggagtcatgttctcagtatctcaatgggttggcggaccttcacactgacaagattgagttgacccaagtaaagtctgcctttcccttgccattcctttcatctgagttctccaagttcctctcaagtgccagaccctgggcacctgctgcacgggtccttactagagcttccgtcacagcaccctctgcagcaagcttcaagacacatggtctggtggacgtccttgtatgcagtggcagaccctgtacacctgccctacgggtgcttactagaggtttgttcgcagcaccctcttcagcaagcttcacgccacggggtctggtggaggtcctgtgatttgcccaggctcgattcacgagcttggtcggccacagattgcatgggagaaggatatggatcgagtcatgtctgcctgcatcactttcatgcatcactttgtggtgtcttcttttatgtattgtatagtcattataaatagcgtcattgtgcggatgtgtcacttcgtccttgaacttgcccgtgtcataccaagtttgcatgcaaaatttgatcgctaagtaacagtatgacaatctaaagtacattggaatacattacagaacttttgtt

SEQ ID NO: 14363 - DNA, 1745 bp, Sorghum bicolor
  Clone ID: SORBI-28MAY03-CLUS2674_1
tgctaaaggcttaaaaacgcgctgtgtgcgtggccggagcacaaaagccggcttctcccccgaccccggcgcccccaccacggccgccgccgccgccaccggctcccaccgcccagcgcaacccgtcagctctccaccaaccagataccctcacggatccactcccacctggagcctgatccggggggagtcggaggggagatcgaagcttgagcagagggagccaaaatggtgaaggatacgcgctactacgacgtgctgggcgtggacccgtccgccaccgagtccgagatcaagaaggcgtactacgtcaaggcgaggctggtccaccccgataagaacccgaatgatcctcaggcagcggagaagttccaggaactaggagaagcataccaagttctcagtgaccccacacaacgccaagcctatgactcacatgggaaagacggcatctcaacggaaggaattattgatccagcagcgatttttgcaatgctatttggtagtgagctttttgaggattacattggtcaactggcaatggcatcaatggcttcacttgataattttggtgaagatgagcagattgatgcaaaaaagctgcaagagagaatgcaggctgttcaaaaggaacgggaagagaaacttgcagagtcactgaaaaaccggctacacatttatgttcaaggaaatagggatgaattcatccagcatgctgaagcagaggtgtccaaaccgtccgaatcagcatatggaattgttatgttgaacactattggctatgtatattcaaggcaagctgcaaaagaacttggaaagaaagcaatgtttttgggggttccatttattgctgaatggtttagagacaaagggcattttatcaaatcccaagaaacagctgccacaggtgcaatagcgcttatgcagttgcaagaggacttgaggaagtatatgagtgccgagggccagtacacagaggaggaacttgaactgtacatgcggaaccacaagaaaatcatggttgattccttgtggaagcttaacgttgcggacatagaagccacattatcccatgtctgtcaaatggtacttcaagacagtagtgccaggaaggaggaattgcgccttcgtgctaaaggcttaaaaactttaggaagaattttccagcgggtggttaagctcaaccctagcgagggagaaacatcacaagtgaagaatatagacaacatggacgacaatgatggcagctcccctgactcatccccaaagagggaggcacagttcactcctaatcagcctcctgtcccgagcccatatgtggaggcacctcatgttaacggagtctattgtccgttcccaatgccagcagctccacctggtgcgcagagggatcgaatcccatgagtccagatgaaatatgcttgttctattggctctgtttaacattgcctgtaatactagatcatttgcatgattcgccgtttgaacctgaagtagaggaaacacaggagtctgtgaggtgtcctctgcggtcccgttattttggtcgtgtatgcatggactgttgatagcagccgtgtcttgtgtacaggtgtgttttgctatttgttgaccgatgcagctgtaggtgtacatgttatgatgtccattattattgttctgttgtcggcctgttctattttagcataaacagtggtcacatttgcatccctgggaaatgaaatgaagttctagtcattttctcc

SEQ ID NO: 14364 - DNA, 1091 bp, Sorghum bicolor
  Clone ID: SORBI-28MAY03-CLUS18987_1
gccggcccgggccggccggggcgggcgcatctcctatagtagccctcctagctagatcattggatacatagccaggccaacagatcggcttccggcatgggttccaagcagcagatcggggtggtcgtcgtcttgtcatgcttcattgccatcagtgctctcgccttccgtccctgcgcagcctggtcggatgccggcgccacctggtacggccctgccaacggcgctgggagcgatggtggtgcgtgtgggtaccagggtgccgtccaccagccgcccttctcgtcaatgatcaccgccggcagcaattccatctaccaggacggcaagggctgcggcacctgctaccaggtgaagtgcaccggacaccagtcgtgctccggcagcccggtgacagtggtcctcactgaccagtgccccggcgcgtgccagtccgagcccgtccacttcgacctcagcgggacggcgttcggtgccatggcgaaacccggccaggccgaccagctccgaaacgtcggccgcctcccagtccagtacactcgggtgccgtgcaactggaacggcgtggacgtggccttcagggtggacgccggctcgaacgccaactacctggccatggccatcgagtacgaggccggggacggggacctgcgcgccgtggagctgcagaatggcgcggcggcgtgggcgcccatggagcgctcctggggcgcggtgtggcggtaccagtcgtccggctccagtctgcaggcggcccccctgtctgtccgcctcacctccggctccggcaagaccctcgtcgccagcggcgtcatccccgccggatggcagcccggcaacacctaccgctccgtcgtcaacttcggaggaaactgacggacgatattatatatattaattaattgttatacgtactcatgttatgtctcaaatccaaataagatgaagcatgtggcctgcatgctagatcatatctgatcttgtctctgttgatgctgatcagccaatggataattgtcgatcggaagctcaacatatataaatataatataatgcaattaccgtaaaaaaaaaaaaaaaaaaggccccta

SEQ ID NO: 14365 - DNA, 2220 bp, Sorghum bicolor
  unsure (1)..(2220): unsure at all n locations
  Clone ID: SORBI-28MAY03-CLUS219_1
tttgtttaagtctgtgtctaacaaaccaccactagagatcttgagaagctgtttgatgaacgtaggaaaatgcttagagaccatattttggctggtgcttctgctgttgctttaacatctgatatttggagtggtaatgctaaggaagactacattacagttgttgctcattatgttactgatgattgggtcttgcagaaaaaggttataggttttagattgattgattgcaaacacactggtgataatattgctgaaaggattggtgctgttattcaggagtttggtttgattgataaagtgtttgctattactttggacaatgcttcttctaattcaaaagctatgaagaaattgaatgttctgtttggtgggtatttaggtgctgaccctgtttctgatgatgatgatgctgagaattttcttgatgctatttacaatcttgctcaccagagatgtgtttgtcatataataaacttgattgtcaaatctggtttaaaaagattcaaaccatacttagaggatttgagaactgctatcactttcttgaactcatctaatcatagaattgctctgtttaagaacttatgcattgctaaaggtattaaacctaggaaatttggtgtggacatggatgtaagatggaactctacatacttaatgctccaacatctttgtgaagaaccataccctggtgttttcaaaacattcattaatgctaactttgggagtgaagacctattaactactaggcatttcacaattgctaaacagattttgcaatttcttgaggtgttttatgagtccactgtcattttgtctggtgtttactatccaaccagtccacttgttatgcatcaactacttgaaattgcaatccatttgcaagctgctgatgaagatataaacctgtatacaattgtctatcctatgaaacaaaaatacctaaaatattggaaacaaatacctatgttgttctccattgcatttgttcttgatcctagagctaaaatgataggtctttataataccttgacattgcttaaagactttgctggttgtgattactcttcatactatgctgatgttagatctgaactagaaaaattgtttgccaagtatgaaaagaaatatggtactgcaagagttgttagagaacaaccaccaagcattataggtaagaggaaaaatgcaacatgggacagaatttttggtggtgcaggttctgtggtacaacctggtgttgtttgtaacagtgctatgtctgaactgtcatcttaccttgacagtgacagactaacagagtatgatgatagttttgatatactgctctggtggaaagaccacaaactaaccttcccagtcctatccatattggctagagatgttctgtctgttcctgcttccactgtttcttcagaatcttgttttagcttaactggaaggatactcgaggagcgtcgtcgacgattattgcctgaacatgtagagatgttggtttgcataaaggattgggaattaggagatgcaagggaacaacattctctggtcactgaacataaagaactggctgagcgctttgacaaaatttctattgttgatggtgcacaaggtacaactgcagatgctggaggagtaccagcaccagctggtgttgcttcacaaggagcaactccttcatctgttcaaggaagaggacctggtgcttctgctggtagaggtggaagaggagctgctgctgctgctggtaatagaggtggaagaggagttgctgctgctggaagagggcaacctgctgctggaagaggtactgctgctggaactggaagaggtactgctgctgctcgaagaggagcttctgctggagttagggcatttggacttagaggaacaaggcgtggctaaagctgtgaggtgagttagggcctttggcatgctggacttttgctgtgtttgtgacttgtgacttgtgagttgagaggtgaaacattgtgagttgacaggtgaaactgggtgagttgagagtcatgtggttgtccattgaacaatatgaacctgttttgaatgaaaattttgagctgtgtgtttgtgctgtactcttttcctttatggggttttatctcccaagggtgagttttacccataaaggtttttaatgaggcagcattgcacacaaacatacagctcaaattccctttaaaaaaaaaaacaaanaaaatt

SEQ ID NO: 14366 - DNA, 1052 bp, Sorghum bicolor
  Clone ID: SORBI-28MAY03-CLUS23950_1
gtttcgcacgaggcgaacaaccaactgcttccttcccttccgcgccgccgcctacaacgaccatcttcacgtgacctatctctctccgcctgaagtgttcacggctccatcctctcgagagtctaggcccatctcccgaagccgctagcgcagacaacgaccctacctatggatacgaagaagaagtcggcccccgccgccgccggagccgcggcgccgccgccggctagcgggtacttcagcaccgtcttctccgcgtcgcctgcggggagcgcaaatgacgcaaagcagtcggacttgtacacgatgctgaacaagcagagctccagaggacagaatggcagtagcattacagatggcaaatcccatggccgccctacttacaaggatggaaaacagtcttatccaaatgagtcatcagaatccccttactttggctcatccgtgcattacggtggtcgggagttctacagcagcactttacagaagcaaccagccaacgagccacatacaaactacaaggaggacaacccggatggctctgctactagaggtgattggtggcaaggttcgctgtattactgaacaatctgctgagaactctcctttctgtgatcaaggaataaaaggagtagagctgagcttgctttgttgtagtgttgggactgttgatgcgagccgtcaggcatggatcgaaagtaatagttgtaattgttgaaagttggcgtcgggactacatccatccggtcggtggaggcagtatttagatgcatcatcacacctggacagatgtggacgtaggctgtgtccttttgtattcatgtttccccctgtgttctcgtggtttagttgcagttctgaacttactaatgggctagtaggtcagcctgtggtagttttataaaaccagttgccaaagagtcgcagactcgtaggatcacctgcaggctacatgtaccatgtgcatcctttgccgctatcgttcggaaagatttggagtgtgcatactatgtttctactattcttatttgtacccgtgcactcacaaagct

SEQ ID NO: 14367 - DNA, 1526 bp, Sorghum bicolor
  Clone ID: SORBI-28MAY03-CLUS24563_1
acagccgcaccatcctctccattgctccattccatcacatccaccacccacacccaaaaccctactccccccaggaagcaatggcttcctccacccagggtcaggtcatcacctgcaaagcggcggtagcgtacgagccgaacaagccgctcgtgatcgaggacgtgcaggtggcgccgccgcaggccggcgaggtccgcgtcaagatcctcttcaccgcgctctgccacaccgaccactacacctggagcggcaaggatcctgagggtctgtttccttgcattcttggccacgaagctgccggagttgtggaaagtgtcggcgaaggagtaactgaggtgcagcctggggatcatgtcattccttgttaccaagcagaatgcaaagaatgcaagttttgcaagagcggaaagaccaacctctgtggtaaggttcgtagtgccacaggcgtaggtgtcatgatgaatgatatgaagagcaggttctctgtaaatggaaagcccatttaccatttcatggggacatcaacattcagccagtacactgtggtgcatgatgtcagtgttgcaaagatcaacccacaggcccccctagataaagtctgcctgcttggttgtggtgttcctactggtcttggagcagtgtggaatactgcaaaggttgaagctggctctattgttgctgtttttggccttggcacagttggacttgcagttgctgagggtgcaaaagctgctggtgcttctcgaatcattggcattgacattgacaataaaaagtttgacgttgcaaagaactttggagttacagaatttgttaacccaaaagatcatgacaaaccaatacagcaggtcttagttgatcttacagatggtggcgtggattacagttttgaatgcattggaaatgtttcagttatgcgggctgcactggaatgctgccacaagggctggggaacctctgtcatcgttggcgtcgctgcttctggccaggagattgccacacggccattccagctcgtgactggtcgtgtctggaagggaacagctttcggtggcttcaagagccgaacccaggtcccatggcttgttgataagtacatgaacaaggaaattaaggtggacgagtacattacccacaacatgaacctggctgacatcaacgacgcgttccacctgctccacgaaggtggctgcctgcgctgcgtgctggcaatgcaaatttgaaattcctaagcaaagcagtttgcatatatgtcgtcatagacttcttttggaactagaactcctttgccctcgtttgtcctgttggaactagagctccgtttgcctcgtttgctgtgtgctaggtatgtggtacttattgatctgtatcacggttgtaaacaagtgctgtttctaaaataagtttatgcgtgtcaaatttcctggcatggataattgaacggtatcaagcatccgtcattttatctagcttagcccaaatgagacatgtaaaacacggttgaccaaagggtggagtataat

SEQ ID NO: 14368 - DNA, 1138 bp, Sorghum bicolor
  Clone ID: SORBI-28MAY03-CLUS25591_1
gcacgaccccacaccgagacacagcaaaggtaccgaaaaccttagcgccactcccgaagtcttcgagctcggcacatgcaggaaagttaccaaaaaccttagcgccagtcctgaagtgttcgagcgccggcactcccggtttcgttggatccacgcctgcagccaaagggcagcgatggcttctccgcaggcgcatcctgccagcgaccacgccggcgagaccgaggcccgtgccgaggagaagacgggtcaagtgatgggtgcggcgcaggcgaaacggcgggaggccaagcacaagatgtccgccgccgcggaccgcgccatgggggctgtcctcgacgccagggaggcgaccagggagaaggcgcgcgacgccgcggaccggaccatggggatgggccacgacgccagggaggccaccagggacagggcgtgccgtgccaagcacgcggcctcggactcctcaacggccgcatgagaatgggccgccgaggccagggaccgcgcccgcgacggcgcgcagcagaccgggagctacgtcgcgcagacggccgaggccgcgaggcagaaggcggccggcgccgcgcagtacgccaaggagaccgtggtggccggcaaggacaagaccggcgccctcctgcagcaggcaggggagaaggtgatgaacacggcggtgggggccaaggacacggttgtcagcacggcggtgggagccaaggacgcggtgatgaactcgctcggcatggccggcgagaacaacgacggcaccacaaccaccaacgccggcaaggacaccagcacccgcaagcctggcagggactattagaagacgggtggacgacagccaaacttacttctcagtgtttccgtttcaaaagtttctgatcccatcaattaggttcaaaagtttccatttcatttcaagatttcagtgtacgagtcacacttaggtttgatttcgagttggtgtttctctatttctgtttctgtggaggctggaggctgtaacttttcagggcaggggtcgtttggaattgcgtcaacactgaagcctctgtgcttttcgtctcaatgatgtatatatgaaataataaagttgcaaagctgttgttttgttttcaaaaaaaaaaaaaaaaaa

SEQ ID NO: 14369 - DNA, 1689 bp, Sorghum bicolor
  Clone ID: SORBI-28MAY03-CLUS34739_1
cctcgatcatttcttcaccattgagtggtcttccttgtaacttgcgatatgcgccatccatctttatttttgacaatagaataacatgtactgcctttttattacgtttactcaagctcttctcatgcacctttcttctccaactctttgtggcctggatacaggttcaatagttactgttgatcctctcgatgctagcaggaacgacggtgactggtgccagcggcgcgccgtggccgcccttctcctcttcctccatctcctccccctccttctcctcctgctcctacatcgcctccccttcttctctctccaatgcccttccgatgcggtggcgggcggcgcggcctggtagtgcggtaggcccgatgcggcaaggcggtgcctttgccgcccccttccccaccctctcgtcctctcccatcaacttgcttgcaccccggcactgcttccttgctgcggtgcaggcctttcctgctcaccgaaacccgagctcttgtgttgtatgctggtgaccactcctgtgagttccttcttcctcgtctgcaccaactacagcggtttagctctactcttgaatcagttatagaggattgccatgcgttacgtcatacggctattgtgcttttactcagatcacttctcatttttaggcttgccttgcgtcatacagctattgtgcttttccttagttcacttctcatttttacgctcatcttgttgtaccgcaattttgctatgtgttctattgcagtatgtgtcatatcaagttgtcttgttcctgttcagtttcactgtgacgacgggcatgctaccatcgctctttccgccttccttacatcatcgtcgggacacaggttcttttctgatgatcttttctagcgtcacttcctctatttttgtctttgttcctatacctcaattttgtaatgtttgattggtgttttatttaccgttgcctatagcccaggcacagctattatatctatcaataaaacaacaaatttgcacgaagcatctccctttcattgtcgtcttgtttatggttatactgttacgactgccctttattgacactgtatcactcccttccctaatttggggctaaagcaaaattacgtcccaccgagtggtctgctgcaggatttcgtaacaataaagtgaaggtccagaaatgcaagggagtgagatggcttatcctttgtccatcatcttagggtgtcagctaatatgtagcgctcaacctttgttccagttgctacacacataagcttccaccttcttcacatgtgctctcatcaaaactatgtcatctccagttttcttggtaaccttttctatccacgtgacttcaggtatgttacggtggcgtattctgcattcctttggtcatcggcgggggttcttacctgctctggtcagctgttttgggttactttgtcttcttttgctcttagtacccataccttagttatgcattgttttagtggtgttatctttacagatgactgcaacacagcctttgctatagtgcttatccataaaataaaaaggtttcctgaagcaaattcctgaccttgtctgtgtgtgtatatatattctattctgacctatgtaaaaataaataaaatatttcagttcctttgtatgacatatatattaaattcctatctctgagcctatttccat

SEQ ID NO: 14370 - DNA, 756 bp, Sorghum bicolor
  Clone ID: SORBI-28MAY03-CLUS1773_2
gccggccgggccgggaattcgcgtcaccgcgtcccgagagcgcgaatcattccgcgcgacgcaaaaccctagcccatccaccgatccctgtcatggcggccaccaccagccaggcgagcctcctcctgcagaagcagctcagagatctcgcgaagcacccggtggatgggttctcggctgggctggtcgacgacagcaacgtcttcgagtggcaggtcaccatcatcggaccgccggacacactatatgatggagggtatttcaatgctatcatgagcttcccccaaaattacccaaatagcccgccatcagtcagattcacctctgaaatgtggcatccaaatgtttatccggatgggcgcgtgtgtatctctattcttcatccaccgggtgaagatccaaacggttacgagcttgcaagtgagcgttggacgcctgtgcacacagttgaaagcatagttctgagcattatatccatgctctctagtccaaatgacgagtctccagcaaacattgaggcagctaaggaatggagggagaagagggaggacttcaagaaaaaggtgcggcgcattgtgcggaaatcacaggaaatgttctgaagaaaatgggggtactgggaagttaaccatgccatgtcaggctgcaaaaattttgctgccaatctcaaaatgctcatctgacaccagtgtcttgtgtattttccatttagcgcctgtcccattggtgatagttgcctccagaatgcattaggac

SEQ ID NO: 14371 - DNA, 925 bp, Sorghum bicolor
  Clone ID: SORBI-28MAY03-CLUS1773_1
ccgcgtcgagaacccggccggccgggccgggaagcaaaaacctgtcatcatcaacaacagctagctagctagcaacaccaccaaataaacatccacctcgctaagcgatcgagaaaatgaagaccaccatggcatcagccgcgctgctcttagtgctagccctagcgctagtgtccgccccactcacagcagaggcaaagaagaagaaaccggcagagagcgtggccgccgccggcgaggcggcggaggcgaagaaggtccaagacagcttctgcgccacgctctgccaaggcaggaaggggatggacctcattgtctgcaaggagtcctgtgagctctcccagcgctccaacctggtgctgtacgggcggatccagtgcaagggcaagtgcaccgagcagaagggcatcactgcgccggcgatgaaggtctgcgaggagcagtgcgacaaggactacgtggtgaaagcggcggaggtcaccgctgcatgcaacaagacttgcgacaaagagaagaacaagatgctcagcgacaattgcaagaagtcctgcacccctcctgcagcttgaagcatgcacttcaatcttctgctgcgtggcattcaactcaagccgatgatcgtcgtcactggctagccgcgtgcaacaatcatttttgatgggtatatatatggacgaaactatatatacccctattaatttggtatttttctaagctaattgtttttgtatgttcaaaatatatcgccaatcgatattgatccatcgatgatatatagttttatggactgctctgtagcaggccaatgtaatgtcacgcaaataagcatttgtatttttgattgtattgattgaatgaatgaatgaagtcagctggtagttgttatcacttaccagtgaaattgtgcattgttagtgtaatgagg

SEQ ID NO: 14372 - DNA, 604 bp, Sorghum bicolor
  Clone ID: LIB5047-002-R1-XP1-H6
gccggccgggcctgggaagcaaaaacctgtcatcatcaacaacagctagctagctagcaacaccaccaaataaacatccacctcgctaagcgatcgagaaaatgaagaccaccatggcatcactgcgccggcgatgaaggtctgcgaggagcagtgcgacaaggactacgtggtgaaagcggcggaggtcaccgctgcatgcaacaagacttgcgacaaagagaagaacaagatgctcagcgacaattgcaagaagtcctgcacccctcctgcagcttgaagcatgcacttcaatcttctgctgcgtggcattcaactcaagccgatgatcgtcgtcactggctagccgcgtgcaacaatcatttttgatgggtatatatatggacgaaactatatatacccctattaatttggtatttttctaagctaattgtttttgtatgttcaaaatatatcgccaatcgatattgatccatcgatgatatatagttttatggactgctctgtagcaggccaatgtaatgtcacgcaaataagcatttgtatttttgtttgattgattgaatgaatgaatgaaaagcatgctggcagttgttatcaccta

SEQ ID NO: 14373 - DNA, 346 bp, Sorghum bicolor
  Clone ID: LIB3478-047-P1-K1-F12
ggataagcttgggtatgcagatgttgttgaggaaatctctgttggggagggcaaggttgtgaagatccaaacggttacgagcttgcaagtgagcgttggacgcctgtgcacacagttgaaagcatagttctgagcattatatccatgctctctagtccaaatgacgagtctccagcaaacattgaggcagctaaggaatggagggagaagagggaggacttcaagaaaaaggtgcggcgcattgtgcggaaatcacaggaaatgttctgaagaaaatgggggtactgggaagttaaccatgccatgtcaggctgcaaaaattttgctgccaatctcaaaatgctca

SEQ ID NO: 14374 - DNA, 448 bp, Sorghum bicolor
  Clone ID: LIB3480-035-P1-K1-A9
caacaacagctagctagctagcaacaccaccaaataaacatccacctcgctaagcgatcgagaaaatgaagaccaccatggacctcattgtctgcaaggagtcctgtgagcactcacagcagaggcaaagaagaagaaaccggcagagagcgtggccgccgccggcgaggcggcggaggcgaagaaggtccaagacagcttctgcgccacgctctgccaaggcaggaaggggatggacctcattgtctgcaagggcaagtgcaccgagcagaagggcatcactgcgccggcgatgaaggtctgcgaggagcagtgcgacaaggactacgtggtgaaagcggcggaggtcaccgctgcatgcaacaagacttgcgacaaagagaagaacaagatgctcagcgacaattgccagaagtcctgcaccccttctgcagcttgaagcatgcac

SEQ ID NO: 14375 - DNA, 381 bp, Sorghum bicolor
  Clone ID: LIB3480-014-P1-K1-D3
agcaaacattgaggcagctaaggaatggagggagaagagggaggacttcaagaaaaaggtgcggcgcattgtgcggaaatcacaggaaatgttctgaagaaaatgaagaccaccatggcatcagccgcgctgctcttagtgctagccctagcgctagtgtccgccccactcacagcagaggcaaagaagaagaaaccggcagagagcgtggccgccgccggcgaggcggcggaggcgaagaaggtccaagacagcttctgcgccacgctctgccaaggcaggaaggggatggacctcattgtctgcaaggagtcctgtgagctctcccagcgctccaacctggtgctgtaccgggcggatccagtgcaaggggcaagtgca

SEQ ID NO: 14376 - DNA, 302 bp, Sorghum bicolor
  Clone ID: LIB3480-036-P1-K1-E12
gcgactagttctagatcgcgagcggccgctcgcgatgaactagaagcgatcgagaaaatgaagaccaccatggcatcagccgcgctgctgttagtgctagccctagcgctagtgtccgccccactcacagcagaggcaaagaagaagaaaccggcagagagcgtggccgccgccggcgaggcggcggaggcgaagaaggtccaagacagcttctgcgccacgctctgccaaggcaggaaggggatggacctcattgtctgcaaggagtcctgtgagctctcccagcgctccaacctggtgct

SEQ ID NO: 14377 - DNA, 1573 bp, Sorghum bicolor
  Clone ID: SORBI-28MAY03-CLUS3550_1
ctacgcacgaggagaaaaaggaggagattcctctccccctccctccctttcccccggttccccctaccccgtcgtcgaaaccctacccccgcctcgccgccgccggcggtggccgcctcagcaccggcaaaaaggccaccgtacctatcctcgcacgctccctccctcccggtgccgtcgccccgccaccgaccgatcgatcggtcgtcggctcggtagccgccgccggatccggatcggccggcgccatgtcgaaggccagggtctacgccgacgtcaacgtgctgcgccccaaggagtactgggactacgaggcgctcaccgttcaatggggtgagcaggatgactatgaagttgttaggaaagttgggagaggaaaatacagtgaagtctttgagggtattaatgttaacaataatgagaaatgcatcattaagatcctcaagcctgtgaagaaaaagaagatcaaaagagaaattaaaattcttcagaatctttgtggaggccctaacattgtgaagctgcttgatattgttagagatcagcattcaaaaacacccagcttgatctttgagtatgtcaacaacacagatttcaaagtgttgtacccaacactaacagattatgacattcgatattacatctacgagttactcaaggcattagattactgccattcacaaggtattatgcaccgagatgtgaagccccacaatgttatgatagatcacgagcttcggaaactccggctgatagactggggccttgctgaattctatcatcctggcaaggaatataatgtccgtgttgcctccaggtacttcaaggggcctgagcttcttgttgacttgcaagattatgattactctttggacatgtggagtctgggctgcatgtttgctggaatgatttttcgtaaggaaccatttttctacggccatgacaaccatgatcaacttgttaagatagccaaggtacttggaacagatgggctgaatgcttatttgaacaagtacagaattgagcttgaccctcagctggaagcccttgttgggaggcatagcaggaaaccctggtcaaagtttatcaatgcagataaccaacacctagtgtctcctgaggccatagatttccttgacaagcttttgcgttatgatcatcaggacaggcttactgcacgtgaagctatggcacacccatacttccaacaagtgagagctgcagagaacagcaggacgcgagcatgacaggcaagtacaaagactggtgctaaccgttgatcagatcagctgctcttgatggagccatgctcttatcagtgacttgcttcagtcagatgtatgagatgaatagtggttggagggttacttggcaaaaacaaacaatagctatagagcctgttatacccttatttaaccgcatcgagaagggactgaattatttggttgtgagctttgggacgtgattgtgaacaatgattattcatgtaagatgtttgtcataaaaggttgtctgttggctgattgtactgttgtattgttgagcttgtaaagaatatcccatcctttgttgg

SEQ ID NO: 14378 - DNA, 1664 bp, Sorghum bicolor
  Clone ID: SORBI-28MAY03-CLUS6107_1
aggagagagagaaagagggagagattagagggagcgcccccctgcccaaggaaagagaaaccgcggcgcgaggagcaagggaggaagggcaagaggcaagatgagagagatcatcagcatccacatcggccaggccgggatccaggtcggcaacgcctgctgggagctctactgcctcgagcacggcatcgagcccgatggcaccatgcccagtgatacctcggttggcgtcgcacatgatgccttcaacacgttcttcagtgagaccggttccggcaagcatgtgccgagggctattttcgtcgaccttgagcccactgtcattgacgaggttcgcactggctcgtaccgccagctcttccacccagagcagctcatctcggggaaggaggatgcagctaacaactttgcccgtggccactacactgttgggaaggagattgtcgatctatgcctggaccgcgtgcgcaagcttgcagacaactgcactgggctgcagggattcttggtgttcaatgctgttggtggtggtactggctctggacttggttcactgctactggagcgcctttcagttgattatggcaagaagtctaagctcggtttcaccatttatccttccccacaggtgtcaacagctgttgtagagccatacaacagtgtcctctcgacccactccttgcttgagcacactgatgttgcagtcctcctggacaacgaggctatctatgacatatgcaggaggtcccttgacatcgaaaggccaacctacaccaacttgaacaggttgatctcacagatcatatcatcacttaccacctccctgaggtttgatggtgctatcaacgtggatgttactgagttccagaccaaccttgtgccgtacccacgtatccatttcatgctttcctcatatgcccctgtaatctctgctgagaaggcctaccatgagcagctccctctcccccgttgccccggtgctctctcgcagccctcaagcatgatggccaagtgtgacccaaggcacgggaagtacatggcttgctgcttgatgtaccgtggtgatgttgttcccaaggatgtcaacgctgctgttgcaaccatcaagaccaagagaactgtccagtttgtggactggtgccccactggattcaagtgtggcatcaactatcagccaccctctgttgtccctggaggtgacctggcaaaggtccagcgtgccgtgtgcatgatcagcaacaacactgccgttgccgaggtgttctcacgcattgaccacaaatttgcccttatgtacgccaagcgcgcattcgttcactggtacgtcggtgagggtatggaagagggtgagttctcagaggcccgtgaggacttggctgctcttgagaaggactatgaggaagtcggcgcagagggtgcagatgacgagggtgacgagggcgatgactattgagtagctggttaataagtagctcgctggtggttaatggttggattattttgagtatactctgtatggtgctccactccattgtgtactgctgctgtgtgtgtttctattttgtattctgtggtaaattgttcgtagccccctattggtcatgattgttcatatcatactgctttggtttgcaaatgcttattcgtgcaagcgttctgagctc

SEQ ID NO: 14379 - DNA, 2329 bp, Sorghum bicolor
  Clone ID: SORBI-28MAY03-CLUS5207_1
cccgcgccgcatgccccctccgcacgcagttcactcacgcccccccgctcgctctccgagactccgacgattggtgtctcgccccctcgctctccgacgactggtgggccgccggcgccggcgccgccctacgccaggtgccgaggtcttcgtctgtctcttcgccggcgacgagcgcccaccagctgaaaaaaagttctagccaaacataataatggctatgattgacgaacctctgtacccgattgctgtgctgattgatgaactgaaaaatgaagatattcagttgcgccttaactccatcagaaagctttctacaattgcccgggcattgggtgaagaaagaacaaggaaagagctgattccgttccttagtgaaaacaacgacgatgaagatgaggtgcttcttgcaatggcggaagagttgggcgtttttattccttatgttggaggtgtagagcatgcacacgttttgcttccaccactggaaacattgtgtactgtggaggaaacctgcgtcagagacaaggctgtggaatcgctttgtcggataggagcacagatgaaggaaaatgatattgtggactggtttgcccctgtcgtaaagaggttggcggcaggcgagtggttcacagctcgagtttcgtcatgtggcctttttcatatcgcctatcctagtgcatctgaacaactgaaggcagaactgaggacaatttatggccagttatgccaagacgacatgcctatggtacgaagagctgctgcatccaatcttggaaagtttgctgcaacagttgaacaaagtcatttgaagacagaaatcatgtcaatatttgatgatctaactcaagatgatcaagattcagtgcgactattggcagttgagggttgtgctgctcttgggaagttgttggagccccaagattgtgcagcacatattctcccagttattgtaaatttctctcaggataaatcttggcgtgtgcgttatatggtggcaaatcaactgtatgagctatgtgaagctggtggtactgagcccacaaggggtgatctggtgtcagcatatgttcgcctcctctgtgacaatgaggctgaagtgcggattgcagctgctggaaaagttacaaaattctgcaaaatattaaacccacaaattgcaattgaacatattcttccgtgtgtcaaggaattatcaacagattcatctcaacatgttcgttcagctttggcatcagttattatgggaatggctcctgtattgggaaaggatgccactattgaacaacttcttcccatttttcttgctttgctgaaggatgagttccctgatgttcgactcaacattataagcaaacttgatcaagttaaccaggttattggaattgacttgctgtcgcaatcacttctaccagccattgtagagctcgctgaagataggcactggagagttcggcttgccataattgagtacatacctttgttggccagccagttaggtgttggtttttttgatgacaaattgggggcactttgcatgcagtggttggaagataaggttttctcaatccgagatgctgctgccaacaatttaaagcgtttggcagaggaatttggccctgagtgggcgatgcaacatataattcctcaggttttggagaagataaacaacccacattatctgtataggatgaccactttgcaagctatttctttgctagctcctgtcatgggtcctgatatcacatgccaacagttgctccctgttgtcattgcttcttcaaaggacagggttccgaacatgaaattcaatgttgctaaagtcctgcaatcacttgtaccaatccttgatcaatctgttgtggagaaggcggtgaaaccatgcctagttgagctcagtgaggacccagatgtagatgtaagatactatgcacaccaggcccttcgggcgtgtgaccaaatggtgatatctagctgactagcctgtccagaaattagcaaatgagatacccattggtccattttttgaatatttattagagtgttatgtaatcttataattattctaccaccaatgactttgatgcaactttttattaattatgtgtttttgatttaggtttagtttagtttttggatttaatcaaccttggggaagtaggtggacacatgatgtttgtgtgattgacctgtgcatgtcatgtgctgttacttggtaggtcattacgtgtaagcacattgttttatagtttgctttgcttactctggttgtgtgcggaaactgtattcattgctctttcagccacgaaaaccatgtttgttgcttggg

SEQ ID NO: 14380 - DNA, 1664 bp, Sorghum bicolor
  Clone ID: SORBI-28MAY03-CLUS10703_1
gcccgtggcccggtgtccacccccgcgtccccccccgccgccccccgcagcccagggtccagcccctcatccctccgctccggtccgcacagcacaagggagcagccggcagcagcacagtgctgcggcaagctaagctaagatggcagactacgtgtatggccccgggcggaaccacctgttcgttccgggcccggtgaacatcccggaccccgtgatccgcgccatgaaccggcagaacgaggactaccgctcgccggcgatcccggcgctcaccaaggtcctcctcgaggacgtgaagaggatcttcaaaaccaccaccggcacgccgttcctgatcccgaccaccggcaccggcgcgtgggagagcgcgctgaccaacacgctgtccccgggcgaccgcatcgtctcgttcctcatcgggcagttcagcctgctgtggatcgaccagcagcagcgcctgggcttcgacgtggacgtggtggagagcgactggggccacggcgccgacctcgacgcgctggagcggaagctccgcgacgacaccctccacaccatcaaggccgtcgccatcgtgcacaacgagacggccacgggcgtcaccaacgacctcgccgccgtgcgcacgctgctggacgcgtacgcccacccggcgctgctgctggtggacggcgtgtcgtccatctgcgcgctggacttccgcatggacgagtggggcgtcgacgtcgcgctcacggggtcgcagaaggcgctgtcgatgccgacagggatgggcatcgtgtgcgctagctccaaggcgctggaggccagcaaggcggcgaggtccgtgcgcgtcttcttcgactggaaggactacctcaggttctacgagatgggcacgtactggccatacacgccatccatccagctcctctacggactccgcaccgcgctcgacctcatcttcgaggaagggctcgacaatgtcgtcaagaggcacaatcgtcttggaacagccaccaggttcgccgtggaggcgtgggggctcaagaactgctgccagaaggaggagtgtttcagtgacacggtcaccgccgtcgtcgtgccgccatacatcgacagcgccgagatcgtcaagcacgcgtggaagcggtacaacctcagccttggcctcggccttaacaaggtcgccgggaaggtcttcaggatcggccatctcggcaacctcaacgagctgcaactcctgggatgcctgagcggtgtggagatggtgctcaaggacgtggggtacccggtgaagctcggcagtggagtggcggccgcggcggcgtacctgtcgaattccacgcctctgatcccgtccaggatctgaaaacaaggcacgacagcacaaagaaggccggcggccggcgacgacgactacgacgacgaatggactgcggacagacaaataaacgaacaaaatgtgcagacatctccgcctctgctgcctttgcagagcatctgcttgcctgcagtaacgaactagtattggctatactctctgtatgtacagttaatttccacactcagctgttggtctgttgctaccgggtataattttgtgaagtacagctttaattaaacttcgaagtagtctccatgtttagccctgcccagatttaactatatttgatcatagtagc

SEQ ID NO: 14381 - DNA, 1684 bp, Sorghum bicolor
  Clone ID: SORBI-28MAY03-CLUS13074_1
ccctctgcctcttggctcgcggcctccttctccctcccctcgcgtctgtggcggctatcccttcactctcctcgcctcgtccccccctccccttccctagggtttatcctctaccaccacctacccaccgcctctccccgccatagacaagaattatcttatcgaattattacatcggccttggatccgattcaggagcagctgcgtggtggtggtagctgcggcaggcgtctgtcctagatcgaattgactcggagggaagaagccatggcgacagttgctcctgcccctaccgctgctgaccagaccaccaatctcctgcagaagctgtccctggagagcaaggatggctccgatgctgccaagaagccttctgggatgccatatggatctgcccatgctggagatgcacagagcgctgcttcgcaggtggataggtcgataacacctctactacaagaggccatggatcctaacttcttctaccagcccaatgcatattcctctccagctgattacttttgtcgagattatgatggcaatggctgtttaccactcacgtggcacttagtcaaggaagtgcccaacaacatcttgaagcatattacactggataacaatgataataagcctgtgacaaacagccgtgacacacaagaggttaagctggaacaaggtcttgagatgttaaagattttcaaagaacatgttactaaaacatcaattttggatgattttagtttttacgagaatcgccaaaagttgatgcaggaaaagagggcaaagcagcaactgcttcaaggccaggggggcgatgtttctcaagaaaaggacaaggatgcaaccaatggcaaaccaggggcacagaaacatgcattgagcaaggaaggcattcctgctgaggcggcggctaatgcctccaaacctgtagctgaaagtggcatatcaaatggcaactgagcatcatgtatactggtcgccttatccgtgcatatgctgcaggttttgtggtatctgcaaatcaaaacctattgtttctgcctgaattatagacttcgtttggtactggagttcagctcatcatgggaatgaacctgattttactctttttgtctgtttcttagtagtcgtccaactgctctttgctgtcttggtccccctgttatgcctctgtctggcatggtgccgacttctttgttgtaaccctcgattttgttttccccttttagtttttatggactttttgttcgcgaggcgaccactttcaaagatttcgatcaacttgaagctagttttttttgcccggttgcggatcggtggtggggaatagtggataccaaatactagcccagagggcgtgcaccttttggttttagtggtgagaatcaagatggctttactgagctgaacagaggaccaaggtctggtggtttcaagcaccaaaaacaattcgggcctactgtcactattgctgtgaagggccaggccctcccttcagcggggaaacagaacagtgctcttccagacaaaggccaatttaaccaggaaggatttcctttagcctacaaggatgcaaagttctttgtaatcaaatcatatagtgaggatgacgtgcacaagagtataaaatacaatgtgtgggctagcacacctaatggaaataagaagctggatgctgggtacc

SEQ ID NO: 14382 - DNA, 823 bp, Sorghum bicolor
  Clone ID: SORBI-28MAY03-CLUS873_2
tgcggcgctcgagccggcggacgccgccgcacgccccgcgctgctggaccctctcacctccttcgccgtcgtctaacagatcttcccatggcgtcggagaagaagcagtcgaacccgatgcgggagatcaaggtccagaagctcgtgctcaacatctccgtcggcgagagcggtgatcgcctcacccgtgccgccaaggtgctggagcagctgagtggccagtcaccggtgttctccaaggcaaggtacactgtgaggtcgtttgggatccggcgtaatgagaagatcgcgtgctatgtgacggtgcggggtgagaaggcaatgcagctgctggagagtggcctgaaggtgaaggagtacgggctgctgaggaggaacttcagtgagactggctgctttggatttggtatccaagagcacattgatcttggcatcaagtatgacccatctactggtatctacggcatggacttctacgtcgtccttgagcgtgccgggtaccgtgtcgcacgtcgccgcaggtgcaagtcccgtgttgggatccagcacagggtcaccaaggaggatgccatgaagtggttccaggtcaagtacgagggtgtgatcctcaacaaggcccaagccaacacctcctaagcatcaccataagatattagaccctctttttagtgcttcgtgttaatgaagtgtttgtggcagtgggatttgtattagaagaaaaatcggatgcattatcagttttgccctgtactggtcctactggagttggatccatgtttttgtgtgcgccctatcttaaaaacttttattgaacagtttggcg

SEQ ID NO: 14383 - DNA, 1065 bp, Sorghum bicolor
  Clone ID: SORBI-28MAY03-CLUS873_1
gtgcggcgctcgaggccgggccgggtccccccccaccccacctagggtttctcccttttaacctcgcgccgccacccccttcgtctctcgacgcccatctcctcctcaagccgccgccgccgccgccgaaggagaaggaggagaagaggatccggccgtctcatcgccccaatggcgtccgagaagaagcagtcgaacccgatgcgggagatcaaggtgcagaagctcgtcctcaacatctccgtaggggagagcggcgaccgcctcacccgcgccgccaaggtgctcgagcagctcagcggccagacccctgtcttctccaaggcgaggtacacggtgcggtcgttcggcatccggcgtaacgagaagatcgcctgctacgtcactgtcaggggcgagaaggcaatgcagctgcttgagagcggcctgaaggtcaaggagtacgagctgctcaggaggaacttcagcgacaccgggtgcttcggattcggcatccaggagcacatcgaccttggcatcaagtatgatccatcaactggcatctatggaatggacttctatgtcgtgctggagcgtgccggctaccgtgtcgcgcgccgcaccacatgcagggcccgtgttgggatccagcacagggtgaccaagcaggattggatgcaatggttccgggtcaagtacggtagggtcatcctcaacaaggctcaggccaacaccacgcagggctcactgtagtgtgtccaagccccgtgcgaatgcatcatcctcatgaagggtttgtgtcaacagggtttgctctggtgtgatgtcgcagtcttcagtagcagagccctgtactgccctatctgtgtttgcaccccgtattgattttctccgggtgtaaaccttagtttgtctaagctccatgcagacgcaagatcaccatgcaaggtttttgttcacattgtattctctgacctgatgttttagtctactatagcagagctataaaacgccatatgaattatttcagtgcccgtatcatactctggtctgttgctcaaaaaaaaaaaaaaaaaggccctaggg

SEQ ID NO: 14384 - DNA, 872 bp, Sorghum bicolor
  Clone ID: SORBI-28MAY03-CLUS1331_1
atcccatctccctcctggctagcacaagcatagtcgtctcttctttctgcctccagttattatccacgagctagtgcgctgcaatcaacttagccatggcatccaaggccgtcctcttcttggctcttaacctcctgttcttcacagtggccaacgcctgcggcagctgcccgaccccgacgccgccaccgccaccgcctcctgctactaccccaccccctccatccagcggcaagtgcccgctgaatgcgctcaagttcggcgtgtgcgccaatgtgctcggcctcgtcaaaggcgaggttggcaaggtgcctgctgagccatgctgcaccctcctcgatggccttgtagacttcgaggccgccgtctgcctctgcaccgccatcaaggccaacgtgctcggcatcgtcatcgatgtccctgtcaagctcagcgccctcgtcaactactgtggcaagtgcgtgcccaagggctacatctgtgcgtaagctccgcgcggttccacgctcgtacgtaatttagcacgcaccctgcatggcacacacatgcattgtgtctgctgatctcttctgtcgtccagctcatttgtgcaccttcgagggttctacaaacctgtagaaccattccggccaaatacttttatcagttcgcatgtaccgtcgatctctttgctggatttccatttttcttttgtatttgatcatttcttcataagagtccgcgacatcttctcgaagaacaaggagtgttgcttctagtttttatatttatgaatcatgtaatctgttgagagtcatttgttgtgtatgtaaaatcaagcacttgaacgtgtaatacttattcgatttgttaattgtgttagccatttggtt

SEQ ID NO: 14385 - DNA, 711 bp, Sorghum bicolor
  Clone ID: SORBI-28MAY03-CLUS12309_3
gccggccggcccgggagagaccagagagcagtgagcggagcagagcagagcagaaggcggccatccggaggcagaggcggagacgaggaagaggaagcgagcgaggatgccgtgcctcaacgtgtcgaccaacgtgaacctggagggggtggacacctccgtcatcctcgccgaagcctccaagtccgtcgctaacatcatcggcaagccagaggcctacgtgatggttgtcctcaagggttcagtgcctatggcatttggaggtacccaggagccagcagcgtacggtgagctggtttccatcggaggcctgaaccctgacgtgaataagaagctgagtgctggcattgcttccatcctggagtcaaagctgtctgttcccaagtcacgcttctacctcaagttctatgactcaaagcgctcggacttcggttggaacggctccaccttctagacttgaggcccgcatctttaataaaggaaattcatggtgcctaacgccatggctattgccaattaagaacaatgtcgttagatgtgtgttaattggtactgaactgagaatcggtaactgttgtgtggaactggaactgggacccagacgtgttgggtgccacctagcatgcttgtgctatcttgttcttggcttgagatcagtctatatattatcttggttggtccttcgtgaataacaaaaaaaaaagcccccta

SEQ ID NO: 14386 - DNA, 767 bp, Sorghum bicolor
  unsure (1)..(767): unsure at all n locations
  Clone ID: SORBI-28MAY03-CLUS12309_2
ccggggagcggagagcagtgagcggagcagagcagagcggagcagagcagagcagaaggcggccatccggaggcagaggcggagacgaggaagaggaagcgagcgaggatgccgtgcctcaacgtgtcgaccaacgtgaacctggagggggtggacacctccgtcatcctcgccgaagcctccaagtccgtcgctaacatcatcggcaagccagaggcctacgtgatggttgtcctcaagggttcagtgcctatggcatttggaggtacccaggagccagcagcgtacggtgagctggtttccatcggaggcctgaaccctgacgtgaataagaagctgagtgctggcattgcttccatcctggagtcaaagctgtctgttcccaagtcacgcttctacctcaagttctatgactcaaaggcccatccggcacaagaacatgctcaatgtttgcatgctttgcatcaagaatagatcatcgctcggacttcggtgggaacggctccaccttctagacttgaggcccgcatctttaataaaggaaattcatggtgcctaacgccatggctattgccaattaagaacaatgtcgttagatgtgtgttaattggtactgaactgagaatcggtaactgttgtgtggaactggaactgggacccagacgtgttgggtgccacctagcatgcttgtgctatcttgttcttggcttgagatcagnctatatattatcttgggttggcccttcggggatggtaaccgtatgttc

SEQ ID NO: 14387 - DNA, 897 bp, Sorghum bicolor
  Clone ID: SORBI-28MAY03-CLUS12309_1
gccggccgggccgggagtaataattattcagcctttatttatcatggaaaaattttccgtgtaggaggatagcgagggagcggagtagcagagaccacagagagcagtgagcggagcagagcagaaggaggagaaggcggccagccggaggcagacgcggagaggaagcgagcgaggatgccgtgcctgaacgtgtcgaccaacgtgaacctggagggggtggacacctccgccatcctcgccgaagcctccaagtccgtcgccgacatcatcggcaagccagaggcctatgtgatggttgttctcaaaggttcagttcctatggcatttggaggtacccaggagcctgcagcttacggtgagctcgtttccatcggaggcctgagccctaatgtgaataagaagcttagtgctggcattgcttctatcctggagtcaaagctgtctgttcccaagtcgcgcttctacctcaagttctatgactcaaagggctcggacttcggttggaatggctccaccttctagacttgaggcccgtatctttaataaaggaaattcatggtgcataatgccatggctattgcctgttaataacaatgtcgttagatgtgtgttaattggtgctgaactgagaatcgataactgttgtgtggaactggaactgggacccagacgtgttgagtgccacatagcatgcttgtgctatcttgttcttggcttgagattattatcttggttgtgctggtccatcgggtatggtaaccgtatcttcaaatggtgtcttgtttgttaatctagcgaaaatctgccaacggtagtgttgttttacagccctacagttacagtggacataaggctggtaaccgagaaatttaatagcccactagttgttgcttc

SEQ ID NO: 14388 - DNA, 377 bp, Sorghum bicolor
  Clone ID: LIB5047-011-R1-XP1-H4
cggcgctcgaggcggctggcggtacatttgtattggacaccttgtttcagcaaaaaaaaaaaaaaaaaaaaaaaatcaaagggctcggacttcggttggaatggctccaccttctagacttgaggcccgtatctttaataaaggaaattcatggtgcataatgccatggctattgcctgtcaataacaatgtcaattggtgctgaactgagaatcgataactgttgtgtggaactggaactgggacccagacttgtgttgagtgccacatggcatgcttgtgctatcttgttcttggcttgagattattatcttggttgctggtccatcgggtatggtaaccgtatcctccaaaaaaaaaaaaaaaaaaggccctaa

SEQ ID NO: 14389 - DNA, 1756 bp, Sorghum bicolor
  Clone ID: SORBI-28MAY03-CLUS14877_1
gctcgaggctccgcccgaccgctcccgaccggcaaaaggcgcccttccgccgctaccgctagggaccggaatagaaatctccgaggagagctcgtcccctctcgccttcgtccccttctccgcctgaccgctgctgtccgcctccaaccctccagttcgacgcagacggcggcggcggcggcggcagcgcggcgagatgaaggtttccgtgaagacgctcaagggatccagcttccagatcgaagtggaacccaccgacaaggttgctgatgtgaaaaaggtcatagagagtatacaagaaaatgcttcctatcctgctgaccaacaagtgcttatacaccaggggaaggtgctcaaggatgacaccacattggaggaaaaccaagtggttgagaataattttcttgttataatgctcagacagaacaagggatcatcaagtgcagcaccagctaaggcaaccgcaaatcaggctccccctactcagacagtgcctgctactccaactcaaatgtcagcagccccagctgcaccggcacctattgtacctgtcagtgcaccggctgcaactgctacagccttggcagctcctgctgttgctgtatccactgaggcagatagttatggtcaggctgcctcaaacctagttgctggcagcaacttggaaggaacaattcaatccattcttgaaatgggtggcgggacatgggacagagacactgtactacgtgctctgcgggctgcctataacaatccagagcctcctggtgagtacttatattctgggattcctgaacaaatggaagctcctgcaccacctccaagttcccagccagccaatcctgtccaggcggcacaaacagctcaagctgtagttccttcatctggaccaaatgctaaccctctcgacctctttccccaatctcttccgaatgcttccgctaatgccggcgcagggaaccttgatgttttgcgtaataacgcccaattccaaaacctgcttggtttggtgcaggctaaccctcagattttgcagccattgcttcaagaattggggaaacaaaatccccaggttatgcagctaatccaggaaaaccaagcagaattcatgcggttgatcaatgaaccactggagggagatgaagagaatgaaatgatgctggaccagatggcggatgcagctgagaccattgcagtcactccagaggagaacgaagctatacttcgtcttgaagggatgggctttgaccgggcacttgtcctggaagtgtttttcgcctgcaacaagaacgagcagctggccgccaactacctcttggatcacatgcacgagttcgacaacgatgacgggctcggagggccaccactatgagaggcggaatagctctcaatctctgcatcatgcgaaggcttgtagggcagaaataggaaaacgttttgggatttgtctcgtctcgtctgtccgctccctctacatttctgtttggctttgctgttttagtacataaattctagatttacagacagactttataacctgatatagaggtaacggatcagtttactcttttctggtgtattgctcaaagcaattgggaggctgaagagaggtaatatccttggaagcaacagccaagactgacatggtggcaagtggatctttcagattcgcgagtttgattgatatgctgtgtttgtggcgagacttgagttcaggacatagcttgcggagttgaactggtgccacattaaaatg

SEQ ID NO: 14390 - DNA, 1756 bp, Sorghum bicolor
  Clone ID: SORBI-28MAY03-CLUS16864_1
cctgccaaaagggaaaaaaaaaaaaaattaaattacaggcacgactgcacgggggcaatcgcggtctgcgcagcctaccaagcccggcggcggcaggccaaacaccaaaccaaccccttcttaagaacgcaacaactacgcgaataaaaatctcgcgtctatcttcttgcttgcttccttccttgcctccgtccccacgcccaccgccccgcatccgccccgaaaccctagcggatcgtcgccatggccgcggccgccctccttcgccgcatccccgccgcgcgggccccggccacggccttcatggcggcgcgcccgatctccgattccacggcggcgctcaccatcgagacatctgtccctttcacctcccacctcgtcgacccaccctcgcgcgatgtcaccaccacccccgccgagctcgtcaccttcttccgcgacatgtccctcatgcgccgcatggagatcgccgccgactccctctacaaggccaagctcatccgcgggttctgccacctctacgacggccaggaggccgtcgccgtcggcatggaggccgccatcacccgctccgattccatcatcaccgcctaccgcgaccactgtacctacctcgcccgcggaggggacctcgtctccgccttctccgagctgatgggccgcgagggcggctgctcccgcgggaagggcggatccatgcatttctataagaaggatgccaatttctacggcggccacggcatcgtcggcgcgcaggtgcccctaggatgcggcctcgccttcgctcaaaagtacaagaaggaggacacggccacgttcgcgctctatggagacggtgcggctaaccagggacagctctttgaggctctcaacatttcggccctctggaagctgcctgccatattggtgtgcgagaacaaccattatgggatgggaacagcagagtggagggcagccaagagccctgcctactacaagcgtggcgactatgtgcctggattgaaggttgatggaatggatgttcttgctgtgaaacaagcatgcaaatttgcaaaagatcatgctgttgcaaatggcccaattgtccttgagatggatacctacaggtaccatggccactctatgtcagatccaggaagcacttaccgcaccagagatgagatttctggtgttaggcaggaacgggacccaattgaaagggttagaaaattgcttttgactcacgacctggcaactgctgctgagctcaaggatatggagaaagaaatcaggaaacaagtagatgacgccattgctaaagcaaaggaaagttctatgcctgatacttctgagctcttcacaaatgtttataagaagggcttcggtgtggagtcatttgggccagacaggaaggagttgagagcttcccttccttaggttggcagcatgatgggcagtcctcgtaatatgatatgatagccaggagaaataaacattaatgaagccctcagacattgctggaattttttgttggcaaatgaacctgtatagagatgcgttgtcaggaggatcagcttctttgtttcgcttttctttttcccccatttctacaattcagttttaactgctgctggctggcttcttattgaagctaatatcgtctgcaattgcttcggtccaagaaaaccgaagctggagattataaatttgctcacgcctatcgtctagacctgctcactctattgctctatggtgattgctcgatcagtttctacct

SEQ ID NO: 14391 - DNA, 602 bp, Sorghum bicolor
  Clone ID: SORBI-28MAY03-CLUS1360_2
taggggccttttttttttttttttttgggacaactgacaaagaaacccagttaccaattcttgaacataataacaagagaaaccaccagttaatttgctttatttaacaacttcagagacaaaaggtccatatttagctagcctcaataagtttgccaggcaaagataccttatatgcatatggaaagatgaaaaggcgttggactaaaattgatccaacaaatgttaaatcattggaggtttataaaacccatcatgaaaactccagctgctgttgcagtcaagttgcatttaatatctgtgggaaagcttctcctgctctttgtaccacatggcgtattggtaggtgccgacgacgggggtgacgaggagcgtggcggagatccagttctcggtgaccttgtggtggatcttggtggtgatgtccttccacagccccggcatcaccttctgctggaaaggcgacagcgcgtacaccaccgccttcatccgcaccggcatcttccccatgtttctccccgcgtcgccgccggccggtcttcctcctcctcactcaggacgggattctccgatcacctcacgcacgcggatgggtgtctggc

SEQ ID NO: 14392 - DNA, 1134 bp, Sorghum bicolor
  Clone ID: SORBI-28MAY03-CLUS1360_1
ccgggccccccctcggattttgctttatttaacaacttcaaagacttttttttttttttttttgtcacacaaacccagttagccatttttggatattttttttttttttttttgctagttaatttgctttatttaacaacttcaaagacaaaaggtacatatttagcaagcctcaaaataagtatgccaggcacagataccgtatatgcattggaaatatgaaaaaggcattgaactaaaattgatccaacaaatgttaaatcatcattgaaggattacagaacccatcatgaaaactccaactgctgtcacagtcaacttggagagcatcgcatttagtatctgtgggacagcttctcctgctctttgtaccacatggcgtattggtaggtgccgacgactggggtgacgaggagcgtggcggagatccagttctccgtgaccttgtggtggatcttggtggtgatgtccttccacagccccggcatcaccttctgctggaacggcgacagcgcgtacaccaccgccttcatccgcaccggcaccttccccatgttttccccctcgtcgccggccggtcttccacgggatgctccgaacgcctcgcgcacgctgatgggtggctggctgggtcgcttctccgccccccggccggctgtccacgctgctctaccggagtggaagacgtcaagatgcaatggaaaagctcaaagcaacccaacaagttgccccttctgcagctttcagagttgcagcgtgggaagcactaatgggattacacatggaggcagggcaggagatgtcctacttgatttccccagatgatttagttgatctgtcaatcaaagatgatagcagatggtctgatcaggaccatcttaaatttcgggttaatgctatcagaggacttgttgcacttctgaatggagaaacagaatcagctgcccagctgtttgatgattggagtagagacttttctggaggcgaaaaccaaacacaaaatgctgccatttcatatggtgaatatttgcattgtgttggggattttcaaatggcagcacaagtgtatgagaaaattcatgaggcattttgcatggatgacgtgtctggaaaccttttagcagctggaaacat

SEQ ID NO: 14393 - DNA, 612 bp, Sorghum bicolor
  unsure (1)..(612): unsure at all n locations
  Clone ID: LIB5051-002-A1-XP1-B9
cgtgcgcgaggcgttcggagcatcccgtggaagaccggccggcgacgagggggaaaacatggggaaggtgccggtgcggatgaaggcggtggtgtacgcgctgtcgccgttccagcagaaggtgatgccggggctgtggaaggacatcaccaccaagatccaccacaaggtcacggagaactggatctccgccacgctcctcgtcaccccagtcgtcggcacctaccaatacgccatgtggtacaaagagcaggagaagctgtcccacagatactaaatgcgatgctctccaagttgactgtgacagcagttggagttttcatgatgggttctgtaatccttcaatgatgatttaacatttgttggatcaattttagttcaatgcctttttcatatttccaatgcatatacggtatctgtgcctggcatacttattttgaggcttgctaaatatgtaccttttgtctttgaagttgttaaataaagcaaattaactagcagcttctctctannnaaaaaaaaaaaaaaaaaaaaaaaaaaaaaaaaaaaaaaaaaaaaaaaaaggaaaaaaaaaaaaaaaaaanggaaaaaaaaaaaaaaaaaaggccccta

SEQ ID NO: 14394 - DNA, 630 bp, Sorghum bicolor
  unsure (1)..(630): unsure at all n locations
  Clone ID: SORBI-28MAY03-CLUS12917_2
ccaaaacacacagtgtcgagccttctattggtgtgattgggggcaccaaatacctacctaaaggcattccattatactgtgtttgtgcgcgtgtgcgcgcgcgcgcagatagggacatatatatagacgggtgaggtgctttgtctccgaccatgaaaggcgccgtcatcggcgcgtcgaccgtcctggtggtggcggtggtcgccaccatctgcgtcgtgtccttgagaggcagcggcgatggcgacagcagggaggagggcgagatgtcgacgtcggtgaagtccatcaagtccttctgccagcccgtggactacagggagacgtgcgagaaggcgctcagggcggctgccgggaacgccaccagcccgacggacctggccaaggccatcttcaaggtgacgtccgaccggatcgagaaggcggtgcgcgagtccgccgtcctgaacgagctcaagaacgacccgcgcaccaagggcgcgctcgacaactgcagggagctgctggactacgccatcgacgacctcaagacgaccttcgacaggctgggcggcttcnagatgaccaacttcaagagcgccgtggacgaccttccgacgtggctcaacttcgcgctcacgtaccaggaga

SEQ ID NO: 14395 - DNA, 1479 bp, Sorghum bicolor
  Clone ID: SORBI-28MAY03-CLUS12917_1
cggacgggtggatgcacacagtgtcgagccttctattggtgtgattgggggatataaatacctacctaaaggcattccattatactgtttcaagaggcgtgtgcacgacctccggacgtggctcagctccgcgctcacgtaccaggagacgtgcctggacgggttcgagaacacgacgacggcggcggcgggcaagatgcgcggggtgctcaacagctcgcaggagctgacggagaacatcctggcgctcgtggacgagttctccgagacgctcgccaacctgggcatcccgagcttccaccgccggctcctggcggaccacgccggcggcgtgccgtcgtggatgcccgacgccaagcgccggctgcggaaggtctcccccggcgacaagggtttcaagccggacgtgacggtggccaaggacggcagcggcgacttcaggaccatcaacgcggcgctggccaaggtgccggtgaagagcgccgccacgtacgtcatgtacgtgaaggccggcacgtacagggagtacgtgtccgtgccccggaacgtgacgaacctggtgatggtcggcgacggcgccaccaagacggtgatcacgggcgacaagagcttcatgatgaacatcaccaccaaggacacggcgacgatggaggcgctcgggaacgggttcctgatgcgcgggatcggcgtggagaacacggcgggcgccaagaaccaccaggcggtggcgctgcgggtgcagagcgacatgtcggcgttctacgagtgccggttcgacgggtaccaggacacgctgtacacgcacacgagccggcagtactaccgcgagtgcgtcatcacgggcaccatcgacttcatcttcggcaacgcgcaggtggtgttccagaactgcctcatccaggtgcgcaagtgcatggacaaccagcagaacatcgtgacggcgcagggccgcaaggagaggaggtcggcgggcggcaccgtcatccacaactgcaccatcgagccgcacccggagttcgagaagagcgccggcgacggcaagctcaggaccttcctggggcggccgtggaaggagcactcgcgcacgctctacatccagtcggagatcgggggcttcatcgaccccaaggggtggctgccgtggctcggcgacttcggcctcagcacctgctactacgccgaggtggagaaccgcggggccggcgccgacacgagcaagcgtgtcaagtggaggggcgtcaagaacatcacctaccagcacgcgctgcagaagtacaccgtggagagcttcatccagggccagcactggctcccacagctcggcgtgccattcatcccggggctgctgccgcagaaccagtctggcaggatacactgacgagcgacatgggcactgacatgtacgtaccatgggtttagtttgttgggttggagactattgtgactgcgtgtttatataatttgaaaaagaaatgtccg

SEQ ID NO: 14396 - DNA, 1163 bp, Sorghum bicolor
  Clone ID: SORBI-28MAY03-CLUS13_1
ccgggactgcccgttgcctcccgactccgcaggtgcaaaaaaggccgaaggcaaaccccccacgaagcaaagcaaccgccagacttcgccgtactccaccaccagagcatgcgcgttgccgcgacccgactcgccgccgctccccctccgatccgcttcctcttcctcctggtgctcctcggttccgcgatcggagcagccatggccggccacgtcctcggcggcgtgaaggagaaccccgccgccgccaacagcgccgaatccgacgggctcggccgcttcgccgtcgacgagcacaacaagcgcgagaacgcgctgctggagttcgtgcgcgtggtggaggccaaggagcaggtggtggccggcacgctgcaccacctcacgctcgaggccatcgaggcggggaagaagaagctctacgaggccaaggtctgggtcaagccatggctcaacttcaaggagctccaggatttcagccacaaaggggaggccaccacgttcactaacgccgacctcggcgccaagaaaggtgaacatgagcctggttggcgtgaggttcctatagaggatcctgtggtcaaagatgctgcacaccatgctgtgaaatcaatccaagagagatccaactccctgtttccctatgaacttctcgagattgttcgtgccaaggcacaggttgtggaggactttgcaaaatttgatattctgatgaaactgaagagaggcagcaaggaggagaagatcaaagccgaggtccacaagagcctggaaggggcttttgtgctaaacaagcatcagccggcggagcatgaggagtcgagcagccagtgaactgacgtagctgacagcttacataaataaaataaagagaaaacgtggccactccggttttatctggatatcgtgtattgtcgatggtcgtttctggcttggcttccgaatgcagcatgcatgccagtgctgttccaactcgttggaagacaggtggtacctgctgttgctcttgctgttataataggcattggaatttgtgaatttcgggagcttatctgttcgtatcatgttgtttaatgtgatgggtcgtatgtggatatatgttatgccaatacattttgccttttggttgcttgcgagcagtgtatgccaagttagcttaagctgcc

SEQ ID NO: 14397 - DNA, 1412 bp, Sorghum bicolor
  Clone ID: SORBI-28MAY03-CLUS2154_1
tccatgagcatcctgcagattgcatttgtgcaaaatcgaagggaaaaactggacagagcaggcctcacctagttaaaggagctggagaagctgtggagagccactctattgatggggaacttgactggaaggatttggactacggagagcatacacccttgggcagggattcatctaatgaaacagaatcagatgatattcgtgttggtggatcagacattcctgaattggaggatatgatgtcagactagacacagatagatagttcattatagttataggtttgtttttatttacaaagggcgcacgaggcagcaagggagctgagacgaaggccaaggccgcagcagagccgtcaaaggaagctgagacgaaggccaaggccgcagcagagccggccaaggaagctgacacgaaggccaaggccgcagcagagccggcaaagaaagccgccgccgccccccccgccgccgctgccaatgacaaggacgaggcaaagaagagcgacaagcccaaggacggcgccggtaagcaggcggagccagccgccgggacgacgacggagaggtccctgccttcgccgccggcgccggcgccgaagcacgcgtacgagcaggagtaccggcagccgtactactccccgcagccggtggtgagctaccacgcgtcgcacccgagctcgagcgtctcgtacacgtacttcgcgccgcaggcacagccggcgtactccatgcagcaggcacacccgcagcaagcgtactactccacgcaccagccgcagccgtcgtactcgtactccgtgcagccgcagccgcagccggagaagcagtggtcgccgtcgtacctgtacatgccgtacccgcactcggcggcgccggagccttactaccagcagcaggaccactacagcccgcccgggatgcacgcgtcgccgatgcacgactcgtaccgcatcttcgacgacgagaaccccaactcctgcagcgtcatgtgagatcgatcgatcgcgttgatcgccgccggccgccgtggccagcaagtagttggggaggcggcgccgctaccgcaatagagacctctctgtggttgtaggtggagtagcctgttactgctctcttccactaattagtatagaggtcaaaccactctccatgacagagcttttcttttcgtttccttttaatatatttttactgttctaatcaagtaattagagcatgtaaatgttcgcctttacctgtagttactgttcaccgcgtctatatatgccggctactagctagaattttgtatatgagctaccacaaatacatacagtatataacagattatacataaaaacagttttctatagatagagaaaggcaaaggcgtatttgttcctttttacagatcccgaacatttccggatt

SEQ ID NO: 14398 - DNA, 848 bp, Sorghum bicolor
  Clone ID: SORBI-28MAY03-CLUS2172_1
tcagatggtattccggaattacccccgggccaccttgcacagctatcggttcaccaggccgggccggcggccaacgggcaccaccattccttccccaactccgcaggctgctcatcgccctcaccccgcgccggacgcgccccgatccagatccaggggcttatcatggcatcaaagcgtatcctcaaggaattgaaggacctgcaaaaggaccctccaacatcatgcagtgcaggtcctgctggtgaggatatgttccactggcaggcaaccatcatgggtcctcctgatagtccatatgctggaggtgttttcttagtgaacattcatttccccccggactaccccttcaagcctccaaaggtatcttttaagacgaaggtcttccatccaaacatcaatagtaatggaagcatatgtctcgacattcttaaggagcagtggagccctgctttgacaatctctaaggttttgctttctatctgctccctgcttactgatcccaacccagatgaccctcttgtccctgagattgctcacatgtacaagacggaccggcctaagtatgaggcgacagcccgcagctggacccagaagtatgctatgggatgaaatgaagccaaaaccccatattactgcttaaatgcagacgattgtggtgttgcccccatgaaactgtttctggggacgaatgttcttccattccttgtggcccgtgtgcattctccgatccatctaggatcgagtcctagtccaacatcaacctaccattgccgtcgataatgagatgacttatgcttgctgtgataactaaaaggcccctagatgttatttgataaatgattctc

SEQ ID NO: 14399 - DNA, 436 bp, Sorghum bicolor
  Clone ID: LIB3480-001-P1-K1-C3
gcatcgtttgctctgttctgtagagtaatttctccgctgtgagacctgaaatccaagtatttcttcctgcgatcggggcttatcatggcatcaaagcgtatcctcaaggaattgaaggacctgcaaaaggaccctccaacatcatgcagtgcaggtcctgctggtgaggatatgttccactggcaggcaaccatcatgggtcctcctgatagtccatatgctggaggtgttttcttagtgaacattcatttccccccggactaccccttcaagcctccaaaggtatcttttaagacgaaggtcttccatccaaacatcaatagtaatggaagcatatgtctcgacattcttaatgagcagtggagccctgctttgacaatctctaagggtttgctttctatctgctccctgcttactgatcccaacccaattgacc

SEQ ID NO: 14400 - DNA, 713 bp, Sorghum bicolor
  Clone ID: SORBI-28MAY03-CLUS26799_1
gtcgcactcgcactcgtggggcgagacgcgcacgccggagtcggagatcgtggacaacgacccgttcccggagctggactcgttcccggcgttccaggacccggcggcggcgatgatgatggtgcccaagaaggagcaggtggacgacggcagcgccgccgccaacgccgccaagagtagcgacctgttcgtggaccttagctacgacgacatccagggcatgtacagcggcctcgacatgctgcccccgccaggggaggacttcttctcctcgctcttcgcgtcgcccagggtcaaggggaaccagcccgccggagccgccgggttggggccattctgaggctgaggcgagcgaggatggagccatggatcaggagaagaagacagcgttgcaaggttgcgaactctgtaaatacagcataggagtcgaacctgaacccgactctgaacctggtcggggttacagggttatgggtgtcggtgttagcgtacatggagccggccggcccagtgttggcgaggctcattctttagtttcactttcaacgcagaagacggtagatatatgtgtagctgttcactttcatcacttcctcttcaacagaaccgacgaaattttgctgctcttgttaacaacttacgagtactaccgtgtgtccgtaaaaaaaaaaaaaaaaaaaaaaaaaaaaaaaaaaaaaaaaaaaaacttaggg

SEQ ID NO: 14401 - DNA, 987 bp, Sorghum bicolor
  Clone ID: SORBI-28MAY03-CLUS2715_1
gccggccgggccgggctagaccagagagctggaccgcgcgcctgtctgcactcgtcttcttcctagcagagaaaaagcagaagacatacaaagatgtccaagatggcggagcagaaggcggcggccgtagacggactcggaggagccggggcggcggacgctgcgccggcgggggaggccgcggcggcgcgtgtgcggcccgttgagacgctcctgcgcgcggcgccgctggggctgtgcgtggccgccatgaccgtcatgctccgtgaccagcagagcaacgagtacggcaccgtcgcctactccgaccttgggggctttaagtacctcgtctacgccaacggcctctgcgccgcctactcgctggtgtccgcgttctacacggccgtgccgaggcccgccaccgtatcgcgctcctgggtcgtcttcctcctcgaccaggtgttcacgtacctgatcctggcggccggtgccgcggcggcggagctgctgtacctcgcctacaacggcgacaaggaggtgacgtggagcgaggcgtgcggcgttttcggcagcttctgccgtcaggcgcgcacatccgtagccatcaccttcggcaccgtgctctgtttcatcctcctctccctcatctcctcgtaccgcctcttcagcgcctacgaggcgcccccgtcgtcggcgctcggcagcaagggcgtcgagattgccgcatacccacgctgaagccgcgcgccggccttccatcgggggctctggagggagacgtggttgcagatctctattatatgtgtaggcgatcaagtaataagggcttatatttatatatataatacttcgttcatatagtagttgtttgctgctacatatgattagtacagtgctgctgctgctgctgctgctaaattgtgcttgactcggtaattatatggtttgaaacgttcttgtgtgtactggatggatcgatcctaaaatttttactggtttctgtgc

SEQ ID NO: 14402 - DNA, 1230 bp, Sorghum bicolor
  Clone ID: SORBI-28MAY03-CLUS34_1
ggccgggcgtccacaccacccatcgtctccgctccagcgccactcgcatcgagatcgagacgacccgcgtccgccgctcccgtgcaccgccgcgactcgcacccccggaagtaactctattccttgatcaacatgtcgcgggaggagaatgtctacatggccaagctggctgagcaagcagaacggtatgaggaaatggttgagtacatggagaaggtggctaagaccgttgatgtggaagagctcaccgttgaggagcgtaacctcctatctgttgcctacaagaatgtgattggggcccgccgtgcctcatggcggattgtctcctccatcgagcagaaggaggagtcccgcaagaacgaggaacatgttgctcagattaaggagtaccgtggcaagattgaggctgaattgagcaacatttgtgatggtatcctgaagctgcttgactcgcaccttgtgccttcctccactgctgcagagtcgaaggtgttttacctcaagatgaagggtgattatcacaggtaccttgctgagtttaagactggtgctgagaggaaggaatctgcagagagcacaatggtagcttataaggcagcccaggatattgcattggctgaactggcacctactcatcccataaggcttggacttgcacttaacttctcggtgttctattatgagattctgaactctccggacaaagcttgcaaccttgcaaagcaggcatttgatgaggctatttctgagttggacacgcttggtgaggaatcttacaaagatagcaccttgattatgcagctcctaagggacaacttgaccctctggacctctgacatcacggaggagggcactgaggagggcaaagaagcctcgaagggtgatgctgagtagcctggtaaaccttgatggatggttcggcatgtttttctagcccatcttgttggacgccctgtgctgattgaaggtgtttgctgctccatgcattccaagattctgtcttctcgttccctccctgctgtagctggtggtagtagtcaaattagccccattgctttagttggctctgggtccatttggactgatgtattgttactgctgttgaagtcattcgttctcgttttgctcttgcagtagattgctgttgggttgtgctttaaaaaaaaaaaaaaaaaaaaaaaaactcgagactagttctctcggattcttcactcatttggctggtcagac

SEQ ID NO: 14403 - DNA, 1274 bp, Sorghum bicolor
  Clone ID: SORBI-28MAY03-CLUS3663_1
aaaaaaaaaaaaacctcgttcttctagcgaagcaaaagcagccgaatcgtctcgtctcgcctcttcagttctcttctcttctcccctccccgcagcccggtttcccgaccaggttccagagaagccaacccaaccccccgtccggttcgcgcgatggcggaggagcagcccaacccccagccgcagcaagcggaggagagcgaggttgttgtggagcagcagccgaggagggccccgaagctgaggtacctggacttcgtccaggtggcggcggcgcaggccgtggtgtgcctcgcggggctctacggcctcgccaaggaccacgccggcccgctccgccccggcgtcgacgccgtcgagtccaccgtcaagggcgtcgccggccccgtctacgctcgcttcggcggcctgcccctcgacgtcctcgccttcgtcgaccgcaaggtggacgacacggtgcacgaggtggacaagcacctcccgggcgcgctgaaggcggcgtcggcgcgtgcctacgcggtggcgcggggcgtgcctgaggtggcgcgcgagctggtggcggaggcgcagcagtcgggcgtgaagggcgcggcgcgcgcggcgctcgccagggcggagcccgtggcgagggacgtgtacggccgcgtggagcccgtggcgagggacctgtacgtgcggtacgagcccgcggcggagcacctggccgtctccgcctggcgctctctcaacggcctgccggtgttcccgcacgtcgcgcagatcgtcgtgcccaccgccgcgcactgggccgagaagtacaacagggcggtcgtcgccgcggccgagcggggctacgccggagccaagtacctccccgccatccccactgagcgcatcgccaaggtgttctcgtcgccggatgccgagccgctggccgccgagtcccagtagtgtttgtcagtttgtgtgtgcgctcgtcgtgacggcaggcagggcagtgcgtcgtttaccctgatgatgatgatgatgatgatgagtggtgaactctggattgccctcgaactgcagaactgaataagaaaggggaaatccgggggctaaagatggtggtactggtattgtggtggtgttgtactagatgcgtgatggggagcgatttgtcatggaccgtgatcatcatgatgatgatgatgctatgttccactagcgctctgctttgcgctctcctccttgctttttttttataaaagaaagtcgttcgatgtcgcgatcccttttaaaaaaaaaaaaaaaaa

SEQ ID NO: 14404 - DNA, 1473 bp, Sorghum bicolor
  Clone ID: SORBI-28MAY03-CLUS4423_1
gcacgagggtttccttcgtcttcccatgaagaaaccgtactagctgtagctgctaaaacatttgagtccctctgctgccaaaaaactcctcttccgaccgcacgagcccagaaaccacccaaaatcacccctgtttccgcccagaaaccgcggcccgcacgggatatttcctttcctctcctttcccctcctcttccgtccgcacggccgaagcgaagcaactccaggcgagggaaaaagggagacaagagcagagatcgaggtcaggatcgaagctgagcttgacaagaggatgagcaccgtggcagccatggcgtcgtcgtcgctgaacccgaacgcgccgctcttcatcccggcggcgtacaggcaggtggaggacttctcgcccgagtggtgggagctcgtcaagaccaccgcttggttccgcgaccactggttccgccagcaccagctccacgaggccgcctacgacgccgcctttgccgccgacgcagcggacgacttcgacgtcgccgcgcttctccccgatgactccgtcgacctcctcgacatggtcgacaccgacgacctcttctacgcgcccgacgtccaccaccaccaggccgccaagccggcgccggcgcccgggtacgacctcgacgtgctcagggcgctcagcgtcagctcccccagggctgccgccactgtcgtcgccgcgccgtcgccgcagcagcagaggtacgcggacaagccggcgtaccacgccggcggcaggggcgccgcccgccgcgccatccaccagcctcgctagaagaagagcaccttctcctcctgccaccatggctgctgtgcctagtgtaacctcaagcaattaaggtagtctttctgtgtatacaactaaaaaaaaccagaggggggattcggcgggccaaggcggccagtgctctctcctcgtagctagtttttcgcctgttcagctcagttcttgttcatccagccgtgttagaaaacaaaaacaaaaacaaaccccccaaaaaaagaggcagacggagtgatgtactgttcctcctcccatgtccatgttgttgaatatatgatggcaagcagtctgatctttacaactcttcgccaggtgtttcttgttcgttgttcctcaaaatctttttgctgtgtgcctgtgtttcagtgtgttctctgatttgggagttggaaagtgtgtgtgttctgtctgctgaactttggtgatgctgactttacttctcgccctgcctttggcgatgccatcatccatggtgattacaagcagttggtgaaggaagattgggggcaactggtttcctggttcttggggaaatggtggtggttggtgagtggcagtacaggaggaggtacgagcaccatcaagcccctcaaaagagtgcagtactagagtgtgtatagctgtttgagaaaatgggattcaaagctcggttgctacatataaagttcatccgt

SEQ ID NO: 14405 - DNA, 717 bp, Sorghum bicolor
  Clone ID: SORBI-28MAY03-CLUS45276_1
ctacgaagatttttttgcatcctgcgagtatcatttggcagaacatggcctacttgtcctccagtcgatcgcgtgccctgaggaattgtatgacaaaatgaggacgaggcctgagttcctgaaggaatatatcttcccaggtggctgcctaccttctttagctcggattacatctgccatgtctaatgcatcaaggctatgcgtacatcacgttgagaatattgggtaccattattacccgactctgattcactggagggacaactttgtggccaatagagaaaaagttttggcccttggatttgacgaaaaattcatacgtacttgggagtactatttaaactactgtgcagctatgttcaaatcacacatgggtttggattaccagatagtgtttgctaggccaggcgattcaaagatgccgagctatgttgccattgcataaacggaggatgtcgttcttatgtttcacaatatatgtgagagatgatattgcattttctctatttgtgtgtgttttagtacttatgtttgtgtgctttaatttgcattgagattgatgttccacacaggatgtgaattagtggacaagccatcgagtcctgtaatgaaacatgtttagtggatgttcatttgaagactggttaccatattgtttaagtatgttgaggtgcattaattaataaaagagaaaaggcactggattttgtgtgcgcc

SEQ ID NO: 14406 - DNA, 1828 bp, Sorghum bicolor
  Clone ID: SORBI-28MAY03-CLUS28656_1
ccctcggggaaaagagacgcaccggcacctaccagccgccaccttcccctttatactcgccggaggcgaaccaaccagtgctcgtgccaccctcgtcctcctcttcttccttgtgatctccgaattcccatctcagattccaagggggcgcgccgtgcaatccccggctctccccgcccaccatatatccgaggctccgcccccgcgtctcgaatccttcgctgttaccagttgttgttgtctgtctgccgtgatttgagccgggcggacggacggacggattgatcccgggacgaggtgtctcagttcttgatcctgggaggcgttcctggttgatttggtgggaagcgaagaagccatgataccttccgtgaggctctctcctggtcctgcagccttctcaggctccagcctacgctcaaaattaccgtcaattccatccatctctagtcttaaaccctccaaatatgtggtctcctcgctgaaaccactctacctagcaccgctagatggtccacgcactgcagagcttaagtctcggagacagccactcgagttccgttgcgctgcttctgctgccgatgacaaggagtcaaagactaaggcggtgccagttcagtcagaaggcacgcagaggctaaagatttccatctatttcgcgacctggtgggcgcttaatgtgatatttaacatttataacaagaaggttctcaatgctttcccttacccttggctcacctccacactctccctcgcctgcggctctgcgatgatgcttttctcttgggccacccgccttgttgaggcccccaagactgatctagacttctggaaagtccttttcccggtcgctgtggcacatacaattggccatgttgctgcgacagtgagcatgtctaaggtggcagtgtcatttacacacataattaaaagcgcagaacctgcattcagtgttttggtgtcaagattcatccttggggagacgtttccagtcccagtctatctttctctccttcctatcattggtggttgtgctctagctgctgtcacagagctgaactttaatatggttggatttatgggtgccatgatatccaaccttgcattcgttttccgcaacatcttctcgaagaggggcatgaaggggaagtctgtcagtggcatgaattactatgcttgcctgtcaataatgtccctggtcatactgactccatttgctatagctatggaaggccctcaaatgtgggctgctggttggcaaaaggctcttgcagaagttggacccaatgttatctggtggattgctgcacaaagcgtgttctaccacttatataaccaggtgtcctacatgtctctcgatcagatttctccattgacgtttagcattggcaatacaatgaagcgtatatcagtgattgtttcatcgatcattatcttccacacacctgtacgccctgtcaatgcactgggagctgccattgccatccttggcacattcctgtactctcaggcaaaggcgtgaggctaaagctctcgcaaagatgagagggggccatggatgacgaacgtctctgcagaatcagtagcaagcactgaatccaattttgcttgttccagtgtggcatgtagatatagggttaggtttccgtatgagagaggtaataatggatgaatggctctgctgtttcgttcttgtttgttgaccagactgaaatccataggccatgaactgcggtcgagtgagtgtacctgaataatactgtaacggaattcgccgatgctgtttctttctgggtatatatagtccaaccgaaatcgcggtttcaat

SEQ ID NO: 14407 - DNA, 1331 bp, Sorghum bicolor
  Clone ID: SORBI-28MAY03-CLUS2908_1
gcacgaggcctatacactgctacaggctagagcttctgttcatgctgccgcgagcgccaacgcggccgtcctcatcccatcctaccagccagcaagcctctcgtcgcaattggctagttccataaataggagtagtaggcagttgctcactggtccctcgcgccgcacgaggctctggactactcccgaaccgcgccgcagatctactccaacacctctgcagcggcggcggcgccgccgccggtggaggacagcaagagaggcacgatggccgggaagagggagcggatagcgatccggaggatcgacaacctggcggcgaggcaggtgaccttctccaaaaggcggcgggggctgttcaagaaggccgaggagctctccatcctctgcgacgccgaggtcggcctcgtcgtcttctccgccaccggcaaactcttccacttcgccagcaccagcatgaagcaggtaatcgatcggtacgactcccattccaagaatctccaaaagtctgaagcgccgtctcagctgcagtcacatattgatgatggcacttgtgcaaggctaaagcaggagcttgctgaaaccagccttaagctcaggcagatgagaggagaggagctccagaggctgagcgtccaacagctgcaagagcttgagaagaccctcgaatctggcctcggctctgtactcaaaaccaagagccaaaaaatccttgacgagatcagcggtctggaaagaaagagaatggaactgatcgaggagaattcaaggctgaaggagcaagtgacccggatggcaaggatggagacgcagcttggcgtcgattcagaaattgtgtatgaggaagggcagtcatctgaatctgtgacaaacacatcctatccgcgcccatcaacagacactgacgactgctccgatacatcgctcaggctagggctaccattcttcagctcgaagtgatggaaaatcaggaaacttgacatgttcagtagcggagcggtgctgattacttgccctctccgttctggattggggagcaggattgctggattagtgaccaacgcgtcgcatcaaaataaggcattctgagtgctgtatgatgtgtgtattctgaaagtgagactgcttttgttatatacaggcagcatggtaataatacaacgggtacccgctaggatgctacctgcagtccgtgttctgtcctctgttttttagtactcgtataatccccctgcaaaccatgtttacctgcagctcatgcttttgttatacagcatgatctctttaggagttattccagtccctgcaaatgagttcccagtacttgtgcc

SEQ ID NO: 14408 - DNA, 414 bp, Sorghum bicolor
  Clone ID: LIB3481-015-P1-K1-F10
cgtccgatgaagcaggtaatcgatcggtacgactcccattccaagaatctccaaaagtctgaagcgccgtctcagctgcagtcacatgcagatgagaggagaggagctccagaggctgagcgtccaacagctgcaagagcttgagaagaccctcgaatctggcctcggctctgtactcaaaaccaagagccaaaaaatccttgacgagatcagcggtctggaaagaaagagaatggagacgcagcttggcgtcgattcagaaattgtgtatgaggaagggcagtcatctgaatctgtgacaaacacatcctatccgcgcccatcaacagacactgacgactgctccgatacatcgctcaggctagggctaccattcttcagcccgaagtgatggaaaatcaggaaacttgacat

SEQ ID NO: 14409 - DNA, 659 bp, Sorghum bicolor
  Clone ID: SORBI-28MAY03-CLUS2596_2
gccggccggggccggccggtacccgtggctgcgccgtcccccgcactcgagctccgaagccatcgtatccggcggcagaagcagcggcggcgagatggtgaaggggcgcacggggcagcgcgtgaggctctacgtccggggcaccgtcctcggatacaagaggtccaagtcgaaccagtacgagaccacgtcgctggtgcagatcgagggggtgaacaccaaggaggacgtcgcgtggtactgcggcaagcggatggcctacatctacaaggccaagaccaagagcagcggcacccactaccgctgcatctggggcaaggtcacccgcccgcacggcaactccggcgtcgtccgcgccaagttcaggtccaacctgccgccggaatccatgggccgcaaggtcagggtcttcatgtaccccagtagcatctaaagataatttgaaggtttggaggatcatgcttttcttctagattttatctaaagctgtccttgtaagggttgtgttcaggttgagagttagcaggttgagctgtctatttgagaaccctttaaagttctccaagttttggtgttatgaatcacttgaaacattattatatggagttgaagttagaactgagttaatttgccaaaaaaaaaaaaaaaaaaggccccta

SEQ ID NO: 14410 - DNA, 702 bp, Sorghum bicolor
  Clone ID: SORBI-28MAY03-CLUS2596_1
actgtgcggcgctcgagccggccgggccgggccggggtctaatctgcacgagctgtctatgtccggcggcggaagcgaagcggaaggaagcaaggcggccaccatggtgaagggacgcacggggcagcgcgtcaggctctacgtccggggcaccatcctcggatacaagaggtccaagtcgaaccagtacgagaccacgtcgctcgtgcagatcgagggggtgaacaccaaggaggacgtcgcgtggtacgctggcaagcgcatggcgtacatctacaaggccaagaccaagagcagtgagacccgctacaggtgcatctggggcaaggtcacccgcccgcacggcaactccggcgtcgtccgcgccaagttcaagtcgaacctcccgcctgagtccatggggcgcaaggtcagagtgttcatgtaccctagcagcatctaaggttttgttggagtaaagatggactagaaatggccatgcgtatttcttacttctctgagcttaaaatgccatgtgttggcaagttagattgttcaagtactgaacctgtcgaagtcctgccaaaatttgttgtcaaacggatgaactattgtcgtattgttatgccagcagcatatctcaaaaaaaaaaaaaaaaatatttttgccccgtgacatcaatgtctcattgcagtatgttcaagttcttgtgcccccctaggg

SEQ ID NO: 14411 - DNA, 607 bp, Sorghum bicolor
  Clone ID: LIB5052-003-A1-XP1-G11
gccggccgggttccggtctccggcggcggaagcgtaagctgaaggaagcaaggcggccaccatggtgaagggacgcacgggacagcgcgtcaggctctacgtccggggcaccatcctcggatacaagaggtccaagtcgaaccagtacgagaccacgtcgctcgtgcagatcgagggggtgaacaccaaggaggacgtcgcgtggtacgctggcaagcgcatggcgtacatctacaaggccaagaccaagagcagcgagacccgctacaggtgcatctggggcaaggtcacccgtccgcacggcaactccggcgtcgtccgtgccaagttcaagtccaacctcccgcctgagtccatggggcgcaaggtcagagtgttcatgtacccgagcagcatctaaggttttattggagtacagatggactaggagtggccatgcttatttcttacttttctctgagcttaaaatgccatgtgttggcaagttagattgttcaagtactgaacctgtggaagtcctgccaaaatttgttgtcaaacggatgaactattgtcgtaatgttatgccagcagcatatctcaaaaaaaaaaaaaaaaaaggccccta

SEQ ID NO: 14412 - DNA, 1448 bp, Sorghum bicolor
  Clone ID: SORBI-28MAY03-CLUS7022_1
gccggctatcatcgcagaatgagcatacggattcagatcgcggccgcggcgaccccccgagcagaggaacccgatcgagcgcggcagtgcaaatccccaatctcagatcctgctgcgccaaagccgggttcgattcgagcagatggcggcggcatgggcggtgctggcggtgttgctcgtcgcggcacaggtggcgtcggcggccccggtcacggcgccagcgttcctctgggcgcccaagaactacggattccgctctgatgatgctaaggaggtagtccattatcagacaatctcaccaaagagcttagctaaatctgttctcgaggaaggtggttggtcaaactttatgtgttcaagggaggatactcagaagagtattgatgttgctgttgtttttattggctcaaagctacaatcgtcagacatatctaaagataagcaagatgatctgactttagcagacacattgaagctctccttcacagattcagagttttccatggcattcccctatgtttccacatcagatgatgagaaattggagaactcattgctatctagctttgctgagaattgtaacagtggttttggaagaaaccgtatcacctacacagacacgtgtactgtaagtggtcaagatgtgaagaaatatacaaacatggatgctattgatgacttggtacggtatggcgtagggtcaaggagaattaacccaagtgaacagactgatataattgttttctgtagcggtgggttcgagaattttttcactccgaaatcagaaggagagttgctttcccagcttgttctcttgctggagcagtctggggctaaatacacgattctttatgcttcccaaccatctggtttactggagaacccttccagcttgccactaggtaggtatcttgcagagaagactaagggtacaaaaactggcgagggcaaatgtgatggagagtgcctagtcaaatcaactcttcttgagggaacttttgttggaatagtgcttcttatcatcctgatatcaggactcatgtgtatgatgggaatcgatactccctcgaggtttgaagctccccaggaatcttgatctccctttgaagcagaatctggggatttgacgaggcacagagtggagggactgatgtttgtcggtctacactgtggatattgtttagtttcccctttgaaagtgccttgtgtattttactgagccaactgttatttacaatgcgctcaaattttttgtgtaatattacgtttcatgtctatggacatctagctgagccattgcaaacaagcatatgtgactgtcaggcttgtgctgtactagacatagcattgcctgcagtgttttctgtgaataacctgaaattcaggtaaccaataagatgggtactatgcatcaaataaaatgaaatctttgccatttgtttgatcag

SEQ ID NO: 14413 - DNA, 1006 bp, Sorghum bicolor
  Clone ID: SORBI-28MAY03-CLUS6091_2
caatttaatcaaacacccaaagttcatcactgataccaaggctgctattgccgaaacttacaaccagacagattcagaatttcttaaagctgacagcagtcaaactcgagatgctggctcaactgcctcaacagctatcattgtaggtgaccgtttgcttgttgcaaatgttggagattctagagctgttatttgtaaaggaggacaggcgattgcggtttcaagagatcacaaacctgatcagacagatgagagacaaagaattgaggatgcagggggctttgttatgtgggctgggacatggcgagtgggtggtgttctcgctgtctctcgagcatttggtgataaactcttgaagcagtatgttgtcgctgaccctgaaatcaaggaggaggtggtcgacagctccctcgaattcctcatccttgctagtgatggactgtgggatgttgtcactaatgaggaagctgttgccatggtcaagccaattcaggacccccaggaagcagcaaacaagcttctcgaagaagcttcccggaggggaagctccgataacatcacagttgtcattgtccgcttcctagatggaactaccggtgataaatcaggcgaagacaaagagaccaccaatgaccaaaactcctagttgtctcctgtagggctgcatcatgcgtgtgtgatcttctggctgctgtatctgatgctcaaagtagatgctccgtgtgtcttggctgctgttccgcattccgtaaggaaactgactgcccccatcgtcgtcctgatgctgctcatgctcctggctgcagaatgacgaatagggctggtgtagttacagtatggtccccttttccccatctttccgttaagctcagtgatgtagctgtccgtgctgttgattcatgaaatcatgctagagattttcctggcagtaagtgcgtgtaaaactgtcgaactatttgaacgaaagttgtacactgcagtatgtacaaaaaaaaaaaaaaaaagg

SEQ ID NO: 14414 - DNA, 1126 bp, Sorghum bicolor
  unsure (1)..(1126): unsure at all n locations
  Clone ID: SORBI-28MAY03-CLUS6091_1
taggggccttttttttttttttnnttctttctcgttaaaatcaaacgacaagagataggggccttttttttttttttttttatactagtaatcgattaaagggacagggaggggaaggagacgaacaatttttttttttttttttcctgtctcaaccaacaatcaacaacggcgtgggattaacggatatgaacctcctcttcctcaacccggccatcataacccacaaccaccaccaatcattcttcctcgttaaaatcaaacgacaagagaaataagcaatagtacgtagcatacaggtactagtaatcgattaaagggacagggaggggaaggagacgaacaattttttttttgctttttttcctgtctcaaccaacaatcaacaacggcgtgggattaacggatatgaacctcctcttcctcctcccggtggacggcggcgagatcatcagccgcggcagcgcgtgatggcggagcagccgcgggagtaggggttggcctgcccgccggggcggcagttgtagtagagggcgagccggacggagcaaggcacgttgtccctgcgcagcgcgccgcagccgccctagccgccgccctgctgcccccgccgcgcttgccgaaacttacaaccagacagattcagaatttcttaaagctgacagcagtcaaactcgagatgctggctcaactgcctcaacagctatcattgtagcgcgccgtagctgaggtagccgccgccctgcagcacccggcgcgccacggagtcgccgccgctggggaagccgaactcctcgtcctcccccgcgcccaccacgccgaggtcccagcccagggacgccgccgctggcacgtcgcccgacgacgcgcgggccagcgccgccagtgccaggagcatgaggagcgggagcgggagcaggagcgcgcgcgtcggcctcgccatcggcggcggatggggtggatggggaatggaggaggaggagcggggcaggggaggggaggggaaagagggctgcgctctgctctggcttttgcgtctgtggggtttggtgctgctctgctctgctggctgctgttgcggctatggcgaagggtgtttctcccgggccgcctcgagcgccgcaca

SEQ ID NO: 14415 - DNA, 346 bp, Sorghum bicolor
  Clone ID: LIB3480-009-P1-K1-D9
ggggccgtggggaccaccaccaccaccggcaccggcacctccatccgcgcgcctctcgctctcgctggtggtgctcctcctgctcgcggggccctcctcctgctggtgctgccagggccgggagggcggcgcggaggtggcgcgcatggggctcgccggggacgggtcggcggacaccgcccaacacctcagtaatagtgaaaatgggcggttcagttatggagttgcgagttctcctgggaaaagagcatcgatggaggacttttatgaggcaaggatagacgacgttgacggagagaaagttgagatggtcggtgtatatgatggtcatggaggagtcagagca

SEQ ID NO: 14416 - DNA, 1031 bp, Sorghum bicolor
  Clone ID: SORBI-28MAY03-CLUS9700_1
gcacgaggggatgatatgtcagatttagtttcagtagggtcttgtgttctggttgttcttcttcatggaacagatctgtgcatcttaaatttgggggacagtagagctgtgcttgcttccatgccatatgtacaaaatggtgctttgaaggctactcagctgacagagacccactcgcttgaaaatcctttggagtaccaaagacttttagctgaccatcccgacgattcttcagttgtcaggggtaacaaaataaaaggaaagttgaaggttactcgtgcttttggagttggctatctaaagcagaggaagttcaatgatgcactgatgggcattctacgagtccgcgatttgagcagccctccatatgtttacacaaatccacacacattgagtcacaaagttacagatgatgacttgtttgttgtgctcggtagtgatggcttatttgatttcttcagtaatgatgaagttgtttggttggtttatcaatttatgcgtgataatccaatgggggatcctgcaaaatatctcattgagcaacttatactcaaagcagccaaggaagcagctttaacagccgaagaattgatgaggatacctgttgggagtaggaggaagtaccatgatgatgtgaccgtcattgttatcatccttggaaatgcacagaggacgatgactgcatcaacttccttgtgaaagaatggagagatagagagacgggctatcagctggtaaatttttgtgggtgtttgcatatgtgcctgtttcaaattacaaggttttttttttgttgagaatggtgtggtagtcaacaaaccaaataaaaatgtacatattgttttgaaacaaaaccttgtgttcaatcacaaggtgcacatggatttgtttgacctacttttgtacatggatcaaacatggaggctcgtacttgagctaatgagtccatgagcagagtggtagatcgtttcagtttctgattgccaatctttctctgctaagtaaaaaaaaaaaaactcgagggggggccc

SEQ ID NO: 14417 - DNA, 2573 bp, Sorghum bicolor
  Clone ID: SORBI-28MAY03-CLUS9131_1
cggacgcgtgggccgttccccaattcgaaatcgaatcgggtcggtcttgccgtgcgtgcgtgcgtggctgcgcgaacgactcgactgcacaccccccaccccgctcctccctccctcccgccgccgggtcttcccccctagggtttcgccgcgatgtcgctccggccgagcgagcgggagcagatgcggaagggcaactacaagcagacggtggacgcggaggagagccgccgccgccgggagggccagatggtggacatccgcaaggccaagcgcgaggagagcctccagaagaagcgccgcgacggcttcccggcctccgccgccggcgccgtcccgcccatgggacactccaccgcgctccagcagaagctcgatggcttgcccgctatggtgcaggccgtcctctccaacgaccccaccgtgcagcttgacgccaccacgcagttcaggaagctgctctccatagagcgtagtcccccaattgaggaggtgatcagcacaggagtggtccctcgattcatcgagttccttacacgcgaggaccatccccaactccagtttgaggctgcgtgggcactcaccaacattgcctccggcacatcagagaataccaaggtggtggttgagagtggtgctgtgcccatctttgtcaagctcctcaactcccacagcgaggatgttcgtgaacaggctgtgtgggctttaggtaatgttgctggtgactccccaaagtgccgtgatctggtgcttggtcatggtgggcttttccccttgctgcagcagcttaatgagcatgctaagctctcgatgctcaggaatgccacatggactctctccaacttttgccgtgggaagccacaaccaaactttgatcaggtcaaaccagcattgccagcactgcagcgccttatccactctcaggatgaggaggtcctaactgatgcctgctgggctctctcatacctatctgatgggactaatgacaaaatccaagctgtcattgaatctggcgtgttcccacgccttgtggaacttctgatgcatccttcggcctctgtactcattcctgctctgcgcacggtgggtaacattgtaactggggatgacatgcagactcagtgtgtcattgacaatcaagcacttccatgccttttgaacctcctgactaccaaccacaagaaaagcatcaagaaagaagcatgctggacaatctcaaacatcacagctggtaacagggaacaaattcaggccgtgatcaatgcaaacataattgcacctctggtgcaacttctgcaaactgctgaatttgacatcaagaaagaagcagcctgggcaatttcaaatgccacttctgggggcacacatgatcagatcaagtaccttgttgcccaggggtgcattaagccactctgtgacctgcttgtctgcccagatcctagaattgtaacagtttgcttggagggtcttgagaacatcctgaaggttggcgaggcagagaaaaaccttggtggaggcgatgtcaatgtctatgcacagatgattgatgatgctgagggccttgacaagatcgagaacctgcagagccatgacaacactgagatatatgagaaggctgtcaagatgctcgaatcctactggctggaggaggaagatgatgccatgccctcaggcgacaatccccagaatggcttcaactttgggaaccagccctctgttccatcaggtggattcaactttggctgaagatgcccatttggaatggcggctgtgccattatgccttggctagtgcttggggctagtcagaggtggggtagtcgcgtcgtccaagtcgtggttgggtcccattggtctggtctcagggagtcggtcaagtcagtcccagtcagcaacagggtcagtcctagggctgcatcaccagtggtgcagcttggtcagtggtcagtcttcaaggtcagcgggttggatcatttgggctctttgctcccaccaccacctaatggtgggaggcatggagtcgcaggtgttgtcgggagtttgggttttgcctcctcctatatagcatgaatggattatattgtttttacctgtttgatgaggtagaaagaaccttgaaagatagggaatgtgtcggtttttgtcaaagcggttcctgtgctgtataacatgttgcaatgagtattggcacaacttataagacataatgtcaaatgggtttttttggagtccccattcgggcctctcgagtctaatttcattggtttattattgtgtattaattatacacaggttttgtggttggttggtcatgtcttgtctgttgtagtcacttgtcttgtttccttgcttttgtatttgccaccgttgtctgaaagttgttccatgcttatctagaacaatagaaatagaaggccagggggtatttgtgagacattttttatatgaggttatcagtatatggttcctagttttatggtggaacctgatttatcgttgtatggccatgataaaaccattgagaattatggtgtagcaactgaatggaatgaaatcaaagaagaaattccgtgc

SEQ ID NO: 14418 - DNA, 799 bp, Sorghum bicolor
  Clone ID: SORBI-28MAY03-CLUS7943_2
gccggcccgggcctcccatcaaaatgaaccaggggaccggctcttcctcttccgcctcgctctcactcctgctcttcctggccgtgcggttccttctccctgatccttctttggcttcgcggttcatggcgatgtggagggccgccgctaggcagctggtcgaccgggcgctcggttcaagcgccgcacacacgtctgcaggcagcaagaaaatcgttggggtgttctacaaggccggggagtatgccgacaagaaccccaacttcgtcggctgcgtcgagggagcactcggcatccgcggctggctcgagtcgcagggccatcagtacattgtcaccgatgacaaggagggccccaactgtgaactggagaagcacattgaagacatgcatgtcctgattaccacccctttccacccagcttatgtcactgcagagaggataaagaaggcaaagaatcttgagcttcttctcactgctggaatcggctctgatcatattgatcttccagcagcggctgctgcaggcttaactgtggctgaggtcactggaagtaacaccgtctctgttgcagaagatgagctcttgcgcattctgattctgctcaggaacttcttgcctgggtaccaacaggtagttcaaggtgaatggaacgtagcaggcattgcccacagagcttatgatcttgaaggaaaaactgttgggaccgttggggctggtcgtataggcaggctcttgcttcagcgtcttaagcccttttaactgcaacctgctttcacatgacagacttcagattgacc

SEQ ID NO: 14419 - DNA, 802 bp, Sorghum bicolor
  Clone ID: SORBI-28MAY03-CLUS7943_1
gctgctgacgcactctctcgctgcagtatcagtacaacaccgatccagcgcacaccacccagctgagctcgagctctagccattttagcagcggttccggtgtcatcatccatggccatgaggagggcggcgcagcaggcggcacggttcgccatggggccacatgtccctcacactgcgcccgctgcgaggagccttcatgcgtccgccggcagcaagaagatcgtgggcgtcttctacaagggcggcgagtacgccgaccgcaaccccaacttcgtcggctgcgccgagcacgccctcggcatccgcggctggctcgagtcgcagggccaccagtacatcgtcaccgacgacaaggacggccccaactgcgagctggagaagcacatcgcggacgcgcacgtgctcatcaccacgccgttccacccggcgtacgtgacggcggaccgcatcgcgcgcgccaagaacctggagctgctcctcacggcggggatcggctccgaccacgtcgacctgccggcggccgcggccgcggggctcaccgtcgccgaggtcacgggcagcaacacggtgtcggttgccgaggaccagctcctgcgcctcctcggcctcttgcgcaacttcctgccgggccaccaccaggccatcaggcggggagtgggcattgcccacagagcttatgatcttgaaggaaaaactgttgggactgttggggctggtcgtataggcaggctcttgcttcagcgtcttaagccctttaactgcaacctgctttaccatgacagacttcagattgacccag

SEQ ID NO: 14420 - DNA, 731 bp, Sorghum bicolor
  Clone ID: SORBI-28MAY03-CLUS12312_1
ccggaaaacaagatgccacttgccaggacagccatgtacgccaaagggattcagatatattgtgctcccacagctgatgcgtccccaacttgggtggcttccatgacgcatatcgccctcgaagggggatgctttgtggtgtcggcgaaccagttctgtcgcaggaaggactacccaccccctccagagtatacattcggtggcctcgacgaagagccatccccggagactgttgtgtgtcctggaggaagtgtcatcgtttcaccgtccgggacagtgttggcaggccccaacttcgagggcgagggcctcgttacagctgacctcgaccttggagagattgttcgagccaagtttgatttcgacgtggtggggcactactcgcgacgtgaggtgctgagtttggtggtgaagactgatccaaagtctgctgtctctttcactgcttcagccgatggagagagggctcccgctgggaagaagggcgacgactctgtgtacaaataatggccacgtatctgtaatctttccttatacgccaattgcaagtttgccactactacatcgcaactattgcgggcttttcctgtacgtctctgaataataaactgtttatgtacacaacagtcgatgtatattatcctacagatatgagatcgatctcttggttgatggaatcgtacgtgtcagtttgtggctaccttgcatttgttggtcacctcatgagatcg

SEQ ID NO: 14421 - DNA, 2434 bp, Sorghum bicolor
  Clone ID: SORBI-28MAY03-CLUS12717_1
gcacgagggagctccggaggggagaggccggcggcggcgcggcacgatcggcctcagcgccggtgtagctcgcaccggtcggcgtggggggacccgcgagcccatgcgtcggtgaggtggtgggggcccgcttggcgcacgagttggactggcggcggctgcggcggcggggagctggtgggcggtggtccttgcggtggcggtgctgctccggccgggacgtgtcgtcgccaacaccgagggtgatgctctgtacagcctgcggcagagcttgaaagatgctaacaatgtcttgcagagtgcgcgtcccactcttgttaatccatgtacatggttccacgttacgtgtaacaacgataacagtgttatcagagttgacctcggaaatgcacaattgtctggtgtcctagtgccacaacttggtcagctgaaaaatctccaatatttggagctttacagcaacaacataagtggaacaataccccctgaactggggaacttgactaacttggtcagtttggatctgtatatgaacaacttctctggcagtatccctgacagcctggggaatcttctgaagctgcggttcctacgtcttaacaacaacagcttggttggtcaaattcctgtatccttgaccaatatctccactctccaagtactggatctctcgaacaacaacctctcaggacaagtcccatcaacaggctccttttcactcttcacccctattagttttgccaacaatccaggcctttgtggccctggtactacgaagccctgccctggggctcctcccttttccccgcctcctccattcaatcctccatctcccccaacccaatcaaccggtgcctctagcactggagcaatcgctggaggcgttgctgctggtgcagcattggtgtttgctgttcctgcaattgcatttgcaatgtggcgccgtcgtaaacctgaagagcatttcttcgatgtacctgccgaagaggatccagaagtccatcttggtcagctcaaaaagttttcgttgcgggagcttcaagttgcaactgataatttcagtaacaagaacattttaggaagaggtggttttggaaaagtgtacaagggaaggcttgctgatggctctttggtagcagtgaaaaggctaaaagaggagcgaacacctggtggtgaacttcagttccaaacagaggttgagatgattagcatggcagtgcacaggaaccttctcagacttcgtggtttctgcatgacgcctactgaacggttgctagtctacccatacatggctaatgggagtgtggcatcacgtttacgagagcgacagcaatctgagccacctcttaagtgggaaacaagaagacggattgcgcttggatctgcaagaggactttcttacttgcatgatcactgcgatcccaaaatcatccatcgggatgtcaaagctgcaaatattcttttggatgaggacttcgaggcagttgtgggtgattttgggcttgccaagcttatggactacaaagatacccatgtcacaactgctgtccgtggaacaattggacacattgcgcctgagtacctcgccgctggcaagtcctctgaaaagactgatgtttttggctatgggatcatgcttctggagcttattactggccagagggcatttgatcttgctcgtcttgcaaatgatgacgatgttatgcttcttgactgggtgaaaggactgctgaaggagaagaaggtggagatgctggtggacccagatctgcagaacgcctacgaggagatcgaggtggagaacctgatccaggtggcactcctctgcacgcagggctccccgttggaccgcccaaagatgtcggaggtggtgaggatgctcgaaggtgacggcctggcagagcgctgggacgagtggcagaaagtggaggtggtgaggcaggaggctgagtccgcaccgctccgcaatgactggatcgtcgattccacctacaaccttcgtgccgtggagctatccggcccaaggtagccactcggcgactcagacgaaagaattcaacactgaattgccaagattcagtctaattgctgcttgtgtatatgaaaggtagcttttggaattgttagcgacaatttgaagggatggtatctttttttttttggattcctcgctagcctcagaagttggggggtaggctgcagttgtgttaaggtgaaaattcgtatatctgagggtgaatttctaaagcattgttgtagtggtctggggaatgtagcagcgatcgtccaattcagaacagtgttacgttttgtcatagcttagtatgcctttctgcatcttgaaaaaaaaattatgtttaggtttttctgtgtaaaactacaatagtacaatggataatcgttgaatcgacgatacacaactaaatgtgaggct

SEQ ID NO: 14422 - DNA, 1627 bp, Sorghum bicolor
  Clone ID: SORBI-28MAY03-CLUS12916_1
gccctctcaggattgtcgatcgcgagagagaatcctaccaaaccccagctaccaactcgatcgatcatctcatcactcgaccgcacatacaaagcgggaaaaaaaacctaaaaactaactctctccaacttcctctgcctttctgcgtgcttcattcggcactaccactacgagctagatagccagctttcgtgacgaaactagctagctagctacagctagctaaagagagggaagaacaacagctggtgcgtggtgtctcgatcgctgatcatcatcgtcgatcgtcgtcgtcgcgcgccaagatgaccgtcgtcgacgccgtctccactgatgccgccggcgccgccccagctgccgccgcggcgccggtggtggtggcgcagcccgggaacgggcagaccgtgtgcgtcaccggcgcggccgggtacatcgcctcgtggctcgtcaagatgctgctcgagaagggatacactgtcaagggcaccgtcaggaacccagatgacccgaagaacgcgcacctcaaggcgctggacggcgcggccgagcggctgatcctctgcaaggccgacctcctggactacgacgccatctgccgcgccgtgcagggctgccagggcgtcttccacaccgcctcccccgtcaccgacgacccggagcaagtggtggagccggcggtgcgcggcacggagtacgtgatcaacgcggcggcggaggccggcacggtgcggcgggtggtgttcacgtcctccatcggcgcggtgaccatggaccccagccgcgggcccgacgtcgtggtcgacgagtcgtgctggagcgacctcgagttctgcaagaaaaccaggaactggtactgctacggcaaggcggtggcggagcaggcggcgtgggacgcggcccggcagcgcggcgtggacctggtggtggtgaacccggtgctggtggtgggcccgctgctgcagccgacggtgaacgccagcatcgcgcacgtgctcaagtacctggacggctccgcgcgcaccttcgccaacgccgtgcaggcgtacgtggacgtccgcgacgtcgccgacgcgcacctccgcgtcttcgagagccccgccgcgtccggccgatacctctgcgccgagcgcgtcctccaccgcgaggacgtcgtccgcatcctcgccaagctcttccccgagtaccccgtccccaccaggtgctccgacgaggtgaacccgcggaagcagccgtacaagttctcgaaccagaagctccgggacctgggattggagttccggccggtgagccagtcgctctacgatacggtgaagaaccttcaggagaagggccacctgccggtgctcggagagcagacgacggaggccgacaaggaggaggccaacgccgccgccgaggtgcagcagggaggaatcgccatccgtgcgtgagctagagggagatgccacgtacacatgaacacaaaaaagcaatgttcattcatactgctgccctgcccctgctgtgtaaacaaactactagtgtttgttcgctggctgatgatatctgtaccctaaggcttgtaaacgtaatgttcgttcttgtgaactatagtgatgagtgaataaaaatggttaatgttcgttcc

SEQ ID NO: 14423 - DNA, 1944 bp, Sorghum bicolor
  Clone ID: SORBI-28MAY03-CLUS12458_1
cccacgcgtccgcggacgcgtgggtttttttttttttttttttttttttttttttttttttttttcagaactacataccaactagaaaaactgcaaatattgcttaagcatccacaggacgcgaggagcacaaaaatgaaagaatagcctgaatccataaacaaatgttggactgaacatcgtcatacaaagggtacatccttgcatggcgatagtacaaatcaggcaaactgaattcagcagctcagcgcaaaccgatacatgtactcaggggcatgcagcaacactcatctacttacagaagcgcagaggatttgttacatcgacatcttttcatcttttcagggggtaaaggggagtgataacctcggacaaaaaataatcacacatattgcctatcttataccacatctggcaatgtcgatctccaccagtttctaacagacattaatttggtcctcaactaatcttcaagccgtcctctcagccagagatcaccaccctacaaaggcacattgcttccgtgcatgctcagggatcaacttcaccaggaaatccatcggtacactcttcagctcatggggcttgaaattgaagagaggtggaagaaagcggccatttggtaagcgggtgtttggatcccgaagttcatcaaagaatggatggatcaatgcttccaaagcagtggaccgaagttttggcgagtactgaagaagcctggacacgagatctactgcttcagcaggcatccttttatggaagatcttatgccatgggtgagctttgatttgcgggaatttaaattcggtataatttggattcatgcacttaatttcttcacgtgtgggtgtgcccagaaccttgatgatttcaacaagctgatcaacaccgctttctccagggaatagtggctgccctagaagcagctcagcgagtacacagccagcagaccaaacatcaatggctgtagtgtattcagtagcaccaaatatgagctctggagctctgtagtacctagaacagatgtaagaaatgtttggttcgccttttaccagaactttcgcactgccaaagtcacacagttttagctgatgggtatgagggttaaccaggagattttgcggcttaatgtccctgtggcacactccaatgctgttatgaatatatgccaaagctctacaaatctgatacatataaagttttgcatatatcaaaggcatgcgctggttcatcttgttataatgtttaatgacacgatgagcagtctccggcacatactcaagcaccaaattgagataaagctcctctttctcagtctttgagaaaaaacagtgctttagagccaccacatttgggtggtcaagcactcgcatagtctgcagctcacgattcttgtatctcttgtcttgaagaaccttttttatagctacggtctcaccagtttccagacacttggcctggaaaacagttccaaaggacccatgacctaccacccgctcagccatgtaactaatggtctgctttgcctgcccatttctcccatcaatgctggtcactatgatatgaccaggctctgccccattgccattgactacaatatcttcaacgtccttatcatcccttatgctcatattgcccaactcgttgggaagtcgatctgcgtcgctgctagaacttgtgccattctgaaatcccaaagaagaagaagagcgtgccacgcccaccgaggccatgctgtgacagagctatacgatttgcagcacaaactactgtccaagcctccaaggggcttccttaaaggcgtgatgcacttgattcaccggatggatcttctcggcgcgcagatcggcgtcggagccggaagccgggaagcttctcccctctccctccaactccggctcgaggagggaggattgaagaagagaggggggggaatccggaggc

SEQ ID NO: 14424 - DNA, 1708 bp, Sorghum bicolor
  Clone ID: SORBI-28MAY03-CLUS5842_1
gcgcgtggctcccccccgcccctttcccacgtggtgcgggagccgggcggtggtactgggccgccgcctcgcgccgtccgcccgccggccgacgagcaaaagggaggaggacggaggaaagcttgctctgctctcagagagggagagaagagagaagcagggcaggggcagcccatggcctctgctccagccgctatataagaccgacccgggcgacgcctctgcttccccgtagtccgtccccccacccgtcctggtctcactcatgcttcggtccacgcacccaccaagccccaccagcggcagcggcagctccgcggcgccggcgtcgtccagcagctccgacgccgcgatggtcgggggcggcgcggcggcggcgggcagcggcgccggcgccggcgggccgagcggcgccaagctgctgcagatcctcaacgtgcgggtcgtgggcaccggcgaccgcgtcgtggtgctgtcccacgggttcgggacggaccagtcggcgtggagccgcgtgctcccgtacctcacccgcgaccaccgcgtggtgctctacgacctcgtctgcgccggcagcgtcaacccggagcacttcgacttccgacgctacgacacgctcgactcgtacgtcgacgacctcctcgccatactcgacgcgctccgcatcccgcgatgcgccttcgtcggacactccgtctccgccatgatcgggatcctcgcgtccatccgccgccccgagctcttcgccaagctcgtcctcatcggcgcatcgcccaggttcctgaacgacaatgactaccacggcgggttcgagctgccggagatccagcaggtgttcgtcgcgatggcggccaactactcggcgtgggcggtcgggtacgccccgctggcggtgggcgcggacgtgcccgcggcggtgcaggagttcagccgcaccctcttcaacatgcggccggacatctccctccacgtctgccgcaccgtcttcaacaccgacctccgcggcgtgctgggcatggtgcgctccccctgcgtggtggtgcagaccacccgcgacgtctccgtcccggcctccgtcgccgcctacctcagggaccacctcggcggccgcaccaccgtcgagttcctccagaccgagggccacctcccgcacctcagcgccccaggcctcctcgcccaggtgctccgccgcgcgctcgcccggtactagcagcgcctaccgcctgcctgattgtgaacggtatttttttaccgcctcgatttacccctgcccatgcagagaatcaaaaaatggcgcgagtcgcgccgtttgctgtgcctgtgcgcgccatgactgtagtagtacaacttgttctggtacccgatttcctttttttactttttactggagccgagcagtagtactggtactccgcatcttgccttccacccaaggacagataagtgggcctgctggcgacacgtggcgagtggcgagtgctcgaggcggtgcacgagctcgttcccgtcttcgcctggcgccgttgcctttgtcccatctgcaacggcagcaggacgactagaggaggctgtaactttttttattactgctgctgctagtttatttacggctatgatatgagaatgagatagggatcagctggcgccccggcggatcttctgactatgattaagcggctaatgttctggattggtttgattggcatcc

SEQ ID NO: 14425 - DNA, 1500 bp, Sorghum bicolor
  Clone ID: SORBI-28MAY03-CLUS14537_1
cctatctatctcgcgccacgaagcgcgacgccacccagcgatctaggccgccgcctcctcctactgctccatctccctcgctctcgccgcctcgttcgcttcgcctccgctccgctcccctccgccccccgagccgagccgagcagagcgcagcccgatccggaggtggggatggcggacgcgaagcagcagccccagcagacggcggcggcggccgcggccaccaccggcgtctggaagacggtcaagcccttcgttaacggcggggcctccgggatgctcgccacctgcgtcatccagcctatcgacatggtcaaggtgaggatccagttgggtgagggctctgctggtcaggtcacaaggaacatgcttgcaaatgagggtgtccgttccttctacaagggtttgtctgccggtttgctaaggcaagcgacgtacacgactgctcgtcttggatcattcagggttctaactaacaaagcagttgaaaagaatgaagggaagccgttgcctctaattcagaaagcttttattggtctgactgctggagcaattggtgcttgtgttggtagtcctgctgatttggcactcattagaatgcaagctgattcgaccctgccagctgcacaacggcgcaactataagaatgcttttcatgcactctaccgtatcactgctgatgagggagtccttgcgctttggaagggtgcaggtccaactgttgtgagagctatggcactcaatatgggtatgcttgcttcctatgaccagagtgtcgagctatttagggacaaacttggtgcaggagaaatttctactgttgttggagccagtgctatttctggattcttcgcctcagcatgcagtttgccctttgactatgtgaagacacagattcagaagatgcaacctgatgcgaatggcaagtacccatacacagggtctttggactgtgccatgaagaccttcaagagcggtggtccattcaagttctacactggtttcccagtgtactgtgtcaggattgcaccccatgtcatgatgacctggatattcttgaatcagatccagaagcttgagaagaagattggcatataggattgccaaccgaccaatacagggttgaccgctctatgctgttatggcttgactcctataataacgttccagctgcttttgcaccatggtagatggttttggtagagacaagtctggtacaatttttaccttagcttacttgccaattgttatgttgcaataatcaaattatttgttgttggcggaaatttttggggggcgggctttgttggctggatgcagccatgaggacagggggtaatacatagttatgccattgaatggaattggaccatattttatacagatttttttttgcagtcaggcttcactccttttgaactcattgcatttgggacattatttttttgtaatgaaaattgatgtttatgaatcggctgggagattatgggcgcgtttgat

SEQ ID NO: 14426 - DNA, 1052 bp, Sorghum bicolor
  Clone ID: SORBI-28MAY03-CLUS15349_1
cactggaacaaggccatatgactaagaaatgtgcagcacagaggacatatattacacaacattatatggtgcacaacaatggttggaaataagtaccaactactgaactgaaatggacaggatattaagtacatatgaagggtggaataacaaatagttcttcatgtcctacgagtagcatagtgctacttcattattacaaccaccatgcctggtagattaaagagaactaaggtcactggaagtgaagaacgaacgcaacaggctatatataaagtatagccaacagattatatagaaaagtttacatgacgaaacacttagtagaactggatatagaaagtttacacgacgaagcacttaatagaactggatacgtctctaaccatagaattttaatagcttcgcagcaggacatattcctactacctcagttaacacggccaccacggaggcgcaggacgagatgaagagtggattccttctggatgttgtaatctgccaaggtgcgcccgtcctcaagctgcttcccagcgaagatgagcctctgctgatctggaggaatcccttccttgtcctggatcttggccttgacattgtcaatggtgtcagagctctccacctccagtgtgattgtcttgcccgtaagagtcttcacaaatatctgcatgccacccctcaagcgcaagacaagatggagggtagactccttctggatattgtagtcagccagagtgcggccatcctctagctgcttgccagcaaagatgagcctctgctggtccggggggatgccctccttgtcttggatcttggctttaacattgtcgatggtgtctgaactctcaacctcgagagtgatggtcttgccggtgagggtcttaacaaagatctgcatcttgagcgggcggaatcgcgcggtcgagcgacttgccggaggcgtccgagggaagtaggaaaccgcgagacgggagacgaggaacagatttggggggagcttatgggtgattgatcggaatctggtctgagtcccggggatgggaatcggaggt

SEQ ID NO: 14427 - DNA, 1970 bp, Sorghum bicolor
  Clone ID: SORBI-28MAY03-CLUS16619_1
gcacatacaacccagtccatgaaatcaagccatcgttgtacgttgcacccatctgcgacggcaactgtaactcagctgcaagtacgtctaccagatgacgacggcggcacggccacgccgcctcctgcacccgcttggatgcctctgcttcctggtggtcgccgccttcgccgcctccatctcctccgccgccgggcgcgtggtcaccagcttgcctggcttcgacggcgacctccccttccacctcgaaacagggtacgtggaggtggacgaggacgccggcgtcgagctcttctactacttcgtccggtccgagtccgagtccgagtccggcgacgcccctttcctcttctggctcaccggcggcgatcgctgctccgtcttcagcggcctcgcctacgagattggtcccatcagattcgtcgtggagccctacaacggcacgctgccgcgcctgcggtacaaccaaaactcgtggtcaaaggtgtcacatatcctctttgtcgattcaccagttggagctggattttccttttccagagatcctaaaggctacgatgtcggagacatctcgtccacacagcagctacgtgacttcttaatcaagtggttcgatgatcatcccgagtcccttgcgaatcctttctacattggtggagactcctatgctgggaaaattgtaccattcattgggcagatgatttcagaaggtattgaggctggaaggaggccctttcctaatctgaagggctatctggttggtaacgcagccacaggcgaaagtattgatactacttctagagtgccctatgctcatggagttggtattatatcagctcaattgtatgagacgatattggggcattgccaaggagaggactacactaatcctgcaaatacgctgtgtgctcaggctctgtatactttcaacaatctcatcgatgaagttcagcatgcccacattttactggacaggtgcgtctacgcatctcctgcaccaaatgttgtgagcagaatggacggctcagataatagaaggatcttgagggcggagatgggaagagggatgctgaatcatccgccagctcgtcctccatttggctgcctcacttaccgctactacctgtcgtatttctgggcaaacgataaacgcactcgagaagctcttgggatcaagaagggaacagtggacgagtgggtgaggtgccacgatggagatctgccttacacgaaagacctcaagagttccatcaagtaccaccggaacctgacgtccagaggctaccgcgccctggtatacagcggcgaccatgacctgctggtgccacacctgggcacccaggcctgggtcaggtcgctcaacttccccatcgtcgacgactggagggcatggcatctcggtggccaagccgccgggttcacgataagttactccaacaacatgacgttcgcgacaatcaaaggtggtgggcatacggcgccggagtatgagccggagaggtgttttgccatgttcacccgctggatacttaacaatccactctaatatcaactcatgcatttgccggattcttgcactatcatggagacatggactactgtggattgctgctcataggcggaataaaatggatgattgctgtgatatgtgtaaactaggtctgtgtcagtgtgctgcccaggagccaaaaaaaatttcaacgtaataataagatgatcatacggggataaatcatgatggaaaatttcacaacattgccaaaagaagtactaaattgaaggacaaagcacattatatagtgaaatttgattatctcaatgacataataggttattaatcaaattaagacatctttttgtatttcaaaattttataaagtccaatcagtcatttttacatgtaataaagaaacagttgtgagacaacagtatgatcaatttataaattaaacttgttttctttccagtaa

SEQ ID NO: 14428 - DNA, 807 bp, Sorghum bicolor
  Clone ID: SORBI-28MAY03-CLUS1894_1
gcacgaggggagcacagagccagctagcagccgcgagaagcagccagctcgctcgccgcgcccgccgccttcttcctcgcctccgttccgccgcgccgtctctacggttgctaagccgccgccgcatccagggatggagatgaagaagatcgcctgcgccgtcctcttcgccgcctcggccaccgtggcgctcgccgcggaggctccggctccggcccccaccagcggctcctccgccgtcgcacccgccgtcggcgccgcactcggggccgccgtggcctccttcttcgcctactacattcagtgagccggccggccgcgcccagagggaggaggaggaggaggaggaagagacgaaggggaggagacatggctgcgctgatcccaacacgcgcgcgcattccgatgcgtgggcgtgttctgattcgacactcctttgtcttcgtttctttgttctcttccttaatttaacgaattcattgatgcaccaagtttaatttggtgccttgttatttgttcgtccctttagagagagggatcgacacttgtaccattgcttgccatttatttggatcaattcaacaattcgatttaaccatcgcgtatatatgtgtgatttggatgaacgttgccctgatggtgatgaggttttgggttcacggcgttttgttatgccttaacatgttgaggatgtgctggtcgtatgatctaaacttctagttgatacggtagcattttcgtcgctgtgtttttaattttgtaaatagtctatatttagtgtattcgatatgatgagagttaaacttt

SEQ ID NO: 14429 - DNA, 1509 bp, Sorghum bicolor
  Clone ID: SORBI-28MAY03-CLUS16681_1
gggccacccggatggcagcttgggtggacatgggcaaagaaggaggttatatggtcgctgcctgccgctcaggctttaaatcaggctccccaccgccccagatctccgacctcccccattcccccctcgcggccgcaaccgtcggcgccgcagtccggagcaagatcggcgggtagacggacagacgggccggcgggcgcggctctgtatcttatctgtcggtggagaccgcgtgtgtcggttaggcggcgggtggcaaggaagaatggcggcgggcggcagatccgtcgcgtgctgtgccgccgtgctgctcgcggccgcgctgctcctctccgcaccgactaccacagaggcttatgattcgctggatccaaccggcaacatcactataaaatgggatattatgcagtggactcctgacggatatgtcgctgttgtcacaatgtataattttcaacaatttcggcacatcggcgcacctggttggcagcttgggtggacatgggcaaagaaggaggttatatggtcaatggttggggctcagaccactgaacagggtgactgctcaaagttcaagggcaacaccccccattgctgcaagaaagatccaacaattgtcgatttactaccaggcactccatacaacatgcaaattgccaattgctgcaaggcaggagtcataaatacctttaaccaggacccagcaaatgctgcttcctccttccagatcagtgttggtcttgccggaactaccaataaaactgttaaggtgccaaagaacttcactcttaagactccaggccctgggtacacactacaacccacttactccatatgggggtggcataaatgatacggcaatgttctggggtgtaaaattctacaatgatttgctgatgcaagccggcaaacttggaaatgtgcaatcggaactgcttctccgcaaggactcccggactttcaccttcgataaggggtgggccttcccacgccgggtgtacttcaatggtgataattgtgtcatgccatctcctgaaaattatccatggctgccgaatgcaagccctctaacaagacaaccattgacactcccactcttggtattctgggttgccttggctgctctgttggcttatgcatgatgagtgggatcaagaggtttagcaagcttcaagttgatgtcagattccatgaggtgcactgcaacaggtcatttattcattcaattccatggttgcacagaagagatgaggcgatgccaagaaaaaagttgatatgtgtgtgtgtgtttttgtaagttaaagggccaaaatgtatttcttgtttggtatatagcagccctacagcactttggtgaacttagttactgcaaattaggtaattacagttgcaccttttgtattttatagcaaacccagaatttttcattggattatatgactgctccacttcttgtagtaaatgcaaggcttccctgataatgttttaaagattggtcggatagaagag

SEQ ID NO: 14430 - DNA, 595 bp, Sorghum bicolor
  unsure (1)..(595): unsure at all n locations
  Clone ID: LIB3481-057-Q6-K1-A9
cggtcgcgtgggcttgccggnactaccaataaactgttaaggtgccaaagaacttcactcttaagactccaggccctgggtacacatgtgggcgggccattgttggcaggccgacaaagttttggagcgcagatgggcgcagggcaacccaagctctaatgacatggaatgtgacctgcgcatattcccaatttcttgctcagaagactccatcctgctgtgtctctctctcatcgttttataatgacacaattgtgaactgcccaacatgctcatgtggctgccagaacccaagtgggtcaaactgtgtgaatgaggattcacctaatctacaagctgcaattgaggggcctggcaaatggactggccagcctcttgtacaatgcacttcccacatgtgcccgataagaatccactggcatgtgaagctcaactacaaggaatactggggagtgaaaatcactatcacaaacttcaacttccgcatgagttacacgcagtggaacttagtagctcagcatccaaactttgataacatcactcaggtgttcagcttcaactacaaaccacttactgccatatgggggtggcataa

SEQ ID NO: 14431 - DNA, 1677 bp, Sorghum bicolor
  Clone ID: SORBI-28MAY03-CLUS23_1
gccatccgtcgaaaccctcccttccgctcccttcccctatccacatccccaaatccgctcccttcccctatccacctcgactcccttccttccatagcagcggcagcggcggcggcggcgaagggcggcggagccatgggcggagccggcgaaggcgatgcttgggcggatcaggagcagggcaacggcgggggcagccgaggtgtaggcggcggcggcggcggcgaggcgaagcggtcggagatctacacctacgaggccgcctggcacatctacgcgatgaactggagcgtgcgccgcgataagaagtaccggctcgccatcgccagccttctcgagcaggtcaccaaccgcgtcgaggtcgtccagctcgacgaggcctcgggcgacatcgcccccgtcctcaccttcgaccaccagtacccgcccaccaagaccatgttcatgccggacccgcacgcgctccgccccgacctgctcgccacctccgccgcccacctgcgcatctcgagcttcccgtccagcgacgccgtcgacgacgccgcggccactgcggcccgctcacctccttcgactggaacgacgccgacccgcgccgcatcggtacctcctccatcgacaccacctgcaccatctgggacgtcgagcgcgaggccgtcgacacccagctcatcgcccacgacaaggaggtctacgacatcgcctggggcggcgcgggggtctttgcctccgtctccgccgacggctctgtccgcgtctttgacctacgggacaaggagcactccacaatcatttatgagtctggttcaggtggcggcggcggcggttccaactcgggcgccggggatggtgggactgcgtccccgacaccactcgtgaggttgggctggaacaagcaggacccaaggtacatggccaccatcatcatggacagccccaaggtggttgtgcttgatatccgctacccaacactgccagtggtagagctacatcgtcaccatgcccctgtcaatgccatagcgtgggcgcctcactcttcttgccacatctgcacagctggggatgacatgcaggcactgatatgggatttgtcatctatgggaactggtagcaatggtagtggcaatgggaatggtaacgcagctgcggcagcagcagctgagggcggtcttgatcccattttggcatatacagcaggggcagagattgagcagttgcagtggtcggcaacccagcctgactgggttgcaattgcatttgccaataagcttcagattctcagggtctgatttcctaattctgccctgtttcactgaggagtaaaaagaatgccaaacttggataatgaggttaggccatgggaggataatcttttgtgcttgctttagttgcttatttatgttgtggacaactgatattcgtggtgggtcatttctagttatagaacagaagacttgctaattagaagctgaattggcaatgaactcggtttgtagagtaaggagctgctctggtgttagtgatggtgataatgggaactgaatttagtttgttcttggtcctagaattctgcccgcctgcccggtagcatgtagattcacatcttaacttgcttgttgaacttgcgatggtcatatgtgccctataaccgataatattccctgtgtgttatctctc

SEQ ID NO: 14432 - DNA, 1689 bp, Sorghum bicolor
  Clone ID: SORBI-28MAY03-CLUS2544_1
gcgcgagccccggcgccactcgctgccagcgcccccgccaccacaacccctctcatcgccatgggaaccaagaatcttacacggaaccgccccgcttccatggcgacggcgtccaccacgctgctcctctccctcgccctcctcgccttcgcctgggcggcatcgccgtcgccggatgcggaggcgatctcccggttccaggagtacctccgcatcgacacggcgcagccggcgcccgactacgccgcggccgtggccttcctccggaaccaggcctccgaggccgggctcgaggcgcgcacgctcgagctcgtcgccgggaagcccctgcttctgctgcggtggcccgggcggcggccgtcgctcccctccgtactcctcaactcccacactgacgtcgtgccgtcggagccgagcaagtgggaccacccgcccttttccgccgccctcgatgaggcgtccggtcgcatctatgcgcgaggctcccaggacatgaagtgcgtggggatgcagtaccttgaagccatccgccgactccgttcttcaggatttattccagatcgaactattcatgtaatatttgttcctgatgaggagattggtgggcatgatggtgttgagctgtttgtttcatctaaggagttcaaagatatgaatgtggggttagtgcttgacgaagggcttccatctcctggggaggagtatcgggtgttctatgcagagcgtagcccctggtggcttaccataaaagcaaagggtgcaccagggcatggtgcaaagttgtatgatggcagtgcaatggagaatttaatgaaaagcgtggaggctatcaggagattcagaacatcgcagtttgatttagtgaagtctgggcagaaggctgaaggggatgttgtgtcagtgaattttgcatacctgaaggctggcacaccgacaccaacgggttttgtcatgaatctccaaccatctgaagcacaggtaggtcttgacatccggatgcctcctgatgttcatactgaagcactggagaggcgccttattgaagaatgggcaccttcctcacgcaacatgaccttcgagtttaaacagaggggttctgtcctggacaactttgggaagccagccttcacacctgctgacagctcgaacccatggtggccagtgcttggagaagctgttaagaaagctggcggtaaactcggtaaaccggaggtatttcctgcctctacagatgctcgctacttccggaagattggtttaccagcattcggtttctctcctatggcaaacacaccagtattgctccacgatcacaacgagttcctaagcaaagacgagtatatcaaaggaattggggtatacgagtcgatcatcagggagctggccactcacaacgatgaagccagagacgaagaatcgagggcagagctatgagatgaccttaccctcgatgcaattcttgaagctcaaatggagcactgaaatcatgtttgggcaaagctgctgattacgtgtctgctccaacggcaaaactgaaacagtgaacacgattacatgaaccttgtacattttcagtaaaattaaacactctgaataatccatactgcagctgcggtttcgccgttgcataaacctagcactatgcactgaactttttctgctaatatcctgttcggttttatgcttgtg

SEQ ID NO: 14433 - DNA, 2563 bp, Sorghum bicolor
  Clone ID: SORBI-28MAY03-CLUS26795_1
ggacagcctggggccccacgtgtcggcgggcgcgcgcagccaaccgccgccgaacgaagccaacaaccccggcaaggcaagcaactgcggccacgccgcgaccctgacgtccgccgtctccggcaccggataggtctccctcccccacacccctcgcgtgccttccgtagcccgtaggcacgcacgcttcccttcaaagccactgcttcgccttcttcttcttcttcttcttctgctacttaagcgcagggcgggcactcgcatccggacatccggtagctccatcacttcttgctttggaaaggaggcaacggatggtggatgcatgacacactcattgcattagtgcttaccacaagtggaagcctatggatctcaagcaatccttctctactacaatcttctgcgttctgcttctattctgtgtgggctgcagatgtcggcctttagaaatagaggccacccagacagcaaccctcaaggttgatgccacgccacagcttgcccggaagatccctgaaacattatttgggatattttttgaggagattaaccatgcaggggccggtggcatatgggcagagcttgtcaataacagaggtttcgaagctggaggccctcatactccatcaaacattgacccgtggtccatcattggagatgactcctctatattcgtggcgactgatcgtacatcatgtttcagccgaaacattgttgctctgaggatggaggtcctctgtaatgactgtccagctggtggtgttggtgtttacaacccaggtttttggggcatgaacatagaagatgggaaggcctacaatcttgttatgtatgttaagtctccggaaacaacggatttaacagtttcattaacaagctctgacgggttgcaaaacctggcttcagctacaataacagtttccggcgcatcaaattggacaaaagtggagcagaagctggttgctaaaggaaccaatagaacctcaaggcttcaaataaaaactaacaaaaaaggagttgtatggcttgatcaagtatcactcatgcctgaagacacatacaagggacatggcttccgcacagaacttatatccatgcttttggatttgacaccacggttcttgagatttcctggaggttgctttgtagaaggtgagtggctaagaaatgcattcagatggagagaatctattggtccatgggaagagaggcctcgacgctttggggatgtttggcattactggactgatgatgggcttggatattatgagtttcttcagcttgcggaggacctgggtgctgccccaatctgggtattcaacaatggaatcagccacaatgatgaagttgatactgtagctattgctccttttgtaaaggatgtattggacagtctagaatttgcaagggggagtgcagattcaacatggggctctgttagggctgcaatgggacaccctgaacctttcccagttaaacatgtcgcgattggaaatgaagattgcgggaaaaagttttaccgtggtaattacctcaaattctacaatgctataagagaggcatatccagacattcaaatgatttcaaactgtgatggttcatctagaccacttgaccatcctgcagatttgtatgacttccatgtctatactgattctaagactttgtttaacatgaggagccaatttgacagaacatcccgtagtggacccaaggcttttgtgagtgagtatgctgtctggagaagtgatgcgggcagaggaagtcttctcgcttcattggctgaagctgctttccttactggtctggagaaaaacagtgacattgttcagatggcaagttacgctccactattcgtgaataacaatgatcaaacgtggaacccggatgctattgtcttcaactcctggcaacattacggaactcctagttactggatgcagacacttttccgtgagtccagtggtgccatgatccatccaattaatatgagttcccggtactcaagctcgctagctgcatctgcaattacgtggcaggactcagagaatagcttccttagagtaaaggttgtaaactttgggtcggacactgttagcctcacgatctccacaagtggacttcaggccagtgtcaactcgctgggatcaaccgccactgttctcacatctggcaacgttatggatgagaactctttcagtaacccaaacaaggttgcgccggtgaaaagccagctgagcaacgctggggagcagatgcaggtcacgctggctcctcactccttcaccacgttcgatctggcgctggctcagtccaagcttgtggcagagatgtgatcaatgtgttagcatcttgataaaaaaaagctttgtataccacgatacagatatatatacctactgtactacatgaataaaaatcacatcaggtttgtttggtgtttgattttgatttgcttcccccgtacgtgtttgctgtgcatggcagatactcagaccttgtctggttacttgggcattttttaacgcttgattggtaggactccttattttttcaccgc

SEQ ID NO: 14434 - DNA, 1200 bp, Sorghum bicolor
  Clone ID: SORBI-28MAY03-CLUS133_1
agcgagccagagggaaagaggagaataaaaagggtgggggcgaggcggccggacaggagccgagcgcaagagctcaggcttcgccgcgaaaccccagacctcgcgccggcccttcccctccccggcgtcgtcctcgctctccgatccaagatgtataagctggggagaggaaaccgcgacaaggtgcagcagttcatgaccataaccggcgccagtgagaaggttgcccttcaggcactgaaagctagtgattggcacttggaaggagcttttgacttcttctatagccaacctcagatttctgcggtcaatactcggcatcttgaagatattttcaacagatataaagaacctgatggtgatatgatcatggtggaaggaatatctcaactttgcaatgatctgcaggtggatcctcaggatattgtcatgcttgtcatatcatggcacatgaaagccgccacaatgtgtgaatttactcgtcaggaattcattggtggactgcagtcaattggggtagattcaatcgagaagttccgtggaaagttaccatcattacgagctgagctaaaagatgacaataagttccgtgatatatacaactttgcattcacttgggcaagggaaaagggtcaaaagtctctctcactggagactgctattggaatgtggcagttgctatttgctgaaaggaactggcctcttctcgagcattggtgtcagtttttacaggtcaggcacaataaagccatatctagagacacatgggcccagctgctggaatttgtaaagacgatcgatccacagctatccaactatgacgacgaaggtgcctggccctacctcatagacgaatttgtggaatatctgactgagaatggattggtccagcgtaaaagatgaacaatgcggaggcttccttcaaacaatggttgggctgtacaaacatgattcatctcggtcggcactagcgacgcccagggcctgatgttggcactcctgctcaatccattcaccaaactgttggcatatcattgaatttgcttataaacgcggggaaacttaacttttagcctgggaagttgtggctgtcagcctgcgattgtgaactggaacttatcttgaactggaacttaccgacgatgcaatggagagtttgggactttggttacccatatgatttgttgcatcatttgtctt

SEQ ID NO: 14435 - DNA, 1370 bp, Sorghum bicolor
  Clone ID: SORBI-28MAY03-CLUS0_1
tactggagagagccgcctcagcccacagcccacacccctcgcgttggcctcttttaaataccgtgcatcccggcgccgcacatggccgaacggcgagcagcaggagggcgtcgcgaacccacgagccccctatcctgaccccgcggcagccactactactaccgcgccccttcgcacgtcccgcgccgctcccgcccccgcggacgcggcggcgtcgtcagcctgcgtccgatggcctcgtcgacggcggctcagccccccgcgccggcgcccccgggcctgaaggagggcatcgcggggctgtacgacgagtcttcggggctgtgggagaacatctggggcgaccacatgcaccacggcttctacgactcgggcgaggccgcgtccatggccgaccaccgacgcgcccagatccgcatgatcgaggaggcgctcgccttcgccgccgtcccatccccagatgatccggagaaggcaccaaaaaccatagtagatgttggatgtggcattggtggtagctcaaggtacttggctaagaaatacggagcacagtgcaaggggatcacattgagccctgttcaagctgaaagaggaaatgctcttgctacagcgcaggggttgtcggatcaggttactctgcaagttgctgatgctctggagcaaccgtttcctgatgggcagtttgatctggtatggtccatggagagtggcgagcacatgccggacaagagaaagtttgttagtgagctggcacgcgtcgctgctcctggagggacaataatcatcgtgacatggtgccataggaacctcgaaccatctgagacttcgctaaaacccgatgaactgagtctcttgaagaggatttgcgatgcgtactacctcccagactggtgctcaccttcagactatgtgaacatcgccaaatcactgtctctggaggatatcaaggcagctgattggtcagagaatgtggccccattttggcccgctgtgataaaatcagcactaacatggaagggcctcacctctctactgacaagcggatggaagacgatcagaggggcgatggtgatgccgctgatgatccaaggttacaagaaggggctcatcaaattcaccatcatcacctgtcgcaagcctggagcagcgtaggtgaccaaggggcagaagttactgtcaaagcacctctgctaagtccaataatgtagatccatggccccatcaccgtctattgtactgtactgtactgtaccagaatgaacagtctcctgggacatgttttccaattgccatgacatgtcaaatgatcttctaccactcctgtaccagaatgctttatttactcatcttgctcagccctatcaccggcc

SEQ ID NO: 14436 - DNA, 802 bp, Sorghum bicolor
  Clone ID: SORBI-28MAY03-CLUS370_1
gccccgatcaaaaacaaaaccatcctcactctcccctgctgccagccaaccaagctccaagctccaagcacgcacagccactcagccacaccacaccaagatcatggccggcgtgaactccagcgtcgtcggactcaagcccgccgcggcagtgccccaggccgccgccgccgccgcctcgtcgcaggcgaagcgggtgcagctggtcgcgcccgagggccgccgcgccgcgctgctcggcctggcggccgtcttcgccgtcaccgccaccaccggatcggccaaggccgggatcatcgacgagtaccttgagaagagcaaggccaacaaggagctgaatgacaagaagaggctggccaccagcggcgccaactttgcgcgcgcctacaccgtcgagttcggcagctgcacgttcccctacaacttcactgggtgccaggacctcgccaagcagaagaaagtgcccttcatcaccgacgacctcgagatcgagtgcgaggggaaggagaagttcaagtgcggctccaacgttttctggaagtggggtgaagcaaaatgaggaggcgacctggtggtgtacatgtacgtgtgtgtgtacctagatgtgcgcccaaactgcaggaagaatttggatgtgtaattgtggtcagtgtatttgtgtcatctcatcatctgattgatcatcatgaacctcttgcattaattggggagagtgaattatagtatttgtgcgtacctagatgtgcgcccaaactgcaggaagaatttggatgtgtaattgtggtccagtgtatttgtgtct

SEQ ID NO: 14437 - DNA, 2038 bp, Sorghum bicolor
  Clone ID: SORBI-28MAY03-CLUS40276_1
gcacgagggtcgccgccctctctcccccatcacactttcgccactggccgggtggtctgagccggagtcgcccacggggcagaactccgggggagcgagggagagagagagcgacagcgacggactgacgcggtgcgctccctgcgaggacccgcgagcggctccccggcgcctcggcggggcagcgacgacccgccgcgcaacgacccccgacggcagcgggcgcgcgccgctctgatgcgccgagaccgcggcgcgggcccatccgggcaggccgcccgtcgcgcaccgccccgtgggtccccacgtgggcggacacctggcgcctccgccgccccctcccaggcgccctcgcgcgtcgcgaggtcggccaccggggcaaggaagcagttacagccccaaaggccaggacgaggaactgagtgcagtccggttgggcagtttctgaacgtgaattggactgcgttagtatctggctttgctcccagtatactctgtattcgtaggagggatggaagttgtaatactatgcgcaaactgcgtttcttctgtataacatccgatccctactgtacgaccaacacagacccataaaccgtgttttgtctgcgcaacacttggggtccgaacgttgtaacgaactcgcgactgggtctccacgggctgcgctcgggttgggtgctatagagtatgaagagtttctgaaaactggtgacccagagttcaattggaagccaccaaaggatgaatggcagagcatcgccctaggctacacttctgggactacttccagcccaaaaggcgtcgtgttgcatcaccgtggtgcttatctcatggcactcagtgttgccattgtgtggggaatgcctgaaggggctgtctatttgtggactctgcccatgttccattgtaatggttggtgctatacttgggcgctggcagccttctgtggaacaagcatatgtcttcgccaggtgagcacaaaggctatatacgaaggcattaccaagcaaggagtgacacacttctgtgccgcacctgtcgtcctcaacaacctgatcaacgctccggcaagcgagacattcctgccgctgccccacgtcgtcaatgtcaatgtggccggagccgccccgacgccgtccttgctggctgcactgtccatccgcggcttccgcgtgacgcacacgtacggcctgtcagagacctacggcccctcgacggtgtgcgcgtggaagcccgagtgggacgagctgccgctggaggagcggtcccgcctgcactgccggcaggggatcaggtacatcgcgatggagggcctggacgtcgtggacccgaagacgatggcgcccgtcccggccgacggcaagtcgtacggcgagatcgtgctgcggggcaacgccgtgatgaaggggtacctcaagaaccccaaggcaaacgcggaggcgttcgcgggcgggtggtaccattcgggcgacctcggcgtgaagcaccccgacgggtacgtggaggtgagggaccggatgaaggacgtgatcatctcgggaggggagaacatcagcagcctggaggtggagaaggtggtgtgcacgcacccggcggtgctcgaggcctcggtggtcgccagggccgacgagcggtggggcgagtcgccgtgcgcgttcgtgacgctcaaggacggagcagccgatgggtcggacgaggcggcgctggccaacgacatcatgcgattctgccgggagaggatgccggggtactgggtgcccaagtcggtgatcttcgggccgctgcccaagacggccacggggaagatcaagaagcacgagctgagggccaaggccaaagagctcggccctgtgattgtgaagaagagcaggatgtgagagatctggggcgatagcgtgtcattgggcaaggactcagaatcttgctcgaagtcgtcgtgcatacaaaattcctgagttctgaagaggcctaataacttgagtgctttgcttgtatcgttctgaaaccagaagttcagatcagattcggtatataa

SEQ ID NO: 14438 - DNA, 808 bp, Sorghum bicolor
  Clone ID: SORBI-28MAY03-CLUS1240_1
tgtgcggcgctcgaggccggccgggccggggaaccctcacgccgccgccgcagttgtcttcggtctcccgtgcttcctcccttcgagagatcaagttgctgttgcggtagtttccccaactgtcaccatgcagaacgaggagggtaagatggtggacctctacgtccccaggaagtgctcggccaccaacaggattatcactgccaaggaccatgcctctgtgcagatcaacattggccacgtggatgccaatggcctctacgacggtcacttcaccacgtttgctctctctgggtttgtccgtgcgcagggtgacgcagacagctccttggacaggctgtggcagaagaagaaggctgagatcaagcagtagatcttacatgtagtttactaagaattggacactttgagggaccctgcataagctatgttttgatttcatatcaccatatgcaatgttgtgatttcagttggtatcttaaatctaaagacttggtatctttgctggatcaaaaaaaaaaaaaaaaaaaaaaaaaaaggcccctaaaaaaaaaaaaaaatgaattatcctatgctcatccatttcgagcctttttaagctataaaaaaaagacaatagttaggacaagaaaataattagcaaaaaaggcccctaggaaattgaaggggtcaagcaaaaagagcagctggtgaccacctacatagaatggtctgatgagtgggtgcttgacgagcttgttcgtcgatctgagaagtcattcgttgaaaaagtacaggttggtaggtttgaatctatccacccttaact

SEQ ID NO: 14439 - DNA, 523 bp, Sorghum bicolor
  Clone ID: LIB5052-010-A1-XP1-F8
gccggccgggttgcgctcacgccgccgccgcagttgtcttcggtctcccgtgcttcctcccttcgagagatcaagttgctgttgcggtagtttccccaactgtcaccatgcagaacgaggagggtaagatggtggacctctacgtccccaggaagtgctcggccaccaacaggattatcactgccaaggaccatgcctctgtgcagatcaacattggccacgtggatgccaatggcctctacgacggtcacttcaccacgtttgctctctctgggtttgtccgtgctcaggtgatagtccaggatatgcttattgcattgtgtctatagcccataaaattcagagcactgaatgtaatgcctacatgcaactttctactgcaaatgtgtgtttcctgagtttcatattgttggcacctgatgtagtgcattcatatggaaaattgttgtagcatctgttttaccttttcagttgaattaaaaaaaaaaaaaaaaaagaaaaaaaaaaaaaaaaaaggccccta

SEQ ID NO: 14440 - DNA, 814 bp, Sorghum bicolor
  unsure (1)..(814): unsure at all n locations
  Clone ID: LIB5047-008-R1-XP1-B11
gccggccgggccgggacgccgccgccgcagttgtcttcggtctcccgtgcttcctcccttcgagagatcagttgctgttgcggtagtttccccaactgtcaccatgcagaacgaggagggtaagatggtggacctctacgtccccaggaagtgctcggccaccaacaggattatcactgccaaggaccatgcctctgtgcagatcaacattggccacgtggatgccaatggcctctacgacggtcacttcaccacgtttgctctctctgggtttgtccgtgctcagggtgacgcagacagctccttagacaggctgtggcagaagaagaaggctgagatcaagcagtagatcttacatgtagtttaccaagaattggacactttgagggaccctgcataagctatgttttgatttcatatcaccatatgcaatgttgtgatttcagttggtatcttaaatctaaagacttggtatctttgctggatcattctgagttcgatgtgtgtgtggttccttcaattttcttttatgcagtgccatttagttctcgagctgctatttgtgatgattttgggaggctgtagtcagggtacagttctaatagctggctgatgtttcatattcggttgctaataatgcatcagagtttacgagtttatctaaccatgtaggcattgtttcgagtgggttggtgttgaattttggttaaatttaacactaaactatttcacacatggattgagggatatacatagagtatcanacnnaggccgcagttggattgctacaaaaaaaaaaaaaaaaaggccccta

SEQ ID NO: 14441 - DNA, 1626 bp, Sorghum bicolor
  Clone ID: SORBI-28MAY03-CLUS4261_1
gcacgcgcccctcccgggcggccccaccccccgccccaccccccggcggccgccccccggcgcggcccgcgccgcggcctcgggccgccgcccgcgccgcggccccggcgggtgagcaggagccccccacgccccgcgccacggaacgcgcaactctggtgcagccccagccccagcgccagcccccatggaccttccggtggtggatctcgcgccgtatcttcgggccgccgccggcgacgcggccccggcgggtgaggaggagctgcgcacgctgtgcgccacggtgagcgctagcctgcgggatacaggggcgttgctggtgatggacccgcgctgctccgcggcggacaacgaccgcttcctcgacgtcgtcgagcgctacttcgcccgatccgccgacgcaaagcgcctccaggaacggccccacctccactaccaggttggtgtcacacccgaaggggtcgaggttcctcgcagtttggtcgacaagaacatgcaggagaagatcaggagcatgccagaggagtttcagccagccacgcctaaagggccggacccgaaatggcggtacatgtggagagtgggtcctcgccctgcaaatactcgctttaaggagctaaactcagaacctgttatccctgagggattacctgagtggaaagagacgatggattcctggggttctaaaatgatttctgcaattgaggttgttgctgagatggctgcaattggctttggcctgtccaaggacgcatttacttctttgatgaaggagggaccacatctcctagcaccaactggaagtgacttgcagcgtcatggttctgagggcactgtttttgctggattccactacgatcttaattttttgacaatacatggccggagtagattcccaggcctaaacatctggttaaggaatggtaaaaagatggaagtgaaagtccctgttggttgccttctaattcagtctggaaaacagctggaatggcttactggtggcgattgtttggctggaatgcatgaggtagtggtgtctaagagaacgctagatgccatagcactagcgaaagagcaaaatagaagtttgtggagggtttcatcaacattgttcgcgcacattgcttcggatgcaattcttaagccgctcggccactttgctgaagcacctgatgctcattcctatccacctatatgcgctggggattatgtcgagcaggagctttcagtcattaacctgaaaggaaaggatggagtatagactctatgcagcagatggatctggttatcttatgaattgacagataccaggatgcaaaactaaattacccaaactggcaattgggtcttcgtttccaagtgctgttgtactgaaggtggttaagttgttttgaagatatgcttgttcattgctctcgttaagatagtggatacccttctttacgtaccacattatcacttgtgaaaataaaatgtatagcttacacataaagctgctattctcctagtgcaatcctgaaactgttattcacctagttcagttatctgtaatgtctaaaacagagaacattttcatcgaccaaaattatactgtacttctcacacgacaagtgaagttacact

SEQ ID NO: 14442 - DNA, 1915 bp, Sorghum bicolor
  Clone ID: SORBI-28MAY03-CLUS2930_1
actaaacacactgcacaactgtggccttgtggctgtcacagcaaataactcgaaaggaaacaatggacggcgacgttgtagcagctccagcagctttgccatcaccgtggagcctgctccaggggctccttgccatgctgatcgcgtgggggagctaccaggccgcggagacattctggctgcggccccggcggctcaaccgggcgctccgggcacaggggctcagcggcacagagtacctcttcccagccggcgacctcaaggagaatgacaggctcaacgacgaggcacgatcgaggtctatgccgttgtcccatgacatagttccccgtgtgatgccgcatctcttcaacaccgttaaggagcacggcaacatttctatcacctggttcggaccaattcctagggtgataatcacggaggcagagttaataagggatgtcctatcaaacaagtctggccacttcgagaagttcatctcgaacaagcgtcttataaaaatgctcgcccttgggattgcgagtcacgacggtgagaaatgggcaaaacacagaaggattctgaaccccgcattccatctcgaaaagctcaagcgcatgctgccggcgttctcgacgtgctctaccgagcttatagatcgctgggagaacaagctcgctgcttctgacggctcatatgaactggatatctgccccccggagcttcaccccactccaggcggcatgatccccccgccatcccgcggcagcagcttgctgggaggacgaaccctctgcctccggcggggccaaccagcggggcggctcatcgccgccctccatttgttcttcccccccggcttcttcttccccccgccgcacaaccggcggacgcgtgggcggaaacgtaggctaaggggcatgattgagaagagggagcgcgcaatcgagaacggtgaaaccagcggcaacgacttgctcggcttgctgctgcagtcgaacatggatagcgggaaaggcagcctgagaatgagcaccgaggacgtgattgaggagtgcaagctcttctacttcgcagggatggaaaccacgtcggtgttgctcacgtggacgctcgtcattctaggcatgcaccctgagtggcaggaccgcgcgagggaggaggtcctcagcgtgttcggcagggacaagcagcccaattttgatggactaggtcgactcaaaacggtgacgatgatactatatgaggtgcttaggttgtacccgccggcagtgtcactaaaccgaagaacattcaaagacatgacgattggaggcatctcctaccctgcaggggttatcctcgagcttcccacaatcgttgtccaccacagtactgatgtctgggggaaggacgcacatgagttcaagccagagaggttcgctgaagggatctcaaaggcaaccaaggaccgaccagcgttctttccattcggatgggggccaaggatctgcatcgggcaaaactttgcactgcttgaggccaagatggctttgagcatgatcctccagcgctttgagttccaactgtcgccttcgtacacgcatgcaccgtacactgttcttacgctgcatcctcagcatggcgcgccaattatattcaagaggatatgatcgtcttatatgacatcatcgatcattgtcaatgagtatgtcatagtgcaaaaataaataaatttgtatgggttagtactatattattatagggaatttaattttgtgtatctaaattttgaggtagaaataaaatggcacgagatatattgctggaacctccaggtcaagatacagtccaaccaatatgtgcacatgctctaacaaaaatcactatgtgcatataaggtaaacagtagtaaacgtaggattgaaactagcttagctgtccttttctaatgttc

SEQ ID NO: 14443 - DNA, 312 bp, Sorghum bicolor
  Clone ID: LIB3481-015-P1-K1-H2
cgtccgaccacgtcggtgttgctcacgtggacgctcgtcattctaggcatgcaccctgagtggcaggaccgcgcgagggaggaggtcctcagcgtgttcggtagggacaagcagcccaattttgatggactaggtcgactcaaaacggcaagtgtttctttattacaataccatgtatacatgtttgctccaagcctatattacctgctaacattgtctatacctaaatgatatccaggtgacgatgatactatatgaggtgctcaagttgtacccaccggcagtgaccctaaaccgaagaacattcaaaga

SEQ ID NO: 14444 - DNA, 1861 bp, Sorghum bicolor
  Clone ID: SORBI-28MAY03-CLUS43548_1
cctcgccggcggcggcgtccccggcgccgccgcccgacccccttccttccttcgcctatacgtaggaggtagccgctgcggccgcctccccaaagcccaagcctaagcctttccctcccacgcacgcgcgcggctccctctctgctgcgccgcggctcgcttgacctgacccccgcagatcgccggcgatgggatccaaggaccagggcggaggggccgcctcctcgggcggcggcttcttctcgtcgttcgccgccggcatgcgcagctggggcaccgccgtccacaaatccgtcaacgggctgcttggttatgaaggccttgaagttattaaccctgatggaggcacagatgatgctgaagaagaagctttgaggggacgatggaagcaggaggatcgtgatagctattggaagatgatgcacaagtacataggatcagatgttacatcacttgtgacacttccagtcataatttttgagccaatgacaatgcttcagaaaatggccgagttgatggaatactgtgaattgttagacaaagcagatgaatgtgaggatccgtacatgcgtatggtttatgcttctacatgggctgtttcggtgtactttgcgtatcagcgcacgtggaagccttttaatccaatccttggagagacttatgagatggttaaccaccagggcattacatttcttgctgagcaggtaagccatcaccccccaatgggtgttgctcattgtgagaatgagcattttacttatgatatcacgtctaagttgaggaccaagttcttgggaaattctgtggaaatttacccagttggaaggacaagagtgacactaaaaaaatctggtgtcgtgttggatttggtgccgccactaacaaaggttaacaacctgatatttggacgcacttgggttgatactcctggagagatggtcatgacaaacctgacaactggagacaaagttgtgctatatttccagccatgcggctggtttggggctggccgttatgaggtggatgggtatgtgtacagtgcagcggaagaacccaaaataatgattacagggaaatggaacaaatctctgagttaccaaccatgtgaccaagaaggcgatcctcttccaggcacggagctgaaggagatctggagagttgctcctgccccacagggcgacaagtatcagtacacacactttgcacacaaaataaacagctttgacacagcacctaagaagctgttggcatctgattcgcggttgagacctgatagatatgccctcgagaagggtgacatgtctaagtctggcgcagagaagagcaggcttgaggaacaacaaagagctgagaaaagaactcgagatgccaagggcgagcaatttactccaagatggttcaacatgacagatgtggttgctcctacaccgtggggtgacctggaaatttatgaatacaacggcaaatacacagagtaccgggctgccatagacagctccagtgtcaccggcgagacagatgtgacttcaaccgagttcaacccatggcaatatggtagctcatcttctcaatgattctccttggccagaagctgccatgccatgtctatgctcattgtgtaaaatgcttccaggcctggccttgctggtttgttgtgccatcagcggttttcgtgcccttgtagtatcaatgaccttcccctttcccttcaatgctacaattatccaggaagtggtgtattttatgtagtccatgtactgtcgtaaatctagcagaaattgcagagtttccttgagccgttgggtggttgtatttatgcgtgattactgatgaacaggagctgtgttgtcagttgtgcttg

SEQ ID NO: 14445 - DNA, 1909 bp, Sorghum bicolor
  Clone ID: SORBI-28MAY03-CLUS4343_1
gctcctgcgcccgcgccctcctcctccacctcaactgctcatgctccttccactcccctcctcctgctcccaatcctcttcccccccgcgcctcctcatcggctgagcccgcccgcgcccgccccgcgcgcgacctacaccctcggccgcgagctcgggcggggccagttcggggtcacctccctcgccccggtccgggagaccgggcagcgcttcgcctgcaagtccatcgccacgcggaagcccgtccgccgagacggcatcggcgacctgcgccgggtcctgcagcgcatgcaccacctcccgcggcagcgcacgatcgccgagctccggggagcccgcgcgcggcgtgcgtctcgaggccgcggagcgcgggggcgcgaggggccgcctcgctgtggcggcagccatgccaaggtcatctccgcccgtcctcccgctgcacgtcaaggccgacggcgcggcgccgctcgagtaaggctccttccgcagggaggctctcccggccagcgcatgaaggagatcttctgggcggtcgacaacaagcccgccgccaccctcaccgccgcggtcttgtgacgctccgcgaccgccagggccgctggtacgtagtgccattgtttgtgtagtccgtgtcaagtcgatttccaagtgattgcatcactgttcgcggttcgagctgacagagggagctccggtgtgtgtggcgacaacaatctgtctctcattcgcactcgagcggcagcgctctcggctgaatcgagtttgttcttgtgacgtcgtcacattgacttcacttctgatccttggccttcaatatctaatggtgcaaaggattttgttaagcaggcccggcgaccagacccaaaagaacgcctgactgctgctgaaattttgaaccacccatggattagagaggatggagaggccccagataagccacttgacattactgtcattggtagaatgaaacagttcagggcaatgaacaagctcaagaaagttgcattgaaggttgtggctgagaacttatcagatgaagagattatgcgcctaaaagaaatgttcagatccctggatacagataacagtgggacaattactcttgaagagctaagatctggtttaccaaaacttggtacaaaaatttctgaatcggaaatcaaacagttgatggaggcggctgatgttgatggaaatggtaccattgattatggggagtttatatctgccacaatgcacttgaatagattggagaaggaagaccacatactcaaagcttttgaatattttgataaggaccacagcggatacataacagtagatgagttggaagaagctctgaagaagtatgatatgggagatgacaaaacaataaaagaaatcattgctgaagtagattcagatcatgatggaagaattaattaccaagagtttgttgccatgatgagaaacaacagccctgagattgttccaaatcggaggcgcatgttctaactatcatgtacaattttcattgaatattttcaagaacaatctgcccgtaaacataatcctggtcccattttctttttggaacagccgttaagaagactgtaatgtgagatccatgtctctgcagcccggaccagtttataccaaaatagggtggtgttatagtgacccgtacttagatgctttgagcatcatggactcatgggtggcaatgtttattcccattgtactccttggggttgttctgctgcttcgatctgaagctttcctcacctttcattttagtttgtcctctcaagagtgttgccacttgtgaattgttatcatgtgttgtggtcctcgtaatggtttatattagcgcaggcattgtaaaatggtattcagcgaccagatcaggtaatgtcatatgcttctg

SEQ ID NO: 14446 - DNA, 582 bp, Sorghum bicolor
  Clone ID: LIB3481-038-P1-K1-D9
cgtccgcgagacgccatggttcaacaagccatccatcgccaagcccgtcaaagcctccggggccggcggcgccgagccgccggccgagcctgtctgctccgtaaaggacggcggcgacaaggacgagccgccggagacgctgaacgcgttccacctgatttccctctccgcggggttcgacctctcgccgctgttcgatgtggaaggcggtcccgcgaggtgccataaccgggagggcggtatgcggttcgcgacgcgggagtccgcgagcggcgtcgtctcccgtctcgaggaggtggcggcccgcggcggcgggcggatgcgggtgaccaagagcggcgcccgcggcgtgcggctcgagggcgcggagcgcgggggccgcaagggccgcctagccgtggcggccgacatcttcagcttatcgccgtccgtgctcgtggtggacgtcaagaaggacgggggcgacacgctcgagtaccgctccttctgcaacgaggagctcccggccagcggctaaggacatcgtctgggcggccgacccgaagcccgccggcaccggcaccgccgtcgtcgtgtgacgcc

SEQ ID NO: 14447 - DNA, 1060 bp, Sorghum bicolor
  Clone ID: SORBI-28MAY03-CLUS4942_1
ctgctggaacccctatcaatcgcagtgtgggcgcgagagagagagagagagactcactgaccggcgaccgacttggggaaggaagcagcagcaaaggatggcgccgctgaagctgtacgggatgccgctgtcgcccaacgtggtgcgcgtggccaccgtgctcaacgagaagggcctcgaattcgagatcatccccgtcgacctcaccaccggcgcccacaagcagcccgacttcctcgccctcaaccccttcggccagatcccggctctcgtcgacggagacgaagtcctctacgagtcccgtgccatcaaccggtacatcgcgaccaagtacgcgtcgtcgggcgcggcgctgctcccggcgacggcgtcggcgaagctcgaggtgtggctggaggtggagtcgcaccacttctacccgaacgcgtcgccgctggtgttccagctcctcttcaggccgctcttcggcggcgccccggacccattggtggtggacaagcacgcgcacgagctcgccaaggtgctcgacgtctacgaggcgcacctcgccagcaacaagtacctcgccggcgacgagttcacgctcgccgacgccaaccacgcgtcctacctgctctacctcaccaagacccccaaggctgggctcgtcaacgaccgcccccatgttaaggcgtggtgggaggagatcgccaagcgccccgcgttccagaagaccgtcgccgccatcccattcccaccgccgccctcctccgcttgagttgacctttcgctgggtcgtcgccggtcacggacgcgtccgagttgaataaaaacggcctccttgcttgttgctgcgccgttgtgtgaatcaaatccaaataatattgtagttgtttccatgtgtgttcatctcactgctgtctcggcttggttgtgtaaagagcacggtgggggtgtggacacgatgtgtagaacctttttttttttttatccttggatgtttctattagccagttgcttaatattatcatccgaatttagtgtttttttctatcaataactctactatgacttattaggc

SEQ ID NO: 14448 - DNA, 2276 bp, Sorghum bicolor
  Clone ID: SORBI-28MAY03-CLUS45363_1
gcacgaggcccaagccaacaaactagcttgccccttggagtggcttgagagatgatgagagtggcggtggtgggtggcggcctaagcgggctagtggcggcgcacgagctggcgaggagcggcggcgcgcgcgtcaccgtgtatgagaaggaggagcatctcggcggcgccaagacggttgccgtcaatggcggatcatcaggccctgttctggtcgacgtggacttcatggtcttcaaccgggtgacgtacccaaacatgatggaatggtttgaacgtctaggggtggaaatggagacatcagacatgtcattctcagcaagcttgcggttaaacaaaggtaatggctttgagtggggtagccgcaatggcatatctagtgttctggtgcagaagagcaattttcttagccccagattctggctcatgatcaatgagatattcaagttcaagaaccatgctctcaagtacctagaggaccatgcaagaaaccctgaccagaatgagactttaggtcaatttattcagtcacatagatattcgcagctgttccaggatgcttaccttatcccaatgtgtgcatgcatttggtcctgcccatcacagaacgtatttggctttcctgccggttttgtgctttcatttttttgcgataatcatcttctcgagttgtttagtcccctacagtggctaaatgtcaaaggtggttcagggtcctacgtgaacaaggtaagggaggaattggagagcatgggttgtcaaattaaaaccggatgtaaagtgagatcagtttcaagacttaagggaggttaccgaattttggaggctgatggctcagaagagatatatgagaggatcatattttgtgttcatcctcctgatgctctaaaagtactaggaacagaagcaacacctgatgaacagaggctcctggaagctttccagtatatctacagtgatttgtacttccactgtgatgaaagttttatgccacataattcttctgcatggagtgcgaggaacttcttggggactacaagcagtggtgtttgtgttacctactggttaaatatacttcagaacactgaatctgccagaccttttcttgcaacactcaaccctcctcgtgttccggatcatgtattgcttaaatggcatactagccacccgattccttccatggctgctgcaaaggctactcttgagctcaacaacatacaagggaagaggggaatatggttctgcgtcccctaccaaggttatggaaatcatgaggacagcgtgaaggctgggaaagcagtagcttctgggttgcttggcaagaaatgtgactttttggttaacccaaaacccatggtcccatcatggactgaggccggcgcacgatttctggttgcaaaaaacatgggcaaatacataaccattggtaactttagcatcctcgaagaaggaggcactactcttagttttggtaaaacatgtgaaagatgtcaactaaaatgtgtgatacgagttcacaacccccaattctattggaagattgcaaccgaaggagaccctggtttcgcatattcctacatcaatggttatatctcgtttgttgataaaaaagaaggccttcagaatattgtagagattactttggctaatagaggtgaacggaaaaggttgagcagtagccatgccaacaataaaagtagttatataaaaaagggctggtggacacccttgcttcgaaatcaatggagttacattagcaaaatatgttttgcatgaagtcttaaggagaaacactatatcaaaagctcgtaaaaatatctctgcacactatgatctgagtaatgaattctttgctctttttctggatccgacaatgacttactcttgtggtattttcaaggtggaagatgagagtttagaagcagcccagctacgtaaactcgacaatctaattaataaggctaaggtggaaccagggcatcatgttcttgacattggatgtggttggggttcattggcaataaggttggtgaagagaactggttgcaagtgcactggaattacattatccgaggagcagctgaaatacggaaagagaaaggtgaaagaatttggattagaggaccgcataactctcctgctttgcgattaccgtcaaatagcgaatggccaaaagtttgataggattataagttgtgggatgcttgaacacgttggccatgagttctacgaagatttttttgcatcctgcgagtatcatttggcagaacatggcc

SEQ ID NO: 14449 - DNA, 1169 bp, Sorghum bicolor
  Clone ID: SORBI-28MAY03-CLUS5522_1
ggctacatttcaggccgggccggcacccgcgcgaccgcagtttccccccgaccacaccgttccgccgcgcacaggagagcacagcccccgcgcccaggagtaagtttgttcttttaccaacatgtcgagggaggagaatgtttacatggccaagctggctgagcaggctgaaaggtatgaggagatggttgagtatatggagaaggtggccaagactgtagatgttgaagagctcactgttgaggagcggaacctcctgtctgtcgcatacaagaatgtcattggggctcgccgtgcttcatggcgcattgtctcttccattgaacagaaggaggagtctcgtaagaacgaagagcatgtgaaccttatcaaggaataccgtgggaagattgaggctgaactgagcaacatctgtgatggtatcctgaagctacttgactcccacctagtgccttcttctactgctgccgaatcaaaggtcttctacctcaagatgaagggtgactatcacaggtatcttgcggaatttaagactggtgctgagaggaaggaatctgctgagagcacgatggtagcctacaaggctgctcaggacattgctctggctgagctggcaccaacccatccgataaggcttgggcttgctcttaacttctcggtgttctattatgagattctgaactccccagacaaagcttgcaaccttgcaaagcaggcgtttgatgaagccatctctgagttggatacccttggggaggagtcatacaaagatagcactctgatcatgcagctcctgagggacaacttgaccctttggacctctgacctcacggaggacggtgctgatgagtgcaaagaagcctcgaaaggcgatgctggcgagggacagtaatcttcggacagggcatgttgtctgagcccattgttttagatgctctatgctgtcgaagctgtgccgtgccattattgtagctgatttcctctccccctcactttttctaggctggtagtagttccccattgctttgtgttgcagctagttgggcactaggtccctgtggactggtattgttcccctggatttgacaagcatgtctgtggttgctctagcgttttattgaagctttgaagttatcgcatcctaaaaaaaaaaaaaaaaaaggccccta

SEQ ID NO: 14450 - DNA, 903 bp, Sorghum bicolor
  Clone ID: SORBI-28MAY03-CLUS4718_1
gggggggggggtttttttttttttttttttttttttttttttttttttttttttttttttttttttttttttttttaagttaaaaacgacacttttttaataggacggagggagtacccaatatcaaaaacagtctataacgcagatggaggatacctccacatagtaatcagaaccaactaacatgatgatattaggttaaaagctctaatcctcatcatgtattcgtgctcgttacatcaaatttcatgtcccagatcttcatacatagcatagcttcatttgcaaacacatatcctgccacaatcctctaggtttctgcgtgaatatatatactaaagtattaagcattgcagcttataccggtcggcaatatatgtacaataccggataacaaagcggacatgttacttaagcgaagaactccagtcctcaggcaggtttggcaaacccaatcctgttctcgccgaagtcaaaaacagtgtggtaggcacccatgaaaacatcaccaagtatccagagaggaccacgaggaggcggcacgtcatatgccataaacccgctgatgcagatggtttgtcctgcttgctccagcttcactatgtactgctctggtgttaaggtgaaagtcttgtttgctatggtaaatgcaagatttggcatctctgagatctgatcacaatcaacagttgattcgccattggggctcgggagacgctcacagagctgattagcataattcaaaatgagctcttttgtcttgttttctcggagttggttctgtatccagacaacagccatctcacaagcagtacagaaaagatcagaaccacgattttgtttctcaacaacagattcaattgggttactgagagaatgggcaccatcaaatacacagagacc

SEQ ID NO: 14451 - DNA, 1690 bp, Sorghum bicolor
  Clone ID: SORBI-28MAY03-CLUS5565_1
gcacgaggcccggacccaagccagcaagcaaagcccacttcagcttccgggtcgaaacctttcttcgaacgcaagaagaaccccctaccccgaacgcgacctacccgagccggcgatggcgacggtggcgatggacatctcgaagcccacgccggcggcgtccggcgacgaggccgcggcggccgcgaaggggaggagcggcgccgggggcgaggggctgcggcagtactacctgcagcacatccacgacctgcagctccagatccggcagaagacccacaacctcaaccgcctcgaggcccagcgcaacgacctcaactcccgagttagaatgctcagggaagagttgcagttgcttcaagagcctggctcatatgttggtgaggtggtgaaggtcatggggaaatcaaaggttctggtgaaggtacatcctgaaggcaaatatgtggtggatctggataagagcattgatatcacaaagatcacaccttcaacaagggttgctcttcggaatgacagttatatgctccatctgattctaccaagcaaagttgatccattggtcaatctcatgaaggttgagaaggttcctgattctacttatgacatgattggaggccttgaccagcaaattaaagagatcaaagaggtcatcgagcttccaatcaaacatccagagctttttgagagccttggaattgcccaaccaaagggtgtcctcctttatggacctccgggcacgggaaagacattgctggcacgtgcggttgctcatcacactgactgcactttcatcagggtgtctggttctgagctggttcagaaatatattggtgagggttcccggatggttcgtgaactatttgttatggccagggaacatgcaccgtccattatatttatggatgaaatagactctatcggatctgctagaatggagtctggaactggcaacggtgatagtgaagtgcaacgtaccatgcttgagcttctaaaccagcttgatggttttgaagcatcaaacaaaattaaggttttgatggcaacaaacagaatagacatcttggatcaagcccttctgaggcctggccgcatagacaggaagattgaatttccaaatcctaatgaggattcacgtttcgatatcctgaagattcattcaagaaaaatgaacttgatgcgtggtattgatctgaaaaagatcgctgaaaagatgaatggggcctcaggagctgagcttaaggctgtctgcacagaggctggaatgtttgctctccgcgagaggagggtgcacgttacccaggaggacttcgagatggcggtggccaaggtgatgaagaaagacacggagaagaacatgtccctgcgcaagctctggaagtgaggctcatgccttgttgtacccacctttcatgtccacgctgaagctagtgccttcatatttttatctttcataccactttgccaaagcagtggaatggtgtaacggcatgctctgtgcatgcctattatgtttaaagttttccttataacagctgtagtatgttattgcaaaagttgaattttatcagatcagctagatgacggtactaatgcattgctagctcgcgatgttctgagttccagttcctacttggtgtgcagtttgccagtcaactcgtaaggaacactgcataatggttgctgctct

SEQ ID NO: 14452 - DNA, 1295 bp, Sorghum bicolor
  Clone ID: SORBI-28MAY03-CLUS5993_1
gcacgaggctttttggcgccttcgtcagcagagctggagtgacggttgtcgatgtcctctcccccaaggttttcattggtttgattgttggagccatgcttccctactggttctctgccatgaccatgaagagtgttggaagtgctgccctgaagatggtggaggaggtccgcaggcagttcaacaccattcctgggttgatggagggaactgccaagcctgactatgcaacctgtgtgaagatctccaccgatgcttccatcaaggagatgattcccccgggtgctctggtcatgctcactcccctcattgttggaaccctcttcggtgttgagactctctctggcgttcttgctggtgccctggtttctggagtgcagattgccatctctgcttccaacaccggtggtgcatgggacaatgccaagaagtacattgaggctggtgccagcgagcatgcaaggacccttggccccaagggatctgactgccacaaggctgctgtgatcggtgacaccattggtgaccccctgaaggacacctcgggcccgtccctcaacatcctcatcaagctcatggccgtggagtcccttgtgtttgcccccttcttcgccacccaaggtggcattctgttcaagtacctgtaagggccacaccaagcacaggagaagtatatgatcgaccgaccatggacatctcgaataactcctgccgaattgccagttcttgtgtattgtgcgctagttgtctagctgcactgctgtttttttggtctcattgtttcaggattgctgctgctgttcgtattttctctttgggcctcctggaggcgttactgttagccttactcttactccctgtagctccacgtagaagagagcagatgtcctgcgtctggcaaattttcccagtcccttgatgatggcgatgatgttgaaatctttgaacaatgatacatgattgttgcattgtactgttggtaactccgtatctgttgatgcccatccggccactccaatcatccaatgttatgctctgctccagtcacccaatgttatgctctggttatagcggaatacgaatgctgcttgtactgtcatggctgctgccgacaagttcataagataacctaaggcctgtttggattgtaggaatttcaaaggaatctaattcctttgttttgcttgcattacatagtgtttggaatggaggaataaagttttcctttcctatgaaaatgctttcttttcaagaaataaagggaataaagtatccactctaaactctggaaactt

SEQ ID NO: 14453 - DNA, 1519 bp, Sorghum bicolor
  Clone ID: SORBI-28MAY03-CLUS5486_1
gccggccgggtttcagaaagcgcccgccgcccgccgccagccgccgctccgttctcctcccccaccaatccgcagcgagacgcgcccgagcgagcgagcgagccccgaccccgccgacacgatgaggccgtcgctgctaaagtcctcggccgagctgctccgccgcagccgcggctacgcgtccgcggccaacccggagcggaaggtggccatcctgggcgcggcgggaggcatcgggcagccgctctcgctcctcatgaagctcaacccgcttgtctcctccctctccctctacgatatcgccgggacccccggcgtcgccgccgacgtctcccacatcaactcccccgccctggtgaaggggttcatgggggacgaccagcttggggaggcgctggagggatccgacgtcgtcatcatccccgccggggtacccaggaagcccggcatgaccagggacgacctcttcaacatcaacgccggcatcgttaaggggctctgcactgccatcgccaagcactgccccaacgctcttgttaacatgatcagcaaccctgtcaactccactgtcccgattgcggcggaggttttcaagaaggctggtacttatgataagaagaagctgtttggtgtgactactcttgatgttgttcgtgctaaaactttttatgctggaaaggcgggcgtgcccgttactgaggtgaatgttcctgttgtggggggccatgcgggtattactattctgccactcttctcacaggccactcctgcaagcaattcattgtcccaagaagacattgaggccctcaccaagaggacacaagatggtgggacggaggttgttgaagcaaaggctggaaagggctctgcaacactgtccatggcatatgctggtgctgtttttgcagatgcatgcttgaagggtctgaatggagttccggacgttgtagagtgctcttttgtgcaatcaactgtgacagagttgccgttctttgcctccaaggtacggcttggcaagaatggagtggaggaagtgcttggtcttggtgagctcaacgacttcgagaagaaggggcttgaaaacctcaagggcgagctcatgtcttccattgagaagggtgtcaagttcgcccacagcaactaggcaacttgctcggcttctaacaattgatatcccttgcattttttgtttgactgcctatttttcctgcccccttatggttggcgcaacgaggctttgtggtccaaaataaaactcagcggaacgaagaaaacatgtaccagaaacagtttacaaacaccggtgttttttgtgctgaactcccagtagttgagccgtgagggaatcgagaacaaactttccactttctcatttccgagcgccttgtctttgattgtattgtatgcatgttttggacccgtgcctcgacgtcttggtagttggcttggcagttggcacacaggaatctaatcactggagctggtagatactggtatgaaagaaaatccaaaactgctg

SEQ ID NO: 14454 - DNA, 414 bp, Sorghum bicolor
  unsure (1)..(414): unsure at all n locations
  Clone ID: LIB3476-058-P1-K1-H3
ggaccaaaacatgcatacaatacaatcaaagacaaggcgctcggaaatgagaaagtggaaagtttgttctcgattccctcacggctccggacgcgtgggcttgattctcctgtcaattcactgcagagtgtattcttcagaatggatgagcttatagaacaatcagatgaatggagggagaaagttaatcctggtggatgtacatcatgcctcaagaatggtgtatggcctttcaaccaatgggccattaacacggaatatggatctgaaggaagcacggcatgtgtggttcttattagagacaatgagattatggtgggaaacgtcggtgactctcagtgcttactctntgtgaacggacagacaatggtgttgaccagtgtcatgtaccatgtgattgtgatgaaagtgaga

SEQ ID NO: 14455 - DNA, 3967 bp, Sorghum bicolor
  Clone ID: SORBI-28MAY03-CLUS71_1
ctgccccgcgcaagccggctcgctgtcccactcgcgcgccacgcctgacgcctcggacccggaggtgtattccctcttcttcccccgtgcttatccgcggcggaaggcaatcccctccctcatcacgtccttctcccaggcaaagccccgtctttttgggcgtatgcccccgctggcgcgcctatgattcccgccgattcatccgcccgctcggtccagcaacccttgctgctgcagtgctgcggctagttcggtggcggggaaggaggaggaggagggatcttgcagtggggcgaagcggagatgtcgtcgccgttgaacaaccgggggacgtgctcccggagcagctctgcgcggtccaggcacagcgcgcgggtggtggcgcagacgcccgtggacgcgcagctgcacgccgagttcgagagctcccagcgcaacttcgactactcctcgtcggtgagcgccgccatccgaccgtcggtcagcaccagcaccgtctccacctaccaccagaccatgcagcggggcctctacatccagcccttcggctgcctgctcgccgtccacccggacaccttcacgttgctcgcctacagcgagaacgcgccggagatgctcgacctcacgccacacgcggtccccaccatcgaccagcgggacgcgctcgccgtcggcgccgacgtgcgcacgctcttccgctcgcagagctccgtcgcgctgcacaaggccgccaccttcggggaggtcaacctgctcaaccccatcctcgtgcatgccaggacgtcggggaagcccttctacgccatattgcaccggatcgacgtcggccttgtcatcgaccttgagccggtcaacccagttgacgtgccagtcactgctgcgggtgcgcttaagtcgtacaagctcgccgccaaggccatctccaggctgcagtcgctgcccagcgggaacctgtcgctgctgtgcgatgtgcttgtccgtgaggtgagcgagctcacgggctatgaccgggtcatggcgtacaagttccatgaggatgagcatggtgaggtcatttccgagtgcaggaggtctgatctggagccgtatcttggcctgcactacccagccaccgacatcccgcaggcgtccaggttcttgtttatgaagaacaaagtgaggatgatatgtgattgctctgccactctggtgaagatcattcaggatgatagcctagcacagcctctcagcctctgtggttccaccctcagggcttcccatggttgccatgcacagtacatggcaaacatgggttctgttgcatcgcttgtgatgtcagtgactataagcaatgatgaggaggaagatgttgataccgggagtgaccaacaaccgaaaggcaggaaactgtgggggctggtcgtctgccatcatacaagcccgaggttcgtccctttcccactaaggtacgcttgcgagtttctcttgcaagtatttggcatacagctaaacaaggaggtggaattggctgctcaggcaaaggagaggcacatcctcagaacgcaaacccttctttgtgatatgctcctgcgggatgctcctgttgggatatttacccagtcacctaatgtgatggatctagtaaagtgcgatggagctgcattgtattaccagaaccagcttttgttgctcggatcaacaccctccgagtcagagataaagagcattgccacatggctgcaggagaaccatgatggttcaactgggctgagtactgacagcttagtggaagcaggttatcctggtgctgctgcacttcgtgaagttgtgtgtggcatggcggctataaagatctcttccaaagattttatcttctggttccgatcgcacacaacaaaggagatcaagtggggtggggctaagcatgaaccggttgacgcagatgacaatggcaggaagatgcatccacgatcttcattcaaggccttcttggaggtggttaaatggagaagtgttccctgggaggatgttgaaatggatgctattcattctttgcagttaatattacgtggctccctgcaagatgaagatgccaacagaaacaatgtaaggtccattgtaaaagctccacctgatgatacgaagaagatacaggggctacttgaactaagaacagttacaaacgagatggtccgcttaattgagacagcaaccgcccctgtcttggctgtcgacattgccggtaacataaatggatggaacaataaagctgcagaactaacagggttacctgtaatggaagccatagggaggcctctgatagatcttgttgttgttgattctattgaagtggttaagcggattttggactcagctttacaaggaattgaagagcaaaatctggaaatcaagcttaaagcattccatgaacaggaatgcaatggtccaataatcttgatggttaactcctgctgtagtcgggacctttcagagaaagtcattggagtttgctttgtaggacaagatttgaccacgcagaagatgattatggataagtatactaggatacaaggagactatgttgccatagtaaagaaccccagtgagctcatccctcccatatttatgatcaatgatcttggttcctgcttagagtggaataaagctatgcagaagattaccggtatacagagggaagatgtgatagataagttgttaattggggaggtcttcacccttcatgattatggctgtagggtgaaagatcatgctactctaacgaaacttagcatactgatgaatgcagtgatttctggtcaggatcctgagaagctcctttttggtttcttcgacacagatgggaagtatattgaatccttgctgacagtgaacaagagaataaatgctgagggtaagatcactggcgctatttgctttctgcatgtggccagtccagagcttcagcatgctctccaggtgcagaaaatgtctgaacaagctgccacaaacagttttaaggaattaacttacattcatcaagaattaaggaacccactcaatggcatgcaatttacttgcaacttattggagccttccgaattgacagaggagcagaggaaacttctttcatctaatattctctgtcaggaccagctgaaaaagattttacatgacactgatcttgaaagcattgaacagtgctatatggagatgaacacagtagagttcaaccttgaggaagctcttaatacggtcctaatgcaaggcattcctttgggcaaggaaaagcgaatttctattgaacgtgattggccggtggaaatatcacgcatgtacctttacggggacaatttaaggcttcagcaggtcctagcagactatctggcatgcgcccttcaattcacacaaccagctgaaggacctatcgtgctccaggtcattcccaagaaggaaaacattgggtctggcatgcagattgctcatttggagttcaggattgtccatccagctccaggcgtccccgaggccctgatacaggagatgttccggcacaacccagaggtgtccagggagggcctcggcctgtacatatgccagaagctggtgaaaacgatgagtggcacggtacagtacctacgagaagccgatacctcatcgttcatcatcctgatagagttcccagtcgcccagctcagcagcaagcggtccaagccttcgacgagtaaattctgacactcatgctcctggaactgcagtgagagttcggccgtgtcaaattctcgggtgtagttggtcaactgactgtgcagtctgaaacatcggttggtcagttctggtatcttagcacgtctgtgtaacgcgggtagatttggttgtttgtatttggagagatataaagctagctggctaggtgtaacgtaacttcgaccgataactgtatgtgaatgatgagctgtgaggatgaataaaagcttcacttgtgttctct

SEQ ID NO: 14456 - DNA, 727 bp, Sorghum bicolor
  unsure (1)..(727): unsure at all n locations
  Clone ID: SORBI-28MAY03-CLUS6058_1
tgtggcggccggctcgangggccggccggccggcgggaaagaagcccgaccgccggaccgggacccacccacgccgacgagcaaaccctagcgagcgagagccggaggcgagaggagatcgatcagccatggcgctgcgtgccctgtacaacgagatccggggcatgaaggtccgcgaggtgccggcttacctgaagccgcgcttgacctgggacaacgtcaagaagagcgccgaccaggccgtcgaccgctacatcgagaagtacatcgacacgagctcgccggacccgctcttccacgtctgcttcggagggatggtcttctcctacctagtcaatctgccctgggagcgcgcccacctcgcccacctcgaggagatggagaggaccggtgggaagcactagatccgcctcctcgcccctcgccggcagcgccggaggactggtggctttcctggggtccattcaggctgatggcttctattttcttctgctgatgagctactggagtcatgttaatttgatcatttattttgtacccagacagcaagaaactgtccagcttattgttatgttcctcagcatcttgtcataagcaacttcaaactaagaagcgcatgcattgtgattaaaaacgttttcagtaattgagtacaagtcttttgtaaaaaaaaaaaaaaaaaaaaactacactattgctgcattgctggaccatcgtggtgttaaaa

SEQ ID NO: 14457 - DNA, 653 bp, Sorghum bicolor
  Clone ID: LIB5048-012-R1-XP1-E10
tccgcatttcctttcctgaacaattccccttccccttcctccccagccccacccacccacgccgacgagcaaaccctagcgagcgagagccggaggcgagaggagatcgatcagccatggcgctgcgtgccctgtacaacgagatccggggcatgaaggtccgcgaggtgccggcttacctgaagccgcgcttgacctgggacaacgtcaagaagagcgccgaccaggccgtcgaccgctacatcgagaagtacatcgacacgagctcgccggacccgctcttccacgtctgcttcggagggatggtcttctcctacctagtcaatctgccctgggagcgcgcccacctcgcccacctcgaggagatggagaggaccggtgggaagcactagatccgcctcctcgcccctcgccggcagcgccggaggactggtggctttcctggggtccattcaggctgatggcttctattttcttctgctgatgagctactggagtcatgttaatttgatcatttattttgtacccagacagcaagaaactgtccagcttattgttatgttcctcagcatcttgtcataagcaacttcaaactaagaagcgcatgcattgtgattaaaaacgttttcagtaattgagtacaagtcttttgt

SEQ ID NO: 14458 - DNA, 2895 bp, Sorghum bicolor
  Clone ID: SORBI-28MAY03-CLUS8018_1
gcacggcggtttattcgtcctccactccacctccctccgaagcctccaacgcatccttccttcctcccatccgaatctctctgccgcccgcccgccttccttccttcctccgctaggcgatggcggcggagccggagcagaccgcggagcagttccggggccaggcgcggctgccccacttcgcgaccccgcggcgctacgacctgcgcctcacgcccgacctcgccgcctgcgccttcgccggctcggtgtcggtgtccctcggcgtcaccgcgccgacgcggttcctcgtgctcaacgccgccgagctcgacgtcgcgccagcgggcgtcagcttcgcgccgcagggctccgaccaggtgctgcaacctttggaggttaccaacgtgtcagaagatgagatcctgattattcgcttcagtgaggtgcttcctctcggggaggggactttgacgattgccttccagggaactttgaatgataagatgcatgggttctacagaagtgtgtatgagctcaatggagagaagaaaaacatggctgtaacacagtttgaaccagctgatgcgaggcgctgcttcccttgttgggatgagcctgctttcaaggctgtgttcaaaattactcttgaagttccttctgagaccattgctttgtcaaatatgccagccactgaagagaagatcaatggtcctaccaaaatagtctacttccaggaatctccgataatgtctacatacctagtggctgttattgttggcatttttgactatgtggaagatttcaccacagatggaactagagtccgtgtttatacacaagttggtaagagtgcgcaagggaagtttgctctagaggttgccttgaagacattggtcctctttaaggagtattttgctgtgccataccccctccccaaaatggacatgattgctattccggattttgcagctggagccatggagaactatggcttggttacataccgtgaaacagcattgctatttgatgaaaaacactctgcagctgccaataagcaacgggttgcagttgttgtagctcatgaattagctcatcaatggtttggaaatcttgtcacaatggagtggtggacacatctgtggcttaatgagggctttgcgacttgggtgtcttacttagctgcagatcagttcttccctgaatggaatgtttggactcagtttctagaggaatctacaacaggtttcaagttggatgctcttgcaggttcacatccaattgaggtggacataaatcatgttgatgaaatagatgagatatttgatgctataagctataggaaaggagcttctgtcattcggatgctgcaaagctatcttggggctgaggtctttcagaaatctttggctgcatacatcagaagatttgcgtattcaaatgcaaagacagaggacttatgggctgcccttgaagaggggtctggtgaaccagttagaacattaatgcattcatggacaaaacagcaaggttatcctgttgtcagtgtgaaagtcaaggatggaaaggtccagctggagcagacacaatttctttcaagtgggtccacaggagatgggcaatgggtggttcctgtcacactatgttgttgtgcgtactcacgccaagagaagttcctttttcatgggaaacaagaagattttgatttgtcagggttagggctcacagaatgccaaaagaagtgtagcttctggattaaacttaatgtcaaccagaccagcttctatagggtgagctatgatgatgaacttgcatcccgacttcggtatgcaattgaaaccaacaaattgagtgcagcagacagatacggtgtgctcgatgatgcttatgccctctgtatggctggcaaacaaaagctagtctccttgttgcagttgatttctgtataccaggatgagactgagtatactgtgcttgcacaagtaatcacgacgagtctgcacattgccgagatgatggctgttgctgctccagaggagttggttaatctgaagaagttcctaattgatttcctggagccatttgcactgaaacttggctgggatgctaagagtagcgagggccacctgaatgctttgttaagaggcacactattaactgctcttgcagaacttggccatgagactaccataaatgaagctgttcgtcgatttaatgtctttttggaagacagagagacgccgctcctccctccagatgttagaaaggctgcatatgttgctttgatgcagacagtgagcaaatcaaacaaaactggctacgaatcgctattgaagatatatagagagactgatctaagccaggagaaagttcgtgtgttaggttctttggcatcatcccctgaccctgatgttgtccgtgaagcattggatttcatattgtcacctgaggtgaggaatcaggacgcaatatttttgctaagaggggtgagttcaggggcacacgaggtcgcatggcaatggctgaaggacaactgggactacatattgggagcctactctggcactctgctcacctatttcgtcaacataaccgtgtcgccactggccaccgatgaacacggtgatgaggcggaggagttcttcaagagcagaaccaagccgaacatcgcgaggactgtgaagcagagcattgagagagtaaggatcaatgcccaatgggtcaagaacatcaaggctgaggctgacctcggcagtgttctcgagaagctggctcacaagcactgatcagagacgatcactttcatctctctgtagtcctagtgcagagatgtaacttgtgcgctggaattgttcaaaaaaaaaaaaacttgtgcgctggaacaagtaataaagggtactttcgtttgtgtcgccc

SEQ ID NO: 14459 - DNA, 1912 bp, Sorghum bicolor
  Clone ID: SORBI-28MAY03-CLUS804_1
caaaatcatggctacaaatggtgttgtccaccaaactgtgtcagatgaccttgaaggtgtttctgctatcctgaaatggctcagttatgttcctccatatgttggtggtcctcttcccattatgaaacccctggacccacccgaaagaccagtagcatacttccctgagaatgcttgtgatgctcgtgcagccatctgtggcattcaagacggtgaagggaagtggttaggtggtatgtttgatagggaaaccttcgtggaaacattggaaggttgggcaaaaacagttatcaccggaagagcaaagcttggtggaataccagttggtgtcatagctgtggaaacccagactgtgatgcaagtcatcccagctgatccaggtcagcttgattccgctgagcgtgtagtccctcaagcaggtcaggtgtggttcccagattctgcagccaaaacagctcaggcattaatggatttcaaccgtgaggagcttccactgttcatccttgcaaactggagaggtttctctggtgggcaaagggatttatttgaaggaatccttcaggctggttcaacaattgttgagaatctgaggacgtacaagcagcctgcttttgtatatatcccaatgggtggagagctacggggaggggcctgggttgtggtggacagcaagatcaatccggaccacatagagatgtatgctgagaggactgcgaaagggaatgtccttgaggcagaaggattggtggagataaaattcaggccaaaggaactggaagattgcatgctaaggcttgacccagaattgattggcctgaatgctaggctgaaagacatgaagaaacaaaatgccagcatctcggaaatggagaccatacggaggagtatgactattcggatgaagcagttgatgcctatttatactcaggttgccacacgatttgccgaattgcatgacacctctgctagaatggctgccaaaggtgtgatcggtaaggttgttgattgggaagagtctcgggccttcttctacaggagattgcgaaggagagttgctgaggatgccctggccaaggaagttaaagaagctgctggtgagcagctttcccacagatcagcactagactctatcaagaaatggtatctagtgtccaaaggaactgaaggtggtagtgaaatgtggaatgatgatgaatctttctttgcttggaaggatgattccaagaactatgaaaattatctcgaggagttgaaggctgaaagagtatcgaactggttctcgcatcttgctgaaagttccgacgtgaaagctctgccaaacggtctttcactcctccttaacaagatgaatcctctgaagagggagcaggtcattgatggcctcaggcagcttcttggttgatcgatggtggtatcgcattccaaccggaaaatgtcctcactttttgcacataaactatgtgttcttgcaagatcgaagtggagcatgaagccctgcttagttgggaacgaattgttgtttgtagtcatgtatttagctgtttatcctgtaattagttggatgtcgtttctcgatgtcatatgatacatcagcaatcctgatcaagtaattatttacttttcaatccaaataatacatgattttcatcagtacgctttgtgcttgtaatatactctctcatttcaaattataagacgtttgaggtttcctagatacattacttttactatgcttagacatagtagatatctaagttcatagtaaaaaaactatgtatttagaaaagctaaaatgtcttataatttaaaattattagaccatgtattgtagacatgtagacatattgtaattcaagccccgttagaatgactctgcaatttatcaaggtgcaaattatattttttatttatt

SEQ ID NO: 14460 - DNA, 1076 bp, Sorghum bicolor
  unsure (1)..(1076): unsure at all n locations
  Clone ID: SORBI-28MAY03-CLUS8290_1
gcgcgggggtcatttggctgtggggggtgcccgagcgtgcccttcatcttgcgctgcgtggggctcggcctcctgtccggaataactcaattgtgtacggcggtggctcagcagagatatcttgttcaattgctgttgaaactgctgcagatcgtcaccctggagttgagcagtatgctatcaggtcatttgctgatgcattagatgctgttccactagccttggctgaaaacagtggtttgtcaccaattgataccttaaccgcagtaaaagcccaacaagttaaggagagcaacccccactgcggtatagactgcaatgatgttggcaccaacgacatgaaagaacagaacgtcttcgagacccttattggcaagcagcaacagatcttgcttgccactcaggtggtgaagatgatcttgaagatcgacgatgtcatctcaccgtccgagtactgacgaagtctgaaggaaaaaggaagggatggctatgctggatgacagttcagtaggcagcattgctgatgtgacattggtgtactccgtatccaggcttgctccatgtatctcgtgagctgcctgcctgcctaccactttttgtgtgaccgtttgtggaaattgtttgtatttcacgatgagtatgcgtatggatgtagtctagactctagacaacaagttttttgtgatggttgcagtattgatacttttgtagtgttttcgccacttggctgaagctaagtttagacagctgtgcttggtgacaattaggcgtcagagactcagaggggctggtggcttcgatttgtgaacggcgccgtggtttaaaaggcaaaaaccattccatatgctgtgcggttaatttgccgtgccaatgatggtacctaaagaagttagctgctgcagctgcgcgcacactcttagcacttagcagagcactatacagattcaatgatgcgctagctacctttgttgagtaaattctaatgtcactaaaatttataaggctttctttaatgtcttgaaaattgttcattttccacgaataccattatgtgaattttgtgattcttgcngtaa

SEQ ID NO: 14461 - DNA, 1507 bp, Sorghum bicolor
  Clone ID: SORBI-28MAY03-CLUS9529_1
attgagcaggcgcagaggactcccgctttcactgtagcagctctgctccttggtcgtcttcgtcctcttctcttgtgcctgccaactgccatccacgaccccgcaagggcaaggtgccagcagaagtgatccgtggactgcagctatgggcaacctgtgctgctgtgttcaagttgaccagtcgactgtggccatcagggagcagtttggcaagtttgacggcgtgcttgagccaggatgccactgcatgccttggttcgttgggaagcgtgtagctggtcatctcacactcaggctgcagcaactggatgtgcgctgtgagaccaaaacaaaggacaatgtctttgtcaatgtggtggcatctattcagtaccgcgctctggctggcaaagcaagtgatgcattctacaaactgagcaacacaaggtcccagatccaagcttacgtctttgacgttatcagagcaagcgttcccaagctccatttggacgatgctttcgagcagaaggacgagatcgcaaaggctgtggaggaagagcttgagaaggccatgtcggcttatggctttgagatcgtgcagactctcattgtggacatcgagccagatgaacatgtgaagcgcgcaatgaacgagatcaacgcagctgcgaggctgagggcggctgcaaacgagaaagcagaggcagagaagattgtgcagatcaagcgtgcggagggggaggcggaagccaagtacctgtctgggctgggtattgcacggcagcggcaggcgatcgttgatgggctgagggacagcgtgcttgggttctccgtgaacgtgccgggcaccaccgccaaggacgtcatggacatggtgctcatcacccagtacttcgacaccatgaaggagattggcgcatcatccaaggcttcatcagtgttcatcccacatggcccaggtgcagtgcgcgacatcgccacgcagatccgcgacggcctcctgcagggctcctctgtcacccagcactagtttgctgttgctgaggggagcagcatgatcattcctggagtttggtacctatttatatgaccccgtcagtcagaccagtgtggtgcttgtctatattgttcgtctatatctctggagctggggtgatcaaggtgtggaacatatataatgtgctcttaagaaccatctgcttctgctaagatggttatcttgatgcaatggggactggagaacctttatctaaccttttagggaaccggtaattatatcataaatataatgcagcatgagtttgcagtatgttcatgtgtcatgtatgctgcctgaattcagatgttgctgccctgaatatgttgatgcagagtgcaaattcatgaatggaatgtgctcaatgttggcaggaggacctgccactgttgccacgagtgaatggcacacatgcacagtaatgggggcatcatagcacagcatagagttgctttcaaacaccataataataaataatgaatgatgatgctg

SEQ ID NO: 14462 - DNA, 944 bp, Sorghum bicolor
  Clone ID: SORBI-28MAY03-CLUS1029_1
gcacgaggctcacagaagcggcggcggcggagcaagaggaggcgaaggcgagggcgagggcgcgagggagggacaggagcaccagccatggtgcacgtgagcttctaccgcaactatggtaaaacattcaagaaaccaaggcgtccttatgagaaggagcgtcttgatgctgaactgaagctggttggtgagtatggtctgaggtgcaagcgtgagctctggagggtccagtatgcactgagcaggatccgtaatgctgcaaggcacttgctcacccttgatgagaagaacccccgccgtatctttgagggtgaggcgcttctccgccgcatgaaccgctatgggctgcttgctgagggtcagaacaagcttgattatgtccttgcccttactgctgagaacttccttgcaaggcgccttcagacacttgtcttcaaggctggcatggccaagtctattcaccatgctcgtgtcttgatcaagcagcgtcacatcagggttggcaggcaaatcgttaatgtcccatcgttcatggtgagggtggagtctgagaagcacattgacttttcactgtcaagcccgttcggtggaggccccccaggcagggtgaagaggaagaacctgaagaaggcaagtggcggtggcggcgatggtggtgatgaggatgaggagtgaggatgaacaagtagcatggccccaatataatattatctagttttcataaacatgttcctatcatgagtacttagctgggtgaccagatgctcagtcccctgtgctgactctgcgtcatggatggttatcattttatcttgtgttactagcctatacttagctgctatgtttggagatgtttaatcctgtggttggtttttgacttatgctctgttgctattaagctgttcctgttttcttttggccaatgacttgctgaagcatcatca

SEQ ID NO: 14463 - DNA, 1272 bp, Sorghum bicolor
  Clone ID: SORBI-28MAY03-CLUS17302_1
gggccggctgcccccgtcgcggcccgccgcgtctcccccccgccccctcccccccccccccctccccccctctggccgcagctcccccccccccccgccccgtggccccgccccccgcgacgccgcctccgccctctccccctgccgccccccgcctgccggcccgggttgtactgctgccaccattcataggctgcctggtgatcacagctccacatcacacctcacaaacacacacagattagctgcagcagccacctcctatctctccttagtccttcctgcataggttgatatatactctgaacaaggaagagagatgaccagtgtgtggaagaccaaggttctgcctggcctcaacaagatctttgacaaggatggcaagaaggctgctgctgtaggcttcttgaagtccttcaacaaggaggagattggcaaggagattgaggacaagaagacagaactggagcccaaggttgtggagacttatgaagcatctcctcctgaggttaaggctctgttcaaggataagaagccagtcaagatcagcaagaagaactcggctgcagttaccaagttcctcgatgagctggctaagattgacttccctggagccaaggtggtgagcgaggcggtggccaagtccggcaccacgcccctgtctccggcgatcaccttcatcttggacaaggttgcaccgttcatccccgaggagcccaaggtggagccggcggctgaggttgaggccacctcccgggaagtcgccgtggaggagaagaaggaggaggccgagccggctgccgccgaggaggccgcgccggcgccggcagagacgccggcggcagaggagaagaaggaagaggaggaggagaagaaggaggaggaggcgaagccggctgccgaggaggcggcgccaccggcagcagctgctactgaggagaagtgatccggccgatccgattgatggagcaaagctgctggtaaattaaattaagttaccgtgagattaaaaagttactggatcatcactgcttgtcaaccacgtagatgcgtagatcgagttaaaattaagtgattaagtcatcagacacacacttggcataatttgttattcttttctctactgtcacctcgatggatggaccttgctgtgtacatttgtaatgtggggttttctttgtttttgatttgggggtgattattacaaatgtgtaattatttatattgatatgtttgttgatatgatggatggacgtatttaagaagccaaac

SEQ ID NO: 14464 - DNA, 1557 bp, Sorghum bicolor
  Clone ID: SORBI-28MAY03-CLUS1734_1
ggaacaaaaatagtactagcagcatttgccattaatcccgtgtcatcttcagtctggcacctcatcaggttatcataagttgattaacctctcccggtgcgccagaagacccctttgttcgtcacaacaagaaaacacccaacgcgacgccactgcagctgcagccacagggcgcgcacggcacgcatataccacgcacacaccaaaccaaaacgcctaccaatattacaccatcgctgcgcctgcgcctgcgccacgccaccgagcgcggcgttaagcaccttacaggaactgcaggaggcggcggccggcggcggcaggcttcttgcgcaggccgacgacggaggcgtcgtcgacgagcgggccgcagagcgtgccgtcggccttcatgtggtagaaggtgctctggaacacgacgcgtgtgcggttggcgacggccgtgaagtcgagcacggcgcgcttgtaccctccggtgcccttggactcgtacggcaccttgacggtggcgcgcgccgcgtaggcctcggcgaccatggaccccgtgcagccgtcgccggagtcccccacggcgaaggcgaggcggtagctccacccgggcacggtgcgcacctcctggaccagcgcgctctcccgcccgcccaccagctcgacggcgcgcgcgccctggggcacggcgaagtgcgcggcgtccacgtacttgacggccttggaggaggcgatcatccagccggggagcggcgagtggtcgtcctcgatgtttggcggcaccagcacgccccacgacgcgttgggcaggaagtaggggccctcctcgaacccgccgttcttgagcatgttccccctggcgagcgtcggcgggtacagcgcccggatggcgacgccgtcgatgagcgggccgcaggcggggtcctcctccacgccggggttgtggatgacgagcgtcacggtgctcagcttcgccttgaaggcccaggcgtacgagtcccagccgttgctgccgtagatggtctgcatcgggagcacaccccactcggggctcaccgacacgttgagcgcctccgcctgcgcgcacgtccgcgccgcgctgaaggtgatggcgtagtaggcgccgcgcgccacggcgaggcgctgccggatggaggcctcgttgcccaggcgcacggcgtgggcgccctgcggcaccaccagcagcatgtcgccctgcttgtggcccgactcgatgtactccacgaagccggaggtctcccagcgcgggatggcgttggcgcccgacaccaccgtgccgttcaccagcgccgacttgggcgggccatcctcgaagttgccgttcgggagaagaccgtcggtgacgaccgcggcagcccgcgccagcgcgcatacgaggagcagcaacagcgcgacgcgccgcatctttgctctccctccctcctcttccattcacaaggacctctaatgtctgtggcttcgtccttccctctttggggttttgcagcagcagctgctggagcttcgcgacgaagggacacgggaggagtggagtggaggggagcctcgtgc

SEQ ID NO: 14465 - DNA, 1396 bp, Sorghum bicolor
  Clone ID: SORBI-28MAY03-CLUS21613_1
gcccgaggcgaggtcgacgcggatttttcttcgtctttataccgcgggcaggcggactggcggagggaaccgagtcgccaccggcgtcgcgaggccgaggcgagctaatctgacggcggcagcgacgacgaccccaacgacctcgcgcgcggaggctgcactgctccagccaaggcaccatgtcactcatttctccattcccggcggtggatataagtaaaatggatcccccaactctgaccctccttggggcagctggttgtgtaatgctgactttgcatttcactgtgcaattggtgtcacaacatctcttctattggaaaaatcccaaggagcagaaagctatacttattattgtgctaatggctccactatatgctatctcttcctttgtgggtcttcttgatatccagggtagcaagacatttttcacattcttggatgctgttaaagaatgctatgaggcactggtgattgctaagtttatggcattgatgtacagctacttgaatatatccatcagcaagaacatagtccctgatgaaatcaaagggagggagcttcatcattccttccctgtttctcttttcctgccacgcaaggtcagattggagcacaagacattaatgcttctgaagtattggacctggcaatttgttattgttaggccagtatgttccattctgattattgcactacagcttcttgggctgtaccccagttgggtctgcccgtcgcttagtattatactgaacttttcagtctccatggccttatatgccttggttcttttctaccacttgtttgctaaagagctggcacctcacaagcctcttgcaaagttcttgtgcatcaaagggattgtcttcttctctttctggcagggttttgcgctcgatattctaactgaagcaggtgtgatcaaatcccaccatttctggctggacgtggagcacatccaggaggcgatccagaacgtcctgattatccttgagatggtcgtgttcgccgtcatccagcaatatgcataccatgttgccccctacagcggcgctgacagggcaaagttcgagaagaagaacgaatgaaccaagtttccaaaatgagtgaaaaaaaaaaaccttgctctccgctttgtggtctgatggaaatggagcaccggtatttcccttacggatggtcagacacgagttcatcgagtctcgcgagtactgtagtatatttggtagctaggtatcgtgctgtaaaagtacaatgtgcttgcacactgaataattttgctagttttgtcgttttgaacgttgtcgctggggctatgtagccatggctgttcatctcgctctctggtgactggggggaatccttttatgaataaagctacagtcctgtcttccag

SEQ ID NO: 14466 - DNA, 945 bp, Sorghum bicolor
  Clone ID: SORBI-28MAY03-CLUS21119_1
ccgcgcggcacggcggcgcggtgcgagatcgagtgtcacggcgcccctccccggaccagccatggcagactgcatcgtccacggctactacgttccctccggcacccgggtcatcgtcaacgcgtgggctcttggcagagatccagagtcatggcaggagaagccagaggagttcatgccggagaggttcgtcgacggtggcagcgctgctgccggcgtcgacttcaaagggaaccacttccagttcctgccgtttggagctggacgaaggatttgccctggcctcaactgtgggatggctactgttgagatcaggtgtgcaaaccccgtgtactgctttgactggcagctgcccagcgacatggacgacatgcgtgtcgtcctgtttggagcgggaggactcatcgtgcatgcccacgaaatgggcattgttgttgtcgagatcactctggcaaccctcatgtaatgctttgactgacacctccccatcggcatggaggataaggatgttgatatgtcagaggtgattgtaatcacggtgcttcttaaggtgaggctcgtacttgttcccacccttccttcggctgatgcacctggaactggtcgtcagtcgtcactgctccatgcaagctcgtcgcgcacaaatgatttggagtaaagatcgaactgcagacgttgtagtgcacgagcacaatgcacacagatgaagtgaactagctagctagctagaatctatatatggatggtttggtgcttggactcaatgtatattgtatatggtaatagtagtgtaatggtaactctatctggaatctgataaaaataagtacactggtattttgaagggaaaaaaaatctctttgttgtagagatttcatctaatgtttttgtggagctgccggcaagagctttccggagcattgttcattataaggaagaaggttc

SEQ ID NO: 14467 - DNA, 422 bp, Sorghum bicolor
  Clone ID: LIB5051-001-Q1-XP2-D1
gtgcggccgctcaaggcggccgggttccaattgactggcagctgcccagcgccatgcaggagaagggtgttgacatgacagaagtgtttggactcacggtgcatccaaaggaaaagctcatgcttgttcccaagcttcctggtgctgctgcacctgcaactagctagtcatctactccatgcaagctgctgaggacacacacacagtcctctgactgtatatgtatctgatgagtcatattgtatactagatcgatcaggtggtttggagtagaaaactacgtacacactctacacacgatggttggagtttcgactcaatgtatattgtatggttataaatcgtgtactaataataattcaatctggaatttgataaaaataaataggataatggaaaaaaaaaaaaaaaaaaggccccta

SEQ ID NO: 14468 - DNA, 1643 bp, Sorghum bicolor
  Clone ID: SORBI-28MAY03-CLUS24552_1
ccaactctaccagagacaaacagcaaagaccgtcgagaattatacacgaaccgaggacacccagaaccaatgctgctaaaactagtactactttataggaccctccacctgatccggggaggattcaagaagttaacttggtggatgagggaggaccccgaaggcatagatgtgctctagatctgaactcgatagacaatgttttatctatgtgatgtatcccttcatcttcagattccaacttaagtgaagaagaaagacttcaagtttcaaaaggagggagagcaatagatgggaggtgttatcaagcttgtacctgacggatccaggtctactaacccgaagcacgctccgaggattcttctctaatttcgcttctaaattctaggatattcttgtatttctactagttatatctaggagtttcctctattactttttatgtgatgtatgcccagattaagttcctatagttatcgtggtgtttaagcaaggttattgatctagtttagaaaactagcggagccatggtcagagcggaggacgggacgtcgctaaggtcgcgtatatcacaatattgcttttgcgggactagtagatcatgtaacaacgtcttccaggtccttcgaattgtttagcctcagtcagccaacaccttaggagagtagatcatctctttatacaatagaagcaaacaacggttgggttattcttcatacatcactcatagtgatagatttacttaatctcttatcccgaaagtaaagaaagttgaatttatacaaattcatgctgtagctcagttgtcctcggatttctgatactcctttggataaactgatggcagatagatcggctccttgccttgggatcgctcgtcatacccttctcgcgtttttaacttttctcttatgcatcgacttctttatatttatctaagacaaatttcgtacctcgtgcgggcgcttgcaaagccgtcctagtcataagtctgcgtctcctctgcccgctcccattaatacgatcgtttttgctgctctttaccgcataagaaatcctagtgtccgtttagttgtgtacttagctaagctcaaagagtagttgacccctctagctgcggagctccgttgttaggacaggcagaaccggtattgaggagtgagtcgtgcgatggtctgatttccttcagcaatgttccgtatacatgaatgaagagtcttttctgctttatatgatcttgtagataactacagtagattgtgacgtagtacttagtagataacttagaatcccttctctagctaatccaacattacctgacatatatgaggagtagtctattttctaatcgctgtgctctttaccccatgaacttatactttattatcaattattgttatggtttaccccctgcggttggaggcccctccgggacctgtttctctttactcttcatggtcttgctagttttcctcccgtccttgccttgatagattttgccccctttgatttaattccatcttcttaagatcccctaagcaaaattataaataacgatacctggaatacttatcctggtgaaatgctacaatgaggtgttttatctgtgcgcttgcggatagaatagattatttcctcgtgcc

SEQ ID NO: 14469 - DNA, 1779 bp, Sorghum bicolor
  Clone ID: SORBI-28MAY03-CLUS34040_1
atcgccacgccgcgcagccgctcccgtcgtcgtccctcctatcgccggcgcctcaaagccgctccgcccgctctcttcgtcgtcgttcccaactgcagtctagggttgtctcgtgctctactcgcctcctctgctcggctggtgtcccctctctctctcacccatggcttcggcggcggcgactcaggtggggacttacttcctgcgaaactactacaacctgctgcaacaaaccccggatgtagtccaccagttctacagtgatgctagcaccatggtccgcgtcgacgacctcaccggcacgaccgcggccgccaacaacatgatggacatacactcgctcatcatgtccttgaacttcacccaaatcgagatcaagactgccaactttgtcaactcatggggcgatggggtgctagttatggtctccggtctcgtgcagaccaaggagtacagccaccaaaggaaatttatccagatgttcttccttgcccctcaagagaagggttactttgtcctcaacgattactttcactttgttgaccaagaacatgtgcagcctgcgccagtgattggtcaggaagactacgagagcaatttggcacccaacacagttgttgagactgctcctgagtacattcacgaggaagaaactcaacaaatagcaccagaaggacatgatttggtcgacaactatacttattctgagccacaacagcaagtagtgtcatctgacaactggggagaggagccccttcctgaagaaccgccttctttctcaaatgaaatgacagtcgctcctgaggagccggtgcaacctccacctgttccgcctcctcacgtcgaggagcctgttggtggcacgaggaagaagacttatgcttccatcctaaaaaccgcaaaggctcctcctgcattcccggtagcgcagcaagtaccagtgagtaagccttctcaccctacaacagagtcaatccagacccaacattcagttatggcttcatcaacgggagctgagaaaccaaggtctgatgtctatggtgagggtgctgcccatgatgatgaagagagcaaatctgtttatgttggcaacgtgccagcaaatgtaaatgaggctgatcttgaaagtgagttcaaaaagtttggtcggcttattcctgacggtgttgctatcagaagccgaaaggagactggtggctattatgctttcgtggaattcgaggaactcagcggtgtacacaatgcgttaaaggcttcaccaattgaaataaatggacggcagatatatgttgaggagaggaagccaaatagcggaataagaggtggaaggaggggaggacgtggccgtttcagcggtggaggccgtggatatgcgagaggcggaggtgacgagtacaatggtaaccgcagtaggtcgaacggctacggtcgtgttcctcaccaagagaggggcatactcgggagccacaccgcaaggaactgattcggtgcagcagcaaacataaggttttgatcccgtgtcgtcaaagcgagagagagatcctgaacaaagcagcctatcagctgctaggttgcttttgggttttggggcttgtttgtcgatgaatgtgtgcacctatgtcacttaaacttttgctagcctgacgctatccctttacattaagatcggctgttctattacccttgctgctattgttgcttgtgcatgactggcggtggtatttggtgttttgcttctgcatggcactggaggtttcagcttaacacatgttacattgc

SEQ ID NO: 14470 - DNA, 1814 bp, Sorghum bicolor
  Clone ID: SORBI-28MAY03-CLUS3736_1
tccagtacctccctgaagcggcccagcgcagtggcccgtgactggtactcgagacgcaggagaagggatcgagaccagggcggtggcattcccggggagcaggagcgtccgcgaccacggaaagatgtctgtactcaagaggatccagttatttttccctcaagtgaaaggtatggatctcgctcaccttactctgagaagcagctattcaaggtacagaaggcgctctaggagtgtggactcaagcgatgctgaaaaccctgggaacaacctgtacgtgactggtttgtcaactcgggttaccgatcgagatcctggagaagaatttttccatgagggagaggtggttgatggaagcgttgttcatgatcctttgaaaagggaagcaacaaggtttgggtttgttaccattgctaccgtttaagaggcagatcgctggagaagcacttttgcactgagggagaggtgattgatgcaagcgttgtgcatgatccttggacaagggaatcacgagggtttggttttgttaccatggctactgttaaggaggcagatcgctgcatcaaatatctggaccgttctgtgttggaaggtcgggtcataactgttgagaaggtaaaatgtaaaatcataagattgggaacatctgaacttccttattaacttcgctactgaatgatatttgtatcattgcttagtactctacactgaacattttagtgttctttccattgaagattttgttgacagcaacagggtagatgttggtagctgctctgcaacaaactgatacaacctaacaccaaaccatgccacctcagccaaagggttgtatgccctacattgtatattattatttttcttaagtgtgtttattcagattgtagataattgctctcttgtttttggtatcaaagacactttcttatctggtcccctattacacaggcaaagagaagacgaggtagaaccccaacacctgggaagtatcttggcacaaaatcttcacgtggacggaggtactccccaagctactcacctgttagaagggaccgttacagttcccgctactcgcctgatcggagggaccgttacagttcccgctatcggagggaccgttacagttcccgctactcacctgaacgtgacctgtcttattctcctgatggtagaggccggtcatactctccatatgacagaaggcgatcatactctccccacggcaggcatggatcttattcccctgacgatcggcgtcgatcatactcaccttactacagaaaccgatatcgttcaaggtctccataccgctacagaagacggaggtcaccttctgtttcgccatactacagccggcaccggtatagatctgtctccaagtcacccagtgtttctccaacaaggaccagagagcggagctattcccacagtttatcgccacagagaagctactctcgcagccattccccagaatcggagagatcaacgagctactctcctaagaaagggagtagaagggaaccctcatgtagcagatattctggcaagaggcgtcgttcaagggaaagctactctcatagccgcagttcatactccgggtccgtgtctagggagcgctcagcttgatctgcgaggtgtatcgtcctaggttgttataagatgccctgtatccgtatttgacagaactgatgtgttttcatgatcattatatgctggctattgtgaacttgagaacagcatggatgtgtgcattgtactgtattatgttatgttcattttgtatgagagtgaaaaatttctgatgctatcttgct

SEQ ID NO: 14471 - DNA, 989 bp, Sorghum bicolor
  unsure (1)..(989): unsure at all n locations
  Clone ID: SORBI-28MAY03-CLUS2646_1
gccggccgccgctcgagggtgagcccgacccggccggccgggccgggacaaagcagtcctcccaccgcacgcaaacgcagccgacctcgagccagccgtcgcgtcgccatggcgagcaagcagacccgccgcgtcctcgtcctcgccgccgtcgccgcgtgcctgctcctcctccccgccgcctcggtcgccacctccgtcgactactgcagtaagaagaactacccggtgaaggtcagcggggtggagatcgtgcccgatccggtcgagcccggcaaccccgccactttcaagatctccgcttctactgataaaaccattgagaaggggaagctgcaaatcgatgttaaatatttcttcttctacgtgcactcggaaacgcgcgacatctgtggagagacttcctgtccagcaactggtgacttcgttctatctcatcagcagacgttaccaggattcactccaccgggctcgtacacgatctacatgaagatacttggtgacgaaaacgaggaactgagctgcatctcgttcgggttcagcattgggttcgtcgcctccagctgaacgcgtccgagctgagcaccacaagtagcccatggatgatgtaattatgtaaaaccactctgtatcctataactcccagccccagtgtcgaggtccatgtacgctttgtgggtgtcgcgctactgtcttgtgtcgttgtgttcaactaagacgttttatccagagttgaacatcacaataaaaacagagtctgatatcatgtaatgaaagtctgcgttcttggtgaaaaaaaaaagaaagtacgctttccattgcctacacctgtttgtatggttgcagtgctatacgggaaatctggacatggacagctcagaatttgcagttgtacctgactgtcagtatggtaaggatgagtaggttaactcaattgaattaatgggtcatccagtagggtctgtccatctcaaaaaaaaaaaaaaaan

SEQ ID NO: 14472 - DNA, 1547 bp, Sorghum bicolor
  Clone ID: SORBI-28MAY03-CLUS4003_1
gtcccaacccgcacgagggtcacacccacccccacccaccgccttccgcctcttttgctctcgtgtttcctcgtcgtctcggcttccggtcgccgattcttctgcgcagagaagattccttgtggtggtgcgtgctcgctcgtcctttgtttcttcgtctcgttcgcgtgcatggggctggacgtcggtgagatcgggatgggcctggatctgggtctcgacctcaggctgttcgccgcgcggacagccggcgggatggcggcggccgcggccaagggtgcgccggcggggatcgagtcctgtatcaggagcctcgaggaggagcgcaagaagatcgaggtgttcaggcgcgagctcccgctctgcgcgcgcctcctcgccgacgtgatcgacgagttgaaggaggaggccgccaagagaggcggaggagacgcggacgcgaaggcggacgacggcgacaagcggaaatggatgagcaccgctcagttgtgggtggacagcgatgccaaatcggacgagtctgataaggagcatcagagtgaaatcacctcgccggagcccaagttgctcggtggcgcacccatgcccataagggccgttgcggctgtaccacccctgccgccgccgttcttcaggagagaagacagctctgccggcacttgtctgtcgttggtatcgccggcatctaaggccccgatttctcccgtggctaccagcgataacgccagcggcagattttgtcccaccatgccaccatctggctcttctggggtcaccttgcactctcaggctcagcagcaggctagcaggaaggcgaggcggtgctggtcgccggagcttcaccggcagttcgtcgccgctttgcatcaactcggcggccctcaagttgctactccgaaacaaatcagggaggtgatgcaagtggacggtcttacaaatgatgaagtgaaaagccatctccagaagtaccggctgcacaacagaagatcccccggtgttgctccggtgagccagccgatcatgttggtgggtggcctctgggctccacaggagcaaagcagctccggttcaccccagggtccgcttcagttctcgggatcaggtgtggccatttctacggccaccgtcggcggtgacagcagcggcagcagcagcgacgaagacgacaagtccgaaggctacagccggaaatgcgtgtaaggttgcgcgcgtttaatttgcggaggatcgtcggatgagagtgtagagatagcgtcgcggcttttgcttgcgcatcggtgtcggtggcaataatagattcatcagtctgaactgaagagaggttgtagtgcagccaggcccatgcatacagggagattgggcggtgtgcgtgtcaaggtttttggtgcgtgtgcgtgcgcccaagagatgaactgatcatgagttgggttgctgtgtcatgtacgtacatggtggagaggttttcttgaggcttcctaacttttaatttccgggcagatgccaaaattttcgccctcagaatcacatattatttattatacatacat

SEQ ID NO: 14473 - DNA, 802 bp, Sorghum bicolor
  Clone ID: SORBI-28MAY03-CLUS40715_1
ggccgtaacaatggctgggcaatcagcaccccaactactgaacaattcagaagtgatggagttgtaatccgtggccaggcttatgggatccgtggtatccgagtagatggcaatgatgctcttgctgtgtacagcgcagtccatgctgcccgagaaatggctataactgaaggaagacctattttagttgaggcacttacatatcgagttggtcatcactcgacgtccgatgattcaaccaagtacaggccagttgatgagattgagcactggcgaacagcaagggatccaatttccagatacagaaaatgggttcagggtaatgactggtggtctgatgctgaagaatctgagctcaggagcagagtgagaaaagagcttcttcaagccatccaggttgcagaaagaatgccaaaaccaccagttgctgaccttttcactgatgtttacgataagattccttccaacctatgtgaacaagagcaattgctgcgggatacaatcatgaagcaccctgcagactacccaactgatgtacccgtttagtattcttgcccttagatgagcaatatcgttgtgtaattattgatgactcaggtccatatcattttaaataatatagtgattcagccagtaaaactgctgattcaacaggttcttaaacaagaattcaacctggcagatgctcacaccaaaagctcatagatgcattgccctgttgctggcatttttgtgaaatagagtaatactaatatatttcatcccctgcacaatgtaccttataataataataataataata

SEQ ID NO: 14474 - DNA, 2135 bp, Sorghum bicolor
  Clone ID: SORBI-28MAY03-CLUS5420_1
gacctcacgctcgatagccgccacgctcgatagccgccgccggcgaccagatcacctcgtagcctagccttgctcgcttctcgtcgtcgccacgatgtcgtcggagcctccacccgccgcctcctctgccaccggcgcagaggaactctctgctgacctttccgccgccaccctcagcaagaagcagcagaagaaggacgccaggaaggcggagaaagccgagaaggcggcgcagcgccagcagcagcagcagcagccggtcgacgccgaggaccctttcgcggccaactacggcgatgtccccgtcgaggagatccagtcaaaggtcatctccggccgctcgtggacccaaatcggggacctcgacgactctgctgcgggccgctccgtgcttatccgcggagccgcgcaggctttccgcccggtcagcaagaagatggctttcgtcgtgctgcgccagcgcatgagcaccgtgcagtgcgtgctcgtcgccagcgctgacgccggcgtcagcacgcagatggtgcgcttcgccactgccctcagcaaggagtccatcgtcgacgttgagggcgtcgtctccctccccaaggagcccctcaaggccaccacacagcaggttgagattcaagtgaggaagatctattgcatcaatagggctatcccgacccttccaattaaccttgaagatgcggctcggagtgaggcagattttgagaaggctgaactggctggagaaaagcttgttcgtgttggtcaagatacccgcttgaactacagagctattgatcttcgaacaccctcgaatcaagctgtattccggatccagtgtcaagttgaaaacaaattcagagaatttttgttgtcgaaggattttgttgggatccacaccccaaaattgatttctggatctagtgaaggaggtgcagctgtattcaagcttttgtacaatggtcaacctgcctgtttagcacagtctcctcagttgtacaagcaaatggctatctgtggtggttttgaacgagtatttgaggttggccctgtgtttagagcagaaaattcaaacacacacaggcatctctgtgagtttgttggtcttgatgctgaaatggagattaaggagcattattttgaggtctgtgacattatagatggcttattcgtatcaatatttaaacacctgactgaaaactgcaagaaagaactcgaaacaataaacaggcagtatccgtttgaacctctgaagtatctagacaaaaccttgaagctcacttatgaggaagggattcaaatgttgaaggaagccggaacagaaattgagcctatgggtgacctcaatactgaagctgagaaaaaacttggtcggcttgtcagggaaaagtataacacagattttttcatcttgtatcgatatcctttggctgtacgtccgttctacaccatgccttgctatgacaacccagcttacaccaactcttttgatgtcttcattcgaggtgaggagataatatctggagcacaaaggatacacactcctgagctgttggccaagcgtgcaacagagtgtggaattgatgtgagcacaatctcggcctacattgaatccttcagctatggtgcacctccacatggtggtttcggtgtgggcttggagagggtcgtgatgctgttctgcgccctaaacaacatcaggaagacctcaatgttcccccgcgacccgcagaggcttgtgccttaatttcctgatttcaagcctgagcctgcaagtggtgtcactgtcactaagcgtatgggttgttccgatgttaatgttaccatcatcgttaacttgcaatctcagctactgaacccggttgctgcggttcagagttcctgttaaattcacaaagctacttgtatctattagattgatgaaaccaacaacaatacgatccttttgggcttttcttcccgtctcacgtgtcgctctggtctgattattactaagtgcaagtattgctaaattctttgtgcacactgctcaggtttgatcctgtttgatggtatataccaagggctagggcttcttaaattcctaagactagacgagtgatgacaaactttttttataagagccggtaggagttctgcacggc

SEQ ID NO: 14475 - DNA, 1750 bp, Sorghum bicolor
  Clone ID: SORBI-28MAY03-CLUS6426_1
cccggaccccggcccgccgccccgcggcccgcctccccacccccttcatgttggtggaagtgcatcagaggggcaggttgtggaagcgtaaaggaaggggaaaaaaccaaatcgaaagagacgtcttccacgcttttagggtttccggatcggaggagcatccccgcctaggtcgccacagccatggttcgcggatcgctcggcaaacttgcgtcgcgcgccctctccgtcgccgggagatggcagcaccagcagctccgccgcctcaacatccacgagtaccagggcgcggagttgatggggaagtatggtatcaacgtacccaggggcgcggcggctgggtccgtacaggaggtcaaggacgccttgaagaacatgttccccagcgagaaagagatagttgttaaaagtcaaatccttgctggtggccgtgggctgggaactttcaaaagtgggctgcaaggtggtgtccatattgttaaggctgaggaagctgaatcgattgcaagtaaaatgttaggccagattctggtaacgaaacaaactggtccagagggaaagattgtgagcaaggtctacttgtgtgagaaactatctcttactaatgagatgtactttgccatcacccttgataggaaaactgctggtccgctcattattgcttgcagcaagggaggaaccagtattgaagatcttgcggagaagtatcctgatatgattattaaggttcctattgatgtatttaaaggaatcacagatgaggatgcagctaaagttgttgatggtctagccctgaaggcagcagataggcagtcttctatagaacagattaagaagctgtatgaacttttctgcaagtgtgattgcacattgctggagataaatcctctggcggagacagctgacaacaagcttgttgctgctgatgcaaagttgaactttgatgataatgctgcatttagacagaaagaaatatttgcactgcgtgatacaactcaggaagaccccagggaggtcgctgctgccaaagcagatttgaactatattggtcttgatggagagattggttgcatggtgaatggagcaggattggccatggcgaccatggatattataaagttgcatggtggtacgcctgccaatttccttgatgttggtggaagtgcatcagagggacaggttgtggaagcttttaagatactgacttcagatgatagagtgaaggcaattctagtgaacatttttgggggcattatgaagtgtgatgtgatagcaagtggaattgttaatgctgctaaacaggttgccctgaaggttcctgttgttgttcggttggaaggccccaatgtagcccaaggaaagaggattcttaaggaaagtggaatgactttgatcactgcagaagatcttgatgatgcggcagagaaagctgtaaaagcatccgtcaagtaactgtagtgtatcaatctgaagtttcttttttttttcactggtacaagatgagcagtgctcttttacggatttcggattggggcagaagtcgtgaactgcaacttttttttgaagtggggttattttggtctagttctcctgttaaacgttgccactagtgccgaaactttgtggtctcatgttaataaacatgtatcggtgccattgggcagcagctattttgtcaattgcaaatcaatttaccttttggtccacagggcagaagctaaatatgctgccagggcctacgttgccagtt

SEQ ID NO: 14476 - DNA, 862 bp, Sorghum bicolor
  Clone ID: SORBI-28MAY03-CLUS44620_1
gccccaccgacacgggcacacccccactagtgtgcgctagtgctccactcgctcgtgtagagcctcgagtactcccagtcgccgcaccggacgcctcttccagcagcttccgcctcagcgacgctgtgaccctgcttctgctggggtttcgcaggctcgcacggcaccgcaccggagccggggcccggcccggccgccggcgcgtcaggggacggtacctgccgccgccaccccgccgccccccggaccgccaccacgccgtgcgcgggcgtgtccgccacgggcccgtaccctgggtccgccgcgccgcggccgctcgacgcgccaacggcaggcacttacaacgcgcacgctccgcgcgcgcgccactgcctgctccccgcgcggtacggccccggcccgggtccctgcgccagctcggtttgaagaaagggacgcgcgccagcgccgtggcttggcatgcgtcaccgtcagtgggtgatacagtgatgataacgcgcctgtgtttgtgtattaccaactcagcgtatgtatatacggagtagtatttgacggttgggtaactgtgaagtaagtactctgtttcgtgaagtttgttctgtctgcctcatcataaaaaaagagagataaatcagtcgactttactctcggcgcagggcgcggcggcgcgcggctgctgcatcgcccgcggcgcccgccgcgggtcctaccgccgcccccccccgtacgaccccgacacgggtgcctgctccaccttggtttgaagaaagggacgcgcggcggcgccgtggcttggcatgcgtcaccgtcagtgggtgatacagtgatgataatgcgcctgtgtttgtgtattaccaaatca

SEQ ID NO: 14477 - DNA, 1957 bp, Sorghum bicolor
  Clone ID: SORBI-28MAY03-CLUS26689_1
gcacgccgataatcacacattttgtctctaatcagagatcaagaagtagcccttaagttaacgatggcttccgccgacctcgcagaggccatcgagcccacgaagaagagcaacgtcaagtatgcctccatctgtgctatcctcgcctccatggcctccgtcatactcggctatgacattggggtgatgagtggagcggcgatgtacatcaagaaggacctgaagatcacggacgtgcagctggagatcatgataggaattctcagtgtctactcgctgatcggatccttcgctggcgcgcggacgtccgacaggatcggtcgccgcttgactgtcgtcttcgctgctgtcatcttcttcgtgggcgcgttgctcatgggtttcgccgtcaactacggcatgctcatggtgggacgcttcgtggccggagttggtgtgggcttcgggggtatgatcgcgcccgtgtacaccgccgagatctcgccggcggcatcccgcggcttcctcacgtccttcccggaagtgttcatcaacatcggtatcctgctcggctacttgtcgaacttcacgttcgctcgcctcccgctccacctcggctggcgtgtcatgctcggcatcggcgcagcgccgtccgccctgctcgcgctcatggtgttctgcatgcccgagtcgcctcggtggcttgtcatgaagggccgcctcgcggacgccagggctgtgctagagaagacctctgcctcgccagaggaggccgcagagcggctggctgacatcaaggtcgccgcggggattccaaaggacctcgacggagacgtggtcaccgtaccaaaggagcggaacggtggcgagatgcaggtgtggaaggcgctcatcttttccccaatcccggcgatccgacgcatactgctatcgggcgtcggcctgcacttcttccagcaggcttctggcagcgattccgtcgtcctgtacagcccgagcgtgttcaagagcgcggggatcaccgacgacaacaagctcctgggcgtcacctgcgcggtgggcgtcagcaagacgcttttcatcctggtggccacgttcctgctggaccgcgtcgggcgtcggcctctgctgctgaccagcgcgggtggaatgatcgtagctctcatcggcctcgggacggggctcaccgtcgtggggcatcacccggacgccaagatcccgtcggccgtagctctgtgcatcgcgtccacgctggcctacgtcgccttcttctcgatagggctcggccccatcacgggcgtgtacaactcggagatattcccactgcaggtgcgcgcgctaggcttcgcggtcggcatggcgtgcaaccgcgttaccagcgccgtgatctccatgaccttcctgtccctctcgaagggtatcaccatcggcggcagcttcttcctctactccggcatcgccgcggtggggtgggttttcttcttcacgtgccttccggagacccgcggtcgtacgctggaggagatgggcaagctgttcggcatgccagacatcgacatggctcaagcagacgacaccgctgccaaggagaaggtggtggaaatgcccaccatgtagatggaaggaaaaccaactaccctgcagtgctggcaatgagccaatgattgatgcagcgtcttttgccagagcagagctcaactcccccaaacaaaaagaaaaaaaaaaaacttgaagcagcgtggcaagattggcctcgtggactcgtggggcggcaggagagagagtgagagccggcgtggtccagcggttcagctagagacttctgcaagacaggctgaatttattggtgtcagcgtcgcgtgtgcttgtcatgccagcggtgaatcctcaatgtagcaacgggcacgtgcatattgtttattccaattatacaaataaatatcatgccagcgtcggtgtgcatgcaatgatgtcattt

SEQ ID NO: 14478 - DNA, 856 bp, Sorghum bicolor
  Clone ID: SORBI-28MAY03-CLUS1893_2
gccggccgggttcgcgagccttgcggtcgcggatccgtcctgcaaaaaactcctcccccaacttctccgccggatccctgaaagattcccggagatgtcggactccgaggagcaccacttcgagtccaaggccgacgccggcgcctccaagacgtacccgcagcaggccggcaccatccgcaagaacggctacatcgtcatcaagaaccgtccctgcaaggttgttgaggtctccacttccaagactgggaagcatggccatgccaagtgccactttgttggaattgacattttcactggaaagaagcttgaggatattgttccttcttctcacaactgtgacgttccacatgttaaccgtgttgagtatcagctgattgacatttctgaagatggatttgtcagccttttgactgagagtggcaacactaaggatgacaccaagcttcccagtgatgaagctctgcaagcccagatcaagagtggatatgatgaaggaaaggacatcctcctgaccgtgatgtctgccatgggcgaggaacagatctgtgctgtcaaggagattgggggcaagaactaaagctgctgcttcgctccggctgtttgtgggcaatacctgttgtcttgtgcttggagttgagaagccaagttgagatacatacataggcgtttaagttatctgtggttttgggtttacctggaatgtgttgagatggtgcgagtacttgtggtacttggttattgatctctggtatctttttgaactgagtaatggtgtaactctggtagtgcatcaatgggaattacaatatatatttgttaaaaaaaatgatttggctttggccgccgtgttgat

SEQ ID NO: 14479 - DNA, 1028 bp, Sorghum bicolor
  Clone ID: SORBI-28MAY03-CLUS1893_1
ccggcaccacaccaaacacccggtaagcgcggatccgtcctgcaaaaatccccgcccccaacttctccgccggatccctgaaagattcccggagatgtcggactccgaggagcaccacttcgagtccaaggccgacgccggcgcctccaagacgtacccgcagcaggccggcaccatccgcaagaacggctacatcgtcatcaagaaccgtccgtgcagggctagtcagccgctgggtcgctcgcccccgtcacccaccttccttcgcgcggcgcttactcggggcttcggtcggccttggaagatgtcggactccgaggaacaccacttcgagtcgaaggccgacgccggtgcgtccaagacttatccgcagcaggccggcactgtccgtaagaatggctacatcgtcatcaagaaccgtccgtgtaaggttgttgaggtttccacttccaagacagggaagcatgggcatgccaaatgtcactttgtggccattgacattttcaatggaaagaagcttgaggatattgtgccctcatcgcataactgtgatattccccatgtcaaccgtactgactaccagctgattgatatatctgaggatggattcgtcagcctgctgactgaaagtggaggcaccaaggatgatcttaagctccctactgatgaaactctgcttacccagattaaagatggattcagtgagggaaaggatctgatcgtctcggtgatgtctgctatgggcgaggagcagatctgtgctctgaaggatatcggccccaagtagagctgagctgcattgcttttgcactggttatttatcttgtcgtctatttacttgggaggtggttgagttgatatacagtataaacgtttcgattgagggtaacatgagacttctgtactgtcgtcttttacgcacagtgatgtcgacgtacctatctgtattgtacctttgagtccaaattgcggaataaataatgaaactatacatcctaaaaaaaaaaaaaaagggcccctaggggcgc

SEQ ID NO: 14480 - DNA, 672 bp, Sorghum bicolor
  Clone ID: SORBI-28MAY03-CLUS6013_2
gccgccgggttcgggagccgcacaccccgcttcgccgccccgccgccgctgccgtccccgcccgcagccaaaatgccgttcaagaggttcgtggagatcgggcgggtggctcttgtgaactacggcaaggagtatggccgccttgtcgtcatcgtcgacgtcgtcgaccagaacagggctcttgtggatgcccctgacatggtccgttgccaaatgaacttcaagcggctttccctgactgatatcaagattgacattaaacgtgtcccaaagaagactacattgattaaggcaatggaggaagctgatgtgaaaaccaagtgggagaatagctcatggggcaagaagctgattgtgcagaagaggagagcatcgctcaatgactttgacaggttcaagatcatgttggcgaagatcaagaggggtggtgccatcaggcaagagcttgctaagcttaaaaaggtggctgctgctgcttagattgctttggtggttttgattttgatcctttatgcttcgatgtcttgaaaaatgtaatgcacgaattacttccagttagcttgtcaagatgccagttttgaactgccttgtttagatattgtctaaaatgctattctgaatctgagatagtgttatatttcggtatctatcaagtgttgcatccttgttccc

SEQ ID NO: 14481 - DNA, 798 bp, Sorghum bicolor
  Clone ID: SORBI-28MAY03-CLUS6013_1
gccggccgggcctggagcagccggccgggcggggccggcccggttggacttccgccgcgcttcgccctctcgctccagccgcttcacagcgtcgccgccgcagctcgcctctccgaccgccgcgaggatgccgttcaagaggttcgtggagatcgggcgcgtggccctggtgaactacggcaaggactatggccgcctcgtcgtcatcgtcgatgtggtcgaccagaacagggcacttgtggacgcccctgatatgatcaggtgccagataaacttcaagcgtctttcacttactgacatcaagattgacatcaaacgtgtccccaagaagacaaccctgatcaaggcgatggaggaagctgacgtgaagaccaagtgggagaacagttcatggggcaagaagctgatcgttcagaagaggagggcagcgctcaatgactttgacaggttcaaggtcatgctggcaaagatcaagaggggtggtgctatcaggcaagagctcgccaagctgaagaaggcatccacggcttagtctccttcagtggatggcatgttacagtttttggttctgagttgtatcagcaattcgatcgagtgttgtcaaagccagaattagtaatatgtttcctgtgaacccatttcaaactttgtcaagcatgggtgtgttctggatattttgtcgtgaatgttatggaatatctaaggtagcctgtggacaaagtgcgaaacacatacaaataaaaaaattgctccaaaaaaaaaaaaaaagggcccctagggcccggggccggctttaaa

SEQ ID NO: 14482 - DNA, 1751 bp, Sorghum bicolor
  Clone ID: SORBI-28MAY03-CLUS6923_1
gccggatgggccgggtcttcgcgaggtcgaacccccaaccccaaccccaaggcgaggtgacgaaaccctcctccccacggagtcagcccacgcgaggagggtgagtgtgcggactgaggcggcgtcgggcgagatgaagcttaacgtcaagaccctcaagggcaccaacttcgagatcgaggcgagcccggatgcgtcggttgctgaggtgaagaggatcatcgagaccactcagggtcagagtacctacccggcagaccagcaaatgctcatataccaagggaaaattctcaaggatgagaccactttggaaggcaacggagttgctgagaacagcttccttgttataatgttgtccaaggctaaggcatcgtcgagtggagcttctaccgctactgctgcaaaagctcctgcaactccggcccaacctgctgcacctgtagcccctgtggcccctgctacatcagttgcaagagcacctacacaagctcctgttgccacagctgaaacgacacctccaagtgcacagcctcaggctgctcctgctgctacggttgctgcatctggtgatgctgatgtgtacagtcaggcagcttcaaaccttgtatctggcaacaatctagaacagactatccaacaaattcttgacatgggtggtggtacttgggaacgtgatacagttgtccgtgctctacgtgctgcatataataaccctgagagagctatagactacctatattctggaattcctgagaatgtggaggctcctcctgttgcccgagcacctgctgctggccaacaaacaaatcagcaggctccatcgcctgctcagccagcagttgcacctccagtgcagccatccgctgcctctgcagggcctaatgcaaatcctctgaacctttttcctcagggtgttccaagtggtggggccaatccaggtgttgttccaggtgcaggatctggtgcccttgatgccttgcgacagcttccacagtttcaagcactgcttcagttggtccaggctaatcctcaaatcttacagccaatgcttcaagagctaggcaaacaaaacccacaaatactgcggttgattcaggaaaatcaagctgagttcctccgcttggtgaatgaaactcctgagggtggtcctggaggaaacatactaggtcaactggcagctgctatgcctcaaacgctgacggttacaccagaggaacgggaggcaatccagcggcttgaggggatggggttcaaccgtgagcttgtgctagaagttttctttgcatgcaacaaggacgaagagcttgcggccaactaccttctggatcatggccatgagtttgacgagcagcagcaatagactttagttgtgtggtatggtgggctggaggaggacaccgaggcagttgcagaacagcagagtgtcgttcttatgtcctccgcctgatgagagatacttggtcgtctatgctatgctgctgactatcttttatttccatatatgtgttcggaatgctttctaagtacatattcattcaatatcaagtgttacaccgtgtatgatagcctatcaaatcgtgttatttgatttgggggaagtgttagatttctcaattgtttagtttgcacttttttgcctggcgtagctttttcttagtatcactgtggctatgaattgtaaggcattttggcttttcgagctatttatttttttaaatgtacctagttgcattgtaatggtttacaatttg

SEQ ID NO: 14483 - DNA, 2674 bp, Sorghum bicolor
  Clone ID: SORBI-28MAY03-CLUS6434_1
cctgccctctgacgcgcccgagggcctggaggagctgaggaaggaagacctacaggcgccctctccgctgaattcgcccaggcgtaccccttctacgacttcaacgccggtcgcgcgagggacgtggttgtcgtgcccgcgtcgtacggggcgaagggcgccgaggaggcgaagcacgagatccacaaggagatcttcagcagggcgatcaggctggtcacggccggcgacaccagtaccgccgtcaccttcgactgcaactcctgggtgcactccaagttccactatgccaacaggcgcatcttctgttccctctaggcctatctgccctctgagatgaccatggacctgggggagctggtggtgcattcataagtgcagcagcaatgattcggtagcggccagagcaaacggtcagtccgcgagcacgacaaaactgtgtactatgacttgggcgacccggacaagcaccccacccaccagagacccatcctcggcggcagcaagcggttcccctacccgcgccggtgccgcaccggccgccccaggaccaagagcgacccgcagacggagaagcgcgacggccggcaccactacgtgccccgcgacgagcagttctcggaggtgaagcagctcacgttcggcgccaccacgctgcggtccggcctccacgcgctgctgccggcgatcaggccgctgctccaaaacaggaaggagctccggttccctcacttcccgtccatcgacggcctctacagcgacggcatcccgctgccggcgctggccggtgtcgtcgcctgcccccgcggcgccccccgcggcggcgagcttgatccagatgagctcttctacttccaggcgagaggtatcaacacggaaactgcaacagatgccctgttatacttctttggagcccatgtgataaagcgcataccgtttaagcccgtaagtgagagggccctgctcctgtgcgaggtccccctcgcgtcctcccggcacgcggcggtctaccgtccggcggggtccgccttcacctaggtggtcccggtgtggcgggtggacggcgccagctcgggggaccaggcggtggccgcggggcggctcttcatcctcgtcttccacggcgggttcctgccctacgtgcgcttgctaatgcagtttgtttgcaaccggcttgttcgtctccggcaccgtcttcttcctcacggacctgggcacgctcatgccgctggccatcgagctgacgcgccccaagtcgccgaccaagccgcagtggaagcgggtgttcacgcacggcccggacgccaccgacgcctggctgtggaagctggccaaggcgcacgtgctcacccacgacacggggtaccaccagctggtcagccactggctgcgcacgcactgctgcgtggagccctacatcatcgccgccaaccggcagctgagccggctgcacccggtgtaccgcctgctgcacccgcacttccgctacaccatggagatcaacgcgctggccagggaggcgctcatcaacgccgacggcatcatcgaggagtccttctggcccgggaagtacgccgtcgagctcagctcagtggcgtacggcgcgacgtggcagttcgacacggaggcgctgcccaacgacctcgtcaagcgagggctcgccgtgcgccgggacggcgacggcgacggcgagctggagctcaccatcaaggactacccctacgcccacgacgggctcatgatctggaactccatcaagcagtgggtgaccgactacgtcggcgtctactacaagtccgacgaggccgtcgccggcgacgcggagctgaaggcgttctgggacgaggtgcggaacgtggggcacggcgacaagaaggacgagccgtggtggcccgtgctcaacacccgggacagcctcgtggagacgctcaccaccatcatgtgggtcacctccggccaccactcggccgtcaacttcgggcagtaccactacggcggctacttcccgaaccggccgaccaccatacggaagaacatgccggtggaggagggccgggacgaggagatgaggaaattcctctcgcagccggagacgacgctgctggacatgatgccgacgcagatgcaggccatcaggatcatgacgacgctggacatcctgtcgtcgcactcgcccgacgaggagtacatgggggagttcgcggagccgtcgtggctggtggaacccatggtgaaggcggcgttcgagaagttcagcggcaggatgaaggagatcgagggattcatcgacgagtgcaacaacaacccggagaacaagaaccggtttggagccgggatcgtgccgtacgagctgctcaagcccttctccaagccgggagtcaccgggaggggcatcccctacagcatctctatctgatgtcatcgagacctcatcctcagcattagtttcttggtatcaggctcaacagtctctcagctccatccccaataagttcaaaaagaaaaaaaaaaagaagctctactcccaatgggaggttgcattattgcatgcagaggctgcttgtcaaataaaatgtactctgatctacgattgtattgtaccatggattgtacacttgagttactaccatttactaccaaaaaaaaaaaaaaaagggcggccgtcgcgatctag

SEQ ID NO: 14484 - DNA, 698 bp, Sorghum bicolor
  Clone ID: SORBI-28MAY03-CLUS594_2
gtggcggccgcttcgaggcccgggtggtgagtagcggtccgacctataaaaaaaaggcaggtccatctcgactcgaggggaagtttcgctctcgccggcgtcgaggacctagggttcgaggaccgtccgtccgtccggggaaggagcaggagccaggaggcgaagatgatcgaggtggtgctgaacgaccggctggggaagaaggtgcgggtgaagtgcaacgaggacgacaccatcggcgacctcaagaagctggtggcggcgcagacggggacgcgcccggagaagatccgcatccagaagtggtacaacatctacaaggaccacatcaccctcaaggactacgagatccacgacggcatgggcctcgagctctactacaactagccgccgccgccgccgccgcctcctctcccctgttgtcaggctggtctgaattcagaagtcacgggtgcaattccagttgcagtctcttaagctcacatatatataagcaacctcagtgagctatttaagacatggtgtgccaaactatagtgactactgacaactttgaatatgttgtatgatcaacctgcaaacttggtgtgctgctactcatactataaataacgtagggctttaaccttggttgtggtaatcaccaaaaaaaaaaaaaaaaatatgtcctcatcattctgcttcctcattgtgctcta

SEQ ID NO: 14485 - DNA, 863 bp, Sorghum bicolor
  Clone ID: SORBI-28MAY03-CLUS594_1
gtgcggcgccaatgccgcgtaccggggaccaattccatcgcgacaatttcttgcctgcacgcaagccagccagccactccgaagcgaagtcttgctagggtttgggttggggggaatctgacgcgagagcgggagcgaagggggaggagaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcaccctcaaggactacgagatccacgacgggatggggctcgagctctactacaactaggcgccctgacccaccccgaccgtgctgcgtgcccccctactgctgtgaggttaatctgaatttttctgaagccatgggtgcacttccagtcgcagtgtctttagctaatgagctcacatacatataggcaacttgagtgagctatgtagtacatacatggttgttgcaagttaccaatgactattgacagccttgcatatattgtcatgtgacaaggatgaacctgcaaaattagtgtgctgctactcgcagaccttaccttaaataacacaggttggtcgtgataatcacggtcctgtgcttctgttatgtgataatgtgaaatatacttggccatgtttagatgttgtagtattagatggagtttgtaaaactccaaaaagattacagttttagtgatactgtggtttccaataccccaaagttattggatcaaaaacttcaggaaaaaattaaagcaaagtatttcataaaaccatggtattttat

SEQ ID NO: 14486 - DNA, 271 bp, Sorghum bicolor
  Clone ID: LIB5051-001-Q1-XP2-B11
gccggccgggttccggagcacttccagtcgcagtgtctttatctaatgagctcacatacatataggcaacttgagtgagctatgtagtacatacatggttgttgcaagttaccaatgactattgacagccttgcatatattgtcatgtgacaaggatgaacctgcaaaattagtgtgctgctactcgcagaccttaccttaaataacacaggttggtcgtgataatcacggtcctgtgcttctgtaaaaaaaaaaaaaaaaaaggccccta

SEQ ID NO: 14487 - DNA, 1644 bp, Sorghum bicolor
  Clone ID: SORBI-28MAY03-CLUS6635_1
ccctctctcttttccgccctccacccctcgcgagccctccaccccccacacgaccctcctcctcggcggcggctgcggcggcgatgcagatggcggcgaccaccaccgactcccaggcggccgtgccgcctcaccaccctcacgcccacccccacgtgcccccgcagcatggtcacccgcaccaccacatgccgccgcagccacggtgggtcgtcatcccgtacccgccgccgccgcccatggtggccgcgccaccgccgccgccgccgcagtttgccaagcactttgctgctgggcctcccccgccgccccaagctgcggccgggcgccgcacgccgaccccacccgcggccggatccggcgggaacgggtgcgaggagaataagaccatttgggtcggcgacctccagtactggatggacgagaactacctccacagctgcttcgggcccagcggcgaggtggttacaataaaagttatccgcaataggcaaacaggacagtcagaggggtatggatttgttgagttcttttctcacgcatcagcagaaaaggctcttcagaattttactggtcatgtgatgccaaacactgaccgggcatttaagttgaactgggcatcatatagcatgggtgaaaagcgatctgaagtagcttctgaccactcaatatttgttggtgatctagctgctgatgttactgatgaaatgctgctggagcttttctctagcaagtaccgctcggtgaaaggagctaaagttattattgatgcaaacacaggccgttctaggggctatggatttgttaggtttggagatgacaacgacaaaactcatgcaatgtctgaaatgaatggtgtatactgctctactagaacgagggtttgttcaatttgtaaacagagctgatgctgaagaagctctgcaagggttgattggagtcattctgatggtgattcttctaatagaacggtatatgttggtgggcttgaccccaatgtcagtgaagatgaacttagaaaagcctttgccaaatatggtgatcttgcctctgtgaaaattcctctaggaaagcaatgtggctttgttcaatttgctagcagaactgatgctgaagaagcactacaaggattaaatggatcactcattgggaagcaggcagttcgcctttcatggggccgcagcccatcgcataagcagtcgaggggtgactccggcaacaggaggaacaacatgtactatggcacaccattctatggcggatatggctatgcctccccagtgccacacccaaacatgtacgccgcagcgtatggcgcgtaccccatgtatggcaaccagcagctagtgagctagagagctcccctccgatgtgtcccctctgacgggaaacaaaggttttggtccggtgagcatagtagggtcaggtgagaaggttatatccttataggttgtccgaaaaagtgggcgagatatgttgttgaacggatggtatggtgcctgtagctgttgtgtgtgtgtgcgtcgcaagaattggatggaactcgtggcttgtagtacaccagggagtcatgtcggtattctttcaagaaattttgacttggtaataaattaaactattgtttgtgcgtccattttttcaaaa

SEQ ID NO: 14488 - DNA, 2454 bp, Sorghum bicolor
  Clone ID: SORBI-28MAY03-CLUS187_1
ctctggaaaaaatgcttccttctttcggtgctcaagacgccccatctctcctctcatcgtcttctctctcatcccatcctgtgccgaaacaaaacgaaaaaaatactcttcctgctgctgctagcctagagcgagaggggaaaaaaagaaaagaaaaggaaaagaaaggggggtaatctccggaaccatctagagacagcgagcggcgcgtggagcggagcgagcaagcctactgcgccggtggtggtggtggcggcggcggcggcgtcctcacgaagcagaagcggttctgatccgcagctctcgattccggaaggagttggtcaagaactggggatcctgagttgaatatgatatcaaatccggtggactggtatagtttcggacccggatagaattcgcagggatgccagattggagggtgcgtgagtttgaaggtaaattcactgatgagtttgcccacagtaatggcaaggaacatgaaggtggagttgaggctccaggtgtcactagtagtaagaagttgaagcatgcagtcgccaatgagaaagcccaaggtcccatccccagaacgaatagctcagattcacagaaatgtaatttagaggacaaccaatgtgagaacgggatagtatcccagaatataaacagtgccgctgactgcataggagactgcaaaaatggttccaatgcctttctttcaagagaagaaaatacaatcgttgaaaccagatgtccaacagataactggaactcctgtcagtttgcactgagcaatggttcgtccattctcaataaccacagtgctccacaggatagcctcacttatggagataatgatctaaactacatcgattggcctggcattgataattttgaggatgtcgacacattattcaggtcatctgattccacatatggtcagcagcagctggagaatgcagatgggttatcttggattccttcttcagatgctgtttactcttctgatgttgctatgcagcaagggtttgactcgtcttattcagattatggtattttggatgatctctcagcattccattgtgcagaagattaatcactaccctcagttgacccttcatcagctttatgtgataatcaattcaatgatacctacctgttcagtgagcaaaagaatgtgaatgcatatggtgaacatatttaccaagaggatgtgatggagttgttgcccactgaccagatatgcagtggacatgaaaacattgatatgttgcaggttggaaaccagtattcatctgaaaatgcaattcaaggtattgaagacaagaaattctctatagcgtcaacttctcagctgagctcctctcagaatttactgaatcaaaggcaccacttaaattccagttcaccaagcaacattacttctgagtcctatgcagaaaagtttggtccatctagcggttcttttgcacaaaggaattcaaaagcgcagaagaaaactttgaacatgcaaccaagacagccaacaaatgataatgacataaacagacatcctcaaacattgacaagaagagcttcttatccttgtgagaactatgaaactgaaagaaaaggattagggaaaagaactctgggggatcctcaagttacaatgggtacttcaatggtagtggatggctcatttgtatcatctgtgtcctctgataactcagttgaagaaagcagctttcgacaactgcaggatgctgttagtcagctggatgtgcaaaccaaattgtgcattagggatggtttataccgattggcacgaagtgcgcaacataggcaagtttttccaaatatgatgaacaacaatggagatagccaggatgtaaaggatttgcagaatgcagaaacttcacacaagttcgtcgatccccggagcatcgagacgcagacaaacccgatcgatcggtctatagctctgctacttttccaccagtcatcggaccaggcggctgtagctgtcgacgatgcctcgtcactaaaatcccctgctggtaacaaacagcacccgggccctgcctctaaccaaggcctgatgccagcttcatcggtgtattccccaggaggtcaggggacccccaaggatgtacagtccctggacaagtactgaatttgtggcgctgctctccatgacctggttaaagcgccatgatgtggagcgttcaacgtccgtgattttcaatgcaatatttttacagacgtatgggggggctttcacatgatgtttctaggcttatatgtaaaaacaagcatattgtgtacccagtagtctgtagtcggttccaatcacattggttttgacatatgcttgtatcctattgttagacggccgctgtgctccctagtgagtgttgactcacatttcttgtgtaatttaaaaagaaaaaattcttttcccctagctatataacctttgaactggtgccc

SEQ ID NO: 14489 - DNA, 1461 bp, Sorghum bicolor
  Clone ID: SORBI-28MAY03-CLUS1956_1
gctgccgaacgccgagcggataacgaacgtctggcggcggctcgcggcggccttcctcctctccttcctcgcatcgcagtcgcagcaggctgcaggcaggcgtagcgtagcgtatccgcctcacccccacaaaaccaaatcgcttaccgtttcggttcgcatagcagagctgctcgtgcaacaggccaaacaaccccagagccgggggagcgtcggtggctgctaccgctaggcagagacagggggcagattgagagaggtgggcagatggcgacgccgtcgtcgtcgctttgctccagcttcgcctccctgcggaccgcctccatcggccaccgtcgtggcctcacctcctccacgcccaggaagggattccaagcgagggcatcagctcgtgttgacaagttctcaaagagtgacatcattgtgtccccttcgattctatctgcaaactttgccaagctcggcgatcaggtaaaagctgtggaggtggcaggatgcgactggattcatgttgatgtcatggacgggcgctttgtgccaaatatcacaattggacctttggttgttgatgctctgcgtccagtgactgatcttccgttggatgtacatctgatgattgtggaaccggagcagcgtgtccctgattttatcaaggcaggtgctgatattgttagtgtccactgcgaacaaacatctactatccatttgcaccgaacagtcaatcagattaaaagtctaggagcaaaggcaggagttgttttgaatccagcgactccactcgctgcaatcgattatgttcttgatgttgttgacctggtgttgattatgtctgtgaatcctgggtttggtggccagagctttatcgagagtcaagtaaagaaaattgcagaattgagaaggttatgtgcagagaagggagtgaacccctggattgaggttgatggtggtgttggtccgacaaatgcctacaaggttattgaagctggggcgaatgccatagttgctggttctgcagtttttggggctccagactatgctgaagctatcaaaggaatcaagaccagccaaagacctgtagctgtacccgcataaggaactggacgtgtaatcatttactctgtgcaagtttaccagtgttgtgatttgtaaagatgtgtgtcttgtattcttatcgagccatacattatactggagatgaaaggaggcggaggcagtggagaaatatcattttctttctcattttccacgaggacgccgtgcactgctcccaggatgctctgttcagttaacgacacacaggtggcgcatgaactagctagagtagctttatttttgaaaaaaaaagtatttgagtcgatgaatcctctggttttatttttgagactctggtaaacgatgtaaccatgtttgataatcaataaagtgcgctgcatggcttcctcaaaaacccacgcgtccgac

SEQ ID NO: 14490 - DNA, 823 bp, Sorghum bicolor
  Clone ID: SORBI-28MAY03-CLUS204_1
gccggcaggagccgggagcagcgcacaccacaccacaccacaccacaaagagagagcgggcaaaaggtgaggccgagaagcgctttagccgttaggcgataagagtgagctggtgcaccggcatggcggccacggcgtactccgtggcgctcctcggcggcgcacgcctcccggccgccccgcgctccgccctcctccctcgccgcagcgtctgccagcttcgcctccaagatgcaccgaggctctccctgctgcgtgcgaaggccgcgtccgaggacacgtcggcctccggcgacgagctcatcgaggacctcaaagcaaagtgggacgccattgaggacaagcccaccgtcctcttgtacggcggcggcgccatcgtcgccctctggctgacgtccgtggtcgtcggcgccatcaacgccgtgccgctgctccccaagatcctggagctcgttgggctcggctacaccggctggttcgtgtaccgctacctcctcttcaaggaaagcaggaaagagttggccgccgacattgagaccttgaagaaaaagattgctggaacagaataaactctcatggaaagttttagagggccctttcttctttggaaagatatctaatcggagaacaatgcaactacctgagtactacagcccatgtgtgtgtgtgatgtatatcttcagtatacaaaggaaacatcgtttgttgtgtagtagcattgtattagtttaaatgtatctctactacctatctgctaaattctttttttgatttggcaaaaaaaagagtacgtaaatctgaacgtaaaacaaatagagtttct

SEQ ID NO: 14491 - DNA, 1624 bp, Sorghum bicolor
  Clone ID: SORBI-28MAY03-CLUS3009_1
gcacgggggatcagtcctagcactggccaggaattctgcctctccgggttgagcatcctgttgacacggatgttttttccggttattatcggcactagttcgctagagtattttagttttggattgtgtttgcgcttggcggtgattttgggacagcggctaaatatttcgaaagaaatttgaggctcccattcatcccccctctggtcgcctttttcggtccttcagcttcgatctgtgaagcagcgttgcggtcgaccgacggcggcggccacgcacgagacgcgcagtgtatcagtcattggctaaagacctatcaagggtgcctctttttggtcagcagccctggagataacagtgagtgggtgttccagaagtatggtcactagagagtggcttcggcatggagttgcttcatgtttctcgtagtttagcagtagtgtttcttgtagcttccacgaaatagcacgaaagattgttgaggtgattgccaagttttgcttggagaaaggtcttgaagtctgctagagcgcacatgcttgaatttttttgcatatattcaagatcatttatattctctattaactctcatatctataacatacattttatgttgaccgtgtatgtgggtaggagtgaaacatgctgtttctttgctcgtggtgaatcatacattgactctttgttgttcaatggtattttagagaatctttcacgttgaaagccttgagaagacagctcaagatgattaccagaaacttgcctctgctgtatatctccaagtcagcaccatcagtcaggctctcatcttcgtgacaaggtctcgcagctggtcatttgttgagcgcccgggctttctattagtgtttgctttcttggtcgcacagctgatagctacattgatagttgtatacgctaactggggattcacttcaatcaaaggcattgggtggggctgggctggtgtggtgtggctctacaatctcgttttttacttcccactcgatatcctcaagttcctcatccgatatgctatgagtgggaaagcatgggatcttgtcgttgagcaaagaattgcatttacaaggaagaagaattttggtaaggaagagagggcgctcaagtgggcacatgcgcagaggacgctccacgggctgcagccaccggatgccaagctgttccctgagagggtgcatgagctgaatcaaatggctgaggaggcgaaacggagggctgagattgcaaggctgcgggagcttcacacgctgaaggggcatgtggagtcggttgtgaagctcaagggcctggacatcgacaccatccagcagtcatacacagtctgatgactcttgcttaaatacaggcatactatatttcctgcagaggaacacctagttctagcaggtggtagtcgcctgcttgtactttccataccatagctgcaccatttacagatcaacatagtatagcacataatgagatctgatattgccagttcagctctatgttatggggtgtattgccttatgaggagcagggatatatctcccgtgcaatgcctcttcctgggcttcagagttctgaacatcattggaatttgcttcagagttttgaacaccatggg

SEQ ID NO: 14492 - DNA, 1256 bp, Sorghum bicolor
  Clone ID: SORBI-28MAY03-CLUS3866_1
ctgggcagctcgcccgccccttcgtcctcttcggctcctcctcgcagtcgctcgctgcgtgcgccaaaagcagcagcagcaggaggaggaggaggaggtcctccagccgtcgccgtctccactctccaccaccactgctcggcggcgcgccggatcgagggagggcagtcggaggaggaggagggatgagtctcttcgggcttggacggaaccagaagacattccgtcccaagaagagtgctccgtcaggcagcaagggagcgcagctccggaagcacatagatgccactctcggcagtggaaaccttagggaagctgtgaggttgccccctggagaggatatcaatgaatggcttgctgtgaatactgtggatttctttaaccaagttaatctgctgtatggcacactcacagaattctgcacacctgagagctgcccgacaatgacagctggcccaaagtacgagtacagatgggctgatggtgtgcagataaagaaacccatagaggtatcagcaccaaaatatgtggagtatctgatggattggattgaaggccagcttgacgatgaatccatatttcctcaaaaacttggcacgccatttccacaaaacttcaaggaagtagtgaagacaatattcaagcgcttgtttcgtgtctatgcccacatctaccactctcatttccagaagattgttagccttaaagaggaggcccatctcaatacctgtttcaagcacttcattctgtttacaaatgagtttggcctgattgacaagaaggagctggctccactccaggagctcatcgaatccatcatcgttccttactgataatacactactaaacatggatgcagagctctcaacgctgatggctgtgaaatttagtctattttcgacaatacttcactggctcattgcatagagcttcttgatccagttattagacataaaaggacatgctatatgtgcgtgtacctgtgtgtttcttcctgatcctgtattggcctgtgtgtttcttcctgatcctgtattggccatgtaagtgtgcctgttatcagctatagaacggtggtgatgtactgcagaaagaaaaacacaagaaagctgtgttggattaatgtatgtatgcagcgtttgtttcctcatggtttatgttaccatcagtttgtcagcttatttccaagaactccccccggttaaattgtaaaccattttagttttgtccaaagtcaaacttcttcaatttggccc

SEQ ID NO: 14493 - DNA, 1642 bp, Sorghum bicolor
  Clone ID: SORBI-28MAY03-CLUS40957_1
atctcaatctcctcgcccgcctcctcgcgcctcgcctcccctccccgccgagttgcccaagtaccccagacggacgcagctccaatctcctcgtccccctcctcgcgcctcgcctcccctcgccgcctccgcctcctcgcgcctcgcctcccctcgcttcccctcgccgcctccgcctcctcgcgcctcgcctccccgcgccgccgtcaagcgccgctcgctagggaggaaagccatggctccggatccctaggacgacctattgaacttgtggaacccccgaccccgagacggggctggcaccgccctccttgtggcctttgggttcgggccgtcagctgctacaataaggaaggccattaaaggtagcaaggcatagaaagagtaaaagacctaatacggatgatgacaaaaatgttataaatgtaagactacttccaaactgtgtggttggacttcaggataaggtatcaccaaaggataacaaccaagggaagagggtaggtgtagatagtaactagtcccagattcagatgcttccacaactataaattgtctcaagtattatcataatgtcggggttggaaaagccgattgtgacttacaaagatgtatggggctgccagtgactgtttgcggtgatgcgtgaagttattgaacttcctacgcttcacccagaaaagtttgtcaagcttggtattgaccctccaaaaggtgtcctttgctatggtccacctggtactggcaagactcttcttgcaagagctgtagcaaatcggactgatgcttgtttcatccgtgtaattggaagtgagctagttcagaagtatgtcggagaaggtgctcggatggtcagggaactgttccagatggcccgctcaaagaaagcatgcattgttttctttgatgaagttgatgctattggtggtgctcgtttcgatgatggggtgggtggcgacaatgaggtgcagcgaacaatgttggaaatagtaaaccagcttgatgggtttgatgcaagagggaacatcaaagttctcatggccactaataggcctgataccttggatcctgcgcttctgcgtcctggtcgtctggacagaaaggtagaattcgggctacctgacctggagggccgtacccaaattttcaagatccatacacgaaccatgaactgcgagcgagatattcgttttgagcttctggcccgactctgccccaactctactggagcggatataaggagtgtttgcacagaagctgggatgtatgcaatccgtgcccgcaggaaaacggtgacagaaaaagatttcctcgatgctgtcaacaaggtcatcaagggctaccagaaattcagtgcaacacccaagtatatggtgtacaactagtcaactagtcagtgcgtcttcatgggatctgttgttttcagaactctggatctttgatgattgtatcatcatgaggttcaatgcaaagattgttgtttgtttagcaaattggatccccagtgactgtaacctgtaccacatgtttttaagacaaggttctctgctcggtgactcatgttgcttgtgtttgactgatgatgtgcacagaacgcaaagttcattcggagaactgacgcaatgtaaacctcaggcacggt

SEQ ID NO: 14494 - DNA, 547 bp, Sorghum bicolor
  Clone ID: SORBI-28MAY03-CLUS3741_2
cgttcctaaccataagtttacagtttctatattaaggaataacactcagaggacccattggcgtattaagacctatcttgctattagccacatggatgccggaaaaattgggactatagttgctgacatgaggaaagtgttggcaaaaaatccacatatagaacaacaaaagctgcacaggagagtattctttgagaaaattgatccaaaaaatcaagcacttatgattttagtatcctgctttgtaaagacatcacattttgaggagtttctcaatgtccaggaaactgttatgttggatcttcttagaatagttgggcatcacaaagcaaggcttgctacccaaattcgaacagttcagaaatcatatggcaatgcagactttgataacattccttttggagaagacatgtatagtcgtgtccgtggccgtccacttctgattgatacatctgcaaggatcagtgatgacaaacccaagcctcgacctgtatcatcacgtgaggagcataaagtcaagacaaatggctcggtagagatcaagtct

SEQ ID NO: 14495 - DNA, 1406 bp, Sorghum bicolor
  Clone ID: SORBI-28MAY03-CLUS3741_1
gcacgagggttgcttacacttgctggtcgtgagattttcactaacttcctctcaagtgtcatgatcaatgccacacgcccatttgtagtcaatgaatggatcgatgtaaagatagatggtgttgatgtctctggcattgttgagcatgttggtttgtggtctccaacaatcattagaggtgttgatcgagaagcgatatacgttcctaaccataagtttacagtttctatattaagaaataacactcagaggacccattggcgtattaagacctatcttgctattagccacatggatgccggaaaaattgggactatagttgctgacatgaggaaagtgttggcaaaaaatccacatatagaacaacaaaagcgcacgagggagagtagctacaggcccatgctttatacacctcgcagatacagatctttgggcttcagatcttgtgccttgccagttcctttgaaggaaattcctcttgtcaagaatgcatcattagcactaactaggtcatgtgatactttacttgcaaatcctgctacctcacttgtggtccctgcaattgggattattgtgtttgctctgtggggttttttgcctctagtgcgtgatattagaaaccgttttgatcatggaagcaactggaagaagagccctacatatttgatttcttcgtcgtaccttcaacctctacttctctggacaggagcaacactaatctgcaggggtttggatccagttgtcttgccttcagcagcaagccaagctgtgaaaaaacgcctaataacttttacggaaaaatatgcaactgtcagatgctcgggcgaagtactttaaaagttatattgtcacaccagtaacaccgtctttagatcctgctacgtcaacttctaagactggtaaagggaagacacgtgaagcagagcccactgagcggcaaggtgatgggtcagtctcggtggctaatccaaagaaagaatctagaccagcttttgaagataacattgttctgggcgtagcccttgagggctccaagaggacactgcctattgaagaaggaaatccttatctatcactatctgagactgagctggacaacgaagaggcggcttcatcaccgaaggataagataggtcaaagcccaaaactttgaggtcaagagaaaagccgttcagaggaatctcagataggtcatccgagttcaaactgtatatccttgtgaagatttgtcaccaagcctaccttttttgtgcgcttgtgcaaatgcaatctagtacgacacatcagtgttctatgtttaaggtgtaaattgccactgatgattattcaggggacattacctgttgaaatatatcagtcgcattgctataggcttgtaaagaagcaagtgttcgacaagcatttgt

SEQ ID NO: 14496 - DNA, 2070 bp, Sorghum bicolor
  Clone ID: SORBI-28MAY03-CLUS21820_1
tcaccgacaagcagagcaggagcgggcgagcagcagacctcctgtctgtcgactcctgcccggagtacgccgcgcgaggacgagggagcggtcgccggcctcggcagcgggcggaggaggatggggcgtgggggagcgggtgcggaggtggaggtggaggatgccggctccggctgggagagcagcaagccgacgctgctgcagcggtggtcctcgtcggtgtgggccatcagcggcagcgggcatctgctgtgggcgggcaacgaggcgtggcgggcgcacgtcgggatggccttcgtccaggtcgcctacggcggctaccacgtcctcaccaagtccgtcctcaacgtcggcatgaaccagatcgtcttctgcgtctaccgcgacctcgtcgcgctcgcgctcctcgcccccatcgccttcctgcgcgagagaagcgtgcgcgcgcggcgcccggtgactcctcgcctcctcgcgtcctttgctcttctcggattcactgggatcttcgggaaccagctcctcttcctgctaggcctcagctacaccaacgcctcctacgcggcggcgttccagccggcgataccggtgttcacgttcctcttggccgcaatcgtcggcgtcgaggtggtcaacaccttcacgaaagatggggttgtcaaagttcttggcacagccgtgtgcgtctttggcgccgtcttgatggtcttctaccaaggcccgtctttgattgggatgggaggcgccactgcagccgatgcagctgccctggccggcacttggagcagcaatgcctattctcctcagtggttgaccgcaaccgccatgctccgaaatggtctggacgcatggagtctcggggtcgtctgcctcattggaaactgcttcctgatgggtgcttaccttgtcattcaggccccggtgctgataaaatatcctgcaagcttatccctaactgcttactcctattcttttgcaaccttgtttatggtggttactggagtatttgctaccaataggctccatgagtgggcactgacaacgaccgagataatagccgtcgtatatgctggaattgttgcgtcctgtctcaactatgcaatcatgacttgggcaaataagattcttgggccctctctagtggccctctataatccactccaaccagcatgctctaccttgctttcaactattttccttggaaccccaatttatgttggaagtgttattgggggactcttcatcattgctggtctttacctggttacctgggctcggtacaatgaagctcagagagttctgactacccgttatctacaacctcttcttgtggaggatctaccaaccaccaaagcagaaggaagttccttcaggggctccatcgatccttagaccccagagaggctggtggattgcctcaattgtctttctaggacagcagcagcagatttatttcatgtctttgttgtataataccaatcttgcctagagtcatcctccacataattactaccattccaagcatccaaacaaggttccattatcaggaagaatgacggtgtactgaaaaaatatcatatcctgaacatagtccggatattctggtatcccaatcggcatttttgttcccagcatttgcagaagataactttggttaggtgcattgatccttcaacttcaacagctttgtctgtacaagtcaaaggccaactccagttggattaacctcaccaatgaaagaatatcctttatgcctaagaagtgaagctgccatgcactagagctatcatactcgtggcaagacaaatttttcttctctgatgatggaatccaacctgttctctgtattcaagggagagacaaaataactctccaaagttcacatattcatgtatcagattttagaacaattggactatgtatactcgtactgtgccttttttgttgtatgggcgttcatcttctctatatatctccgatcctgtctgtgcttccagctctgtataaaagttacttgatgctgtctatgcttcccctgagtaaatttttatacgatcagatatgaattca

SEQ ID NO: 14497 - DNA, 730 bp, Sorghum bicolor
  Clone ID: LIB5048-007-R1-XP2-E9
ccgggaaagcaacgtcctccgagtagcagtagtacgtgggaggagtggagacgagagtggagggcgatgggcggagaccggagagcggcggcggcgctccagcgacactggtgcccgtcatggagcgtgagcgagcggtggcgggcgcacgccgggatggtcctcgtcatgctcgcctacagcggctaccacgtcctcaccaagtccgtcctcaacgtcggcatgaaccaggtcgtcttctgcgtctaccgcgacctcctcgccttcgctgtcctcgcccccgtcgccttcctccgcgagagaagggtgaggcctccggtgacacctcagctcctcgcatccttcgctcttcttggcttcactgggctgtatgggaacccgctcctgttcctcgtcggtctccggtacacgaacgcttcctacgccgcggctttccagccctccataccagtactcacatttctcttggctgccattgtcggtgttgaagccattaacatcttcaccaaagacggcgtcctcaaagtcatcggcacggtcgtatgcgtctccggcgccattctgatggctctgtaccgaggttcatccttgattggccttactagaagcatgcccaacgcatgggcgagcacttcctatcctgctggcccccactggttgacatccaccgtggttccacaccgggcaaaaacattggcacttggtgtcctgtgactttgtagaaaatgcc

SEQ ID NO: 14498 - DNA, 1767 bp, Sorghum bicolor
  Clone ID: SORBI-28MAY03-CLUS44098_1
gcacgagggaccatcgatagggggcaatgcattcacttcaaactgctgtatagagagcgatcgacatcagttagagagatgagttcctccacgtccagcgctctcgtagtagtagtagcagcagtactcctagcactgaccttagcacagcatggctccctcgccgcaaccgtcggccctagggtcatcgtcgtcggcgccggcatgtctgggatctcggcggcgaagaggctgtcggacgccgggataaccgacctgctcatcctggaagcgacggaccacatcggcggccggatgcacaagaagaacttcgccggcatcaacgtcgaggttggagccaactgggtggagggagtgaattcgaaccgcggcaagatgaacccgatctggcccatcgtcaactccacgctcaagctccggaacttccgctccgactttgattacctcgcccaaaacgtctacaaggaggatggtggcctctacgatgaagattatgttcagaagagaattgaccgagccgatagcgtggaagagctcggggagaagctgtctggcactttgcacgccagtggcagggacgacatgtctatccttgcaatgcagcgcctctacgatcaccagccgaacgggccggcgacgccggtggacatggtggtggactactacaagtacgactacgagttcgcggagccgccgcgggtgaccagcctgcagaacgtcgtccctctgccgaccttcagcgacttcggcgacgacgtctacttcgtcgccgaccagcgtggttacgaggccgtcgtgtactacctcgccggccagttcctcaagaccgacaggtctgggaaaatcgtcgatccacggctccagctcaacaaggtggtgcgagaaatcaactattctccgggtggcgtcaccgtgaagacggaggacaactcggtgtacagggcagactatgttatggtttctgcaagcctgggtgtcctgcaatccgctctcattcagttcaagccgcagctacctgcatggaaggttacggcgatctaccaattcgacatggccgtgtacacaaagatattcctcaagttccccaagaagttctggcctgaagggaaagggagagagttcttcctctacgcgagcagcaggagaggttactatggtgtctggcaggagtttgagaagcagtatcctggtgccaacgtcctcctcgttaccgtgaccgacgaggagtcgaggcgtattgagcagcagtcggacaaccagaccaaggcagagatcatgcaagtgctgaggaagatgttccccggcaaggacgtcccggatgccaccgacatccttgtcccgagatggtggtctgacaggttctacaaaggcacattctccaattggccaattggtgtcaaccgctacgaatacgaccagcttagggcaccggttggcagggtatacttcaccggtgagcacaccagcgagcactacaatggctatgtccatggcgcttatctttcaggtatcgactctgctgaaattctcatcaactgcgcccagaaaaagatgtgcaagtaccatgtccagggcaagtatgactagaagatccaacaaattagaatctacctatagattggcagccatgtcttggcatgccttttctttattgcagtaaggctgctgatttataaagattcaatgcttgttatcatctatgtttttgtgattatgtatttgatctgcttaagtattgatctgcatatgtatcttgcttaagtaccg

SEQ ID NO: 14499 - DNA, 1373 bp, Sorghum bicolor
  Clone ID: SORBI-28MAY03-CLUS458_1
tacgcttattataactcgtttccccgttccgccgttcgtcccctccccatccccagcccacgacctccgccaccggccaccgcctgcctcagatcccccgccccgccccgcccgtccgttaccctccccagcgcgacgcggccgcggccatgaccatgacgccctcctccgctctcgccctcgcgcaccacgccgcggcgtccccgctcccggcctccacgccgcgggcctcttccaggtccagctcgctgagcctggtgggcccgggggccgcgggtctcggcccgcgccggctcgtcgcggcggcacccccgcgggcgttcttctcctcgtccccgtactaccagccgccgccccagcagcagccggaggggttctcgccgcaccgggagtacggcctggtccccatggtcatcgagaccacctcccgcggggagcgcgcctacgacatcttctcgcgcctgctcaaggagcgcatcgtctgcatccacgggcccatcgccgacgacacggcctcgctcgtcgtcgcgcagctgctcttcctcgagtccgagaacccgctcaagcccgtccacctctacatcaacagccccgggggcgtcgtcaccgcggggctcgccatctacgacaccatgcagtacatccgctgccccgtcaccacgctctgcatcggccaggccgcctccatgggctcgctcctcctcgcggccggggcgcccggtgagaggcgcgcgctgcccaacgccagggtcatgatccaccagccctcgggcggcgcgcagggccaggccaccgacatcgccatccaggccaaggagatcctcaagatgcgcgaccgcctcaacaagatctaccagaagcacacgcgccagcccatcgataagatcgagcagtgcatggagagggacctcttcatggaccccgaggaggcgcgcgactggggcctcatcgacgaggtcatcgagaaccggcctgcctcgctcatgcccgacggaatcggtggaggcctcgatgtgcccagcctcggtgtcggtcccggcggacggggaagggacgccgtggagccctcggcggtgtgaggattggcctcaaaggtgaaatccctttcgcatccggtggctctgttgtttgttgttagatctaaaaaagcttcaattcttactgtacaaggttaaccttgttattatggttatggaggtgtccggctccccattctccttgttgcttaaattgcctgaattgagctattggcgatataattattgcaactccaaggaaattctgttctgttgatactgataaattaacacagtattgtgtatgttgtactatattagtatcaattccatgccaggacattgaaactttttttt

SEQ ID NO: 14500 - DNA, 2329 bp, Sorghum bicolor
  Clone ID: SORBI-28MAY03-CLUS4825_1
ttcggcacgagggaggctggagctggtaaaagcccgtcctcccccgtggtttcggtcacctcctcgcctcccggcttcacttggtatctaacgcaatcagcggggaaccccaaaccctaatcctctccatccgcgacgccggagacagccgtgtcggagctcggttctcggggttctgcatcgattctgttatctaggtttctcagatgggcgatctcaaggaggttttccgctccctccaagaactcttccctcaggttgatcatcgtatactgaaggctatcgcaattgagcaccgtaaagatgttgattccgcggtggttgctgtccttgatgaagtcatgccatccatgactggttcggctggagctttgtctacccatcgagaagggttgccatctatggatgattctgttgggaatttgtttgctaatcgcagcacatgtgaagtgggaagttcatcgtctgctggacatgatatacatatcgatgagattgatgtaagtgttcactctgcgcaacacacttcttctggggaggtcaaaacttgcaagcaagaaaacataaacattgaatatgtgggaagagttgcatcaatcgaaggggtcagtgagcaactaaatctacattctgatcctatcccaaatgacggtcagcatgatttgattcccaaccttgatgtgctatcttcaaataccaatccagagaaacagttggctaacacagataatgaagttggatacggtggattgtcaagtgaatgtttttctcaaccaccgacaggggaagacggtggtgatatcccacaatcccatgatcaagatcctaataagattattccagttggggattacgccccccggaacacttcaatgaagttcttcagtggttatgaggacataaattttgatgatgaccttttgcctcttggttctaatgatcaaatatcttctggaattttgggtactgaaaaagattcttttgcacctgtgctggatgttcctggccgagataaagaagaatcctcagttgggacttctggatttatagaacagaaggacaccagcagtgttgcagatatgcttcctgatcttaatttgaatcattttgcttctacggcttcaactcactcaagccattctgttagttgagtctcttgaggattctgttgctgatgccagaagcaataagaatgatctgttaccttctctagagttggttacaaaaatgatagaggatgcggggcttcttgaagaaaaggctaaagtagccaagcatgaagcatctgttgctgggacaggcattctgaccaaagttgaggagctcagagaaatgttaactcatgcaaaggaagcaaatgatatgcatgctggcgaggttttcggtgagaaagctattttaaccacagaggcacgtgagcttcaatcacgacttcagaggctttcagatgagaggaataaatatctggtgataattgaagagatacgccaaactcttgatgaaagattggctgctgcacaacaagaaattgcagcagctgagaaagaaaagattgaaaaggaggctgctgctcaggcactacttgatgaacaggaaaagacgatgaattctattgttgaagaatcaagaaagctgcagatagcagctgaggagaacctgaagttgaaggaattcttggttgagcgggggcaaattgttgatatgctgcaaggtgagatggccgtgatctgtgaggacgtttcgttgctcaagcgagtggtggatgagcgcctatcattgagcaagttgcagcgctcagctatgtcgagcctctcttcttcactgcattcttctcaacacaagagctggacttcctcggataggactactgaagcaatggagtctccagataagcgcacccttgttgaacctgcaagcccagtgtgcaaagatctggatggcgatgacgacgagtgcactgtggaagtgtcatatggcaacgacactggtaaaggtatcttgaagcgcgtgaattccaaggaggacggtgatggatgggagctttgctgaagatgttcaggaatagcggccttgccagatgatgctgaactgctgaagcatagaaaatatgaactagcaataatggtgtataaacgttttactagtccggtgctaatctagtcgttttcatatgaaatcggcgaactgtcgtggaactgagtcactggctcaccgcagcagtatgtgagatgagtccaactgcagcttgatgtggtatatataaaagtgaacatttcagctgcctctgctgccgaaattttaagttgttcctaaaaaaaaaaaaaaaaaa

SEQ ID NO: 14501 - DNA, 2336 bp, Sorghum bicolor
  Clone ID: SORBI-28MAY03-CLUS5118_1
ccccgtggcgggccccggccccccctcgcccgtcgtgccccggctcttgtcctgccctggccggcaccgctgggccgtaactggcaacatcacgctgagggagctcccgcaggggctctccgtccacggctccagtgcgtccaccttgtcccgggggaccccccgcctgtacaactccatgttcccgagacacaaggatcggctagacaagaaggtggtggatgtgtccagggcggtggccctgggcgtcgtacctttctgccgccgccatatggacgctggggtggcccgggggctcgtggatgtcaatgccggcggcaccccgcttgtgtccatttacttccggtaaagagggggtgccgcccggttacaggatcctgcacgatatttgtcagaaggatctgagtgtataagttgcgaatgcaaccgtgaactagattgtgtttaagcacatgctgatggtttcccgggctacaagctgggtagagttggttgggaattgtcgctgagatttgagtcactgttatggaattcttgatcataacatcatgatagttaatgcatggtactgtcgttgatatgcattggacaatgtgactgcaagaatgtacattgactccagatgtgtatatttccagaagccacttcttgaatcaggcactctgggtgctaagtgcaacacacagatggtcattcctcacctaacagaaaactatggggcatccagagatccaccagaaaagcaggcacctatgtgcactgtacattcatttcctcacaatattgatcactgcctgacgtgggctaggtctgagtttgagggtctacttgagaagactcccaccgaagtaaatgctttcctgtcgaaccctggtgggtatgcaactgcagcaagaactgctggtgatgcacaggctagggaccaacttgagcgagttattgaatgccttgagacagacaagtgtgagacattccaagattgtattacctgggcccggcttaagtttgaggattatttctccaaccgtgtaaagcagctgacattcactttccctgaagatgcaatgactagctctggtgctcctttctggtctgctcctaagcggttcccgcgacctctggagttctcatcttccgactcaagtcacctgaactttttgttggctgcttctatattaagggcagagacatttggaatacccatacctgattgggcgaaaaacccaacgaaactggctgaagctgtggacaaggtcatcgttccggatttccaaccaaaacagggtgttaagatagagacagatgagaaggctactagcctttcctctgcgggtgttgatgatgctgctgttattgaagagcttattgcgaagctggaaacaatttctaaaacattgccaccaggattccatatgaaccctatacagtttgagaaggatgatgataccaatttccatatggacttgatcgctggctttgccaacatgcgggctaggaattacagcatccctgaagttgacaagttgaaggcaaagttcatagctggaagaatcattccagccatcgccacctcaactgcaatggccactggccttgtctgcctggagctttacaaagtcctcgctggtgggcacaaggttgaagactaccggaacacatttgcgaaccttgcaatccccctcttctccatggcagagcctgtgccacccaagaccatcaagcaccaagacatgtcctggactgtctgggaccgctggaccgtaactggcaacatcacgctgagggagctcctggagtggctcaaggagaagggcctgaatgcgtacagcatatcctgtgggacctcgctgctgtacaactccatgttcccgaggcacaaggaccggctggacaagaaggtggtggatgtggccagggaggtggccaaggtggaggtgccttcgtaccgccgccatctggacgttgtggtggcctgtgaggatgacgatgacaatgacgttgacatcccgcttgtgtccatttacttccggtaaagaggggctcgctgcctgtttacatgatcctgcgcgatatttgtcagaaggatcgagtgtataagttgcgaatgcaaccgtgaaactagattcggtttaagcactgatgttttcccccgctaccatctgggtagagttggctggggattgtcattgagatttgggtcaccgttatggaattcttgagcataacatcatgatagttactgcatggtactgttgttgctaaatgttgtcttagtacttgggaaatgcatttgacagtgtgacgctattctggttgcaatttaatgttttcctggc

SEQ ID NO: 14502 - DNA, 1092 bp, Sorghum bicolor
  Clone ID: SORBI-28MAY03-CLUS4585_1
gcacgaccgggctcccgacctccctgtgtgcccccagagctccgagaagccatccccccaaatcggcctacgcttccacgccctcctccacgaggtgaggaaaccctagcgaccgaccatggcgctgctcccgcgcaccgcgcggctggccctcctctccactccgcgggcctactccgccgccgctgctgcgggcgcctcctcgacgtccccagcgccatacgggggcgcgcccccgccggcgatgtcgaagacggccgagttcgtggtctccaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccctcgccgcgccagtccgattgcatgatcgtcgccggcacgctcaccaacaagatggctccagccctccgcaaggtttatgaccaaatgcctgagcctagatgggttatttcaatgggcagctgtgccaacggtggtggatactaccattactcctactctgttgtacgtggatgtgaccgtatagtccctgtggacatctacgtccctgggtgcccaccaactgctgaggcactactgtacggtgttcttcagctccaaaagaagatcaacaggcgtaaggatttccttcactggtggaccaagtgaagcatgcttctgctgttgctcgctccctatatttctttgcatttgacctacttatctcatctgaaataaggacagactttgctcagatttgcaaatttgttgtgcctggaaggatgtatgtccaggttgtttgatgagcatagagctctgtacttgaagtcagttcgcctgtaatggacaccatacctgccgtgaatctgtttttaagcttccattgtaatacagcaatacaccagatgcctgttaatgggtatcttctccctaccattgggtttatatacaggcttacatgtcttgtcttttatcatcagatgcctaactaatgaatggtactgcatatttttcttccgatctgcaagtcctgtattgag

SEQ ID NO: 14503 - DNA, 1471 bp, Sorghum bicolor
  Clone ID: SORBI-28MAY03-CLUS6845_1
ctccccccactgcctcccctcgtctccccctcccccccttcccgctcccgcccgcccgcgccccctctcgctctcgctctctcccgctcctccggccgccaccctgcagtagctgtgcttgcctccacgtgccctcgccccctcgctctccctcccccccgcctccctccctcgctacctgctgctcgcccccccggtcccggggccgatctccgcgccactgcaaccccaaatctccccttcctcacaaacgcgcagcagaggggccgagacccaagaagaagaagaagaaagcagaagcagcgacagcgagcaagcagaagcttagctagcgtggaggtgcccaaggcgagagggacaacgacggccgcgacaggctagctagcaaccagctgctagctcctgcggagccgaagccgatggctggcgccgacgtcgacgtcgggacggagctccggctcggcctgccgggaggaggcgccgaggcggccaaggccgcgaagaggggcttcgaggacaccatcgacctcaagctgaagctgcccaccgccggcatggaggaagctgccgccgccaagccggagccggcagccgagaaggccaagaggcccgccgaggcgccggcagctgatgccgagaagccacctgcacccaaggcacaagctgtgggttggccaccagtccgatcataccgcaggaacgtcatgaccgtccagtctgtgaagagcaagaaggaagaggaacctgagaagcagcagtcggccgctgccaacgccagcggcaacagctccgccttcgtgaaggtcagcatggacggcgcgccctacctgcgcaaggtggacctgaagatgtacaacagctacaaggacctctctattgctctgaagaagatgttcagcaccttcaccacatctgggaacaacatgaatgaggggaaattggttgatccagtcagcggtgctgatgtggtcactacttacgaagacaaggacggcgactggatgcttgttggtgacgtcccatgggagatgtttgtcgagtcatgcaagcgtctgaggatcatgaagagttctgaagccataggtcttgcaccaagaacgaaggacaagtgcaagaacaagagctgaagaagatgcagcgttaaagatgctgcccattgtgtcaaaagaatggtgcccttgcagtgtgctgcggtttttctagaaatataatgtgttttaattactagttggagggagacctgtcttgttcaatttgttcatggaccagaagcaataatctatctgtgtgtggctggattggtgttatgtgatgtcccctaccgtgtgtcccagaatctacttggtgattttattgccagtgttgttaatcaagcttgtgtgattgttaagtaaagggcatcaatgagaactattattattatggtaccttgtaagttaacctgtttgttaattgtcaatacaattttggc

SEQ ID NO: 14504 - DNA, 1485 bp, Sorghum bicolor
  Clone ID: SORBI-28MAY03-CLUS9257_1
tactggattgccatttgccaccactccacgtctccaccaaacaaggcaacaaggggagaggaaggagaagtagatctgcatctgcgagagcgagaggaggaggaggaggaggaggagcagcggcggtggtgatgatggagagccagccgctgcaggacccgacggccacggctccggcacccggatctgcggagccagccggagctccgccggccgtcacccccggcaaggagttcacgcgcacctgcaagggcctcgtcgttgtgctcatcggtggatacgtgctgctccagctcctcccctcgtcactcaactacctcgccatcatcccctccaagacaatcccctatgtatggaccgtcttcaccgctggttacatcgagcaagtcctcccaggggccattggcagttctcttggtcttcttttttgtggaaaggacattgaaccagcatggggccgcaaggaattcttgaagttcattattttgatcaactccatctgtggcattcttgcgttctgctttgctattggactctactatgtcactggaaaggagagcttcctggtcacaccactttctggtttccacggttgccttgctggctttcttgtggccctgaagcaactcttaccaaaccttgagcttcctatgtgctttttctggaaaataaaggcaaagtggatgccattctttgttgtatgtttctcaagtatcatggccttcattgtgcctgattccattaacttcttgccgactttggtgtccgggatgtatgttagctggctttacctaagatacttccaaaggaacccactgactggacttaagggtgatcccagtgatgacttctccttccccagtttattcccagctgccatgagaccagttacagaccctgtggccaacctgtttgataggatgttgtgtgcaaggtctaggccttcggaagtagctctcccaatttcagatcctgccaaggcttcaagaagaagggagcgcggcgagagggttcttgaggaaaggttggcagctgacaatgctggtgacacagaagccacgcctcatggccacggcacagccgaagactgagaactctctcacgaccatcagcgccttttataggagtcatgcctgtcgcccatggctttgctctccagcgtcgtagctcaccagatttgtcttgtggagatggagagtcattgagtttacagcgaaccaataatatgttcttaatttctccttgttttcatttatctgtttgatgagatttattggttaaatttctgtagtagtcgattgttataacacagtaaaaagaagaagaaaagggtggtggcatttgcaggaattgcagcgagatgttgagattccgtagcagtgatgcatttgcagccgattgtttgttactggtcaaattctgtagtagtcatatactctgtctctactcatatatagaaagaagaatggcttttccagtatcaaa

SEQ ID NO: 14505 - DNA, 782 bp, Sorghum bicolor
  Clone ID: SORBI-28MAY03-CLUS6299_2
gccggccgggctccgaaaagcgttcccctcctttcgctccttccgaagccgccgccacctccccgagccgccgccgccgcagcagccctagcgcgccgtcgccgtcgcctccgctgcgatccccgcaaccatggctgccgtgctgcagcgccccgcagcgggcacggtccagtgcttcgggcggaagaagacggccgtggccgtggcctacaccaagcctgggcgcgggctgatcaaggtgaacggcgtcccgatcgagctcatccggccggagatgctccgcctcaaggccttcgagcccatcctgctggcggggcggtccaggttcaaggacatcgacatgcggatccgcgtcaggggcggcgggaagacgtcgcagatctacgccatccgccaggccgtcgccaaggggctcgtcgcgtactaccagaagtacgttgatgaggccgccaagaaggaggtcaaggacatcttcgcccgctacgaccgtaccctcctcgtcgccgaccccaggcgctgcgagcccaagaagtttggcggtcgcggcgcccgcgccaggttccagaagtcttaccgttgagcgcttgcttgcctgcgcttgccggactgttgcctgtgtgttgtcccaatcatcggagctacttatctgcttctatatctagctgttttaccttcatctttagactttttaagttttgtcccgaccgtttttgacattgtgatatgaatgtgagaaattttgaagaccaaaaaaaaaaaaaaaaagcccctatggccgcggc

SEQ ID NO: 14506 - DNA, 829 bp, Sorghum bicolor
  unsure (1)..(829): unsure at all n locations
  Clone ID: SORBI-28MAY03-CLUS6299_1
ngcgggcgccgccctccgcgcacccctcccccaaagccgccgccgccaaaaccctagcgccgccgctgcgaacccagcagccaccaccgcaaccatgtccgtgctgagccgccctaccccgggcacggtccagtgcttcgggcggaagaagaccgccgtggccgtggcgtacacgaagccggggcgcgggctgatcaaggtgaacggcgtcccgatcgagctgatccgcccggagatgctccgcctcaaggccttcgagcccatcctgctggccggccggtcgaggttcaaggacatcgacatgcggatccgcgtccgcggcggcgggaagacgtcgcagatctacgccatccgccaggccgtcgccaaggggctcgtcgcctactaccagaagtacgtcgacgaggccgccaagaaggaggtcaaggacatcttctctcgctacgaccgcacactcctcgtcgccgaccccaggcgctgcgagcccaagaagttcggtggtcgtggagcccgcgccaggttccaaaagtcttaccgttgagcgattgctttgctgggtcgcaaatttgcaagatcgctctggttgttcgtggcttcatttcctgtccatggagctgcttatctatatctagcttctgctttacctaccttaatgttttagactggcattgtggtattaaatgtgaggagattttgaagactattaattagtctctgaagtatgtttttcttgtcattatctctgtcgagtaattatgatatggtcgcctattagtaacccctgaaaaaaattttgattgttatcttttaggccgcacattattgcctt

SEQ ID NO: 14507 - DNA, 1214 bp, Sorghum bicolor
  Clone ID: SORBI-28MAY03-CLUS10801_1
ctactggagagcgaatcctttgccgtagcatagcaaacagccaagggagagtggggagactagcgaaagaggacagcgcacggaaagcgaggagaggggaaacagagaggtcgcatcggacggcggcgagatgctggcggtgttcgatcccacggtggccaagtgcccggagggcctccgcagcccgccggtcgccggatcggccgctgcagcagcaggcggagccggcgcgggcgcgctgatgaagggcttctccgactcgcacgacggcgccgtcaccgtcagcctgggcccctccggcgcgctggcctactcggcagccaaccagaaccccctcgtcccaaggttgtttggtgctgtgaatgacatcttctgcctgttccaagggcacattgagaacattgccaacctgaagcagcattatggcctgagcaagactgcgaatgaggtgactatcctcatagaggcctacaggaccctgagggacaggggtccagtcccagccagccaggttgtgagagacctcagtgggaagtttgcgttcatcctgtatgacaccctgtcgaagtccacctttgtcgctgctgacgctgatggcagtatccctttcttctggggtgtcgattctgagaaccaccttgtgttttctgacgatgctgggctcctcaagacaggctgcggcaactcgtatgcgccattccccaaaggttgcttctacaccacctccggtgggctgcagagcttcgagcacccgctgcacgaggtcaaggcggtgccgcgcgtggacagccaaggccagatgtgcggctccaccttcaaggtcgacagcgagagcaagaagaagcaggacgccagcatcccccgtgtcggcagtgccgccgactggtccaaccagttctgatcgtctggctttgttcaccatctttttggtacccattaccccggctgcctactacgaggtgccgagctgtgtatctgatggatccatgagacgatttctgccacgtttctttcacacttgtcgaacgtcgtgagattctcacatcgcgtttatctacgctatcgtgtaactgatatactaatcatacggagtgttccaggtggtggtagatgtactgcagaatctatctcccgtatgtttcaataaagctcaataagaggctcgatttggttctgtggatttggatgctaataagagtatttacttatgagtc

SEQ ID NO: 14508 - DNA, 491 bp, Sorghum bicolor
  Clone ID: SORBI-28MAY03-CLUS10098_2
gtcgtgccccgcgcgctctgcactgcgtggtcaccaccaccaacaccaccaccaccagctaaggtagccgaagagagccagggagcgaagcggagcggaggcgagatggaccacgcggcggacgcgcaccggacggacctgatgaccatcacgcggcacgtgctgaacgagcagagccggaacccagagtcccgcggcgacttcaccatcctgctctcccacatcgtcctcggctgcaagttcgtcgcctccgccgtcaacaaggccgggctcgcccagctcattgggctcgccggcgagaccaacgtgcagggagaagagcagaagaagctggatgtcctgtccaacgaggtgttcgtcaaggccctcgtcagcagcggtcgcacctgcgtccttgtgtccgagaggacgaggaacacgtcgggaccctaagctacgtaagtttggttgttgtcctgacgtctcacatgctggggttctgacattgatat

SEQ ID NO: 14509 - DNA, 944 bp, Sorghum bicolor
  Clone ID: SORBI-28MAY03-CLUS10098_1
gtcagaagccgcacgtgtcaaccaagcggaagatctagccagtccacgacgcgaacccccaacatgccgacgtgccccgcgcgaaacttcgccgtccgcccccacccccccacggtgccgaccctaccacgacacgagcgcacacgccctccgccccgtcgcgcgcgccacaggacaaaggcgaccccaaccgccgccccatcccctctcgtcagctgcccgccgatcgatagctccctcccctcagcgaggtagcctcactctccacccctcccccaacacagtccgagcacccctatagtccgggcgagctagctcttgagcgggccgaaccgggcgggcacgcgagcggaggaggcgaaggcagacatgaaccagacggcgggggcgcagcggacggacctgatgacgatgacgcggcacgtgctgcacgagcagagccgccacccggagtcccgcggcgactgcaccatcctcctctcccatatcgtcctcggctgcaaggtcgtagcctccgtcgtcaataagatcggcgccgcgaagcgcatcggcctcgccggcgagaccaacgtccagggtgaggagcaaaagaagctggatgtcctgtccaacgaagtctttgtcaaggcgctcgtcagcagcggccgcacctgtgttcttgtgtctgaagagaacgaggcggcccctgcccgcgtcccggccctccgcggaaagtactgcgtttgtttcgatccgctggatggctcctccaacatcgactgcggtgtctccatcggaacaatctttgggatttacatgatcaaagataaggacaacgtgactttggaggatgtacttcagcctggaacaaacatgcttgctgctggctatggcatgtatgggagttcctgcacgctggtgttgagcacgggaaatggagtcaatggtttcactcttgatccttc

SEQ ID NO: 14510 - DNA, 269 bp, Sorghum bicolor
  Clone ID: LIB3480-019-P1-K1-F11
ggaaatcaaagccttgtatgccgagcaggcaaagtcaagctcggcttgatcagcgaacccaaatgaggtgtaaatcgacctgattcagacatttcttcccttggtgtcgtcgtaagtttgtaacattcagtgtaatatatagtatgggggcccggaacagcttcacaagcaactaaggtcctccgaaaaaagttacatactcatagtttgattcgagttatccataaattatatacatacatgcatgcacatatgcatctctagcacct

SEQ ID NO: 14511 - DNA, 2235 bp, Sorghum bicolor
  Clone ID: SORBI-28MAY03-CLUS11110_1
gcacgaggcctagtggtcgtccccgttaaatccctgctcgcccagtcacgagcacccgccccgccacgctcctcccgcccgcccccgacccaacccagatcagagattccgtttgcggcgttggcgtttgcgctggcgtttccgagccgcggccgtgaccgaccgtccggagctagcttcatgcgccagggccggcggcttcaccccgtcgtttgatgggcaacgcatgcggcggctcccttagatccaagtacctgcacagcttcaagcacgccgcgtcgcagcgccacgactccgagtacagcgccaccagcaccgtcgacgactcgcccaggaagcagcccaccacgccgcccgccaccacggacgcccacgcgcagccgccgccggcgtccgccgccgccgcagccatgaggcgcggcggggcgggcgcgacgcccgacctcgggtccgtgctcggccaccccacccccaacctccgcgacctctacgcgctcggcaggaagctcgggcaggggcagttcggcaccacctacctctgcaccgagctcgccacgggggtcgactacgcctgcaagtccatctccaagcgcaagctcatcaccaaggaggacatcgacgacgtgcgccgagagatccagatcatgcaccacctctcgggccacaagaacgtcgtcgctatcaagggcgcgtacgaggaccaggtctacgtccacatcgtcatggagctctgcgccggaggcgagctcttcgaccggatgcacgagggcgggcactacagcgagcgcaaggccgccgagctcaccaggatcatcgtcggggtcgtcgaggcctgccactcgctcggggtcatgcaccgggaccccaagcccgagaacttcctgctcgccaacaaggacgacgacctctcgctcaaggccatcgatttcggactctctgtcttcttcaagcctggtcaagttttcaccgatgttgttggtagcccatattatgtggctccagaagttttgttgaaaagttatggaccagcagctgatgtatggacagccggtgtcattctttacattctactaagtggtgtgcctccattttgggcagaaacacaacaaggaatatttgatgctgtattgaaaggtgtcattgattttgattctgatccgtggcctgtcatatctgatagtgcaaaagatcttataagacgaatgctgaatcctcgtgctgccgagcgcttaacagcacacgaagttctatgccatccatggattcgtgatcatggagtagctcctgaccgtccactggatccagctgtcttatctcgcattaagcaattctctgcaatgaataagttgaagaaaatggctttacgagtaatagctgagagcctatcagaagaggaaattgcggggttgaaggaaatgttccagaccatggacactgataacagtggcgcaattacttatgatgagctaaaagaaggattgagaaaatatggctccacactgaaggacactgagattcgtgatcttatggacgcagctgatattgacaacagtggaacaattgactacatagaattcattgctgcaactttgcatctcaataagctggaacgtgaggaacatctcgtagcagccttttcatatttcgacaaagatggtagtggctatatcacagtggatgaactacaggaagcttgcaaagagcataacatgccagatgcttttcttgatgatgtcatcaacgaagcagaccaggacaatgatggccgcattgactatggagagtttgttgccatgatgaccaagggcaacatgggagtgggtcgaagaacaatgagaaacagcctgaatatcagcatgagggacgcacctggtgctttctgagacttaacacgatgtacagcttgtggcttagctacttcctctgtcttgctgccctacgaaaccgtctgcgatttttcaagatgttgtcaagtgtctgtgtggatgtgtttttctggggattctgattgaactcttgtgattgattccatgaaatgcataacaagatgtccatgtcacgcatgaagccgtaaaatgatgctgctgccccttgactctcagaaacacttatgttcagtgaactagcttgccatgtgtgtctccggatgacatccattcttggatgcacgctgtatctcaatgcaacgcgttgctccgtttgtatgaacctgtacttaatgcacgtgttttcccg

SEQ ID NO: 14512 - DNA, 1266 bp, Sorghum bicolor
  Clone ID: SORBI-28MAY03-CLUS12043_1
gccggccgggccgggactggatcccgtacgcaaccgcaacaaccaaccggagccgacagggacaggaaatcgccacctcccccaccgcggcgccgccgctcgcccgccgcccatattaacaaccccaagttcttgtcttgttccgccctcgtccgggatcgctgctcctcgaatcgattcgattggttgatttcgtctcgaccttcaggttgacaaggaaaccatcgcgaattcatcacacaatttcagatgggttccaaagcgcctttatgtctcacgctcctcttgctgctgctcgtcgctgcctgcggacctgctgcagaggccaggcgtcttgtactacctgctgcgcaggccaacgatgctgttgaactcccagatcatggctcaaccttgaaggaacaaatttcttcaatgaagactcctgtccatctcaagagtagcggccaaatatgcttagcctgtgagaacttcatgagcgaagctgtcaattatctcagtgagaaacagacacaagataaggtcatggaattccttcatgacgcttgctctaagtcattctcctttgaagagaagtgtgttgaattgatggactcttatgcaacactcctttttgccaagattacagagatcgaaccagaagcgttctgcaaacagtatggcctgtgcaggaacacagctcttttctctggtgtgagaagtaacagcacatgtgtgttttgccaccatctgcttgatgaaattatgtccaaactgaaagatccagatgcggagattgagataattgagattcttatcaaggagtgcaataagattgaaggtcacgtccagcagtgcaagagactggtcctgcaatacattcccctcatcctggtgaacggtgagaagttcctcgagaagaatgatgtctgcgcgctcgtccaggcgtgtccagccagccagaagaagaccttcagctcagtcttgcagggagcgttgctgagtgacgcttgaattgaagattggagaacacgcgaagcgtttagcagtggttggaaatagtgtgtccatccaagtgccgtgttgtacatatatatattattgtcatatataaatgcatgatgaaggacgtgtcttgtgccctgcattcttttcgtcttgtatcataataatcacatcgtcttaaagtaaatttttatggacatccagaggaatgaaggggggaaatatttgtatcataaacccattgccttgagctacggatgcagtcaatcaatttatttccag

SEQ ID NO: 14513 - DNA, 2186 bp, Sorghum bicolor
  Clone ID: SORBI-28MAY03-CLUS16496_1
gcacgaggtgacccggcccgcgcgcctctccgccgtccccccgcgcccccgcggagccgtcgcgccgccgagcggcgccgcccccccccctcccccgctccgcctcgcccgcccggcctccgtcgccgttccgcctctcatcgccgccccgcctctctccgtcgttcctggtcgccgggcttcttctccgtcgacggctacgcgcgtgaggaggagggaggaagagtcgcagcgcgtggatccaggggcagcggcgtccgtcccgcgtgagaagggagaaggagccggagcatttgctatgcctgacatggagtccgtcgcagcccttatggactcgacaagctccaagatacagcagcttcaggaggcatttgctgagcttgagagccagagtgctgtctccatgaaccttaagtggaagcagcttgaagaccactttcgtggccttgaacagtccctcaagaaaaagtttgacgagctaaaagagcaggaggaggagttccaggagattgtcgcaaaatcagatctgatgctggagcagcgggaggcagctgttgtggccaaggaactgacctctctggagaggttgcaggagaagagggatgctgcattagctatgatctttagcaagtctaggctttccttacctgttcctgccatcaatccaatgaacaaggcactggataatcttggtgtcaagtggcctaaaccggcttctgaagagagtgtgcacttgcaagatggtaatgctgcagtgaggcctcgttctgagcttgcctcactctgtgaggaaatgaatgttaaggggcttcataagttcatatccgacaacaggaagaacttggcagccatccgcgaggaaattcccagtgcactgaagaaaacatctgatccttatggcttggtgttggattccctggaagacttctattctggagataatcttgtattagatggcaaaaaggatggagaccttctgggtgttagaaggacctgcctgatgttgatggagtcacttggacagctgcaaactaataatataacttgtttctctttggaggggcacatgcttacaactaatatcgtagagcgagcacgggggattgcatttgagtggaagtccaagttagataatcttgacattgatgctagtaatgggaactgtcttgaagctcatgcatttcttcaactcctggcaacctttggtatttctgctgaatataacgaagatgacctgtgcaaattgcttccatatgtcagtcgtcgtcgtcagacacctgaactttgtcgattgcttgggttgtcgcagaaaatgccaggtgtcattgaagttctggtggaaagtggaagacctattgatgcaattaatttggcttatgtgtttgagcttactgaacagtttgagccagtgcaactgcttaaagcatatctgagggatgttaagaaagtgtcacatgccaggaatgtcaaaggttctcctggggcacagaatgagatgaatgaacgcgagttgtctgcactgaaatctgtcattaagtgcattgaagagcacaagcttgaggagcagtaccctgtggatccacttcagaaaagggttttgcagctagagaaagcaaaggcagacaagaggagggctgttgaagcagcaaagccacagtccaagcggcctcgtgccaatggatcggcctttgcacaccgtgctacaggctttgctgacaagagcttctacccagcagcagcaaccccagagaggcatccctccaatccttacgagaggcagtttgtgtatggtgctgaggctcatcttccaccaatggtgagctcagcgtcttacaccatgcaacctgcccacggaccttattacggtaatggctacccagttcagtaccaggtcccgtatatccactaatgggagacagccaggtgcaggtgctcgttcctaactatctagcttaacctgctgcccactgttgtagtcgtatcatcagttactctgctagtttgcctagctggaaatagttggaccactcaatatgtgtgtttctgagtggctgttgtgaaatctgttaattttatgccctaatgacatgacataaatcactcctaatatttagctatcgatggatatccctacgtacttcattcgccgtcttgtggtgttcatgaaaattagttattttgagttg

SEQ ID NO: 14514 - DNA, 896 bp, Sorghum bicolor
  unsure (1)..(896): unsure at all n locations
  Clone ID: SORBI-28MAY03-CLUS12865_1
gccggccgggcncgggaagacgccccacgcctctccttcttctccttccccatccgcccatcgcgcgaccccctcctctcccctgcggtctgcgctcccacagcctcacacctgcgctctcgccgatccgcatcgcccgttgttggaaggaacgatggcggagcagaccttcatcatgatcaagcccgacggcgtccagcggggcctgatcggggacatcatcagtcggttcgagaagaaagggttctatctcaaggggatgaagtttatgaatgtggagaggtccttcgcccagcagcactatgctgacctttctgacaagcccttcttccctgggttggtggagtacatcatttctggccctgttgtggcaatggtgtgggaggggaaggacgttgtattgactggccgcaggatcattggggccaccaggccttgggaggcagcccctggtaccattcgtggggactatgctgtggaagttggcaggaatgtcatccatggaagtgactccgtggagaacggaaagaaggagatcgctctctggttccctgaaggtgtggccgagtggaagagcaaccttcatccctggatctacgagtcttgagcagttgagcttcgcggtattggatgcctgcttccatgaaaactgagttttgtttgagttatctattggctctggctatagagtcataatttagtgctttgtgctacatctgagttaagtctgccagaacttatgtggcatttgagtttctgtctttgcgcgtggtttaatgtgtactgtgattgtgaaccaactaatgtgatcttaaataaaacatgcatgccaagtttgtgtcaaaaaaaaaaaaaaaaaaaacccaaaaaccaaaaaaaaaaaaaaagaaaaaaca

SEQ ID NO: 14515 - DNA, 1537 bp, Sorghum bicolor
  Clone ID: SORBI-28MAY03-CLUS2843_1
ctactgggtctcgcgtttgctttctccatctctctccccctccgcccccgcgcctctgttcccctccctccgcttagggttagccaggcagcagccccgccctcgcgaatcttccttcaatagcgacaccgacccggcggccatggccacggcggttctcagatcccacgacgcgctcaacaaccgtatgcatctcgacgcgtacaccccgtccccggcgaagccgcgccggcgccggagccctaagccggcggccgcgtcctcgcctcccgctagggccgcggcgcccatagcctcgacgaagcctgcggcggtgcagaaggccgtgacgcccgctaaggcgcccgtggcgcccggccgccgctcgccgccggccaggccggctgcttcgtcgcggaagcagccgtcccccaccaaggagaagtccaagcagcggcttgtcatggaggaggtccggatcctcaagcgcggcgaggagccgccggctcccgctcccgcgccggttttggccgtgccccccgtggcgctagccgcggcggttgaccagcgcgttctctgctccactggccggatcgggccacaggcgcccgccgtggtgccgacgaagaggatggtgtccgcccccgccgcatccagcgcggccgtgtacgccggcccggcgttttctgccgcggcgcccgagccgagttcactccccatgcccgccttcttcctccggcgcgcggagtccgaggccacccggggcctccggtgcctcctccgcatcggcgagctcgcctgacacggctgacgttctctcgaccagcctctgtctactacttcgttcaccccttcggcttcgtctcttctactcttcctccctcgtctccggtggttccttgatctatggatggttggcgcctgatgggcggttgttggatccgatggaaagctagcttctccggatcggatcagatcacatctcccggtaaccgttccgatcaacctcttccggtattttttcagaggaaaggttggccaacgggcttccggtggttggatttggtggcggacttcggttaggttcacatatcgcttgcagttcggttcgcttcaatggaaagctgatgtctctaggttagaagaataactatgagtaagaaaggaaggatggctgctagattgggtagctagctgttggctgcttggttctacagtagcttggagcttggcttctaggtgttctagtgatggtggtggtggtgtttggttcaggggatggattaaattagtgtctgaaatagctgtttggtttaggtgatcttaagtagacgacctgattataattcagggtagtttatcgttgcaataatctaaggtttggtgtgcgtttgatctgtgtgagttttgtgttaggtgtgtcatgaactaaagttatgcgatgtttagtaggtcaggtgaaggttcttctcttatgtaagatgtcaaggttgtatctattatcagcttagctgtgatatactactatatatatatatgagtggtaaatttaggtagg

SEQ ID NO: 14516 - DNA, 867 bp, Sorghum bicolor
  unsure (1)..(867): unsure at all n locations
  Clone ID: SORBI-28MAY03-CLUS1833_2
cgaatnccaggaaggaagcagcagcgtgaccatcgagtcggacttcttcattgccagcggcatcttgttcaggaacgacgcgccggagccggagctgaagagggataatcaagggaagatcggcgaggtgactagcgcaaccatggcgccagcgctgcgagtggcaggatccaaggccaccttctacaaatgcaccgtcgacggcgggcatggcgccctgtatgaccataagggactgcactactataaatcgtgcacaatcaacggcaccttcgacttcatcttcggcaatgcaaggtccttttacgaggactgcaacattgtctccaaatccgccactgattacctcggggacctgccggtggcaaagccgcccttgaccttgtcgcctgcggcggccgacggcggtttctctttcaagacatgcaccatcacagggcaaagttttatcttcctaggaagggcgggctggcctgtcgtctactcctacaccaacataggatacgacctttttcctctaatcgtctctggctctgacgatagccaagcaggggctaaatttcagttcaaccgggagtttgccccgttcctctttatatcatacaagaactacggtgttccgagtggtgcggtggggataaacaaaaccgatgtcgcaccctttcttggaacccaatttgtctccggagacaattggatcctgtccataccacctgcaacagagtagcagcacgcggcggcggcaaggactgactagggatcggatggagcacatatgtttatatgcatgatatatatatgatggccaccatcatcatcctatgacacaacccgcggaagttggtggttgttttacttcttttgtac

SEQ ID NO: 14517 - DNA, 1362 bp, Sorghum bicolor
  unsure (1)..(1362): unsure at all n locations
  Clone ID: SORBI-28MAY03-CLUS1833_1
gagagacataaatggctccctgtaaggtcccaaattcacaccanagaccagagggaactaggggccttttttttttttttttttgcatcacaaatccacacagaattaatgttcttagcccacacagaattaatgtttttagcacaacaggctgacagcgaaggattacattacatatttagatggggcaacacaaccgaaagcagctgcagcaacagcaacagcagctgagacccattgacacatagtatatggcaaccagtcactgatgaagacgacagtacttggtggatgacgacacttttctctctttgttgagctgagcatatgccccttgtctgaggaagcatatgctgctgcttactaattcttgaggtgggggaagcactggtagaggtcattcttgggatgcctcgcctcggcatgctctttgcacttggcctcagaggtggtgcagataaaagtctgcatacagatcttgcactggatgttcatggccttcttgtttgtctccagctgactgcctttggagcccttgttcttctcggcgttcctctcccgcgccatcttggacttctggccgttgccgccgcccatggctgaagctcctcctcctgctccttggtcccctgcgagagaagagaagagagaagagtcgcggaaggaagggacgtgtctggttcgcgggcgacgcacgccaagccaacgcgtaagctgcagcgacacgggccggattttgcttgacaggcttgggtcgtgttggtgtggcggacactctttcttcgaagacatcgtccgaaccatcttgatcattccacatgcgtgtcttgacttgacgtccgcgcgatgaaacaaatgtcgcaccaattgttggcacgagctctgtttcgaaatttgatttgtgttggcgcggtcctcgtggtcgaccagcattaggtgagagtgaattgcgaggtccacggcctcgtcctccatcaacaccaccagtgctggctcgtcgcttgggcttctcacctccgtcaaagtcatcatcgtccgcactctcgtcgtcatcagagagcggtacttcttcttgttcgagttctaacagctcttcagccaatgtcttcctcgtgctgcgttcagaagaaagcatggttagtgcatttggatgtaagcatttttcagatgaccaactgatgagaactgaaataccagaccacaactacacaaacaaacattgttcaagttcaaaaattctgggtacatacatttggccaatgagagaaatggcagctagtaactagcaattcacacaacaggtttcagtagtgattctattgtccctccagagtccggggtatctgctgatgttcccggacg

SEQ ID NO: 14518 - DNA, 661 bp, Sorghum bicolor
  Clone ID: LIB5047-005-R1-XP1-G9
gccggccaggccgggtcttgattctatgggtggtggtgcaggtacgtactatggtggtgggtggcgactcttctctcttctcttctctcgcaggggaccaaggagcaggaggaggagcttcagccatgggcggcggcaacggccagaagtccaagatggcgcgggagaggaacgccgagaagaacaagggctccaaaggcagtcagctggagacaaacaagaaggccatgaacatccagtgcaagatctgtatgcagacttttatctgcaccacctctgaggccaagtgcaaagagcatgccgaggcgaggcatcccaagaatgacctctaccagtgcttcccccacctcaagaattagtaagcagcagcatatgcttcctcagacaaggggcatatgctcagctcaacaaagagagaaaagtgtcgtcatccaccaagtactgtcgtcttcatcagtgactggttgccatatactatgtgtcaatgggtctcagctgctgttgctgttgctgcagctgctttcggttgtgttgccccatctaaatatgtaatgtaatccttcgctgtcagcctgttgtgctaaaaacattaattctgtgtgggctaagaacattaattctgtgtggatttgtgaaaaaaaaaaaaaaaaaagggccccta

SEQ ID NO: 14519 - DNA, 408 bp, Sorghum bicolor
  Clone ID: LIB3480-031-P1-K1-D2
cacagaattaatgttcttagcccacacagaattaatgtgttgggcacaacaggctgacagcgaaggattacattacatatttagatggggcaacacaaccgaaagcagctgcagcaacagcaacagcagctgagacccattgacacatagtatatggcaaccagtcactgatgaagacgacagtacttggtggactgcactactataaatcgtgcacaatcaacggcaccttcgacttcatcttcggcaatgcaaggtccttttacgaggactgcaacattgtctccaaatccgccactgattacctcggggacctgccggtggcaaagccgcccttgaccttgtcgcctgcggcggccgacggcggtttctctttcaagacatgcaccatcacagggcaaagtttta

SEQ ID NO: 14520 - DNA, 1311 bp, Sorghum bicolor
  Clone ID: SORBI-28MAY03-CLUS2702_1
gccggccgttggataaaactcgcctgtcgcctcccagcacgaggctcgctttccctggctgcccgtcaccactgacgcccgcctccaccgcccccggcctccatcccatcccatcgccgcgtataaagattcgcttccagcgactagaagatgcagctcatcaccacctccgcgctcgaagctccgcctcctcccgaacccgtaccgtcgccatggcatccggcttgcctgtaagctccaaggaagtgctgccgtctcccctgacctccgcctccgagccccctcccctcttcgatggcactaccaagttgtacgttgcctattattgcccgttcgcgcagcgcgcttggattgccaggaactacaagggtttgcaggataagattaagattgtcgccatcgatcttgctgacaggccagcatggtacaaggagaaggtttatccagaaaacaaggtgccttctctggaacacaacaaccaggtgaaaggagagagcttggatttggttaagtacattgacagcaacttcgaaggtccatcgttgctccctgaggatcctgcaaagaagcagttcgctgaggagctgcttgcatatactgatgcatttaacaaagcattatactcatctttactcagcaaggaagatgtgtctgaggaaactgttgctgctttggataaaatagaagacgccctggggaaatttaatgacggcccgttcttccttggtcagttcagtttggtggacattgcatatgtaccattcatcgagaggtttcagatattctattccaacataaaaaactatgatatcacaaagggcagacccaaccttcagaagttcattgaggaagtgaacaagatcgatgcatatacgcagactaaactggacccagattttttacttgagcagacaaagaagcggcttgggattgcttaaagcttgtgaccaaggatgaatctctcgccagaagtacaagcatagtagattgagactagtttagtcgtttgtgtgcttgaataatgatgaatatcacagttatggttttcagtgaggcatggtcttctatattggttgtgcttctgaaataaattagttgtcactatataaaaggatcatttggtaatgtgttgatgtcactggttgtgcttctgaaaataaactagttgtcactgtataaaaggatcatttggtaatgtgttgatgtcactgtatatgagtgggtggggagagagagagagagagagagagagaatgatatgcagtgtgttctgtcaaatgttgctgaattcaatggatcagtattcgtctc

SEQ ID NO: 14521 - DNA, 922 bp, Sorghum bicolor
  Clone ID: SORBI-28MAY03-CLUS2793_1
gccggcaggaggatcagagcgaacaaccgtgtcgccctcgctcggtctccagcctttgctttgtgcgcagccgcagccgctgctttttcctgcctcttcatcctgcccgagggcgaaacccccaaaccctctccctccctccctccctcccgttgcccggccgatccatccaccggcgatgacgctgggaagctccggcgccggatcgagcgtcgtcgttcctcggaacttcaggctattagaagagcttgagcgtggagagaagggcattggtgatgggacagtgagctatggaatggatgatgcagatgacatctatatgcggtcatggactggtaccatcattggccctcacaatactgtacatgagggtcgcatctaccagcttaagttgttttgtgacaaggactatcctgagaagccaccatctgtcagattccactcaagaatcaacatgacatgtgttaatcacgagacaggagtggttgatccaaagaagtttggtttgctagcaaactggcagcgggactacacgatggagaacatcctaacccagctcaagaaagagatggctgcctcacagaatcgaaagttagtgcagcctccagaagggacattcttctaatgaagtgttcactggcccatcatgggatccaacaacagtaacgataagttgttttatgggttaaaaaacagctcctacatctggtgccagtgtctgtctttatggttttttttattatgctatgttcttgtatctgtgaaccgcagtgaacaacagaagcatcttccttgcaattcttgcatgggttgttgcaggttccagggatgtatctttgaaagtggcgtagtgccgtgttaagtaaacaaatgcgtcttatatctataatattagtgttgagcatgcaaatgcattccgtct

SEQ ID NO: 14522 - DNA, 1588 bp, Sorghum bicolor
  Clone ID: SORBI-28MAY03-CLUS2100_1
gcacgaggcccacccccgccgccgcctttcgtcccgcggccgctaaacccctccccatctaccccccacgactccttctcagtttggcacaatggctctggctaataagcttggtggtctgctcaagaaagccacgagttcaaatccgtctgtctatcaagcaatcagatgcatgtcatccaagctctttgttggagggctttcttatggaactgatgatcacagtctcagagatgagtttgccaaatatggagaagtcattgaagctaggattatccttgaccgtgagtctgggaggtctagaggttttggctttgtaacttacacatcttctgaggaggcttcagctgccatcactgccatggatggaaagactcttgatggacgaagcatacgggttaatcatgccaacgagaggacaggtggcttccgcggcagcggtggtggtggttatggtggtggcggcttcggtggtggtggctatggcggtggcggcggtggctatggtggtggcggcggtggctatggtggtggctatggtggcaactacggcaacaggggtggcggtggctatggtggtggtgttggtgattatggagctgcaggtggagctggaggcaactttgctgctggaggtagtaacagctttgccagcagtaacttcggtgctgacagtggttttggtggaaaccctgctggtagctttggcggtggttccactggcgccgagaaggagtatggccggcgctggggcatggagatgaagtggaagaaggtggaccgcttcgtggtgttcaagatcgacgagcggtcgcgcgccgtgctggtggacaaggtgggcggccccggggaagggtacgaggagctcgtcgccgcgctgcccggcgacgactgccgctacgccgtcttcgacttcgacttcgtcaccgtcgacaactgccagaagagcaagatcttcttcatcgcctggtcaccggcggcgtcgaggatcagggccaagatcctgtacgcgacgtcgaagcaaggcctgcggcggctactggacggggtccactacgaggtgcaggccaccgacccctccgagatgggcttcgacgtcatcagaggccgcgcgcaatgaggcccgcgctgcgctctgctctactactacctgtgcgtgtgcgtgtgtgatcggccggatgctaattggcgttggtgtgctcccgtagcgatagcagcgtcgatgatgccaatctgacgaggctttcgcgtgtgttttgctttggtattttcggttttgtttggagagatgattagatgatgcaggcgtggtgtgtgtgtgtgctgatgttggtgggtggagtagaagctgaaggagtggcagcagcggattaatgaaacgtccatctctgcgacgtagaattccactgaacaatgctccagtgtactgtaccataagctgcttcagatttgatcgcgtttctctccgacggtggagaaaacactttctgttaaggatggggatgaccctactaaagaggaaataatatttttttaggtcaaaaaaaaaaaaaaaaaaaaaaaagggggggcgccctttttttttttt

SEQ ID NO: 14523 - DNA, 488 bp, Sorghum bicolor
  unsure (1)..(488): unsure at all n locations
  Clone ID: LIB3481-003-Q6-K1-F2
ccgtccgccctgctggtagctttggcggtggttccactggcgccgatgagttctctggtggcacatttggtggcgacttgagtggtaacaagaatgatgaaatcatggaggatatgttcaaggatgatgagcctgacagcttcgctgacaaggtgggcggccccggggaagggtacgaggagctcgtcgccgcgctgcccggcgacgactgccgctacgccgtcttcgacttcgacttcgtcaccgtcgacaactgccagaagagcaagatcttcttcatcgcctggtcaccggcggcgtcgaggatcagggccaagatcctgtacgcgacgtcgaagcaaggcctgcggcggctactggacggngtccactacgaggtgcaggccaccgacccctccgagatgggcttcgacgtcatcagaggccgcgcgcaatgaggcccgcgctgcgctctgctctactactacctgtgcgtgtgcgtgtgtgat

SEQ ID NO: 14524 - DNA, 753 bp, Sorghum bicolor
  Clone ID: SORBI-28MAY03-CLUS2983_1
cccgcccccggcccgcccccagcccgaagcggcggccggccggccggcccgtgatcgtccatccgtattcccgtcacgcccccaacccaacccaaacccgaagcagcgagagctcccctgaccctcgcgcagcctccgatcgcaaggaagaagaggaagatgagctactacggccagcagccccccgtcggcgtcccgccgcagcaaggctacccggggaaggacggctacccgccagcggggtacccgccggccggctacccccctccggcgcagggctacccgccgcaggggtacccgcagcagggctacccgccgcagtacgctcagccgcctccacagcagcagcagagcagcgggccttccttcatggagggatgcttggctgccctctgctgctgctgcctcctggacgcctgcttctgagagggccatccgacggattcaacacgactgcaagtgaaactactactagcttatggaagagctggaactgaactgagcttcaaacgctagcgtgcttctattctagctttgtcctgcattatcgccttctttttttctctctgttatgagactactagtactatgttgatgttgattggatcagactaggccggtgtgtattctgtggatgttccgtgtttctggtggaattcaaccctgggattgttattgtaaaaaaaaaaaaaaaaaaggcccctactttgctggcactctggtgctgagcacgttttgcttactttattagaa

SEQ ID NO: 14525 - DNA, 926 bp, Sorghum bicolor
  Clone ID: SORBI-28MAY03-CLUS3265_1
aaacactgaaactgatacatacaatacaactgatggaagcagtccaatgatgggtgtaacgagacaatgactcctcattcctgttagccggcaggagtcgggcgacgcaatcttgcaatccagccctcgtaagaaaccttaatccacaacagaagctttcgattcgatcccaccgaggagggaggaggaggaagaagaagacggaaatggcgtccgaggagggagtcgtgatcgcgtgccacaccaaggccgagttcgacgcccagatggccaaggccaaggaggccggcaagctggtggtcattgacttcaccgcctcctggtgtggtccttgccgcgccatcgctccactgtttgtcgagcacgccaagaagtacactcaagctgtcttcctgaaggtggacgtggacgaactgaaggaagttactgcagagtacaagatcgaggcgatgccgaccttccacttcatcaagaacggcgagacggtggagactatcgtcggtgccaggaaggacgagctcctggccctgatccagaagcataccgcgtccgcgtccgcgtaagaagatagtcagtcgtcgtcaataagggccagcgcatcgcatggctgtaaatgatgtcgttatcagtttggtttgtcatttgtgggcgattgtgaaccaatagtatgttccgatctgaataccttaaccatggatacttgttgtgagttgtgattttgactggtattggaatttggatgtctggcttcattttctgttggagtgcgactcttgaataaaccacattggtgatggcaacgctgttctctcctgcactaggccatggtgacagtgatttcctgtcaaaccattgtcaaccagtatataagccctctttgaaactgagaatgtttcgttttttgtttcattttttttctgtaaata

SEQ ID NO: 14526 - DNA, 1843 bp, Sorghum bicolor
  Clone ID: SORBI-28MAY03-CLUS3560_1
gcacgaggcgggaccagtcccggcacgagggtcaggccgtcgtcacgctcgcagcaccggccggtttctacgggcggtgcagtggacgcactagtctcttcgaagacggcggcggcgtgtggtataaacccggggccgcccgtcacgccgccccgtccgtgcgtttccttttgtttcttgctttgcttcttttcgagtgcttgccgtccgtcactgctcgccgatcgagttttctccggattccagcagagaggccccgaacgaagcgatcatcgccgcacctctcttcgagcagaatagttgagaatggctgacgaggatattcagcctatcgtatgcgacaatggcactggaatggtcaaggccggttttgctggtgatgatgcaccaagagctgtcttccccagcattgtgggaagaccgcgccataccggtgtcatggttggcatgggccaaaaggatgcctatgtaggtgatgaggctcaggccaagagaggcatcctgacactgaagtacccaattgagcatggcattgtcaacaactgggatgacatggagaaaatctggcatcacaccttctacaacgagctccgtgttgcgcctgaagatcaccctgtactgctgaccgaggctcctctcaaccccaaggccaacagagagaaaatgacacagattatgtttgaaacctttgaatgcccagcaatgtatgttgctatccaggctgttctttccttgtatgctagtgggcgaacaactggtattgtgatggactccggtgatggtgtgagccacacagttccaatatacgaaggatacacacttcctcatgctattctccgtttggatcttgcggggcgtgacctcaccgaccacctaatgaagatcctcacagagagagggtactccctcactacgagcgctgagcgagaaattgtcagggacataaaggagaagctcgcctatgttgcccttgattatgaacaggagctggaaacagccaggagcagctcctctgttgagaagagctacgagatgcctgatggtcaggtcatcaccattgggtcagaaaggttcaggtgccccgaggtgctgttccagccatctcttgttggtatggaatcgcctggcgtacatgaagccacatacaactccatcatgaagtgtgatgttgatatcaggaaggatttgtatggtaatgttgtcctcagtggaggatctaccatgttccctgggattgctgatcgaatgagcaaggagatcacgtccctggctcctagcagcatgaagattaaagtgattgcaccacctgaaaggaaatacagtgtctggattggtggctctattttggcttctctcagcacttttcagcagatgtggatctcgaaggcagagtatgatgaaaccggtccaggcattgtccacatgaagtgcttctaagtttttctcagacagttttctaaaaaaagggcgtttctggggaagttcgagatggttcgtaaggtgttactggctcctgtgaaccaatacatgatactgccatgataagggttataattagtcaagcagagtaagaagaaataacagtagcagtgactccgattcctgaagatgagtcatatttgtcttgtgctcctgctgtatgaaatggatcgcatgtgtatattcgtcgccgcgccgcactggtgtaacctgttgcctcagagtttgcttttagctggttctgttttaaaaataagtactgttttttggttggctgcaagccattctgaacttcagtttaccaattgtttttatgttgtggttgaatattttaattttttatttaatgtttggttcttttttt

SEQ ID NO: 14527 - DNA, 2273 bp, Sorghum bicolor
  Clone ID: SORBI-28MAY03-CLUS37126_1
aaaactcagttcattgatcatcgtgccttccaaccttctgctgcgttgctgattgtccccttccgaattcttcgtctttgccgggcggcgggcgcggcgccttgccggcggctgcagcggcagcggagcgcagcaaccccctccgcggcaccccaccccactattcctccacgccgtatacaacaattcaacccggcccggctctcctctcctcagctcgatcgatcgcatccgccccccgctacgcgacaccgctcaccaccaccacaccgcgctcgccgccacgaggagtcccatcccatccagctcccaccagcaaaccaatccgatcgaatagtccgcgagcgaagccgaagcgaagcccatggaggcggcggcggagatggcgctgcgcctccgggcggcggccaacgaccgcctggcgggctacgagccgctggccctcgtcgccgcgccgctcctcgcgctcctcgtcgcgcggaccctccacgccgccgccaacgccgtcgccgaccggggcctcgtcgccatcgccatcgccgccgtcaagttgctgccgggagtctccggctacatcgcggcggagaagaagaaggttgttgacaagatgcaatccggtggggccaagaacgatcggcgagctgacttgccaactattggccttggcgagcaagtgatagaagagcttgaaacactgaaagccaaagatgtagactggcagggaaaatgctctggcacagtatatattgctggaagtgagtctgagggccattttgaattgataaacaaggcggtatctatgttttcacacaccaatccgctccatcaagatgtattcaagagtgtggcaaacatggaagctgaagtagttgcaatgacagctgctttacttggcagcaaagaaaaatcatctggtggacaaatttgcggcaacatgacatcaggtggaactgaaagcatattattagcagtcaaaacaacacgtgactatatgcgatcaaagaaagggattacaaagcctgaaattataatggctgaatcagcacattctgcgtacgacaaagctgctgaatacttcaatattaaagtgcggcgtgtacctgtgaacaaagagtttcttgcagatgtgaaaggattcaaacgatgcataaatggaaacactataatgatgattggatctgcaccaggatttccacatggtttaattgatcctattgaggaacttggggaactggcttcacgctatgacatttgcttgcatattgatttatgccttggtggcttcgtactgccttttgctcgtaagcttgggtaccctattcctccttttgatttttctgtcaagggtgttacatcaatctcatcagatgttcataagtacggattagcaccaaaaggcacaagtattgttctgtacagaaatcatgaaattagaaagcatcaatttgttgctgttactgagtggaccggtgggctttatgtttctcccactatggctggaagcaggccaggtggattaattgcgggagcctgggctgctatgatgtctctcggactgaatggctacttggacaatacaaggtgtgtcatggaagtttcgaagaaaatacaaagagggattggagaaatcccagggttgtttgtgattgggaaaccagatatgaccattgtggcgtttggctcagatgttgtcgacatatttgaggtgaacgacataatgtcatcaaaaggttggcatctcaatgctctgcagagacctaacagtttgcacatctgtgtgacccttcaacacacgactatttacgaccaattcctgaaggatctgcaagattctgtggacactgtgaaagcaaacccaggccctattagcggcggaatggctcctatctacggcgccgcagggaagatgccagacagaggcacggtgagggagctgcttgtggagttcatggacagctcttgctgaactgattatggcttgtgaaaaacagtcccagtgctgtgatttgtttgcctaggtatacaaagttatcataggaaagaggggaaagtcattgaggcgatacaaacacatgtatttcacaattacaagaagtgtatctgtatgattgtatatcaatatcagagcatgcatatgtaatgtaccaccaagcttacaaatgtatctgttcctatatacaacatttgttacattttaggcgtactcaccctgtgaatcaggggataataataatagaatacaaaagatggggtatcaagaatacgttttcggg

SEQ ID NO: 14528 - DNA, 738 bp, Sorghum bicolor
  Clone ID: SORBI-28MAY03-CLUS44198_1
gcagcacgaggcacacaacacagacacaccaaaacgtacgcgtgcttctcgatcgatcgatcgaacctgcagcaggtgtccaagcgtcatggcggcagcgagcagggcgtctctggtgctgttcctggtggtggcgacgagcgcggtggtggcgagcatgctggccgtggccccgggcgcgggcgcggcgacgacggcgtgcgtcccgacgcagctgaccccgtgcgcgccggccatcgtggggaacgcggcgcccaccgcggcgtgctgcgcgaggctcaaggcgcacccggccagctgcttctgccagtacaagaagaaccccaacatgcagcgctacgtcaactcccccaacggcaagaaggtcttcgccgcctgcaaggtgcccctgcccaagtgctgaatcaagtgcatgcagctagagtagtgcctagtctgttccttgtcgatgtcgaccttgacctctcgcgggcacgcacgcactctcgtgtatggtacttatgaatacttggctgagttagtattttgcttgagaataaacggagacgtagtaattcagtactacttcgtagttggtacagtgtgagtcctctgctctgtgcagacttggtatgtcatgtatttatacgtgtcacacgtatactatgtatgatgttacaaaatgaataaaagtgttgccacttctgagttgacttaaaaaaaaaaaaaaaaaaaaaaaaaaaaaaaaaaaaaaactca

SEQ ID NO: 14529 - DNA, 1050 bp, Sorghum bicolor
  Clone ID: SORBI-28MAY03-CLUS6476_1
tcgattccggagagggagcctgagaaacgggcacgagggtacgatcgagcacctagcagcagcagcagcagcagctagcagcaatggagtccaccaagctctccgcgctgctggtgctcgccatgctcgcgctctcctcgtccccgctcgctctcgcgtgggagaaggcggagccggagtgccactcgtgcgagtccggctcgccaccctcgaccggcgtccccctgccccctatcagcataccgtcagtccccttgccgcctgtcagcataccgtcggtgcccctgccgcctgtcagtataccgtcggtccccatcccgaagctccccgtcccgcccgtcaccttaccccctgtcagcgggctgccgccggtcagcctcccgcccattccgatcatcggaggaagcccgacgaagaagggacaccggaaggcgtgcccgccgcctccgtctcccccgacgccgacgccgacgccgacaccgtcctcggacaagtgccccatcgacgcgctgaagctgggcgcgtgcgtggacgttctcgggaacgaggtgcacatcggcgacgccaacgtcaagtgctgcccactcgtgaagggcatcgccgggctctccgcggcggcgtgcctgtgcaccgccatcaaggccaaggtgctggacatctccgtctacgtgcccatcgcgctggaggtgctcgtcaactgcggctgcgccgtcccgccaggctacaaatgcacttaaacgagtccattcccttccatttccatccatcacgcgtgcacagcaacgtctccttttgccttcccaaatgcaaagtttgaaaggctcgtcgacggatttgggtggaagccgctcgcctccgggctgttcagctagtgcattcttctttatttcatttcatttgctgttcttgttgcatgactgtatatgcatctagtgtctcctcaaacgtcacttgtacctttgtgtgatcttgtatcaaactatttttttttcggattcgattattgtttggagtgctaaattaaggcgcattgtcatcatcattttattc

SEQ ID NO: 14530 - DNA, 1258 bp, Sorghum bicolor
  Clone ID: SORBI-28MAY03-CLUS624_1
gcacgaggaaaacacgaggcgcgccggcaggactggtcactcggcacgcaggcagcacagcagcagcagccaggacccccctccctgctctttcccctcctcgcttcgcttcctcggcggattcctcctcctcctctcgtccgtgcccttccgacgcgcgagctcgcccgagatggcaaatgcaagatcgggtgtcgctgtgaatgacgagtgcatgctgaagtttggcgagctgcagtcgaagaggctgcaccgcttcataacttacaagatggatgacaagttcaaggagatagttgtggaccaggttggggatcgtgctaccagctacgaggacttcacaaacagcctccctgagaatgactgccgatacgcaatctatgattttgactttgtgactgcagaggatgtccagaagagcaggatattctatatcctatggtccccagactctgccaaggtgaagagcaagatgctttacgcaagctctaaccaaaagttcaagagtgggctcaatggcattcaggtggagctccaggctacagatgcaagtgaaatcagcattgatcagatcaaggatcgggcacgctaggcgcagtgcaccgccatcacgtgtttcatgatcatgcatcatggactcgcctactactgtggatttgtacgccattatagacttggtgctgtgaaagactgcttgatgatttgcaggtttgttgctgtgtaaaaaaggtcctcggcttccagaagaccatgaaggtttggatctatcatgtaattccttgttatctgccaattatgtatggactatggacatgtgttgcgctgttcaacttactacaaataagtaatcgatatgttccctattcatgattcggtgacaaaaaaaaaaaaaaaaaaaactcgagactagttctctctcctgaaacatgggtgccacctgaaggtcaaactggtgatggccgcactgcgttgaatgaccgtttaggttattgaaaaagttcttccagcaacaacgccccctgtggagaagtgcagcatagtggttatggtgcagagcctgtttggggccatattctgtgaagacattacaatagaagctgagatggtttattctgttaatggcaagtttggcaaaggaactaggttttcattgacatagtggtctatgctaatcctctcgctttgtaaagagagggtacagagactatacaggctgttgaggttcaagtgtatatcaccaccagagtgtacattttgt

SEQ ID NO: 14531 - DNA, 1676 bp, Sorghum bicolor
  unsure (1)..(1676): unsure at all n locations
  Clone ID: SORBI-28MAY03-CLUS11151_1
tcaggaaaagcataccaatggcaggggttgttgggacgtacacgcctgtgagaaaatgacatacatcaacattcccatgggcatgtagctggtaaagtctaattgcaaaaccgcaagcaaatccaacctcttgtgcccataaaaattacaaaaaaagacctaagacaaatgtcaaaacaaattaaatctccaatcaaaagaattgcatgccacgtggcaacgtggtattagccgagaaacatgcgtaggcctactggataagaaagatcccatccctccgctccactgcccagacgaacaatagcctttcctcgcactcgcccctctgcatttaccactttgcccttcgtcggcggcgacgaccacccgccgccgcgtccggcgaaacaaccggctgtaggtccaaagtagtacctcatggcggccatatcgtcgcttcccttcgcggcgctgcggggagcctccgagtggaggccgtcgtcgacggcggcggccgtttccggcgccgtcgtgcttagcgcgaggtctcgccggggctcgcgctcggtggtgcgctgcgttgccacggcgggtgatgtcccacctactgtggcagaaacaaagctgaacttccttaagtcatacaaacgcccaatcccgagcatttacagtacagtcttacaagaacttttggtgcagcaacacctgatgagatacaaaagaacctatcagtatgatcctgtgtttggtcttggcttcgtcactgtctatgatcagctcatggaagggtaccccagcaatgaggacagggattccatcttcagggcatatataacagcattaaatgaagatcctactcaatacagagctgatgcactaaagatggaagagtgggcacgttcccagaatgctagttccttagttgatttttcttccagagatggagaaattgaggccattctgaaagatatatcagaaagggccaagggtaagggaaacttcagctacagccgattctttgcagttggcttgttccgtttgcttgagcttgcaaatgcaacggagccaacagtactagacaagctttgcactgcactaaacgtcagtaaaagaagtgtggatagggaccttgatgtttaccgtaacatactctcaaagttggttcaagccaaggaacttctcaaggaatacgtggatagggaaaagaagaagagagaagaaagatcagaaaccccgaagccgaatgaagctgtcacaaaatttgatggaaacctttattccatgaggcattagatcagcccttgcagaggagagtttcccacgataacagaattaacagtaacatatgaaccatgttgagaaactaccaaatattcccctttcatcacagacatctttggctgctcgtcgtgtggtgtagcattctgccgtacaaaaggatccagattattcttactattggacagaaatttgtattttctcatgtgtcttgaaatcagatgtattcgttttctctgctagtccgacagtatatgaagagatatgtgggggtcaatgttactcctaagcagagaaatatagctttctcttttgtatttcaatggagatttgagaggttgtgttcacttatatatttgtggcatccatgaaatcagttgatgtgttctttatctgaatttgtatgtgcggggncttag

SEQ ID NO: 14532 - DNA, 2258 bp, Sorghum bicolor
  Clone ID: SORBI-28MAY03-CLUS4929_1
ccacctgtccctccactgttccctcccgcccccgcccgccttcccctccccggccccgcgtcccccggcccgcccccgcccccctgctaatggaataccgccccgcgccgcgcagcctgaccagctcgcacgagcagcccctcgcccccctccgccctcccacgtcgtcgcgggtaccctattccatgccaacacgtgatctcgcgagctcgcccgagcaaaccgccgccgctgcccgccgttccccttcgtcgctcgtcccctccacaaagcccatagaaaagttgatctcatgaattcaggaagaacagtggcatccaacgtttcctgttcagcgggaaacagcggcagcttccctccctgcctccttccaggatttcttgggttcccagttattttcgtaaatttccacttgttcaaggccattgttcgcagccctgcatcttctgttatcttgggaatctgtggagggagccttccttagaccgctgccctacaaggcattatttctggtctgggaattggctgtgtggagctgcctagctaaattgtggcccaagacttcctagtcatcttgttgaatctcataggttctcgaagatggtttcctctgagataacctctgttacagcagtgcgtgcacagggccccaagctttttcgagggaagatccttctgccaggggggcctccagatgttgtcccttctgaaaatgttgagttcgatttttctgatgtttttgggcctagtgcagtccagactcacacagaagtgagtattctcactcctgacagtccagcacctgtggctgagtccaacgatgaggtttacgatgaccctgatgtcattgtcaaacgatctcattctcttgttggtccatcatctcttgttagtcagtctttgccatttagcaagcttacactgcacaaaacagagagttcattggatctttcagagtgcccttacaaagaaaagcaaatcaaccaagggtcccttagtgatgatgagtttgatgatgtaaaaaaggagaatgaaggtgttggactagatgacttcgaagttttgaagctcgttggccaaggggcatttggcaaagtatatcaggtgagaaagaaaggtcctgctgaaatatatgcaatgaaagttatgaggaaggacaaggttgtggagaagaatcatgctgagtacatgaaagctgagagagatatactgacaaaagttgaccatccttttgttgtgcagctgaggtactcctttcagacaaagtaccgactttaccttgtcctggacttcataaatgggggccatctcttcttccagctttaccaccagggtttatttagggaggagcttgcatgcatctacactgctgaaattgtatctgccgtagcccacctccatgccaatggtattatgcatagagatttgaagcctgagaacatcttactggatgctgatggtcatgctatgctgactgactttggtgtggcaaaagaatttgatgaaaacactagatcaaactcaatgtgtggtactgttgagtacatggccccagaaattgttcagggccgaggtcatgataaggctgcagactggtggagtgtgggaatccttctttttgaaatgcttacgggaaagccaccgtttattggtggaaacagagacaagattcaacagaagatagtaaaggagaagataaagctgccgacatatttatctagtgaagttcactctctgttgaaaggattactgcacaaagaagctggcagacggctggggagtggaccaggtggcagtgatgaaattaagaaccacaagtggttcaagtctgtaaactggaagaggctggaggcccggcagatccagccaagcttccggccgaatgttgctggcaagacctgcattgcaaatttcgacgagtgctggacgaatatgcccgtgcttgactctccagtggccagccctgttgcagccaacagcaactttgtggggttcagttatgtgaggcccgcaccgttcctccaaaagccgagtccccttgctgaagaacgactcccgtaatctgagacctaccccggagttcaaatatttatctgagtccgaaccctatgtatttcttcaagacattagtgatggaaatctaaccttatattgttgttgcttgagaactacagtttggctagtgcaatgtgtaatattgccaaaacttcttattgaagcgccataattatcctcttaatgagtatttattttggttt

SEQ ID NO: 14533 - DNA, 1636 bp, Sorghum bicolor
  Clone ID: SORBI-28MAY03-CLUS8407_1
ttggccttctggaaaaaaaaaaaaaaaaaaaaaacccgcacgaggctccttaaaaacctcgcgagaagagtcgagagcgcgagcacctacctgtgtcgccgatttggccccaaatccgctgaggggctcgagccgatcaaggcgtcatctgcggctgcggcggcggcaatggcggggctgtcgctgcggtgcggcgactgcggcgcgcagctgcggagtgtggaggaggcgcaggcgcacgccgaggccaccaaccacgccaacttcgtcgagtccaccgaggccgtcctcaaccttgtctgctccgactgcggcaagccgtgccgctcccagaccgaggtggacctgcataccaagcgcacgggccatacggagttcgcggacaagaccgcggaggcggccaaacccatcgatctcgaggcgccgcttaagccggcctccgaggatgccatggacgtcgacgcctcggcctcggcgagcgcggagccacaagagatggttgtcccggaggtgaacaaggagatgctcacggaccttgagggcatgggtttctcaacagcccgcgccactagggcgcttcacttctctggtaatagcaccattgaaggtgctattaactggctttctgagcaccaggaggacgcagatattgatgagatgcctctggtaccggctaattcaaaaacagaggctaacaaacctagcctgactcctgaggaaatgaagattaaagcacaggagctaagggagcgtgcacgtaagaagaaagaggaagaagaaagaagaatggaaagagaaagggagaaggaaagaatacgaatcggaaaagaacttcttgaagccaaaagaattgaggaacaaaatgaaaggaaacgcatgatagaactgcgaagacttgagaaagaggaggagaaaagagctagagaaaaaatccgccagaaattagaagaagataaggctgaaaggagaaggaaactaggattgccaccagaagacccagcagctgccaaaccaagtgcaccacctcctgttgaagagaagaagagtgcattacctgtcaggccagccacaaaggcagagaggatgagggattgcctaagaaatcttaagcaacagaacaaggatgatgatgctaaagtgaagagggcgtttcaaacactccttacttacattggaaacgttgctaaaaatcctgatgaggagaaatttagaaagatcaggttgacgaatgcaacatttcaggagagggttggaaatctgcatgggggcatagagttcctggagctctgcggatttgagaaactcgaaggcaacgagtttttgtttttggcaagggaaaaagtcgacaaggcgatcctgaacacagctggagccgagctgaattctgccatcaccaatcctttcttcggagtcctttgaggagtcgtaaaaaaaaactagtacaatgtatactcaaaccgcttggtttctcctttgcttgacgtcaattgtgtctacttggcgccaactgtagatttcaagtctgtggtcagtcagattttacgaattatcagatcgagttcacatactacttccgtacattactgaggcaacttgctctgcatatgttttcatatcccggcgactgggatttttc

SEQ ID NO: 14534 - DNA, 2354 bp, Sorghum bicolor
  Clone ID: SORBI-28MAY03-CLUS1385_1
gcacgacccgcgcccctcccccggccctcggctccgcctcgctcgtgccccctcccccacctctctgcaccagtctccctctccctctccgccttgacttccttcgccactgtcctcttcatcctcctcctcctcctcctcatcatcaatccgctctttgaaggaatcaggaacaagctacacgcaacaagccgccaacaagcaggggggatactgacaggatcatggccgggcgccggcgccgcaccgaccaccagctcctgctgccggccggcagtagcactagcaccgcctgcctgtgggctctgtcatgcgtgctgctgctgctgctccgcgcgtccgcccacagcgacggcggcctgctcagggtcggcctcagcaagcgtggcctcgaccagcacgcgctgcaggcggctaaggtcgccaggcaggaggacagcctccaacacggccgcctgagggcctccagcaccggcgacgacgtaccgctcgtcgactacctcaacacccagtactacggggtcgtcggcctcggcacgccgccgcagaacttcaccgtcatcttcgacaccggcagctccaacctctgggtcccctcctccaaatgctacttctcgatagcgtgctacctccaccccagatacaagtccgccaagtctagcacttacaagaaggatggagagacttgcaaaatcacctatggctctggttcaattgctggattcttcagctacgacgacgtgctggttggagaccttactgtcaaaagccagaaggtcatcgagacgacgcgcgaacccagcatcacgtttataattggcaagtttgatggcattcttgggcttggataccctgacatctccgtcggtaaagctcctccgatctggcagagcatgcaagagcagaacctgcttgcggaagatgttttctccttctggcttaaccggaacgctggtgcggaatctggtggcgagcttgtgtttggtggtgtcgaccctgatcacttcaagggaaaccacacctatgttcctgtttccaccaagggttactggcagttcaacatgggtgatcttctcattgatggccagtccactggtttctgcgccaagggctgtgccgctattgtcgactctgggacttctttgctgggcggtccaacgactataattgcccaagtgaacgaagcaattggggctgctggaattatcagccaagaatgcaaagaagttgtgagccagtatggagagatgatcctcgaactgctcatagcacagacagatccagagagagtgtgcagccaggttggtctgtgtctgtttgatggcgctcagtctgtcagcaagggaattgaatctgttgttggcaaagaaaacctgggctcagatgttatgtgctcagcctgtgagatggctgttgtgtggatagagaatcagctccgtgagaacaaaacgaaggagctgatattgcaatatgctaaccagctatgtgagcgtctaccaagccccagcggagaatcaactgtcagctgcgaggatatctcaacgatgcccaatcttgcattcaccattgcaaacaaaaccttcaccctaacaccagagcagtacatcgtgaagctggagcaaggaggccaaactgtctgcatcagtggcttcatggcatatgacgtcccaccaccgcgtggtcctctctggattcttggggatgtcttcatgggagcttaccacacggtgttcgacttcggcaacgacaggattggcttcgcggaatctgcatgaggagtgtggctcttcatgaaaatatcctatatatatcagggatgtgtagtttctctatcccctacgtgcagacagcacgccgcaaataaatggatggccaaaaatgctgaaactgaaaacgtgaacagagctttctttctggagaaaagcaagtggatgctcgaagacatgtatgcttgaagttgaagagcaaatgtttggacagggctttcttgaaaactgtttgttcatggtagtacaatttatcacatgtaaaataatttatggattgcctttgaactgatgagcatgtataaatgcaatcttgtttcagtaggatagctcttgccttcttggatatggattgaattatagttgcacagggtgtcaacgtgggctattcctaagaatagcgagacaacatgggctggtggtgaacgccgatctccggcacatttttcccttcgcgtgttgttttttcgctcatcgcaaccggtccacttgccttcgcccttgcacccgctcctttcgatttgttaccttcctttctcgcctcatccgactgctttccccttcaagctctactccaaatgctcccct

SEQ ID NO: 14535 - DNA, 740 bp, Sorghum bicolor
  Clone ID: SORBI-28MAY03-CLUS1061_2
gcttggagtcagcttgctctggaggaaggtaaggatatcccaagtgctgctcatgtggggaagagcattcttcatggtgctgctgaccatgttcttagaaaggttttgtactgggcaaaagaggaagataaaatggaaaaaatgaaggcacgccttatagagttatactatgaaaacctgttcaaactggatacacctgtagaaggattgagagaatggctggatgctgttcagactgcagggataccttgtgctgttgcatcatcccttgacaggagatgcatgatcgaagctttggatcggatggcactaagcaaatatttcaaggcgattgtgactgacgaagatgatatggactcaatagcaaataggtttctgtcagctgctatgaagttggatcgtaaaccctcaaagtgtgttgtgtttgaggacgacccaagggcgtcacagccgcccacaactgtactatgatggcagttgcattgattggtgctcatccagcgtatgagttggtacaggccgatcttgccattgcaaagtacagcgagctctcagtgatcaacctcagaaggctgtttgcgaacaagggaatcagcttcatggacttgcagaagcagataatcgagaagtcacctcccaagaggaggctgacagtagacaccattttctgatggatatactttatttggtgtctgtctgttgttcttgagtagccgaccatctttgacagcgttgtatat

SEQ ID NO: 14536 - DNA, 1329 bp, Sorghum bicolor
  Clone ID: SORBI-28MAY03-CLUS1061_1
tcctgtctcttctttccccttccatggagtcctgtagcttccgcgccgcaacagcgccttctccctttccgtccgcgccatcctcctcctcctcatcatccccgcgcgcccgatccctcatactccgatttcccagaccaagaaaagggaggaagattggggtgcgcaggagagcgtccgggtttgatgccttcccgcccctccccggcaaggtcttcgtcgatgaggcaatcggagcggaatacggggagggcttcgaaacatttcggatggatggaccactcaaggttgatgtggattatctgaatgaaaaattgcaagaatgcttccttcaaaggataaggcatgctatgaagccggatgaggcgtttggtctaattttttcgtgggacaatgttattgctgacacagactcgctaaagttgaatgcttggagtcagcttgctctggaggaaggtaaggatatcccaagtgctgctcatgtccggaagagcattcttcatggtgctgctgaccatgttcttagaaaggttttgtactgggcaaaagaggaagataaaatggaaaaaatgaaggcacgccttatagagttatactatgaaaacctgttcaaactggatacacctgtagaaggattgagagaatggctggatgctgttcagactgcagggataccttgtcctgatttggtgtctgtctgttgttcttgagtagccgaccatctttgacagcgttgtatataagatagtgctgatcttagttgatctgccgtgtccctccttgtgaatgcaatgcggctcaatagcaaataggtttctgtcagctgctatgcagttggatcgtaaaccctcaaagtgtgttgtgtttgaggacgacccaaggggcgtcacagccgcccacaactgtactatgatggcagttgcattgattggtgctcatccagcgtatgagttggtacaggccgatcttgccattgcaaagtacagcgagctctcagtgatcaacctcagaaggctgtttgcgaacaagggaatcagcttcatggacttgcagaagcagataatcgagaagtcacctcccaagaggaggctgacagtagacaccattttctgatggatatactttatttggtgtctgtctgttgttcttgagtagccgaccatctttgacagcgttgtatataagatagtgctgatcttagttgatctgccgtgtccctccttgtgaatgcaatgcagtagttccatcaaggtaccatgaagactgctgcatcaatgttgctgttgatgtaagctgatattattcaaatttattcatatttcatagtcg

SEQ ID NO: 14537 - DNA, 1182 bp, Sorghum bicolor
  unsure (1)..(1182): unsure at all n locations
  Clone ID: SORBI-28MAY03-CLUS7520_1
gctcgagcgtcccttcctcctttccctgccgttccccttctccttcagttctccccagctgctgcgtgctgctgccctccctccgtccgcgtccagatcccgcccaccaaccgatctggtcggcctccagcatggcggcggcgggggcgaaggcgaaggcggcgggagccctggcgctggcgctcgtgctcgcgctcgcgggggccaactccgagggcgacgcgctctcggcgctgcgccgcagcctcagggaccccggcggcgtactccagagctgggaccccacgctcgtcaacccctgcacctggttccacgtcacctgcgaccgcgacaaccgcgtcacccgcctagatcttggtaatttgaacttatccggtcatctggtgcctgagcttgggaaattggagcatctgcagtacctggaactttacaagaatagtattcaaggaacaatcccttctgagcttggtaatttgaagaatctgataagcttggacttgtacaagaacaacatttcagggacaatacctcctacccttgggaagctgaaatcccttgtattcttgcggctcaatggcaatcgtttgactgggccgatcccaagggaactcgccggaatatctagtctcaaagttgttgatgtttcaagcaatgatttatgtgggacaattcccgcatctggaccatttgaacacattcctctgagcaactttgagaagaacccacgcctcgaaggtccagagctacaaggcctggccatatatgacacaaactgctagagggcaccatgaagaaaagaatcgctagaaagtaatgagcgcacaatgttaccaaaattgggtgatatagatttattaggtctggttctgctgccactctgtaatcctccctgcatagctcttatttgtaacttgctgtctgcacgaaagttaatgtatgttttagcagaatgctttctgtccgtgaaagtaaacttgaaactgcttattatgactgaaatgtgtaccgtatggtttatttatgaactggaaccgtgtaaaatgccatgtgccagttgatttttgctttggtctgtaatgcttcccttcgggataggatagatactgtacttcatctttgaggaactcatatgttgtttggctgataagccatggcaganaagtattgttggctgattttttt

SEQ ID NO: 14538 - DNA, 785 bp, Sorghum bicolor
  unsure (1)..(785): unsure at all n locations
  Clone ID: LIB5049-005-R1-XP1-E12
tgtgcggccgctcgcggccggccgggccgggaaaataggactcaccagtcactgccgcagtgccgcgccactttccccacgccccttcctcttcgccgccgcctcccgggagtcgaaaccctagccagccagctcatggccggggcggcggctgtggcgctgatggtcgcggcggcggcggtgctgtcgcctgcctacgtggcgttggcgtccaactcggagggcgatgcgctctacgccctgcggcgcgcgctcgcggacccccgaggcgtgctccagagctgggaccccacgctcgtcaacccctgcacctggttccacgtcacctgcaaccgcgacagccgcgtcacccgcgtggatttgggtaactcaaatttgtcaggcaatcttgttcctgagctgggccaccttgagcacctgcaatatctagaactctacaaaaataatattcagggcactgtcccagctgagcttgggaatctgaagagccttatcagtttggacctgtataacaacaacatcacagggaccataccaaaagaacttggcaagctaaaatccttagtgttcctgcgacttaatgataaccgcttgactggtccagttccacgggaactgacaaaaatctctaacctcaaagtgatagatgtctccaacaatgatctttgcggcacaatcccaactagtgngctttttgaacacataccattgagcaacttcgacaataatcccaggatggaaggcccagagctaccagggcttgtcacatatgacacaaactgttg

SEQ ID NO: 14539 - DNA, 1670 bp, Sorghum bicolor
  Clone ID: SORBI-28MAY03-CLUS1018_1
gcacgaggcagagactgcactcaggcactaccaacagctgctccagaaagagaaacagagagagcaacacagagcagcagagagctagctagcaggcgagcttgcttgttgcaggagcagcgaagcagccatggcggcgacgcgtcgcctctcttcatgctgccttctcctcgccgtgcttctgggagccgtggcggccactgccaccgccttcttcgtcgacgaagcggcggctgccggcgtcgggcttggccatggcggccgcttcgcgcgcaagcatggacgtgctgccgccgagctgccgcagccggagccacaacccaaaccggaaccccagcctcagccgcagcccctgccacagccagagcccaaacctgaacctaaaccagagcccaagccacgtccagagccaaaaactgagcctcatccagagccttcgccgaaacctgaacctaaacctgagcctcaacctaaacccataacgaagccagagccaaagcccaaacccgaaccgatgcccaagcctatgcctgaaccaaagccaaagccaaaaaagcctgagccaaagccaaaacctgagcctaagcctgaaccaaaacccgagcctgagcccaagcctgaaccactgccaaaaccggagcccaagccagaaccaaaacctaagcctgagcctaagccggagcctaagcctgaaccaaaacctgagcccatgccaaaaccaaaacctgagcctaagcctgagcccaagccagaaccaaagcccgaaccgatgccgaaaccggagcctaagcctgagcccaagccgaaaccaaagcccgagcctaagcctgaacccaagccagaaccaaaacccgaaccactgccacctaagcctgagcccaagccggaaccaaagcccgagcctaagcctgaacccaagccggaaccaaaacctgaaccactaccaaaaccagagcctaagcctgagcccaagccggaaccaaagcccaaaccattgccaaaaccagagccaaagccagagccactgcccaaaccagagcctaagcccgagcccaagccagaaccaaaaccagaaccactacccaaaccagagcctaagcccgagcccaaaccaaaacccgagcctaagcctgagccgaagccggaaccaaaacccgaaccactacctaagcctgagcctaagcctaaacctgaaccaaagcccgagcccaagccgaaaccagaacccaaaccggagcctaagcctgaaccaaaaccaaagcctgaacccaagccggagcccaaaccaaagcctaacccgccgcacatcccaccagcagcagacaactgaatgatcgatgaagagtctccattagccattatagggtatatgaataaagcctcccatgaggacgaagttgtagcatgcatttgtaggtgctagctgctacttgctgtacacctattctttttttttttttttgctttgcgtcattttttatgtaatgctgattacatgattttagtgcagtttagtttgttccctctaaaaaaactatgagcttatgcactcgatcttgtttttttttgctacatgttcattgttatgtatgtatgtttgttcgttgtttttgggggcagctgactgacagaacccattgtggtggtacgcaaaattacaaatttcattc

SEQ ID NO: 14540 - DNA, 1194 bp, Sorghum bicolor
  unsure (1)..(1194): unsure at all n locations
  Clone ID: SORBI-28MAY03-CLUS1522_1
gcgggccgggccgggacctcaccgcacctcacctttgctgctgtccactggacccccggccgtcgattctcacctactgtacaggccgcgcttatataaccaggtcggccggctccgtgtctagcagcgctaacggcatgtggttcggcaacagcagcacaagaggtacccgagcgagtcgttagaggcgtgcgtgcgtgcgtgtgtgtgtgctagtgctacggcgtacggcgcagcagcagcagcggcagccatgagcaccgggcgcgagagcaccaccagcagcaggtggcccgagctggcgaccctgcgggcgctggcgcgcgacgccgcggagcagctgcagctgccgcgcgtcggcatgtcggcgtcggcgggtgcggcgggcgggagggagccgtcgaagcggcagccggcggggtggcgcggcgggcgagaccgggaggaccacgtccacggccacggcaagacggccaaggtgatgcacctgctgctctggggacccaagtgaaggtgaagtgaggccggccgggcatgtcctcctccgatccagtcctcagtacgttcctcaccgaggtcggtcttcgatctctgccgcgccggtgtttctggcgatcccggccgctggccgcacgtacggattgggattgtacctatactacgactgctgtaccatactagcagtgtacagtattattgtactagtagtaaaactgctgctgcttcttcttcttgcaccactttgctgtttgctcgatcgactgctcgtcgcatcggtcagtttggttttcaactgtaagctctctagctaataagctgtagtgtggtgttacagtactgtgttactgggtgtggttcactggtttggactctggagcagcagattattattaccctctccatctgtaatgtaatgtaatgtaagaagagtgctgctgcgtgtgaaattcaacttattaccaacacagtttttgtgtgtgtcgtcaaatgaacccgagcagtcgacacatgtggcgcatgctcaagacaattgtggacatttgcatgaagtatgaagagggcaagtatgtgtttgtaaaagatccagcaaagccacatgtgatgatctatgaggtgccatctgatgcatntgagaatgattatgttgaatataccttgtaaaatatatgtagcaccttatatcataaaaattaa

SEQ ID NO: 14541 - DNA, 340 bp, Sorghum bicolor
  Clone ID: LIB3481-027-P1-K1-A11
cgtccgcttgctcgctggactgcccaggctttgcttgctggtgctgacatgatgaagttgggctatgtgtcacgtgtgaacccccgtgatcactacaaccattctgtgctcactgtgatggggtacaagccaagggattttgccgcacagatcaacctgaacactgcaaacatgtggggaatcgtcaagtcaattgtggacatttgcatgaagtttgaagagggcaagtatgtgtttgtaaaagatccagcaaagccacaggtgaggatctatgaggtgccatctgatgcatttgagaatgattatgttgaatataccttgtaaaatatatgtagcacct

SEQ ID NO: 14542 - DNA, 1014 bp, Sorghum bicolor
  Clone ID: SORBI-28MAY03-CLUS243_1
cccggcttcgacctctccgcccgcgaaaacctcaaagggaggggcggtcagtggtcgcctcgccgtcacgaaatccaccctcctcccccggcgctctccactccgcgccatgcttccgcggccgagccagagaagcatcttccacatcggggaggagggtggcgacgagtccgacgaccaccgcagcgccgacgagcctgtcaagaacaccgatactacacgtatcctcgcagggcgccgagaccacgggcgtcaactgcgaaagcaagactccgccgtcgatgcggtcggcgtcgggctgcagatcctggtccagacgaacctccaccacacgcgggcgccgccgcactcgcatatcgtcctgaagcaggtggtggtcctgccgccgacgacgacggtggcacgccgccaccgccgtggaccgtgcagcagcttcttgagcgcctgctcccgctgcaggaaggagctcagcagcaaggacgtgtacatgtacagaggcgaccaggggttctgcagcgaggagtgccggtgtcagcagatcttggcagacgaggcgacagagcgtgaagccatgatcaagaaggagcggatgcggcgagggttgcctcgccatctccaccacgggccacggtcggcaatgggggcggcggcgatcggtggtgcgtcgaggagactagttgcaatagcgtactaggatctctagcatctgtacgtccatgtccatccgaggtcgatgcatagaaatggcaactagctagtactctttgcgtaagtggtgatgttatacgaacctatgatatcctcgcattcagaggagagagacgggaaaaagctgagcaaatcgaggtgcaaaattttataaggaatcacgggagaaccgccatgtctagctgtttgtgtaaaattaagggagagagatgcagaataggagtaatatttgcatacagagacgatgtaagattgtgagaatcatcacataaacacaaaagtcaaagtaagtgactgtttctctgc

SEQ ID NO: 14543 - DNA, 1508 bp, Sorghum bicolor
  Clone ID: SORBI-28MAY03-CLUS21554_1
aaaactaccaggccgcctgagagactcaccgacagacagtcaccggcaacaagcagcatcgacaactcgacgacgaggggaagctttgcgttggtgtggctggcaatatgtcgtcgtccgcgggtaacaagaagacgatgaagacggcgtgcgttactggagggagcgggtacatcggctccgcactcatcaagttgctgctggagaagggctatgccgtcaagacgacggtcaggaaccccgatgacatggagaagaactcccacctcaaggacctgcagaagcttggaccgctaacggtcttccgcgccgacatggacgaagaaggcagcttcgacgacgctgtcgccggctgcgattacgtcttcctcgtcgccgccccgctgcacttcgaggcacaggatccagagaaagagcagatcgagccggctatccaaggaacgctcaacacaatgaggtcgtgcgtgaaggccgggacggtgcggcgtgtgatccggacctcgtcggcctcggctgtctacttagtctacatcaggctggacgtcggaggcgagcatgtgctgctcgacgaggactcctggtccgacgtcgacttcagcagagccaagccgccaacctggtcacactgcgtgtccaaggtgctcctggagaaggaagcgggccggttcgcggaggagcacggcattagcatgctcaccatcctccccctcatcgtcgttggcgccgccgcgccggcacccaaggtccgcaccagcatcgtcgacagcctctccctgcccgccggcgacgccgcccgcgccatgctcagagccatccagaagacctccggcgaggtgcagctggtccacgtcgacgacctctgccgcgccgagctgttcctcgcagagaacgcgacggccaatgggaggtacatttgcagcagataccacccgaccctcgtcgagctcgcgactttcctggcacaaaagtacccgcagtacggcgtgaaaccaacagatttcgacgatgaggagaggccgagagtgaccatgtcgttggagaagctgatccgggaagggtttgagtacaagcacaacaccctggaagagatctacgacaacgtggtcgagtacggcaaggcattaggaattctgccctactgatatatagatgcccgatttagcttaaataaatgggcagtatgtcagtcggacgtatgagtcttggaaagtactttaaataagttatatggacattttctattgggaaaatgttcaaggaacgcttaacctttgcgttctcgctattcatttttcaacacaataattagccaccatagaatgtgatgtctgtttggttgtaattgattgatttatcatctcatctctatctatatcttttgtcgctttcatggcgccgctccccggctggcgcgaccaggtgtgccagagcctgagaagtggtttgatgacccaatgtgaaattgcaatttgctacaaaagactcgtatatttactcgatcatatcct

SEQ ID NO: 14544 - DNA, 310 bp, Sorghum bicolor
  Clone ID: LIB5048-011-R1-XP1-H5
ccgggactgtgtctactaatttcatcaatcatcaagctgcaggactgacccacagtcaccggcaaaagcttcatcgacgacgagggtgcgtgcgttggtgggcgccggcgatgtcgtcgtctgcgcgcaacacgacgaagctgaagacggcgtgcgtgaccggaggaaatggctacatcggctccgcgctcattaagatgctgctggaggaaggctacgccgtgaagacgacggtcaggaaccccgatgacatggagaagaactcccatctcaagggcttgcaggagcttggaccgctgacggccctccg

SEQ ID NO: 14545 - DNA, 1337 bp, Sorghum bicolor
  unsure (1)..(1337): unsure at all n locations
  Clone ID: SORBI-28MAY03-CLUS4442_1
gcacgaggctggaacccctgccatcacgtccctccgcctctcccccgcgccccccgcggtccccgacgcagtctgcccacatcccattcccagatcccaccgatcgaaacgcgaccccgaaccgacgcaatggcgaccctcaccgtcccctcctccgtcccggccgtcgccgaggacgccgagcagctccacaaggccttcgaaggttggggcaccaacgagaagctgatcatctccatcctggcccaccgcaacgcggcgcagcgccgcgcgatccgccgcgcgtacgccgaggcgtacgggaaggagctgctccgcgccctcggcgacgagatccacggcaagttcgagagaacggtgatcctgtggacgctggaccccgcggagagggacgcggtgctggcgaacgaggaggcgaagaaatggcaccccggcggccgcgcgctggtggagatcgcgtgcgcgcgcacccccgcgcagctcttcgcggccaagcaggcgtaccacgaccgcttcaagcgctcgctcgaggaggccctcccggctcgcgtcaccggcgacttccgcaagctgttggtgcctcttgtaagtgcataccgctatgatggcccagaggtgaacacgtctttggcccattctgaagccaaaattcttcatgagaagatcgataaaaaggcttacagtgacgaggagatcatcaggattctcaccacacggagcaaagctcagctacttgcaacattcaataactacaaggatcagtttggtcatgcaatcaacaaggatctgaaagctgaccccaaggatgagttcctttcaacactgcgagcgatcatccggtgcttcacctgccctgacagatacttcgagaaagtcattcgactggctcttggaggcgtgggcacagatgaggatgctctcaccagggtcataactactcgcgccgaggtcgacctgaagctaataggggaagcttaccagaagaggaacagtgtgccgctggaccgtgctgttgctaaagatacaactagagattatgaggatattctccttgccctcctaggggcggagtgaggaggcgtgcctcaactccatcccatctgctcctccttgtttgatgggaacaaaaaactgcatcgatgtggtatacacgtggttgtgtttttgaacaataataagtttgtaacctagcctgcattagcagcgcccgttaaataaaaaaaaaaccttctcgataagcttgttatcttttgactgccattaatacaacctgtgtttattgtggctannnnnnnnnnnnnnnnnnnnnnnnnnnnnnnnnnnnnnnnnnnnnnnnn

SEQ ID NO: 14546 - DNA, 555 bp, Sorghum bicolor
  Clone ID: SORBI-28MAY03-CLUS2193_2
cgtccgagatgaacacaccggtgtacgagggacgtgaggaactgctggagcaacacctcaaggacgaccttcacagtatcgtggacttcactggccatggtgccctctatttacaggaagacgatggtggtgtggtcagcgacgagggctgcagctttgatctcccggatgccatgttcactgccggggtcacccaccatggcgccgaggaggcgcagctggccaactggacatcctggttctggaactgatttccatcagtggagggatggctgcatcaagtgcaaagagcaaatcctctcctggcttcgacccttttctgcaccatataattactgtgttaattatgtgccgtgatgccgtcagatgttttcaagtaaatgaattgttactgatgttggaagtttaagttttgaagattttatatggtcatatataaaatatatgctttgaacattagacttcaaaagtcgaaaattaatggacgtggataacctgtgggcactacagcacttgcagcccgcatgagtttttatgctgcttttaaacatgaaa

SEQ ID NO: 14547 - DNA, 1013 bp, Sorghum bicolor
  unsure (1)..(1013): unsure at all n locations
  Clone ID: SORBI-28MAY03-CLUS2193_1
ctacgacgcgctcgccgccgaccaccagggcctcctggccgacaacgatagcatccgcccaaaattcatcccaaaaaaagtctaaaaaaaaaacttgcagcggcatccaccaccggagctgccatcatcggcccgtccctccgtgtcaaccccctcctcagaagttctatttgcagttcggcccctggccggtccgcccggccaccggaaggagccgctcgccggaggaaggcccccctgtctccttgccctgcggcgggttcatggggttctcgctgtaccccatgaagacgtccacgcggctgctctggagcactagcttcttccgccataagctcagctcctcctcctgcttcctctgagcccgccacgatcgtgttgtcggcggcggcggcggtccgctgctgctgcgcggtcctagcatccgttcaagtttgtgtttgtgtttgtgtttgtgttcgtgtgcgcgcacgcgcgtaccggcgtacgggtttcaagattgggttttgttgcgttcttggggagaggaagggactagggcgcgggcaagaatcagcatagcatggatccgagcgcggtcagtttcgactccggcggcgcgcggcggggcggcggcggcggcggcgcgcagatgctgctcttcggcggcggaggcagcgccaacagcaacggcttcttccgagttgttccgatggcggtcctgggcatggacgacgcgacgcgcgtgggcaagcggcctttcttcaccacgcacgaggagctcctggaggaggagtactacgacgagcaggcgcccgagaagaagcgccgtctgacggcggagcaggtgcagctgctggagcggagcttcgaggaagagaacaagctggagccggagcgcaagaccgagctggctcgccgcctcgggatggcgcctcgccaggtggccgtctggttccagaaccgccgcgcgcgctggatgacttagcagctcgagaccgactatgacttatgtgcggctgnctacgacgcgc

SEQ ID NO: 14548 - DNA, 1720 bp, Sorghum bicolor
  Clone ID: SORBI-28MAY03-CLUS33_1
ctccaggccaggaccaggacagggtgccacaaaaccaaaaccaaaccccaccactccgcacgagatcatttcgccagctcatcgccaccgccctccacagcccccgctcggctcccgcgactccttctcctcgtcgccgggtgagtgggtccacctctcgccgcgccccgccgtcgacccgcctcagaggcaaagataagtcaaaggagaggtcggtatgcgccggtggttttgctgcacgcagtttaatgcttcatatcgtgaacatgaaaatgaacgtcccatcagtccggaggagaaagaaggaaatggttttgctgttaaaagtgatcccatcaaggtaccaccttccattgaagtccctgaattatcatttgaagaactgaaagaaaagaccgacaattttgggtcaaaggctttgattggtgagggatcatatggaagagtgtattacgctattctggacagtgaaaaacatgttgctgttaaaaagcttgacgcttcaacagaccctgaactcgataatgagtttttgacacaggtatccattgcctcaaaactaaagcatgataattttgtggagatgcttggatattgtgtggaaggaaatcagcgtctagtggcctatgaatttgctacaatgggttctctgcatgatatcttgcatggaagaaagggtgttccaggtgcacagcctggcccagcacttgattggatgcagcgggttaagattgctattgatgctgctaaagggctagagtatcttcatgaaaaggtgcagccttcaatagtccaccgggacatacggtctagcaacgttcttctgtttgaggactacaaagcgaaaattgcagatttcaatctttccaatcagtctccagatatggctgctcgtttgcattctactcgtgtccttggaaccttcggctaccatgctcccgagtatgccatgactggccagctaactcagaaaagcgatgtatatagcttcggagttgttcttttagagcttctaacaggaaggaaaccagtagatcatacaatgcctagaggtcagcagagtctggttacatgggcaacacctcgattgactgaggacacagtgaaacaatgtgttgatccaagattaaagggagagtatcctccaaaaggagttgccaagcttgcggctgtggcggcactctgtgtgcaatatgaatctgaatttagacccagcatgagcatcgtagttaaggcactctctccccttcttcaacataaaccgcaaccaccaccagccactactcctgatgcaacagcaccttcagatgcctgactttttcaacaagctatgaatcatgaatgtaaagagagccatttcctcttcggtgcgtgcgctgttctgaagtactaccgtgtgcctgtgaagtgatcagtgtcacacaagtaacggcattgtggactaatgcatatgcacacctttacataggttggtacagacaggaggctcccccccttgtcattaccgcgtgctaagctgagtcatgtcctgccttcgttggccgggtgaggtgtgcttgttggccagcggtcgtgatcacctaattaccgtgttactgtaacatgtgaaggttctaatttttttttcaaggtttgtttttcgtgtgcatgtctatgcgtgagattgtgatgacattatgcgcattattttcttttactggagatacgctggagagctaga

SEQ ID NO: 14549 - DNA, 2318 bp, Sorghum bicolor
  Clone ID: SORBI-28MAY03-CLUS23128_1
tggctccttggaacgaaaatgtgaaatatgtttaaaatgaaacatgactaataatatagcagtacaacgggtgcccaacaaatataacggcagctcgctcgcttgattatttgttgcaaacagtgacactgacaatatgcatgggggcaacgccggatgaggaagccggccggagaaacgatagcatgccatgcatgcaagctatctatccttcgatggcaacgccaggcggcggcggcgctgctgctaccctgatggtcctaggcttcttgctgcctcctgctgcaatggtgtccggaacatgtttaggatcttgttcgtgttcgtaggcggcaagatggacgcccagcgccgccctccccgaggggtccaggttctctgaccactgcgcgtcccactcgatggccttggccgtgctgcacgccacgcttggcccgccgggcaccgtcaggatagcaggcttctgtgggaagaacctctcgaagatcatcctgtaatagtaggcctcctttgtggtcggagtgttgtgtgggaagatgaactttgcattcgacagcatcttgtcagtcacatttgatgcagcatgagccttgaggccatcgatccagctgtacccaacgccgtcactgaactgctccttctgtctgtataggatatgcttaggcaggaatggctgcccctctgcgtcaaatgcctgccgcagcaccctctgctctcctctgcccatatctattctactttgtaatgaaattttaaacgtaccatctacttcttgtaagcagcactgcatcatacaataagataccttgtgtggcccctggccgttctcgccttgttggctctctggcagtcatactgatgcagagccttaaccttcctgcatgtctcttggtggaactcctccttgttgggtgccttgtggaagtagaggtagcctccgaagagctcgtcggagccctcgccggagatgaccatcttgaccccgagcgacttgatcttgcgcgacatgaggaacatgggcgtgctcgccctgatcgtcgtcacgtcgtacgtctccgtgtggtagatcacgtcctcaatggcatcaatgccgtcctgaacagtgaagtggaactcgtggtgcagggtgcccaggtagtctgccacctctctggccgccttcaggtcaggggacccctccaggccgacgcagaaggagtggagcttggtgccccagcgtgttgcagcctctgtcccggcgaggtgacgcacagcgacggctgccaccagcgacgagtccaggccgccggagagcaggacgccaaaggggacgtctgtcatcagccgctttaccacagccttttcgaaggccttcctgagcgccagcgggttgtatggaaccgagggggtgatggcctcgtcgaaccatcgtgggttgtaccacctgctgaatcctcctccggtcttgttgttgctggagtagagatgccccggagggaagatctcaaagtgctcgcactcgtcgttcagggccttcatctctgacgaaatccacaccgacccatcgattccccatccgatgtagagtggcgtgacaccgatggcgtcgcgggcagccatgaagctgcttgcgcggtcgccatggccatggcgggtgtccagcagcacgaaggagaagacgccgtccagcatgtccacgaactcttctccatgctcctcgtacaggtgcgcgatgacctcgcagtcgctgccggtcctgaatctgtggccggcggtggagagcctgctcctgaggtcctggtggttgtagacctcgccgttgacggcgacgaccaccgactggtcctcgttgtagaggggctggtcgccggaggccgggtcgatgatggcgaggcgctggtgggagaggtagcagtcgcccatctgacggaggccgctccagtcggggccacggtgcttgagccgccgcgacagctccagcacccggcctctcttgttcttgccatgactcgcctcgccaagcacagcaagtatgccgcacatcctcactgcactgcactggacgatcagctagctaccttagcttgtgcttgtgtcttgggtgcacaggttgtggctgccctgctcctcctcctgggggtaactaaaggaactcatgtgtggtgaattgcctccagagaaggcaatggatgtatacttgcgctgtatatctgtgtgtattaaaagtgtggagcaacatcatgtgctctcctatgtccatatctattctactttgtaatgaaattttaaacgtaccatctacttcttgtaagcagcactgcatcatacaataagatacc

SEQ ID NO: 14550 - DNA, 385 bp, Sorghum bicolor
  Clone ID: LIB5121-004-A1-PF1-E7
ctctatcaagtcatcagtgtccttccagatcccaccgcgcgtctctgcgggcgacacgcgcacacgccacagctcgtcgcgatcgtcaacggtcgagccatcgcccatgggagggaggcacgaggcggaggcggacggcggaaaggccgggggctactcctcctccggcctcccgccgtcggaggcgccgcacctgcagggccagccgtcgcaggagtacgggtacggcacgttccagggccctcggcaacctcccgtcgggttcccgcagcctgctccgcctcccgggttcggcggcggcggctatcacaaccagcagaagccgtacgcgcccgcggagccctactacgctcaggggtaccaggccgcgccccgctatggccct

SEQ ID NO: 14551 - DNA, 1580 bp, Sorghum bicolor
  Clone ID: SORBI-28MAY03-CLUS360_1
gccgggacttgcacttggttggagcttcttctcctttttttttttccattgctcctctgcttcgcgtcgcctcgcgtctcttctctccctcccccggcaggcaaacagacacagcagagcgcaggaacacagagcgagagagatcaatcgaggccatggagggctacgaccgcgagttctggcagttcagcgacacgctgcgcctgcagacggccgccttctccggcctatccctcggcgactccatctggtcccccgccaccggcggcgcccccgccggggctgaccggcccaacaacagcaccaccgacctcttctccgcatccccatcgcccagccacaccaccgccgcgacgaacgtcgccaccgtgggccccacactcaatctcaacgatggcggggcaggccacatcggctccgctaagctcgccttcggctgcaccaaggccgaccgctacgacaacctccccgccacccccgagaagacagcgccgccgtccgggtaaaaaaaaaacttaaacgtaaacgccggcaacgccaagaacaacaacaacaacaacggcagtgcactggcgttcaacacaatgggtatctacggctacaacacgaacgacggcaacatcagcaacaacagcagcagcggggaggtgaagagctacttcaacatctgtattgttcgggtctcgagcaacaacagccacgggcacgggcacgccggcggcaagaagggaggggagtacggcaataagaagaagcacggcaagaacgagggcaacaacggcggtggcggagcgggggccacggacaagcggttcaagacgctgccggcgtcggaggcgctgccgcgggggcaggccatcggcgggtacatcttcgtctgcaacaacgacaccatggacgagaacctcaggagggagctcttcgggctgccgtccaggtacagggactcggtgcgtgccatccgccctgggctgcccctcttcctctacaactactccacccaccaactccacggcatcttcgaggccgtgagctttggcgggaccaacatcgacccgacggcgtgggaggacaagaagtgccccggcgagtcgcgcttccctgcacaggtgcgggtagcaacgcggaagatctacgaccccctggaggaggacgccttccgccccatcctccaccactacgacgggcccaagttccggctcgagctctccgtcaccgaggccctcgcactcctcgacatcttcgccgacaaggacgacgcctgatcctagatcctcctcatcggatcgtcagggactcgaggcttggaacttggatgaaccaacaataatggatggacatgtatcccgtcctacgagacgggagtatacacaccaccacggtgtagtagtagtatattaataattaatataatatatccacctttgtttgatgttatgggctatgtatgaggcacgcgtccaattgttttgtttttataacacttgtgcgatgattgcagaggactagccctcgtttttgtaagatatactatgatatctgtattgttcgggtctaactgacatgtataaacatctgtg

SEQ ID NO: 14552 - DNA, 902 bp, Sorghum bicolor
  Clone ID: SORBI-28MAY03-CLUS32730_1
cagccccgcaaacaacggtgaggacgtgttggggcagccactcccggagccggacctggaggcccttcttccagaggggttcttggagaggaccagggacagagggcttgtgctcaagtcctgggcaccacaagtggatgtgctagggcatagagccaccggcgcatttgttacgcactgtgggtggaactcgacgctggagggcatcatggcagggttgccactgctgtgctggccactgtatgcggagcagaggatgaacaaggtgtttattgtggaagagatgaagctcggggtggaaatgaatggctacgatgaaggaatggtgaaggcagaggaggtggagacgaaggttaagtgggtgatggagtctcaaggtgggcgagcactcagagatacaatggtggaggtaaaagatagagcggtcaaggcactcaaagaaggcggctcatctcatgatgcttttgttgaattcgtgaagtgaaggatatcgatagcatggctcatcttcatccctaagggaggctcatcttaggacacgacatgttcgattcctcgaataattcaaggttcacaaagacattaggcaatctgtaatagcataagtcaaccagtatcgcttacatgacatgtactgcattctatcttataggtcatacatctgaggttctttttatttcacatattctctctcatgtgacccactagtcgctagttttgtacgtgtacaagagaaacataggagaggttttcccttcatgcattagagagcataaaaagtttctcttctcttctcactctagtataaaggtttctagcctctaggctctctccaccgtgtgtcttagagctagtcatcagagaaattcttattgatgtgattaggagaatatgatagctgg

SEQ ID NO: 14553 - DNA, 1218 bp, Sorghum bicolor
  Clone ID: SORBI-28MAY03-CLUS3254_1
gcacgaggaaggcctcaactgccatcgttctccaggtcacgatattgctatattcgcatgtttggtcaaaactaattttggtttaaattttgtttcgtcggtctaggccgtgccttacttcactctctgcaatgatgagatgtaagcgggatgctgagatttctaccagggcatcatctctctacactttggttgacttacatggtaaaacaacgtgattatgcaccaacttactagtcatctttcttgacgcttatttttttcgcaggccgataaggacttgcagacttggattgctagagacgatgaacaaggtcagaagatgtggagagtcaaccaacgtatagtgaagcttatagctgagcttatgaggaaccatgacagccctgaagctttggtgatacttgctagtgcctctgaccttctacttcgtgctactgatggaatgcttgttgatggggaagcttgtactttgccacaacttgagcttctcgaagtaactgctcgagcagtgcatcttattattgaatggggagattcaggtttatcggttgctgatggcctttgtaatctgctaaagtgccgtctatcaaccaccatccgctgcctttctcacccaagtgcacacgtccgtgcgctcagcatgtccgtcctccgtgacatcctgaacaacggatccatgaaccccagcaagatcatccaaggggaacagcagcggaatggcatccagaacccgtcctaccggtgcctggccgcaggcatcatcaactggcaagctgacgttgagaggtgcatagaatgggaagcccacagccgccgtgccaccgggctgacgctcgccttcctcagtgcggcggcgaaggagctcggctgccctctcccctgctgacaaggccagtcccggatctgacatcggaggccacttgacggccagtgctggcagcagctgcatgcagggccggcgagtaggacgctaatctctcgatcaaggacgactcgccggtttgttcacacgatatgtgattaagctgatattagatggggtttccaaagcatatacgggacttgctcccattgtgcgatttcatttcaacctgacgtcagatgttgtacaagcttatttaactgcttgagttgtacgtaacttgtatacttgtaacttcgtttaatatggttactgaagaagcaaaacattatcttttcctttttatacttgtt

SEQ ID NO: 14554 - DNA, 374 bp, Sorghum bicolor
  Clone ID: LIB3476-057-P1-K1-A8
ccctgaagccatcatcagttggtacctcatggagctatagctcaaatgaaatagttgcagcagctatggttgccgctcatgtttctgagttgtttcgtcggtctaggccgtgccttacttcactctctgcaatgatgagatgtaagcgggatgctgagatttctaccagggcatcatccctctaccatttgattgacttacatggtaaaacagtgtcctccattgtgaacaaagccgagcctcttgaagctcacctgacccttacaccagtaaagaaggataatcaacatcgctgtgaggaaaacaataccagctcaatcgatagtgtaagttggaaaacaagatggttcaacatacataagaaaaatggtctc

SEQ ID NO: 14555 - DNA, 352 bp, Sorghum bicolor
  Clone ID: LIB3476-011-P1-K1-C6
cccacgcgtccggaaaaatggtttctcaagaccactcttgaaatgtgcagaagaggttctactgaatggcgatgttgcaagtacatctgggaaatccattgcaagcttacaggtggaagcatctgatttggcaaacttccttaccatggatcggaatggggggtaccgaggttcacaaactctcttaagatctgtattatctgagaaacaagagctgtgcttctctgttgtctcattgctctggcagaagctcatagcttctcccgaaatgcagatgtctgcagaaagtacatcagctcaccaaggaattggaggaaggttgtggatgcaacttttgtgatgcgtttcagcc

SEQ ID NO: 14556 - DNA, 1856 bp, Sorghum bicolor
  Clone ID: SORBI-28MAY03-CLUS4209_1
gcacgaggcccgaatcgtggagaggaaaccctagccccccgccgcgcccggggcccaaccctatcctgtccgccgccgccgcccgtggcttcaagttggccccgaatcgtggagaggaaaccctagccccccgccgcagccgtcgccgccccaatcccccacctacttcacgcgctccgttcgacagatccatacatgatgggagaagccaaggagaacgacgtctacgaagaggagctcctggactacgaggaggacgatgacaagacggtcgatggctccgccgccaagcccactggagaggtcgcgaagaagggctacgtcgggatccacagttccggtttcagagacttcctgctcaagccagagctgcttcgtgctattcaggattgcggttttgaacatccttccgaagtgcaacacgagtgcatccctcaagccattcttggaatggatgtcatctgtcaagctaaatctgggatggggaaaactgctgtttttgtcctttcatccctccaacaaattgaccctgttgcgggtcaggtagcagcacttgtactgtgccacactagggaactggcttaccagatatgtcacgaatttgagaggttcagcaaatatctccctgaagttaaagttgctgtcttctatggaggtgttcacatcaggaagcataaagatttgttgaagaatgaatgccctcatattgtggtcggcacgcctggaaggatacttgctcttgccagggataaggatctctccctgaagaatgtgaggcacttcattcttgatgaatgtgacaagatgcttgaatcactagacatgcggagagacgttcaggagatcttcaaaatgactcctcatgataagcaagtcatgatgttttccgcaactctcagcaaggagattcgtcctgtatgcaagaaatttatgcaagatccgatggaaatatatgttgatgatgaggcaaagttgaccctccatggtcttgtacagcactatataaaacttagcgaggctgagaagaaccggaaactgaatgatctcttggatgctctagatttcaaccaagttgtgatatttgtgaagagtgttagcagagctgccgaactgaataagttgctttgtgagtgcaacttcccatcaatctgcattcattctggaatgacccaggaagaaaggctaaccagatataagaacttcaaggagggtcacaagagaattcttgtggctacagatttagttggcaggggcattgacattgagcgtgtcaacattgtgataaactatgacatgccagactcagctgatacatatttgcacagggttggaagggctggtcgatttggcacgaagggacttgcaattacctttgtttcctctgcttcggattctgatgttcttaaccaagtgcaagaaaggtttgaggtagacataaaggaattgcctgagcaaattgacacttccacctacatgccatcataagaagagccgccaatgctgcaatgcattctcactgtgcttcaactgaggataatagagcaggataggggagtcggcagtttggagtactgccgtcggttacttttggaactgtatgcgatctggaggatttgttttgcctcctttgtacttttaaaaaaaggcagtcaggatgatctgtattttaagacaatgctgtctgtttgggttttgcctacctaacttgttctgttatgttaggattttgctttgtcaaaaattaattcacttattgtgctaagtgagcagcatatttgttgtttttataattgttcttgtttttataattgtggaagccaacgaaagggaggtcatgtcgttgctccgcagcaaaa

SEQ ID NO: 14557 - DNA, 1350 bp, Sorghum bicolor
  Clone ID: SORBI-28MAY03-CLUS5525_1
cagccagcggcgaccaggtagccggtcgctgccgatcaccgccgatcttcctttgggtgtcacggccgcttcgtccgagcacaacgctagagcgctccatccagcccctgcgctcccagccgggcccgacgaggacaagcccctgcgggcataagcagaaaccacacagcttgcactttaggagaccgacacagagagagagaaaggggaaaggttcgcttcttctcacagcttgttttcctttgggtgccatggccgatccggcggaggagaacgttgcctcgccgcctccgaccccggcggccccagccgagggcgtctcggacccgcccctgcagcctgctgctgacggcgcctcaacggagaaggtgtctgctccggcgccggaggtaaggtcccggggattcaggcttcttggagaggacaactccgtgcacaaggcccttgggggcggtaaaactgctgatgttctgttatggaaagacaagaaaacttctgctgttgtaatagggggtgcaactgtcatctgggttctgttcgaagtgcttgattaccatctcctgactctgatatcccatgcactgattggtgtgcttgccatcttattcctctggtccaaagctaccacctttatcaggaagagtccaccagatattccagtagtgcagatacctgaggatcttgttgtgaatgtttcacgagcattatgcaatgacatcaacagagcacttcacttattccatgagattgcaatggggcatgatctgaagaagtttttgtttgtgatcgtggggctgtgggttaactctgtatttggaagcagctgtgacttcctcaccttgatatacattgccgtcctgttgctccacacggtgccaatcttgtacgacaagtaccaggacaaggtggaccatttcgctggaagggcacacaccgaggccctcaagcagtacgaggtgctggatgccaaggtcctgagcaaaatccccaggggtccggtcaaatccaagaagcagaactaggatcaaccgcagattatgaatgctggtgtccttttgcgtgaatggcttttcgtttgcatggtatatacatgtaatctcgatcggtctgatggcttcagcttggttcttttgctactactttgtgctgattgtgggtgcatgctgctccctatctccgtgatgccagttgatgttactctagtcctatgtatgtcagtgtgtacgtgatacagatgttgggatggtacgtttacggtttatgctactgctgtagcttgtaaatttcagtggtaaataaataaacccttgttgctcaacaaaaaaaaaaaaaaaaaaaaaaaaaaaaaaa

SEQ ID NO: 14558 - DNA, 1132 bp, Sorghum bicolor
  Clone ID: SORBI-28MAY03-CLUS55634_1
gcacgaggcactttctcagcgagtggctaccaacgcagctccgatcccccttggtcgtcagctagctctcctgccagcgccaccatgtcgggtaacattgccttcggccggttcgatgactccttcagcgcggcctccctaaaggcctacgtggccgagttcatctccaccctcgtcttcgtcttcgccggcgtcggttccgccatcgcatacaccaagttgacgggtggcgcgccgcttgaccccgccgggctgatcgccgtggcggtgtgccatgggttcggactgttcgtcgcggttgccatcggcgccaacatctctggcggccacgtcaaccccgccgttaccttcggcctcgccctcggcggccagatcaccatcctcaccggcatcttctactggatcgcccagctcctcggtgccatcgtcggtgccgtcctcgttcagtactctaccggtgtggcgaccccgacccacggcctgtccggcatcggcgcgttcgagggcgtcgtgatggagatcatcgtcaccttcggcctcgtctacactgtgtacgccaccgcggctgacccgaagaagggctccctcggcaccatcgctcccatcgccatcggcttcatcgtcggcgccaacatcctcgtagccgggcccttctccggcgggtccatgaacccggctcgctccttcggccccgccgtggccagcggcgacttcaccaacatctggatctactgggtcggcccgctcgtcggcggcggcctcgctggcatcgtgtaccggtacatctacatgtgcggcgaccacgcccccgtcgccagcagcggcttctaagtgccctgcctctgcctcagccgtcgccgtccccggttcctcttcctcaatcatagtgttgagacagcatgaagtgacggttaggctgcgatgaactcgcagcatttgtttggttcaggtgaaaggccccaaggcagtgtgcgcttggatgattggtccatggttctcaattatttgttccttcttttgtatcgtggtgagtgtgaagttagttggttttaagaaccagtgacttcgttgaataatttcaaataatttaattcagcttgttccttctgcggtactgtttagtttttttaat

SEQ ID NO: 14559 - DNA, 696 bp, Sorghum bicolor
  unsure (1)..(696): unsure at all n locations
  Clone ID: SORBI-28MAY03-CLUS5513_2
ggcggcgctcaggcggcggtcgggagtcctctcaccactccttcccctccaccccaacacccggcggcgtcgagcggcggcgatgacgacgagcctgaagaagaaccggaagaagcgcggtcacgtgtcggcggggcacggccgcatcggcaagcaccggaagcaccctggaggtcgcggtaacgccggaggcatgcaccaccaccgcatcctcttcgacaagtaccacccgggctacttcggcaaggtcggcatgcgctacttccacaagctccgcaacaagttctactgcccctcggtcaacgtcgagcggctctggtcgatggtgcccgccgacaaggtcgccgaggcggccggtggcgacaaggccccgctcctggacgtgacgcagttcggctacttcaaggtgctcggcaaggggatgctgccgcccaagcccatcgtcgtcaaggccaagctcatctccaaggtcgccgagaagaagatcaaggctgctggaggcgccgtcctgctcaccgcataggtcttctttttttgtatcttgtttcacctatctgtgctaagaaaatttctaaatttttcgtggatcatgtgttgtgagttatgagaccccaatttttgtgctcttggtaacgaatgcgaattcaactccctgaaatatttcagattaaaaaaaaaaaaaaaggcccctannnn

SEQ ID NO: 14560 - DNA, 816 bp, Sorghum bicolor
  unsure (1)..(816): unsure at all n locations
  Clone ID: SORBI-28MAY03-CLUS5513_1
gccgcggccggccgggcctccactccctgccccgcctccacttctcccctcccaggcgctgcccaggtaagtcggcggcgagcggcggcggcgatgacgacgcgcttcaagaagaaccgcaagaagcgcggccacgtgtccgccgggcacggccgtatcggcaagcaccggaagcacccgggaggtcgcggtaacgccggtggcatgcaccaccaccgcatcctcttcgacaagtaccatcctggttacttcggcaaggtcggcatgcgttacttccacaagctccgcaacaagttctactgccccgcggtcaacatcgagcgcctctggtccatggtgcccgccgacaaggcggctgaggccggcggcgacaaggccccgcagatcgatgtcacgcagttcggctacttcaaggtgctcgggaagggggtgctgccgcccaagcccatcgtggtcaaggccaagctcatctccaaggtcgccgagaagaagatcaaggccgccggcggcgccgtcgtgctcaccgcctaggtttcagtccttgttcgcctcttggttttgagatctatatctgaactagtagtgctttcctgtctcagctatttgtgttaagaagacctgtagtttttaaatctgtggctgctgcctgttgggacagtgctttatgaggattttgatgccagttcatatcaaatatttcagatatattaaagctatctgtgctaattgttctaaattcaactgtgcaattgatttatgatgcatgtgcaatcttcggtgttgtgaaacncaaaaaaaaaaaaataaaaaacaaaa

SEQ ID NO: 14561 - DNA, 2075 bp, Sorghum bicolor
  Clone ID: SORBI-28MAY03-CLUS164_1
ccacccgccgcgccggcccacgacgcggccgcacgtcgcgacccgtagccccacaggagcacaaacccctggactggaagctggaaggatcgggagcgccccaaaaaaaaccccccaagagccactcgctgctgcgctgcagttcccgcgatatataatataaccggcggtgtgtggctgacctcgcgtacgtagcccgcacggcgcacgcgctgcacgccgccccggcccgccgtccgcccacctcgacatcgccgccgccgccgccatggacccgtacaagcaccggccgtcgagcaccttcaacgccccgtactggaccaccaactccggcgcgcccgtatggaacaacgacaactccctcaccgtcggcgcacgaggtcccatcctgcttgaggactaccacctggtggagaagcttgccaacttcgaccgtgagcggatcccggagcgcgtggtgcacgcccgtggcgccagcgccaagggcttcttcgaggtgacccacgacatcacccacctgtcgtgcgccgacttcctgcgcgcccccggcgtgcagacccccgtgatcgtgcgcttctccacggtgatccacgagcgcgggagccccgagacgctgcgcgacccgcgcgggttcgccgtcaagttctacacccgggagggcaactgggacctggtgggcaacaacttccccgtcttcttcatccgcgacggcatgaagttcccggacatggtgcactcgctcaaaccaaaccccaagacgcacatccaggagaactggcgcatcctcgacttcttctcccaccacccggagagcctccacatgttcaccttcctcttcgacgacgtcggcatccccgccgactaccgccacatggacggctccggggtgcacacctacacgctcatcaaccgcgccggcaaggccacctacgtcaagttccactggcgccccacctgcggcgtcaggtcgctgctggacgacgaggccgtcgccgtcggcggcgccaaccacagccacgccaccaaggacctcaccgacgccatcgcggcggggaacttcccggagtggacgctctacatccagaccatggaccctgagcacgaggaccgcttcgacttcgacccgctggacgtgaccaagacgtggcccgaggacgtgttcccgctgcagcccgtggggcggatggtgctcaaccgcaacatcgacaacttcttcgccgagaacgagcagctggcattctgcccgggactcatcgtccctgggatctactactccgacgacaagctgctgcagaccaggatcttctcctactccgacacgcagcgccaccgcctgggaccaaactacctgctactcccggccaacgcgcccaagtgcgcacaccacaacaaccattacgacggcttcatgaacttcatgcaccgcgacgaggaggtggactacttcccctccaggtacgaccctgccaagaacgcgccgaggtacccaatcccggccgtccacatcaccggccgccgagacaagactgtgattgccaaggagaacaacttcaagcagcctggggagaggtaccgcgcaatggacccagccaggcaagagcgattcatcaagagatgggtcgatgcactctctgacccccgactcacccatgagatcaggagcatctggctctccaactggtctcaggccgacagatctctgggccagaagcttgcgagccgcctcagcgccaagccgagcatgtaagatcagaaaacagcgcaggggactgaactctgcttcgctcatggaagaaaggaagacagcctgaaaaagaatccctcttattgatcggcaacacccaacctgatgctccagtcattcttgcatgcatactgagtctcttctttgtataagaggacataacatatggttctgtctcatttctgtaccaatcaatcatcatcatgtaataatctgtacttgcagacgtgtctccacctgatactacactggattattgtaagtgcacctgcttgttgaattcaggacacatcatacaataaattatgacatgtctttgttaggattcttc

SEQ ID NO: 14562 - DNA, 1006 bp, Sorghum bicolor
  Clone ID: SORBI-28MAY03-CLUS1983_1
aacctgctgatggttatttacaacgagctagcatagcactccatccaatataacaatgaataattgtgtatttgccggtcctgatgaccgatcgcgatcgataaatcataagcagaagaactagaatagcttgatgtgtttctgcatgcatgtatctactcccacaaaagggatgtgcagtacgtgtgtggtggctacactacactagtaccacatcaagtacgcgctagctagctagttcattcgcccacatgtatggatggatcgatcttgctttgatgagctagctagctgaggccattttgctttgttcttgtgagatcagcctgacttgagtgtgtcgatggcatgcgctagctcctcgatcttggcgccggtcacctccttgacgaccttcccacccttgaggatcttgaacgttggcacaacctttattcccagctcctttgcaagcggcttgttgtcctggttgcagtcgagcttgaggaagacaacatccaggttcttctcagacatctcctggaacttgggagccatcactttgcaaggcccgcaccattcggtgtacatgtcgaggacgacgaccttgtcgccggcggcctcgacgatgggccagaaggtgtccttgttgacctccgtgacctgcccggtgacggcctcagctcccaccgaggtcgacgtctcgatcccgctcgacctcaccggcgcgaggactccagctcccctcgtctcggaggccgtcgtcgtcgtcgtcgccagcagcaggctcctcttctgctgggctcccgccgcccagctgctgctgctgccaaccgccaagaagacagccggccggcacgtcggcgccggcgaggaggccagcccgtgggacgaggagatggtgggtatgcgcagcgccattattggtcttgtccgtactcgctgctggtggtggtggacggatcggagagctagctgagggagtgatggtacagtccaatataaggccggctctttcccctcgtgc

SEQ ID NO: 14563 - DNA, 2076 bp, Sorghum bicolor
  Clone ID: SORBI-28MAY03-CLUS6040_1
ctgcccctttcggctcgccccctccgccgcccctccctgccgcctggacgtctaggacctgcccctgctcgcccccctcgctgccccccgccatggcccacgaggcgacggcgcagggcaatgcggcgttctcggccggccgcttcgaggaggcggcgcggcacttcacggacgccatcgcgctcgccccgggcaaccacgtcctctactccaaccggtcggcggcgctcgcctcgctccaccgctactccgatgcgctcgccgacgcgcacaagaccgtcgagctcaagcccgactgggccaagggctactcccgcctcggcgcggcgcacctcggtctccgtgacgccgcctgcgccgtcgcggcgcacgtgcccccccgcgcgctcgtccccggctgcgccggccgcggggcggggctcgtcggcgcttggatggcggccgccgccccccccgcacgagggccgtccggccccgacggcctcggccagatgttccagggccccgagctgtggagcaagatcgcgtccgaccccaccacgcgcgcctaccttagcgagcccgattttatgcagatgctgcgcgaggtgcagaggaatcccagcagcatcagtatgtacctctccgatccccggatgatgcaggtgctcagcctcatgcttaacgtcaagatccagagacccgaggcctccgaggcgccgcggtctactccatcgcagccgccgccgcagcagcagcagacgccgcctcctgagacaaaggcgagggaggtagagccggaaccggagccagagccaatggatttaactgatgaggaaaaggatcgcaaggagaagaaagctgctgctcagaaggagaaggagttaggtaacacagcttacaagaagaaggacttcgagacggcaatccagcattacaccaaagccttggaacttgacgatgaggatatttcctatctgactaaccgagcagcagtctacattgagatgggaaagtacgatgaatgcatcaaggattgcgataaggctgtggagaggggaagagagctccgtgctgatttcaagatgatttcaagggcactgacaagaaaaggaacagctctggtcaaacttgctaagacctctaaggattttgatattgccatcgagaccttccagaaggctctaactgagcatcggaacccagacactcttaaaaagttaaatgaggctgagagagcaaagaaagatttggagcaacaagagtattatgatccaaaattagcagatgaggagagagagaaaggtaacgagttcttcaaggagcaaaaatacccagaagcaataaaacactacacagaggctctcaggaggaacccaaaggatcctagggtttacagcaatagggccgcctgctacaccaagttaggagccatgcctgaaggtcttaaagacgcagagaagtgtcttgatctagaccccaccttcaccaaagggtatacaaggaaaggtgcaattcaattcttcatgaaagaatatgacaaggccatggaaacctaccaggctggcttgaagcatgacccaaacaacccggaactgcttgatggtgttaggaggtgtattgaacagatcaacaaggccaacagaggtgaaataagtcaggacgaattgcaagaaagacagaacaaagctatgcaagacccagagatccagaacattcttaccgaccctatcatgcgacaggtgctaattgatttccaggagaacccaagggcagcccaggagcacctgaagaaccccggagttatgcagaagattcagaagcttgtaagtgctgggatagttcaaatgagatgatcaagcacgatgcgattgtacctgcttgttcgtcccttgtgcttggctttgttagttcacatgccccccgggtcatatatatcctttaacaagcagcagcagcggcagaagaatgaacatgctggggggataatctttttagcagttggattgtaagtgcaattaacattgggattgttcgtgtttgtggcactgagtctaagtataggcaacgtcttgctttcttgatgctagactttaa

SEQ ID NO: 14564 - DNA, 855 bp, Sorghum bicolor
  Clone ID: SORBI-28MAY03-CLUS809_2
ctgacgtccgcgatcatgttccgcgccatcagcctcttgctgctggcatgcgccgccgaaggtgaagccgccgccgtcgtccacgccgtgccctcccccgccgtactcgccgtcgacgccgacgggcaagtgccccgtgaacacgctgaagctgctggcgtgcgtggacgcgttcaacggcctcgtgcacgccgtcatcgggccaaggccagcgcacctgctgccgctgtctcgggtggcgcctgacgcggcttgcttgacacataagcaaggctaggaggcggctccggcattggtgacaggcgacctcctcgtacggcgataccttttttttttcttttttttttttttttttttttttttccagcttcacgtgcccgtaattaagcccatactgatcatcatctgcatatgtgtaccactatgatgtatcatcattataccataatatcatcggcatgcatgcatcaatgcatatatatatgttggccgggttatcaaggccggtcttatagacttatatatatagtatacatatacatatgataaatcaatcaagttatacatgcatatatgttacacaaatatacatatctagctcattaagcatatgtagcttttcatacctggagcagtgggttacaacgttgtgcatttgtaatcatgtatcataaaccagtgtgagagttgtggcctcttgcggtagggccgcttgtagtgttttaagaaaacttatatgaataaagtgtgtgtaatatatatgatgcttttggtggtgtaatgttgacaaagcttgtcaactttcctagtaaaaaaaaaaaaaaagcggacgctgggcggacgctgggcggacgc

SEQ ID NO: 14565 - DNA, 1054 bp, Sorghum bicolor
  unsure (1)..(1054): unsure at all n locations
  Clone ID: SORBI-28MAY03-CLUS809_1
cttcattcagcgtccgcttcgctgtccgcccgtccgtccaccactcgcttcgctcgcaacctgagaagcaagttaattatctacccgcgccgcgccgcgcgccatggccacgaccacgaacaaccgccgcattgtggccctcctgctggccacactgctcgcgcaggccgcggcgtgcccctactgcccgacgccgacgccgccaccgccgccgccgccgccgaaggtgaagccgccgccgtcgtccacgccgtgccctcccccgccctactcgccgtcgacgccgacgggaaagtgccccgtgaacacgctgaagctgctggcgtgcgtggacgcgctcaacggcctcgtgcacgccgtcatcgggaccaaggccagcgacacctgctgcccgctgctctccggcgtggccgacctcgacgccgcgctctgcctctgcaccaccatcaaggccaaggcgctcagcgtcagcgtcgtgctccccgtcgccatctcggtgctcgtcaacgagtgcggcaagcacgtgccctccagcttcacgtgcccgtaattaagcccatactgatcatcatctgcatatgtgtaccactatgatgtatcatcattataccataatatcatcggcatgcatgcatcaatgcatatatatatgttggccgggttatcaaggccggtcttatagacttatatatatagtatacatatacatatgataaatcaatcaagttatacatgcatatatgttacacaaatatacatatctagctcattaagcatatgtagcttttcatacctggagcagtgggttacaacgttgtgcatttgtaatcatgtatcataaaccagtgtgagagttgtggcctcttgcggtagggccgcttgtagtgttttaagaaaacttatatgaataaagtgtgtgtaatatatatgatgcttttggtggtgtaatgttgacaaagcttgtcaactttcctagtatatacttctgtcaaaattaagtaagttccatgtttcactaaaaagnnaaagggcgacgcgtggtcgaccggaattc

SEQ ID NO: 14566 - DNA, 2236 bp, Sorghum bicolor
  Clone ID: SORBI-28MAY03-CLUS1297_1
gcctactgctctcttttcccctccctttcccggcacggggagcgacctccgccgccgccgccatgccgaagcactaccgccctgcgggtaagaagaaggaggggaatgcggcaaagtacatcacgaggaccaaggcggtcaactacctgcaagttagcctcgcaatcttcaggaagctatgcattctaaagggtgtctttccgcggcagccaaagaagaaggtggaagggaaccacaagacctactaccacacgaaggatattgcattccttgctcatgaccctttgatcgagaagttcagggagattaaggtccatcgaaggaaggttaaaaaggctgttgctaagaaaaacagggatctcgcagacaggctgttgaatcggccaccaacttacaaacttgataggcttgtccttgaaaggtatccaacatttgttgatgctcttcgtgacttggatgactgccttacaatggtgcatctgtttgcggcattacctgctgttgatggtgaacgcgttgaagtcaaacgaattcataactgccgcaggttaagccatgaatggcaagcatacatatcccgaactcattccctgaggaagacatttatttccgtcaagggcatatatttccaggctgaagttcaaggacaaaagatcacctggctaacccctcatgctcttcagcaagtattaaccgatgatgttgatttcaatgtgatgctctcttttctagaattctatgagactcttttaggatttgtgaacttcaagctctatcattcaataaatgtaaattatcctcctattctggatccacgtctggaagctttagctgctgagctctatgcattgtgccgatacatgtctgctggttccagaagaatgattgggaattcacaatctgacgaagtaatggaggataaggatgagaagagtaaagctgatggaataactgaggaagagaaggatgtgaagaataaagcaagctcaaaagcagatgaatctgagctcagattagcacagcttcaacatcagctcccaactaatgaacctggtgcactgatgaatcttgtagaagaatcaactgctgatgatgcagatgatgacgatactaaagaatgtaaaggtttatttaagaacttaaagttctacctgagtcgggaggtgcctagggagtctctattatttattatcccagcatttggagggactgtttcatgggaaggagaaggagctccatttaaagaagtagatgaagatatcacccaccagattgttgataggccgacacaaagccatgttttcctctccagggagtatgttcaaccgcagtgggtctttgattgtgtaaacgctcgtatcatattgccaacagaaggttatcttgttggaagagtacctccaccacatttgtctccttttgtggacaatgatgcagagggctacattcctgagtatgcagaaacaataaagaggctgcaagctgctgctcgcaatgaggtcttgcctcttcctggtattggtgatgaagatctagacaattcattggtagcagcaatgatggatcgaacagaatctaacgaagctgctgaaaagaagaggaagttggagatgctagagaagcaataccatgatgaactgaagatggaaattgacggtgttgctttctctagtctgtcaaataaggaagcaaataaatcaccagatgccaaagatgatactcagtcagatcacgaggcggatgccattaaacaagaggagaaggatgatgatgacattggtactgctctcatgtctcgcaagcagcaaggcctttataaagctatgaagatgggcaaagaaaagaaaaaagagaaaattgagctacttaagaagaggaaaaagaatgcggattctagtgcttcttccaagaagcggcactgatgctcagagttcgcttcatagcattggtgtggcatctctagtagaatgttgccatgatcatcttcgtgccaagtccctgttatgagtggttgtattttgatatctctcctatgtatgctgaagatgagcttaaggaatatgtaccaggaaacttgaattggaaaagttttgatccgtcgttattattgtgtatcaggaaacttgaacagataaattttgatctcctatgtattaagcatttagagtcgttattattatttttgcctggatatattgcttgtcttttttatatagaaaaggtacaagaatttttg

SEQ ID NO: 14567 - DNA, 2264 bp, Sorghum bicolor
  Clone ID: SORBI-28MAY03-CLUS14281_1
tctggggagcacgaggcttgagttccccttctcctacccttcacctccctagcgccgccgccagcaccgcgtccccaaccccaagcactccagcgcccccgaaccggatcgacgccatggtgtcggaggccagcaagaagaaggccgctcagaagaaggccgccgcggccgcgaagaggggaggcaaggccgcggtggcgtcctcatcgtcttcatctgcggccgcggccgccgataaggcggcgaacggcgtcgcggcgctcaaactatcagaccgcacctgcaccggggtcctcgcgtctcacccgctctcccgcgatatccacatagagtctctttctttaacattccatgggcatgaccttattgtggattctgagttggagctgaactatggaaggcgatacggtttgcttgggttgaatggctgtgggaaatctactcttctcacagcaataggctgcagagaacttcctatccctgaacacatggacatataccatctaagccatgagattgaagcttctgacatgtctgcactgcaagccgttgttacttgtgacgaagaaagagtaaagttggaaaaggaagctgaaattttggctgcacaggatgatggtggtggcgaagcactggatcgtgtttatgagcgtctagatgcaatggatgctggaactgcagaaaagcgagctgctgaaatattattcggtctgggttttaacaaagaaatgcaggcaaagaaaactaaagatttctctggaggttggcgtatgaggattgctttggcgagagcactgtttatgaatccaacaatccttttgcttgatgagccaacaaaccatctagatcttgaagcttgtgtctggttggaagagacactaaagaaatttgaccgcatacttgttgtcatatcacactctcaagattttctaaacggagtgtgcactaacattatccatatgcaaagcaagaagctcaagttatacaccggtaactacgatcagtatgttcaaactcgctccgagcttgaagagaatcaaatgaagcagtacaaatgggagcaggaacagattgcatcaatgaaggagtacattgctcgtttcggtcatggttctgcaaagcttgctcgccaggctcagagcaaagagaaaactcttgcaaagatggagcgaggtggtctcactgagaaggttgttagggacagagttctagtgttccggtttacagatgttggcaagcttcctccgcccgtgctgcagtttgttgaagtcaagtttgggtatacaccagataatctcatatacaagagtctggactttggtgttgatcttgactctagaatcgcattggttggtcccaatggggcagggaagagcactcttctgaagcttatgactggtgatcttgttccattagatggcatggttcggcgccataatcacctgcgcattgcacagtaccatcagcatctggcggagaagctggatctggacatgccagccctggcttacatgatgaaggaataccctgggactgaagaagagaagatgcgagctgctgttggcaggtttggcctgtcaggaaaggcgcaggtgatgccgatgaagaatctttctgatgggcaaaggagccgtgtcatctttgcatggctggcatataggcagccgcaactgctactgctcgatgagccgacaaaccatctggatattgagaccattgactccctggccgaggcactgaatgagtgggatggtggtttggttctagtgagccatgatttcaggctgatcaaccaggttgctcaagagatctgggtgtgtgagaatcaggcggtgacaaggtgggaaggtgatatcatggatttcaaggcacacttgaagagcaaggctggtttatctgattagaaggcttgtctagcaaccatgagctttttaactctgtatcacgaagtcctatttttccagtagcaaactatcggagatactgctattgtatcggattccttaagacatccatagcagccaccagccagagtaccttatactacctggaatgtttatttatatatttttttgaaatgctattatgtgttctgtaagttttgtagattttggaagtttggatttgtcaaagttactggattctatgatccttgtgaacatacaaacataaatttagtttcaaattcaactgaaaaataaaaaaaaaaagggcggccctcgtcgaaccccattttcatcgacatgaagtactgccctaacaaa

SEQ ID NO: 14568 - DNA, 2129 bp, Sorghum bicolor
  Clone ID: SORBI-28MAY03-CLUS15279_1
gcacgagggctcctcccgcccgtcaataagtaccgccccgctcgccacctccacttccgcagaggagacgccctgcactgcacgactcctccccatctaccactaccaacccatctatctaccacccctcgctcgcaatggcgctggccaccaactccgccgccgccgccgcagcagcagcggccgtatccggtggcgcgtcatcccagccgcgccgcgcggccgtgttcctcccgctgaagaggcgcaccatctccgccatccacgccgccgacccgtcaaagaacaacggacccgccgtccccgcggcggccgctgccaagtcttccgcctcggcggtggccacgccggagaagaagccggcggctccggggaagtgggcggtcgacagctggaaatcgaagaaggcgctgcagctccccgaatacccgaaccaggaggagctggacacggtgctcaagaccatcgaaacgttcccgccggtcgtgttcgccggagaggcgcgccacctcgaggagcgcatggcagaggctgccatgggccgcgccttcgtcctccagggcggcgactgcgccgagagcttcaaggagttccacgccaacaatatccgtgacaccttccgtattctgctccagatgggcgccgtgctcatgttcggtggtcaggtgccggtcgtcaaggtggggaggatggctggccagttcgccaagccaaggtccgaaccgttcgaggagagggatggtgttaagctgccgagctacaggggcgacaacgtcaacggcgatgacttcaccgagaagagccgcgtgccagacccgcagaggatgatccgcgcctacgcgcagtcggtggcgacgctcaacctgctccgcgcgttcgccacaggagggtatgctgccatgcagcgtgtcacacaatggaacctcgacttcatggatcacagcgagcaaggtgataggtaccgtgaattggcccatagggtggatgaggctcttgggttcatgactgcagcaggacttaccgttgaccacccgataatgacgactactgacttctggacctcgcacgagtgccttctgttaccctatgagcaggctcttacccgtgaggactccaccagtggccttttctatgattgttcagcccacatgttgtgggttggtgagcgcactcgtcaacttgatggagctcatgttgaattcctccgtggtgtggccaaccctcttggcataaaggtgagtgacaaaatgaatcccagtgacttggtgaagctgattgagattctgaacccgtcctgctgccccggaaggtgctccccttgtacaaggatgggggcagagaacatgagagtaaagttgcctcatctcatccgtgctgtccgcaatgctggattgattgtcacatggattactgatcctatgcatggaaacaccataaaggccccttgtggcttgaagactcgtcctttcgattccattctggctgaagtgcgcgcattcttcgacgtgcatgaccaagaaggaagtcacccaggaggtatccaccttgaaatgactgggcagaacgtgaccgagtgcattggtggatcacggactgtgacctttgacgacctgagcgaccgctaccacacccactgtgacccaagactgaacgcctcccagtccctggagcttgccttcatcattgcagagaggctcaggaagaggaggatgcggtcagggctcaacaacagcctgccgctgccaccactggctttctgaatggccaaagccgaacagagagggtagaaatagttgcagtgagtcgaaagaggtgatcggcgcctatttatttgttgatgttcggtgtggtggcctggtgggtgctcttggcacaagttacatgctggggagctataggaggtacttgttgtatcctggaagacagtagctagcattatgtgttgtaattgtatgctttcgtttcctgttttgggtgcgtgacttgccgacttagctgcttctggtgttttgaccttggtaaggagagaataaagagataatgggagtgcaatgtttgctgaactggtgctcaataaattgatccccttgatggttctttcttgttctcttctgcagtgagtgaaatgc

SEQ ID NO: 14569 - DNA, 688 bp, Sorghum bicolor
  Clone ID: SORBI-28MAY03-CLUS1124_2
tcgacccacgtccgaaagaagggagaagcatatagcaccagcggaacacgggaacggcgggggaagcaaacaactagaaattccccagctatgttccttgcgtgcggtttgatctcgtcgaggcccggccgaagttccccaatccgccatcgaattcgatggcggccaacgccgggaacaagatccgcaacgccaagctggttcttcttggagatgtgggtgctggcaaatctagcttggttcttcggtttgttaagggacagtttgttgaattccaggaatcaacaattggagcagctttcttttctcagaccttagcggtcaatgatgagactgttaagtttgaaatctgggatactgctgggcaggagaggtatcatagcttggcccccatgtactataggggtgccgctgccgccattgttgtctatgacatcacaaatccggcctcctttacccgtgccaaaaaatgggttcaagaacttcaagctcaaggaaatccgaatacaatagtggctcttgctggaaacaaggctgatatgctagatgcgaggcaggtgccagcagaggaagcaaagacgtatgcccaggagaatgggctcttcttcatggagacatctgctaaaagtgcaatcaatgtgaatgacatattttatgagattgccaagagattgctttcaggacaaca

SEQ ID NO: 14570 - DNA, 1785 bp, Sorghum bicolor
  Clone ID: SORBI-28MAY03-CLUS1124_1
gctcgaggggaatccctattatacgagtgtactgaatagacatgtaaatgaaacagttctgaactaatagaccaaaaactgaaacctttatcctatccaagaattgtacaccaccaatcaagtaattttccttccaacccatgatagtcacaacctccaaaccagagcctaatgaatcaatccgaatcatagtgcaaaatgaacaagaatttgctccccccctattcactgtcttcatccccgcgcgcaagcctcactctgtttatcgctccgctcctggacagccggtggcggcagcggacttgccgcagcagccgcagctgtggcagcagtggcaatccgtcaatggtgagactgttaagtttgaaatctgggatactgctgggcaggagaggtatcatagcttggcccccatgtactataggggtgccgctgccgccattgttgtctatgacatcacaaatccggcctcctttacccgtgccaaaaaatgggttcaagaacttcaagctcaaggaaatccgaatacaatagtggctcttgctggaaacaaggctgatatgctagatgcgaggcaagtgcctgcagaggaagcaaagacgtatgcccaggagaatgggctcttcttcatggagacatctgctaaaagtgcaatcaatgtgaatgacatattttatgagattgcaaagagattgcttcaaggacaacaggctccaagcccacaggctggaatggttctgaatcagagaccaaacgagaggatggtcagctcttcttcatgctgctcttgaagctgtgtttcaacctcatagtgctgttatgaaatgtatcagaggaggttaagcaaaatatcccatctcgcctgtgtggctgacttccaggctgatgtgctccccttctcctgctcctcgtttcttttcacatgtttgtcatgtaaatgccaatactagaatgtcactgcatggacagaagtgttaccaaagtgttgattgtgctcttatcgcacgtctgtgccgaggtatatcgcgcgcgggatgcagcgcgggagcaggtcggcgaggtggttccgcgcgttggtgagcggcgcctcgagcgcggcgcgcacggacgcggagatgagcccggcgaccgcgtcggcgcggaacgggtagatctcgaagcgcagggacgggaaggaggcggacacggcggcccggaggtcggcgacggccggcgcgccgccgccctccgcggcgaggaagtggaagaagagcgactccgggcaggaggcgtgcttgagcagcgagtagatggccgccatggagcccctgaggtagtgcgcgtcgagcgtcatggcgatgtgcaccaggcccgggtcgcagacccccgcgcccgccaccggggccgggcacccctccccgttcctgtactcgggcgcctcggcgaacctcggcagccccgccgccgctgtcgccgccggccccgatgcggccaataacgccaccagcaccagcccggcccacatcgccggggagggcgcacccatggccgccgccgccgaggggatcccccttggtccccgccccggccggctcaccgctcgccctcgccctcgcctcgggggcgtcggggggtcgggtccggttgtgtggtttccctccctggaagtggtcggcgtcgttggtgtatgcgcctgcgcgtaggtgtgcgggcgcgggtggcgtccgcgtccgctccgctccgctcgctggatccctcgacctcgagatggcaggcaggcaggcagcctgggctgggtcgatcggc

SEQ ID NO: 14571 - DNA, 1318 bp, Sorghum bicolor
  Clone ID: SORBI-28MAY03-CLUS17676_1
gccggccgggccgggataaatactcgacttcgtcacccttaaaaaaacacacaaaacaacgctcataaaccagtcctgcactttcactcaacaatcctcacctattagtctactcgcaggtcgccgccaattcctccttgagaaagtgagaaatggcatcaccccgtagttgctttcgcggcctgcagaagaacacgagccacgtcgcactagtgctggtgtccgtgctgctcctgagctcggcacgtctctccgtggccggcaggagcctgctggagctgtacaagccgccggccagcgcgctcctcacgtaccacaacggcgccgtgctgcagggccgcatcccggtgtccatcctctggtacggccgcttcacgccggcgcagaaggccgtggtcaccgacttcctccagtccctcaccaccgcctcgccgacgacgccgtccccgtccgtgtcgcagtggtggaacaccatcaaccagctgtacctgtccaaggcgcggacgagaggcaacggtgcgcgctctggcggcggcagcgcgcaggtggcgctcgtcggccagaccaccgacgaagggtgctcgctggggaagcgcctcacgctggctcagctcccgcggctggcggcgcgggcggggacgaagaagggcgggatcgcgctggtgctcaccgcgcaggacgtggccgtggacgggttctgcatgagccgctgcggtctgcacggctccgatgccagggccggaaccgcgtacatctgggtcggcaactccgccacgcagtgtcccggtcagtgcgcgtggccgttccaccagccgctgtacggaccccagacgccggcgctcgtgccgccgagcggcgacgtcggcgtggacggtatggtcatcaacatcgccagcatggtcgccggcacggtgaccaacccgttccgcgacgggttctaccagggcgacaaggacgcaccgctggaggccgccactgcctgcacaggggtctatggcagcggggcctaccccggtttcgcaggcaacctggcggtggaccgtacgtcgggggcgagttacaatgccaatggtgcaaatgggaggaagtacctgcttcccgctctgttcgaccctgcaacctctacgtgttcgactttggtgtgacgactaagctgtcagaattgtgtagtaacactgtgtatatatatagtatgagagtgagatataaggagtgtactgtactaagtgttgatatctggatatgtaccgtccacttttgaagatcgaaccgggggattgcagccagaaatgatgcaacaacgatactatcctcctcc

SEQ ID NO: 14572 - DNA, 1704 bp, Sorghum bicolor
  Clone ID: SORBI-28MAY03-CLUS19699_1
acacgagggggcacgtgggtgtagctagaggtcccactccagcagcaccagctcatctccgagccgactgctcctcctcctgtcccgctccgcgcgcacccactcgccggcggggcaggtcggggtgccgcccgcgtttgcctactccgcctcccgcggcgcggagccggcggatggggaccacgaggcgggacctgcggcgggcctcggcgacgaagccctcctacgcgaggcgcgccgcaacagcggcagccgcagcccagtccttgtgccttggcgccgacccggccgcgcgccgcttcgcggccgaaatgcccgcgttcacgggcacggacgccgcgctgtccgtaccctcggcgacctgcgccccaggactgtccgtcctagcgcagtgggctgtctggtgcttcgcgggattgccgcgggactcctccatcatccacgtcttcaagttaggcctgctctccacggcttgcagcggacacgccagcaacgtgtcagacaaagcttaccttcagaaccacgtcactacgtttgttggctccctgagagacccggctcgatgctttatgtaccccacgaccaggttgtatctgcttgggagaacacacatgccaattgtggtgcgatgtggtcgtctggagaatgctgagatttggttctctgtttgtccgtgacttgcgggtttgtgcttcacattgatggagctcgtatgttcaatacctctgtgccgctgggatgtcctgtacatgatcctgtataagctgccgactcagtttcgatatgcctatctaaagggttaggcgcgcccatcggatcagttattgttggttcaaaggccttcattgacaaggcctgatctccttcgaagaccctaggtggtggaatgagacaggttggagttctttgtgctgctgcttatgttgctgttcgcgacactgtgggaaagcttgcggatgatcacaggaaggcgaaagccttggcagagggcctgaagaaaattaaacagtttacagtggattcatcttcggttgagaccaatatggtgttcttcgatatcgtggatccacgcatttcaccgaacaagctatgccaagtcttggaacagcgcaatgtgcttgcaatgccagcaagttcaaaaagtgtcaggttcgtcgtccattaccaaatttcagatagcgatgttcaatatgcactgacatgtgtcgagaaagctgttgaagagctattgaagggcggtacaaagttggagcacttgacaaatggtactgtcaaaaacgcatattggcactagacgtcagcctggtgccctgcttgtttgtgatcaacgctagctgttaaaactcttctctattaatgaaataggcacactcctcgtttgcccgtttgttaaaaaaaaccgctagctgttaaattgtagccacacctttgctggatagttatagctgttcacccatcactcgcatgcgttcgttcttgtgttgtagtttaccttccgagaatttgcttgatccgtttccgcttcttggtaagagggatgcaacgaaatttgctcgagaagaagacagatgcactgtatgctttgtatgctgtatgcaccgagcaaaaacattgacatcgaaagttaaagacagagcattgccaatgcagaatatatgtgacccagataatactgttcaaaaaaaaaaaaaaaaaaggccccta

SEQ ID NO: 14573 - DNA, 791 bp, Sorghum bicolor
  Clone ID: SORBI-28MAY03-CLUS1694_1
tacaacacaccgcggaaaccatccacaggacacacagagccgagccacccaccatcgacagcacccagccgccggagcgcgagcttctttacacagcaggccggagaaacacaggcagccaaagccgccaccgcttttaccgaccgaccgaccgatcggtgttgccgccgcctgtcgggttaagcaaccaaccagaccaagccatgggattgccggtgatgaggagggagagggacgcggaggcggagctgaacctgccgccggggttccggttccaccccacagacgacgagctggtggagcactacctgtgccggaaagcggcggggcagcgcctcccggtgcccatcatcgcggaggtggacctatacaagttcgacccctgggacctgccggagcgcgcgctgttcggggtcagggagtggtacttcttcacgcccagggaccgcaagtacccaaacgggtcccgccccaaccgcgccgccggcaacgggtactggaaggccaccggcgccgacaagcccgtcgcgccgcggggccgcacgctcgggatcaagaaggcgctcgtcttctacgccggaaaggcgccgcgtggggtcaagacggactggatcatgcacgagtacaggctcgctgacgcaggccgcgcagccgcctccaagaagggatcgctcaggctggatgactgggtgctgtgccgcctgtacaataagaagaacgagtgggagaagatgcagctggggaaggagtccgccgccggcgtcggcaccgccaaggaggaggcgatggac

SEQ ID NO: 14574 - DNA, 1655 bp, Sorghum bicolor
  Clone ID: SORBI-28MAY03-CLUS4967_1
gccggccgggccggggataaaaagcctttctctctcttggtcagtgacatcacgaactcgtcgacggtagagagagagcaggctctccggcgatttgagaagaaacgggtagcgagagcgcgtgggtgtgtgtgagagagagcgcgaggaggagctgggacttggagactgcgcccggggggccagggtcacggaatcctaccactaccaaccctagcctccgttgatcgccgtctccggccatggcagggccggcgccggatcgggccgccctgactgtggggccgggcatggacatgccgatcatgcacgacagcgaccggtacgagctcgtgcgcgacatcggctccggcaacttcggcgttgcccgcctcatgcgcgaccgccgcaccagcgaactcgtcgccgtcaagtacatagagcgcggcgagaagatagatgagaatgtccagcgtgagataattaaccatagatcattgaaacaccctaacattattaggtttaaagaggttattttaacaccgacccaccttgctattgtcatggaatatgcctctggtggtgagctttttgagagaatatgtaagaacgtgcgattcagtgaagatgaggctcgctacttcttccagcagctcatttcaggagtaagctactgccattcaatgcaagtatgccaccgtgatctgaagctggagaacacacttctagatgggagtgatgctcctcgcttgaagatatgtgacttcggctattccaagtcatctgttcttcattcccagccgaagtccactgttggaacacctgcttatattgcacctgaagttctgttgaaaaaagaatacgatggcaagattgctgatgtttggtcatgtggtgtaaccctctatgtaatggttgttggtgcatatccttttgaagacccagaagagcctaagaacttccgcaagacaattcagcgcatcttgaacgttcagtacgcaattccagacaacgtgaacatatctccagagtgcaggcatctaatttcgaggatttttgttggagatcctgctatgcgaataacaatccctgaaatccggaatcatagttggttcctgaagaaccttcctgctgatctgatggatgatgatagcatgagcaaccaatatgaggagcctgaccagccaatgcagaccatggatcagatcatgcagattttgacagaggccaccataccacctgcctgttctcgcagtataaatgtcctagctgatggattggacatggacgacgacatggatgatcttgactctgactcagatcttgatgttgacagcagcggtgagattgtgtacgcaatgtgagtaaccatctcactagtcaaccaaagaaccaatcaggcatgggatgccctgatgttgtatactctggcaaagagctagcatccttttgtgaaaaatcttcctgtagtcttctcagcgaatcgcaacctgttctgtggaacacagatgtagtcaaactggggttactcagcttgtaaaactagcctcctcttgcttcctggttactgaggtttggatactcccgggttcgacctgtgtgttactgttaaatatgtacaagaaacttctactcatgttgatctgtcaatttggactcgggtagtggttttgctc

SEQ ID NO: 14575 - DNA, 1533 bp, Sorghum bicolor
  Clone ID: SORBI-28MAY03-CLUS3688_1
gccccgcacgaatgctcccctcccactcgctcgtcaattccacgcgaccgccagagcgttcagaaagcaccagcccccaaagccccacgagagagacgaatcttccgatctctcggcggcgatggcgctctccgaccgctcccgcgagtcgctcctcccgagcttcctctacagctcctcggcgcgctccttcgccgccacaggcgccgccgccgcgcgcctccctgtctcggccccggcgcctgccgcggctggagcaggaggccgcgtgccgttctcgatccaggcgcccagcgagaagatcgagatgtactcgccggccttctacgcagcctgcacagccggaggaatcgccagctgcgggctcacccacatggccgtcacgccgctcgacctcgtcaagtgcaacatgcagatcgatccagcgaaatacaagagtatctcatctggatttggtgtcctgttaaaggagcaaggggctaggggcttcttcaggggatgggtccctaccttgcttggttacagtgctcagggggcttgcaagtttggcttctatgagttctttaagaagtattactcggacattgcagggcctgagtatgcccagaagtacaagactctgatctaccttgcaggatccgcatctgctgaggtaattgctgatgtggctctctgcccttttgaagctgtgaaggtacgtgtgcagacacaacctggatttgctcgtgggttgagtgatgggctccccaaatttgtccgatctgagggtgctcttgggctctacaagggaattgttcctctctggggtcgtcagattccttatacaatgatgaagtttgcttcctttgagaccatcgttgagcttatctacaagcatgctgtgcctgttccgaagtctgagtgcagcaagactacccagttgggtattagctttgctggcggttacattgctggtgtcttctgtgctattgtgtctcacccggctgacaatcttgtgtctttcctgaacaatgccaagggtgctacagtgggcgatgctgttaagaagctgggtctctggggtcttttcactagaggacttcctcttcgtatcgtcatgattggtacccttactggtgctcagtggggaatttacgatgctttcaaagtgatggttggactcccaacaacgggaggacctgcaccagcagcggtggctgccccagcagcagaggctgaatcgaaagccagtgcttgatttttctgtattccctgagatcatatttggtggaggttggagttgtgtaattcactcgagagcttagttcccgaatcatttttttttcttaacggaaaatttgtccgtcgtccttatgatgagaggaactcattaaacaagtgaaataggtcttttttgcccccgggaaaagtttatgctggatgcataataatttgtaggacagcaatgctgttagagcgcaggttttggttacctccttactaagtcacatttcacattacgatgtttatggaagcgtgcacctcgtttgatgt

SEQ ID NO: 14576 - DNA, 1519 bp, Sorghum bicolor
  Clone ID: SORBI-28MAY03-CLUS7131_1
gcacgaggctcgcactccgaaatcacacaatgacgcaggccccccctcgacccccgcctccgtcctcgccgatcccccccacccccccggcccccccccaccccctgcccggccggctccccgggcgcgccggcccgcctgcccctccacgccgccccccccggccggcgcgcccgccgcggcggcggcagctgcgggcggcgggggggagcggggcggtgggcgagagcccctcggacggggatctggaccggcacatcccccagcggcgcggctgcgactacccgcccgacgccgaggtcaaggcgctctgcgagcaggccaaggccatcctcatggaggagtggaacgtgcagcccgtgcgctgccccgtcaccgtctgcggcgacatccacggccagttctacgacctcatcgagctcttccgcatcggcggcgacgctccctattccgaatccgtggtaacgggcgacaacgcaactacctctttatgttcggacgacgtcgaccgtggctactactcagtggagatgctttacagagatagaattacaatacttagaggaaatcatgagagcagacaaatcactcaagtgtatggcttctatgatgaatgcttaagaaaatatggaaatgcaaatgtatggaagtattttacagacttgtttgattattagtactttacagactttattgattatcaggtcctcacagctcttatagaaaactcgatcttatgcgtacatggtggtctgtctccatcactggatacattggataatatccgtgctcttgatcgcatacaagaggttccccatgaaggacctatgtgtgatcttttgtggtctgacccggatgaccgatgtgggtggggaatttcaccaaggggtgctggatacacatttggccaagatattgcacaacaattcaaccatacaaatgggctaagtcttatttcaagggctcatcaacttgtaatggaagggttcaattggtgccaggataagaacgttgtgactgtgttcagcgcgcctaactactgctaccgatgtgggaacatggctgccatccttgaaattggtgagaacatggatcagaacttcctccaattcgacccagctccgcggcaaatcgagccagacatgacgcgcaagaccccagactactttttgtaataagcatgttggcttcttttaacttctcagggtcagtagatcttctgtccgatgatatgggtaaatgtggcccgtcctgtacgtctcccaattcctttgtttgtagattttgttgcttctttctcgatctttataaaagatgggatgtggtaagtgcctggcgttgggtcttcccgtttctgccctacgtcgactttgtattatttgtagtcagtgaatggaagtcacagtagcaacgcccctgctatgtttttatttcggcttagggatgtgtcatccgcgtggctgaataaattctgtcagattttagtcgcggaatcccaatctgatttgctgtttcatct

SEQ ID NO: 14577 - DNA, 2109 bp, Sorghum bicolor
  Clone ID: SORBI-28MAY03-CLUS5752_1
tctcccccgcacgagggaacaacagagccgcaccgcacctccctcggcgcctccttcgagccccgcccaaccccgccccgccgcgccgcgtctcggcgtctccttcccattgcagccaacctctgttccgcgccgcgagcagcagcgccgccttctcacctccttcctccctccctctctctcgcctctcgggcggtccttccaaggagcccgctggtctcggcgccgccggcggtcgcgtgctggacgaacttttaagaaggggacatttgtggatgctctaatggagtctaaaggtggcaaaaagtctagtagtagtaatttcatgtacgaagctccccttggttacaagattgaggacgttcgcccagccggaggaatcaagaagttccagtctgctgcttattccaactgcgcccgcaagccatcctgatatcgcctcacatgcaattcgcagtagagtaggattttaattctgttttcttgttgtttcggtagttctcccttggctggctgcatcctctgcttgtgagattccaacttgtcttcaccatcctctccctttcccttcctctcccatcctctctttcttgcaacacatcatccaatggcgatgtcttcagcagattcttggggctcttctcccacctcccctattgggtttgagggctacgagaagcgcctcgagataacgttctctgatgcacctgtcttcgaggacccttgtggtcttggcctgcgcgccctctctcgtgagcagatcgactcgttcctggatcttgcacggtgcaccatagtgtcacagctctccaacaagaactttgactcatatgttctgtccgagtcgagcctctttgtgtatccccacaaggttgtcctcaagacctgtggaacgacaaagctgctgctctccattcctcgcatccttgagcttgctgcagggctgtcactgcctgttctttcagccaagtactctcgtgggactttcatcttccctggtgcgcagccagcgccgcaccgcagcttctcggaggaggtatctgtgctgaacggtttctttggtaacctcaagtctggtggcaatgcctacgtgatcggtgacacgttcaaacccaacaagaagtggcatgtctactatgccacagaggagcccgagcatcccatggtgacacttgagatgtgcatgacagggctggatgctaagaaagctgcagtgttcttcaagaactctgatgatggcagctgcacatcagctaaagagatgacaaagctctcagggatttctgagatcattcctgagatggagatttgtgactttgagttcgacccctgtgggtactcgatgaatggtgtctttggacctgctgcctccaccatccatgtgacacctgaggaaggtttcagctatgcaagctatgaagcgatgaacttcaaccctagctccctggtttacagtgatgtgatcaagagggtcctggcaggcttctctccttcggagttctcagttgccgttaccatctttggtggccgtggctttgccaaatcatgggcaaagggtgcagacgtcgattcctacatgtgcgatgatcttgtggagcaagagcttcctggtggaggtctgctgatgtaccagagctttactgctgttgcctctggcactgtgtcgccaaggtcgaccttggagatggatggctggagcagcgatggaatggagacggctacgaagagcgatgatttgtgtattggctgctgggatgtggcgaagaaggtggtgaagaaagatgtggacgcctgagtgaagctttgaggtttctgagacctcttggccctgttcttgtttcagttaagcagttggctgtgctaccggcaagatgtttcctttatatttttcctgctcaataagtgctctagatggtttgctgcgtctgccatagtgagctgcatattattgtttcgtgattttgtttctgctgccgatgcccttgtggggggaatgatcttgtaatgctcatattattgtttcatcattctgtttttgttgccgatgcacttgtggggagaaattatcttgtaataaaattgcctatttctacaatatatgtttttaag

SEQ ID NO: 14578 - DNA, 154 bp, Sorghum bicolor
  Clone ID: LIB3476-057-P1-K1-A2
agagaatctctccaccgtccagtgcccaaccaggacattgttgtcgaaatggcagcactcgcacatatgacattggtactccattcctcgcatccttgagcttgctgcagggctgtcactgcctgttctttcagccaagtactctcgtgggact

SEQ ID NO: 14579 - DNA, 2036 bp, Sorghum bicolor
  Clone ID: SORBI-28MAY03-CLUS7804_1
tactggtactcccgtctgcgctcgactctcttccgctccctcctcacacttgaagccctagctccgcgcagcccccaaccatggcgtcgatgatgcaaccgcagatcatcctgctcaaggagggcacggacacgtcgcaggggcgcgcgcaggtggtgagcaacatcaacgcgtgcacggcggtgggcgacaccgtgcggaccacgctggggccccgggggatggacaagctcatccacgacgacaagggcggagtcaccatctccaacgacggcgcaaccatcatgcgcctcctcgacatcgtgcaccccgccgccaagatccttgtcgacatcgccaagtcacaggactccgaggttggtgatgggacaactactgtggtgcttctagctgcagaattcttaaaggaagcaaaaccttatattgaggatggggtgcacccccacagtctaattcgcagctatagaactgcaggcaatatggcaatccaaagggttaaagagctagcagttagcatagaaggaaaaagccttgaagagaagaaaacattgctagccaagtgtgctgctacaacactctcttcaaaacttataggcggtgaaaaagaattctttgcttctatggttgtggatgctgtccttgccattggcaatgatgacaggcttaatcttatcgggattaagaaggttcctggaggtaccatgagagattcttttctggtgaatggtgttgcgttcaagaagacattttcgtatgctggatttgagcaacaaccaaagaagttcctgaacccgaagattcttttgttaaacattgaactagaattgaaatctgagaaggaaaatgcagagatcaggttatctgaccctctgcaataccaatcaattgttgatgctgaatggaacattatttatgataaactggataaatgtgtgaaaagtggagcaaagatagttctgtctcggctagctattggtgatcttgcaacacagtatttcgcagatcgagacattttctgcgccggccgtgtcactgaagaagatttgcaacgtgttgctgcagcaactggtggaactgttcaaacttctgtaaataatgtcatcgatgaggtacttggttcctgtgaggtattcgaggaaaagcaagtaggtaatgaaaggttcaacatatttagtggctgcccttctggtcagacagcaactattgtgctccgtggtggtgcagaccagttcattgaggaagctgaacggagtctccatgatgccatcatgattgtgaggagagcacttaagaactcaacagttgtgccgggtggcggtgctattgatatggaaataagcaagtatctcaggcagcatgcacggacaattgctgggaagtctcagttctttgtaaattcgtttgctaaagccctcgaggtcattcctcgtcaactttgtgataatgctggatttgatgctactgacgttctcaataagctcaggcagaaacatgcatctggtgaaggtgctaattatggtgtagacatcaacactggcggaattgctgattcctttgctaactttgtgtgggaacctgctgttgtaaagatcaatgctataaatgctgcaactgaagcatcctgccttattcttagcgttgacgaaacagtgaaaaacccaaagtccgaaagcgcacaaggtgaggcagcagctggcgcaatggctggtcgtggtggtggggcaatgcgtggacgtggtggcaggggcatgcgcaggcgatgaactgagccacgttgatcctgtaacattatgttttgatcgcctttgttggtcagatttttttgcctgtttgcgcttgcgcggtgctgttgtgtcgtactgcacatgtaatgtgagtttatggacacgcacttattattgtgtgcttttggttgggaagcagtagcagcctttttgtttcagaggagatgcgctaggcgtttatcattgtagctttcctgttgtgatatagtagtagacctgagcctttggttacaatttgtttggccccttctc

SEQ ID NO: 14580 - DNA, 2044 bp, Sorghum bicolor
  Clone ID: SORBI-28MAY03-CLUS6220_1
aggctcaggaagtaacacacgaaaaacttagaaatcataggtgaatatatcgttacaggattcaatggttcacacaaagatcatagaataggaacacctaaagcaatcatagaataggaacacctaaagctcccaagtgcttcttcgtacagggaaaaatatcagtagtactagcattcaggaaagcaaatactacatttgtttcttgggttggagaagcccagcacatggtctgatgatgaattgaacagaagcatataatgatatattgaacatccacactgctttgtccagctcattaactcagcgcctaccacccctttttttactcttcctccggctgcccttgtcatcagaatcactgtccgatgcagactcagattcagaagatgctgatgatgtgctgtccctcctgtgccttctcttcttctgcttccttcggtgttgcctcttcttgacctcagagtctgaggatctataacttgaactgcttccagcctagtctgcacggcccgtcaccgatgattcaggggcggagtcgaccaccgaagcaccactactattgcgatctgaatcagtcggcggccgacgcttcctcttacgctttcccgtctttctttcagctgtctccttcttctgctttgctatcatcaacttctgctccgcttcccgctcctttataatatcaggattctcgaattgataagaaactggtacgcttttcttcagcttgggattcttaagctgctgcgttcttgagggccgtgatatgtaaacccgctcgtttttgcactcatatgtccagtgaccatgctggaaacacttctggcattgggtatacgcgccaacagaagaagtttctgaagcattttggcttcacagtgcccagctttgcagccttctctgtactcatcagatacatctgtctcttggcttccttcctctcctgccagcggcttggtccctcttccttctgcccataggcattgacattgcgggcagcagcagccgcagctcgttcagcttgagccctgctcaatcccttggccactgataacgtggctgcctttattctgtccgcagcagcatgtggcttatcatcattcccagacatcttgattcacccagagagaacaagattatcccaaattggcaactcagccggagcgcagcggaacggaggccgccagatcgccgccgtgaactagggtttggcggtgcgggggtcggggacgagacgcaggccgcccggtcccggtctggactctggactcgcaggaggaagaggacgccacgaggcgttattgtcagatgagatattccagcctaaggttatttggtcccttgctgatgtacaggcaacatgtggaacacttggcttatctacagcaacagtgaaactgatagcaccagatggagaggagaaaataggatgttcagttggaacaggtccagttgatgcagcttacaaggctgttgaccaaataatccagattccaactgttctccgagaatatggtatgacttcagtcacagagggcattgacgctatcgcgacaactcgagtggttgtcactggagatgtgaccaacaactccaagcatgccttgactggtcaatctttcaaccgctccttcagtgggagcggggcagctatggacatcgttgtgtccagcgtcagagcttacctgagtgccctgaacaagatgtgcagctttgctggtgctgcgaaagccagcagcgaggtacctgagagcgcaagcgttcaacgcacagagtgagcttggcgctcctctttgttcccatgtgggcttggcgacgtaagagcttgagcaactgttatagagtgtatgtcgtttcagtaacaggctgttcaatattggggttttcccttgtcagtgtggagtgattgtgctgttctattttggaggatagtccctttagcttagaacatgcaggaaattttggccctatgtagtgtacaatttgtgccttatatgaaccatactttcaataatgaaataatattagggtccatccagcc

SEQ ID NO: 14581 - DNA, 500 bp, Sorghum bicolor
  Clone ID: LIB3478-020-P1-K1-B6
gcctgatgatattggtttgacacgtgcaaacgaatttggtattgttcttgggaaactcagtggaaggcatgctgtgagatctaagctagtggagcttggatatgaaatcggtgacaaggaatttgaggacttctttaaacgctacaaagaggttgcagagaagaaaaagcgtgtaactgatgaagacttagaagcgttattgtcagatgagatattccagcctaagcttatttggtcccttgctgatgtacaggcaacatgcggtacacttagtttatctacggcaacggtgaaattgataggaccagatggagaggagagaatagcatgttcagtcggaacaggtccagtcgatgcagcttacaaagctgttgaccaaataatccagattccaaccgttctacgagaatatagcatgacatcagtcacagaaggcattgacgcaattgcaacaacctcgagttgtggcactgggaatgtgagcatcaacgccaaacatg

SEQ ID NO: 14582 - DNA, 492 bp, Sorghum bicolor
  Clone ID: LIB3476-017-P1-K1-F10
agaggttgtcatggcaattaaatgtcgtggggagctcttagatggtctatatacgggaatcaattcccaacatattactttgacaagcaaaatggtacaagagcacagtggacttcatgtacaaccacataaagctattgttggtgccaatgcctttgctcatgaaagtggaattcatcaggatgggatgcttaagtacaagggaacatatgaaataatatcacctgatgatattggtttaacacgtgcgaatgaatttggtattgttcttgggaaactcagcggaaggcatgcagtgagatctaagctagtggagcttggatatgaaatcagtgacaaggaatttgaagatttctttaaacgctacaaagaggttgcagagaagaaaatgcgtgtaactgatgaagacaatagagcgttattgtcagatgagatattccagccctaaagtaattggtcccttgctgatgtacaagcaacatgtggaacact

SEQ ID NO: 14583 - DNA, 396 bp, Sorghum bicolor
  unsure (1)..(396): unsure at all n locations
  Clone ID: LIB3478-050-P1-K1-B1
caagatttgcagttttgctggcgccgtgaaagccagcagcgaggtacctgagatcgcaagcgttccgagcacagaatgagcttggtggcgttccttttgttcaagatttctggaaggatcagcccttcagcttaggacaggcttgtcttgggcctatgtagtgtacaatttctgtatctcatataccatactcgtggccagtttgtatatcatatataaaccatacaatctgtatttggaggtacttgccatttagaactctgtggccaaagaaagatgaggtcatttagaatgattcattcttttagcctgtaaacattatacattgaaaacctgagcagtgaattaaggatgcccaagnttgtaaaataaaaatatttattattattataatta

SEQ ID NO: 14584 - DNA, 1528 bp, Sorghum bicolor
  Clone ID: SORBI-28MAY03-CLUS127_1
gcacgaggcgcgaacctactatctcccgcgcgcgggcgccaccgccaccgccaccctcctcctcctcctcctcccggctctcgccctccgtctcgcccggcggaccccgccgagcgcatccgccgccatggcctccgacgcgaggctctccttaccgtgccgcctgccctcgctcctccctccgccggtgctgctgcgccggttgccccgcgccgccgccgccgcggcggcgtcaacctccccgcggtgccgcgtcgccagtacggcggcggcggcgcctgcccgcgcccgcggccggttccggcctcgcgcctccgaggttgaagggcagggcccggtgcagcagcagcagcaggtggaagatgaggtggtggacagcaacgtgctccagtactgcagcatcgaccgcaagaagaagaagaccatcggggagatggagcaggagtttctccaggcgctgcaggccttctattacgaccagaaggcgatcatgtccaacgaggagttcgataacctcaaggaggagctcatgtgggaaggaagcagcgttgtgatgttaagcgcagatgagcaaaagcttttggaagcctccatggcatatgtctctggcaaccccatcatgacggatcaagaattcgatgaactaaagctgagacttaagaaagaaggaagtgacattgtaacggaaggtccaagatgcagtctacggagtcgaaaggtctacagtgacttgactgttgactacttcaagatgttgctgctatatgttccagcagctgtggtagctctgacactattcttcttcttggatgatttgacgggatttgaaatcacacttcttcttgagttgccagagcctttcagtttcatcttcacatggtttgctgcactgcctttaatattttgggtagcacaggcattcaccaatgtcatagtgaaagactttctgattttgaagggcccatgtccaaactgtgggactgaaaatctttccttcttcgggaccattttatcagtgtctagcggtggttcaacaaacagtgtgaaatgtgcaagttgtggcactgtcttggagtatgactctgcatcccgattgattacactcccagaaccggctgaggcataagtaattaatggtggtttagatttcgctagcaggaaagacggcccacagattcctgatcgacagtacaaagcaagaccgtccttgaatcgggtgacaatcatgtcgtgatgtatgtttgctatgcgagtctatgtatatctttaaacaagtttagacatctatattatatagatttaacgaaatcgatatatgtatatatatgtgcatagagtgtacaaagaaaagtctttagctatgttccattttgtatgaactatcttggcatatgtatagctgtctgaagaacttgacgttctgtgcgatgttcagtaaagtaaaccaggttccatcgtaaaaatattccaaacaaatcaaaagggccgactctcggggaacccaaaaaacaatggtacttaatggagt

SEQ ID NO: 14585 - DNA, 472 bp, Sorghum bicolor
  Clone ID: LIB3478-012-P1-K1-G3
ctagaacctactatctcccgcgcgcgggcgccaccgccaccgccaccctcctcctcctcctcctcccggctctcgccctccgtctcgcccggcggaccccgccgagcgcatccgccgccatggcctccgacgcgaggctctccttaccgtgccgcctgccctcgctcctccctccgccggtgctgctgcgccggcggcgcctgcccgcgcccgcggccggttccggcctcgcgcctccgaggttgaagggcagggcccggtgcagcagcagcagcaggtggaagatgaggtggtggacagcaacgtgctccagtactgcagcatcgaccgcaagaagaagaagaccatcggggagatggagcaggaagttctccaggcgctgcaagccttctattacgaccagaaagcgatcatgttcaacgaggagttcgataacctcaaggaggagcttatgtgggaaggaagcaagcgt

SEQ ID NO: 14586 - DNA, 1337 bp, Sorghum bicolor
  Clone ID: SORBI-28MAY03-CLUS9432_1
acccggtccagcccgatcaggccccaccgtctccggcgcccccccgccgaccccgcggtccgctccgggggccgggatccgcccccaatccaccaaccgcaccgtgtccagcagccccctcaaaacccaccaaaacccacggtgctttcaggcagcgacgaaccggcggcgacccccacccgtccacccgccgccactccgtccagcgatggcgttccggctgagcaacaacctgatcgggatcctaaacttcatcaccttcctgctctcgatcccgatcctgggcgcggggatctggctgggccagcgcgcggacggcaccgagtgcgagcggtacctctccgctccggtcatcgcggtcggggtgttcctcctcgtggtctcgctcgcggggctcgtcggcgcctgctgccgcgtcacctggctgctctgggtctacctcctcgccatgttcgtcctcatcctcgtcctcttctgcttcaccgtcttcgccttcgtcgtcaccaataagggcgccggggaggccgtctccgggagagggtacaaggagtacaggcttggggattactccaactggctgcagaaaagggtcgagaacaccaagaactgggacaagatcaggagctgccttgaggattctaaggtctgtaagaaactgcaggacaagaacgagaccttcacgcagttcatatcttccgacctctcccccatcgagtctggctgctgcaagccccccaccatctgcggctacacctacgtcagcggcaccaactggacgacgcccgccaacgcgacggcggacccggactgccagacctggagcaactcggcgctctgctacaactgccagtcgtgcaaggccggcgtggtggccacggtgaagcgggactggaagcgcgtcgccatcgtctgcatcgtcttcctcgtcttcatcatcatcgtctactccgtcggctgctgcgccttcaggaacaaccgcagggacaacgcctaccgcggcggctggaagggcggatacgcctgatccaatccaccatcgtttggggttggagcagagctggggctcgatcggccgcgccgccctgtcaccatgcacgctcgctcagtgctctgctccctgtctcgtcgtggtcactgccgtagtacatgtttagtaggctcgtcgatgtagctctgtacaggtgatggagattattgttaccgccgactcttatcgtcttcttagttacattattatcctattatgatcagatcagctgtaggttttgtatacgctgttcattgattcgtcagactgctatttttcatatatatatatatggatgcctttattttcc

SEQ ID NO: 14587 - DNA, 775 bp, Sorghum bicolor
  Clone ID: LIB5052-012-A1-XP1-A6
gccggccgggctgcgatttcggttcagttgattcggtttatcaaaccgcaccgtgtccagcagccccctcaaaacccacggtgctttcaggcagcgacgaaccggcggcgacccccacccgtccacccgccgccactccgtccagcgatggcgttccggctgagcaacaacctgatcgggatcctaaacttcatcaccttcctgctctcgatcccgatcctgggcgcggggatctggctgggccagcgcgcggacggcaccgagtgcgagcggtacctctccgctccggtcatcgcggtcggggtgttcctcctcgtggtctcgctcgcggggctcgtcggcgcctgctgccgcgtcacctggctgctctgggtctacctcctcgccatgttcgtcctcatcctcgtcctcttctgcttcaccgtcttcgccttcgtcgtcaccaataagggcgccggggaggccgtctccgggagagggtacaaggagtacaggcttggggattactccaactggctgcagaaaagggtcgagaacaccaagaactgggacaagatcaggagctgccttgaggattctaaggtctgcaagaaactgcaggacaagaacgagaccttcacgcagttcatatcttccgacctctcccccatcgagtctggctgctgcaagccccccaccatctgcggctacacctacgtcagcggcacaaactggacgacgcccgccaacgcgacggcggacccggactgccagacctggagcaactcggcgctct

SEQ ID NO: 14588 - DNA, 862 bp, Sorghum bicolor
  Clone ID: SORBI-28MAY03-CLUS485_2
agtagaataagcaagttcgtagattgtcaggcgcctaataataataatagcattggttggttaattttgtgataggaaaaaacaaaaacaaaaacaaaaacaaagcagcggatatggttcactcgagagtgatatatatgcatgcatgttggttcagaacttcagatgcacgcgagctcctttgacaagccgaaggacttgccgacggcgttcttgcagacggccatggtcttgttgttggacttgttgtacttgatgtcgacgttgtggagctgcacgccctggcatggcaggttgtcggcgcagttgagcgtgatggcctcgggcgtgttggaggtgccgtggatgttcttgaagacgacgtcggtgacggccaccttggacgcgccggacctgacgcagatgttgttcgggcagtacttctggtcgatgatgatcgggtacgagacgttgtccatggtcacgtcctcgtacacgaacttggtgaccttgggcgacgacttggagtcctcgtacgacttgatgcgcaggccgttggtggtgcccaccagcgtgcaacctttcaccttcacgtcctccacgtccttctcgtccttgtacctccccaggctcccgacgctgatgccgtggccggggccgcacttgacgccgtcgatccggatcgtcttgctgccgggcccgatggagatgcagtcgtcgccgacgccgatggtggtgccgctgatggtcacgttctcagagtcccccatgtggattccgtccgtgttggggctgttccccggggccttcaccgtcaccttgtcgatcaacacgttcttgctcgcgaagatgttgaggtggaagaacttgctgttggccagcg

SEQ ID NO: 14589 - DNA, 808 bp, Sorghum bicolor
  Clone ID: SORBI-28MAY03-CLUS485_1
aggagataccacaacgaagagatattaaccatatagtgagttcttcatatctcagatcacagaaacacatagatccacattaagttccaaaactctcatcgaggcataaagcagttttcaagtaatttaaaactcctagcacataatcattgatagcaaaaactagagcgataaggaggaaaaggcggtacaaccaccatcagatccccgcgaagcgcctagtcgatctcctggagagaggcaccggtggcggcggcaccaccagcagcggcggcgacgtcgtcggcggtgaacttgcccttagccttgtcggcgttgcggccccgggccttgcggtcgaggagcgccttgcggtccttgtcgagcttcagcttggtgacgatcaccttcgaggggtggatgcccacgttgacggtggagccgttcaccttctcgcgggtgatcctctcgacgtggatgacccagcggcggcggtacacctgcacaaccttgccctcacggcccttgtaggtgccgcgcacgacctgcacctcgtcgtccttgcggatcgggatggagcgcacgttgtacttgtggcggagctccgtcgacagcgccgcggacatgagcacgcggcggacggaggacggggccgtgaagtgcgccttgcggcacttccggcgggagctcgtgacgcgggggttgcgcttcatggcggcggtggcggggttggacgctcctgcttacctgggaggccgcagcggcggcggctagggttctctgggtgggggagctggtggagcccggcccggccggctcgagcgccgca

SEQ ID NO: 14590 - DNA, 458 bp, Sorghum bicolor
  Clone ID: LIB5051-008-A1-XP1-B7
gccggccgggttgcgaagtacacgtgcgctccatcccgatccgcaaggacgacgaggtgcaggtcgtgcgcggcacctacaagggccgtgagggcaaggttgtgcaggtgtaccgccgccgctgggtcataaggaccgcaaggcgctcctcgaccgcaaggcccggggccgcaacgccgacaaggctaagggcaagttcaccgccgacgacgtcgccgccgctgctggtggtgccgccgccaccggtgcctctctccaggagatcgactaggcgcttcgcggggatctgatggtggttgtaccgccttttcctccttatcgctctagtttttgctatcaatgattatgtgctaggagttttaaattacttgaaaactgctttatgcctcgatgagagttttggaacttaatgtggatctatgtgtttctgtgaaaaaaaaaaaaaaaaaaggccccta

SEQ ID NO: 14591 - DNA, 399 bp, Sorghum bicolor
  Clone ID: LIB3480-013-P1-K1-D3
aagaacaccatttcccccattaagcgttttttttttttttaaagattccaaacgaaccatggtaaatgtttctaccaatcatacaaaatccaaacgcgcaatgaacgttaataaacattgtggaccgaaccaaatctataatgagaccacagagcacaagagacaggcaaggctgatgatcgatcgagcgggatgttgttggaagtactgcccgaacaacatatgcgtcaggtccggagcgtacaatgtggccgtcaccgacgtcgaatttaagaacattcacggaacctacaacacgcccgaggccatcacgctcaactgagccgacaacctgccatgccagggcgtgcagctccacaacgtggacatggagtacaacaagtccaacaacaagaccat

SEQ ID NO: 14592 - DNA, 1440 bp, Sorghum bicolor
  Clone ID: SORBI-28MAY03-CLUS15736_1
ccgccggggcccgtgctggcgcgcccctcccctccccccccccccgccccgccaccgctcaccctggacgcgcgcgggctggcggtcgtggcagcgccagggcgccgccaccaaccgctgctattctaagtctctgacacacacgcgcaccgcaggctccatcagatccaccactctagcagcaagcagctagcatcatggcacgcctcgccatcctgttggtgctcctggcgtcgtcgtcggcgctgtccgcggcgcagaaagccgcgacgaccaaggcgccggcgacggcgaaggccgcgccaggtccagcagcgtcgtcgtcgggcggcggcgcggcggacgcggcgccaccgacggacatcaacaaggcgctcaaggacgagcagttcagcgagttcaagcagctgctccacgacacgcgcgtggacacgcagatcaacgcgcagctgacggacagctacaacgggctgaccatcatggcgcccaccaacacggcgttcgacaagatgaaggccggcgtgctcaacgggctgtcgccgcaggagcagatccagatggtgctctactgcgtgctgccgcgcttctacagcctctccatgctcggcaccctcgacggcaaggtcaacacgcagggctccggccacgacgggccttacaagtacgacatcaagcggtcgggcaacaacgtcaacatgtccacgggcgtcaactggatgctgctgggcagccccgtcagcaaggaattcccgctcgccatctaccccgtcgacaaggtgccgctcccctacgagctgttcggccccaagccgcccacgccggcgcccgcgcccgcacccgcgccggccaagtccaagaccaagaagaagaagaagtccgcgggcatcgccgagccgcccaccgccgacgacgacacctctacctccgacgaccagaaggcggcggccgcgcccggcgttggcgcgcccaccaggtgggtcactgccgcgctctccgtgctcggcgccgctgtcctcggcggcggcctcttctaatgggaagaggaggaggaggatagaatcaatgcatcatcagatcacacggcggcgcgcggtacggcggtggcggtggcgcggtggtggcgtgtgatccatggcgatctcacctgcgccgtgcattgccatgcatcttgcacgcacggtcgatatgatcatagagttggtgtgcccggccgtacaatctcagcccattcatccatccattattgatccctgtaccccatccatgcatttgtgctgctgcgtgtgcgtgcgtttgtccaccatcggctttattctttctcctctctttttcttttcttctgggggatttttcttggtgatttgtatttgtaacttaatgtgatatacactagtagtgcttcttctttcatttcattggattggatcttgcattagcctc

SEQ ID NO: 14593 - DNA, 616 bp, Sorghum bicolor
  Clone ID: LIB3480-046-P1-K1-B4
gcgcaaagcgaagcgaacgaagcccagcaaggaaaccacacatgccccacctcgccgccactccccccacttcctccgccgccgccgccgtccccaccgcgcatcccacggccgcgggccgcgtcgcgttccggcgcccgtgggacacgccgcgcctgcgggtgcgcgcgcggggcgtccgtcgtgaggacggcggcggcgtgcgcacggaggatcaggagcaggagcggacgtcatcgcggacgttctacgacctgctcgggatctcggcggaggggagccccgatgaggtccgggcggcctacaggcggtggcgcggtggtggcgtgtgatccatggcgatctcacctgcgccgtgcattgccatgcatcttgcacgcacggtcgatatgatcatagagttggtgtgcccggccgtacaatctcagcccattcatccatccattattgatccctgtaccccatccatgcatttgtgctgctgcgtgtgcgtgcgtttgtccaccatcggctttattctttctcctctctttttcttttcttctgggggatttttcttggtgatttgtatttgtaacttaatgtgatatacactagtagtgcttcttctttcaaa

SEQ ID NO: 14594 - DNA, 2685 bp, Sorghum bicolor
  Clone ID: SORBI-28MAY03-CLUS3045_1
gcacgaggtgtttgtggatcataggtaagtaggtagtgtacgtaaaaacttctagaatttcgtatggatacattatcagtcgatcgcacatgggtacgaatgatcagcgttaaagaagtacagtacctatccagatgttcgttatggtcatgtcatgtgctatatgatttgatgtgttcttcacggaagggaggactgggaaagcatatatgaaaatgcaatttggtaaggggggaggacgaggcccagatgccaaaaaaagttacgagtacaaactcgagggtggcccgacctcggcggctatcgactgtcggccgcccttcccgcaccgcggtctgcggtttggccgcccctgcgggtccccgtcaaccatatcaaccgaatatccaattcaaagggcggggagcgtacgtgtaccaccaccgccgcccgtccaccgcccgtccaccgtttcccgtctccagcccacgggtaaaggcaagcaaacgagcggcgaggcggctagccgcagtacaaaatccggagggaactcgcaggaggcgaaaagcaaagcagatccgcctccccgacctcgaccggcgatcgccccttattgacttgtagcggaagccatggcgtcgccggcgctaatctccgacacggagcagtggaaggccctccaggcgcatgtcggcgcgattcagaagacgcacctgcgggacctgatggccgacgccgatcgatgcaaggcaatgacggctgagtatgaagggatctttctggattactcgaggcagcaggcgactggtgaaaccatcgagaagctgcttaaattggctgaggttgccaagctcaaggagaagattgagaagatgtttaaaggtgaaaagataaatagcacggagaacaggtcagtgcttcatgtagctctgagggctccaagagatgcagttataaacagtgatggggtgaatgtggtccctgaggtttggtctgttaaagataaaatcaaggagttttcggacactttcagaagtggatcatgggttggagcaactggaaaaccattgaccaatgttgtgtcagttggaataggtggtagctttcttggccctctatttgtgcatactgcgctccagactgatccagaagcagcagaatgtgcgaaaggccgacaactgagattccttgcaaatgttgatccagttgatgttgcacgaagcattaaagatttagatccagaaaccactctggtggtggttgtatcaaagacattcacaacagctgaaacaatgttaaatgctcgaactcttaaggagtggatcgtttcttctcttgggccacaggctgttgcaaaacatatgattgctgtcagtactaatcttaagcttgtgaaggagtttggaattgacccaaacaatgcttttgccttttgggactgggttggtggccgttatagtgtttgcagtgctgttggtgttctgccattatctcttcagtatggttttccaattgtccagaaatttttggagggagcttccagcattgacaaccacttcaactcatcttcatttgaggacgcgtgggctgtactccttggtttgttgagtgtgtggaatgtttcatttcttggttatccagctagagcaatattgccatattcccaggcacttgagaaattggcaccacatatacaacagcttagcatggagagcaacgggaagggtgtttccattgatggcattccactccccttcgagacgggtgaaattgattttggtgaacctggaactaatggccagcacagcttctatcaattaatccatcagggaagggtcatcccttgcgattttattggtgttgttaaaagtcagcagcctgtttacttgaaaggggaaactgtgagtaatcatgatgagcttatgtccaatttctttgcccagcctgatgcacttgcttatggaaagactcctgaacaattgcacagtgagaaagttccggaaaatcttatccctcataagacttttaagggcaaccggccatcactaagtttgcttttgcctacactatccgcatatgaggttggacagcttttatccatctatgagcaccgggttgcagttcagggcttcatatggggaattaactcgtttgatcagtggggagtggagctagggaagtcgcttgcttcccaagtgaggaaacagctgcatgaatcccgaatggaaggaaagcctgttgatggctttaaccacagtacttcaagtttgcttgcacgatatcttgctgtcaagccacccactccatatgacactaccgtgctaccgaaggtgtaatgtctcagatgtttgacatgctaattgctgagttctgacttggcaaggttgagcattaagtcttccttttgggagttgttacagccattttggcagtgctttagttttgaggttttgtatactccttgtaaaagaagagaaacaaatttttgggtgctttaccacatacccgtggaataaaacggatgttaaactcaactgcagttacaacaccctaatttggcttttgtctgtagttggatagcattatgctgtcgctgccgtgatttatgtgcttggtggcccgagtaccaacctcggttcttactctgtatgcaattcgcatcatgtacaactgagccgcgtgctaagagtgctttgcaatacacaa

SEQ ID NO: 14595 - DNA, 635 bp, Sorghum bicolor
  Clone ID: SORBI-28MAY03-CLUS1885_2
gccggccggtccgggaagcgctcttttcccctgttcccgaacattccatccggcgttccccaaccccaacccttcgagcacccgaggaagaaaagaagttaaaccatggggaagaggaagtcagctgctaagccgcctcctaagaagcggatggacaagcttgacactgtcttttcctgcccattctgcaatcatgggagcagtgttgagtgccgaattgacatgaagaatctgattggtgaagcttcttgtagaatctgtcaggaaaactttagcacaactgttaatgcactcacagagcctattgatatatatagtgagtggattgacgagtctgagcgtgtcaacactgttgaaggtgacgatgatgcgtgagcttgtcccatgcggatgaaacggttacctatacaactgtaatgtgacggcattctcgaatgtcatagcccacagtcagccatggcttgtaataacgtagtggctgactgatatgccagtaggcagctttatctagtacttaagagctccaaaaagtttgtagtatacatgtatggataaccttaaaagtggttatgtgtgtgcctatggaattaacgcttatcccagaaaacgaaaaaaaaaaaaaaaaaaggccccta

SEQ ID NO: 14596 - DNA, 728 bp, Sorghum bicolor
  Clone ID: SORBI-28MAY03-CLUS1885_1
gcggggtcctctgccgtgatccgtcaactcgcccaaccacaacccttcgagcacccgagaaagctaaaaagacggccgccggccgggccggggttcccgaccattccatccggcgttccccaaccccaacccttcgagcacccgaggaagaaaagaagttaaaccatggggaagaggaagtcagctgctaagccgcctcctaagaagcggatggacaagcttgacactgtcttttcctgcccattctgcaatcatgggagcagtgttgagtgccgaattgacatgaagaatctgattggtgaagcttcttgtagaatctgtcaggaaaactttagcacaactgttaatgcactcacagagcctattgatatatatagtgagtggattgacgagtgtgagcgtgtcaacactgttgaaggtgacgatgatgcgtgagcttgtcccatgcggatgaaacggttacctatacaactgtaatgtgacggcattctcgaatgtcatagcccacagtcagccatggcttgtaataacgtagtggctgactgatatgccagtaggcagctttatctagtacttaagagctccaaaaagtttgtagtatacatgtatggataaccttaaaagtggttatgtgtgtgcctatggaattaacgcttatcccagatggtgtaacagcgtttttctgtgagattgttttcgagcaaaaaaaaaaaaaaaaaaggccccta

SEQ ID NO: 14597 - DNA, 258 bp, Sorghum bicolor
  Clone ID: LIB3480-038-P1-K1-H6
tccggaattcccacgcgtccgagacgaatctgattggtgaagcttcttgtcaattcggcactcaacactgctcccatgattgccgacatgacatgaagaatctgattggtgaagcttcttgtagaatctgtcaggaaaactttagcacaactgttaatgcactcacagagcctattgatatatatagtgagtggattgacgagtgtgagcgtgtcaacactggtgaaggtgacgaatatgcgtgagcttgtcccatgc

SEQ ID NO: 14598 - DNA, 2120 bp, Sorghum bicolor
  Clone ID: SORBI-28MAY03-CLUS622_1
ggctcgaaggatcttttttttggggggggtgtgtaggggcctttgttttttttttttttctgaatagaccgatcagatttggattattattagatgatgatgaaagcaggttaatataactcggaaaatagatctttcagtaatcaaggtattaacaacagcaaatgcagcgactacatcaaagtagccatgccaaggtccagaacaaataacagttgcaaaatgcaaatgctagctagttcttgggcgcattgctctccagctccttcctcagctgcagcgagaagtcatcattgacatcgtcatcatcccagtcatcctcccattgctgaagtgcttcattgccttcttccttgtcatcccactcttgatcgatctcaaactcctcgaactcgtcgtcgtcctcgagcaggtccatcttagcttcctccgtcacctcgggcttcgctggttccgccatcgggactcgcaacactggtggctgctcgtcgccggtgaagggctccaacccgaagatagagatccggaaacctggcgaacggcggcgctggcgccggcggtcgcgtagtcgtcgcagaactcacgcgaaggacacggggagaaccgcgatgcgtgggagactggcctggggaagccccggccgggccggctcttcggcggctctttcgagccctccaaactcactccactgcctcccctcccctcccctcccccacctccaccatggccacagcagctgcggccaccgccgcctccacctccctgctcgcgccggcggcgagcagcacggcgccgggggcctcgcccaacgcgctgttcttcccctcctccgtgccgtcgctgcgcgcctacccgcggctcctcctcgcgttccgccgccccgccgccgcggccgcccagggcgccgtgctcgaagaggaggaggtacaggccgaccagcggggccagtacgacgacgacgacgacgggtacgagggcgggcgcggccccgcgttcacggcccccacgcggccgcgcaccggcaaggccgcactaccgctcaagcgcgaccgcacgaggtccaagaggttcctcgagatacagaagctgagggagagcaagaaggactacgacgtgcccaccgccatctcgctgatgaagcagatgtccagcgccaagtttgtcgagtcggcggaggcgcacttccgcatgaacctcgaccccaagtacaatgaccagcagctccgggccacggtgaatttgcccaagggaacaggccagtcggtgaagattgcggttctcacacaaggtgagaagatagatgaagctagagctgcaggagcagatatcgtaggtggagaagatttgattgaacaaataaaaggaggatttatggagtttgacaaattgattgcatcacctgatatgatgcctaaggttgccggcttgggtaagattctaggaccaagagggctgatgcctaaccccaaagctggcactgtttctccaaacattactcaggctatcgaagagttcaagaaagggaaggttgaatacagagttgataaatcaggaattgtccatattccctttggcaaggttgactttccggaggaagatctcattgcaaacttcatggccgttgttcgctctgttgagaggaacaagccatctggtgctaaggggatatactggaaaacagcgtacttgtgctcatccatgggaccttctatcaagctaaacataaaagaaatgcttgattatggtttggactcatctgactagatgtgaccacaggcaccagttaagtcagattaactatctgccccttgcgacaaatgagcggagacatggttgtggggtatggcaaggaggtgcttaggtacagttttttcagttttacgggcacccatcatcagagcagctaaagtatgcccagatcgacaaagaggtggtcttgttggtcatgtatttatgagcaaattattcatggtttcatagatgtctgtctctgagacgtttgttgtaatgtttcatattctgtcaatagtcatccttgagcttaagccagcaatttattttcacctgtcattaacataagtacttaccgttcatgtttgtgttggcgagtcggcatgtat

SEQ ID NO: 14599 - DNA, 923 bp, Sorghum bicolor
  Clone ID: SORBI-28MAY03-CLUS66_1
gccggccgggccgggcgctcgaggccggccgggccgggatcaccaccactggtcttcattcagcctattaacttatatctatctactccagagcagacaagaactcgacaccatgaaggtgttgctcgttgccctcgctctcctggctctcgcggcgagcgccgcctccacgcttacaaccggcggctgcggctgccagacacctcatctaccaccaccgccggttcatctgccgccgccggtgcatctgccaccgccggtgcacctgccgccgccggttcacgtgccaccgccaccaccacaatgccacccacaccctactctgccgccccacccacatccatgccctacatacccgccgcatccaagcccgtgccacccagggcatcccggatcctgcggcgttggcggcggccccgtcactccgccaatcctgggccagtgcatcgagttcctgaggcatcagtgcagcccggcggcgacgccctactgctcgccacagtgccaggcgttgcggcagcagtgctgtcagcagctcaggcaggtggagccgctgcaccggtaccaggcgatcttcggcgtggtcctgcagtccatccagcagcagcagccgcaaggccagtcgtcaccgctcccggcgctgatggcggcgcaaatagcacagcaactgacggcgatgtgcggtctaggagtggggcagccaagtccctgcgcttcttgcagcccttttgccggtggtgtccactattaaagaaactatctatactgtaataatgttgtatagccgccggatagctagctagtttagtcattcagcggcgatgggtaataataaagtgtcatccatccatcaccatgggtggcaacgtgagcaatgacctgattgaacaaattgaaatgaaaagaagaaatatgttatatgt

SEQ ID NO: 14600 - DNA, 1858 bp, Sorghum bicolor
  Clone ID: SORBI-28MAY03-CLUS5091_1
aagatccaggcgcccttccgctgcagcgccgcctctcgccctccccgcgtcgtcgccctcgccccgctcaccgcgggccggcgtgcggtggagatcagtccttgctcgaactgactcgttcctttgctgcaagtacctactatcagccatgtttggacgcatgccaaggaagagcagtaacaataccaagtattacgaggttcttggtgtgtctaagaccgcaagtcaggatgagctaaagaaagcatacagaaaagctgccataaaaaaccatcctgataagggtggagaccctgagaagtttaaagagttgtctcaagcttatgatgttcttagcgacccagagaagagggagatctatgaccagtatggagaagatgcccttaaggagggaatgggaggcggcggcagcagtgatttccatagcccatttgacatttttgagcaactttttccgggttctagcggctttggtggtggctcaagaggacgcagacaaaagcgtggtgaagatgtggtacatactatgaaggtttccttagaagatctgtataacgggacaaccaagaaactatctttatcgcggagtgctttgtgctccaagtgtaagggtaaaggatccaagagtggggcatcaggaacttgccatggttgccgtggtgctggaatgaggacaatcacaagacagataggccctggcatgatccaacagatgaacactgtttgccctgaatgcaaaggatcaggcgagatcataagtgacaaggataaatgcccaagctgtaaaggaagcaaggtagtccaggagaagaaggtcttggaggttcatgtggagaaaggaatgcaacatagccaaaagattgtattccagggtcaagctgatgaagctcctgatacggttacaggagacattgtttttgtcttgcaacttaaagaccatccaaagtttaagaggaagtatgatgacttatatgttgagcacacaatctctctcactgaggcactgtgtggcttccagtttgttcttactcatcttgatggccggcagcttctgatcaaatctaaccctggggaggttattaaaccaggtcaacacaaggccattaatgacgagggtatgcctcagcatgggcgtcctttcatgaagggtcgtctgtttgttgaattcaacgtcgagtttcctgagcctggtgtgctctccactgcccagtgccgatcattggagaagatccttccaccgaaaccagggagccaactgtcagacatggagctggaccagtgtgaggagaccaccctgcatgatgtcaacatagaagaggagatgaggcgcaggcagcagcagaggcggcaggaggcctatgatgaggacgaggaggaggctggaccaagggtgcaatgtgcccagcagtaagatttgggtttatcagaacactgttgtcccaaaatttccgcaggatttatccatcccatcatctcgattcttttttggcaaaaatgtatccattctgaacttaaaactgtgtagttactagtgtctgtcagggaaaaaaaaagagagttcagaatgacatgttctttgtttgaacatctagccccaggattcaaccctggtcattcagctacaatttactgagcatgccagtgcaatgcgtactggcttagttaagctccacgtcgatgttattttgtgtacccgtctaaaaagtgtccagctcatggtgtgctactattttgatgttgtaaggaacattgagtttgttggtggtaatgatttgtgatgcaccgtggtggtccttggaagcggaaaaaaaaaaaaaaaaaaggcccctattaatgacagtttggctatttggaggtc

SEQ ID NO: 14601 - DNA, 3330 bp, Sorghum bicolor
  Clone ID: SORBI-28MAY03-CLUS86_1
gcacgagggcttcgccgccgccccgctctcccccctctccccgcctccgccgccgccgccgcccgccctcggacgccccgccactccccccgtccctcgcccgcccccccgcgccgggctcgcgcgagcctgcggtgcgcctctcccgccgggcggggaggtggcttttgagcccctccgtctcgctgccgcccccaccgccatgccggagcggcaccagtcgatcgacgcgcagctgcggctgctggcccccgggaaggtctccgaggacgacaagctcgtcgagtacgacgccctcctcgtcgaccgcttccttgacatcctccaggacctgcacggcccccacctgcgcgaattcgtccaggagtgctacgagctctcggcggagtacgagaacgaccgggatgaggctcggctcggcgagctcgggagcaagctcaccagcctgccgccgggggactccatcgtcgtcgccagttccttctcgcacatgctcaacctcgccaacctcgccgaggaagtgcaggtcgcgcagcgccgccggatcaagctcaagcgtggggacttcgccgacgaggcctccgcgccgacggagtcggacatcgaggagacgctcaagcgcctcgtctcgcagctcggcaagtcgcgggaggaggtcttcgacgcgctcaagaaccagaccgtcgacctcgtcttcaccgcccaccccacgcagtccgtcaggaggtctcttctccagaagcacggcaggatccgtaactgcctgaggcagctctatgccaaggacatcactgctgacgacaaacaggagcttgacgaggcacttcagagggagattcaagctgctttcagaactgatgaaatccgcagaacccctcccactcctcaagatgaaatgcgtgctggaatgagttacttccatgaaactatatggaagggtgtaccaaaattcttgcgccgtattgacactgctctgaaaaatattgggatcaatgaacgtctcccttacaatgctcctctcattcagttctcttcctggatgggtggtgatcgtgatggaaatcctagagtaacaccagaggttacacgggatgtatgcttgttggcaagaatgatggctgctaacctgtacttctctcagatcgaagatctaatgtttgagctctctatgtggcgctgcagtgatgaacttcggatccgtgcagatgaactacatcgctcttcaaaaagagctgcaaagcactatatagaattctggaagcaagttcctccaaatgaaccatatcgtgtcatacttggtgatgtcagggataaattgtactacacacgtgaacgttctcgtcacctattgtcatctggaatttctgagattccagaggaggcaacttttactaatgttgaacagtttctggaacctcttgagctctgctatagatcattatgtgcttgtggtgacaaacctatagctgacggaagtcttcttgatttcttgcgtcaagtatcaacttttgggcttgcccttgtgaagcttgacatcaggcaggaatctgatcgacacaccgatgttcttgattcaataacgacacatcttggaattggctcctatgctgaatggtccgaggagaaacgccaggattggctgttgtctgaactgaggggcaaacgtccattgtttggttctgatcttcctcagactgaagagactgctgatgttctaggcacgtttcatgtccttgcagagcttccagcagattgctttggcgcgtatatcatctcaatggcaactgccccatctgatgttctcgcggtcgagcttttgcagcgggagtgccatgtaaagcagccactgagagttgttccactctttgagaaactagcagatcttgaagcagctccagcggctgtagcacgactcttttcaattgactggtacatgaataggattaatggcaagcaggaggtcatgattggatattcagactctggcaaagatgccggccgtctctctgcagcatggcaaatgtataaagcacaagaagagctcatcaaggtggcaaagcattatggagtgaagttgacaatgtttcatggaagaggtggaacagttggcagaggaggtggtccaactcatctggccatattatctcagccaccagacacgatacatgggtcgcttcgtgtaacagttcaaggcgaagttattgagcactcctttggagaggagctcttgtgctttagaactttgcaacgctacactgcagctactcttgaacatggcatgcatcctccaatttcccccaagccagaatggcgtgctctgatggatgaaatggctgttgtagcaactaaagaatatcgatcaattgtcttccaagaaccacgcttcgttgaatacttcagatcggctacgcctgagactgaatatggtaggatgaatattggcagccgtccgtcaaagaggaagcctagcgggggaatagaatcgctccgtgcaattccatggatctttgcttggacacaaacaaggttccatctgcctgtttggcttggatttggtgcagcgatcaagcacatcatgcagaaggacatcaggaacatccatgtactgaaagaaatgtacaatgagtggccattcttcagggtcacccttgatttgcttgagatggttttcgccaagggagacccgggaattgcagctgtatatgacaaattgctagtggctgaggatttgcaatccttcggtgagcaactaaggaagaactatgaggagacaaaagagctcctccttcaggttgctggtcacaaggacgtccttgaaggcgatccttacctgaagcagcgtctgcggctgcgtgagtcctacatcaccactctgaacgtgtgccaggcctacaccctgaagcggatacgtgacccgagcttccaggtgagcccgcagccgcccctgtccaaggagttcaccgacgagagccagccggtggagctggtgcagctgaaccagcagagcgagtacgcgccaggcctggaggacacactgatcctgaccatgaagggcatcgctgccggcatgcagaataccggctaggccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaaaaaaaaaaaaaaaaaaaaa

SEQ ID NO: 14602 - DNA, 538 bp, Sorghum bicolor
  Clone ID: LIB3481-057-Q6-K1-D6
ccccgcgtccgcaaaaaactcctccttcaggttgctggtcacaaggacgtccttgaaggcgatccttacctgaagcagcgtctgcggctgcgtgagtcctacatcaccactctgaacgtgtgccaggcctacaccctgaagcggatacgtgacccgagcttccaggtgagcccgcagccgcccctgtccaaggagttcaccgacgagagccagccggtggagctggtgcagctgaaccagcagagcgagtacgcgccaggcctggaggacacactgatcctgaccatgaagggcatcgctgccggcatgcagaataccggctaggccagatcctcggtgtacaaataacccgtcttatcctatgagacgggcgcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattg

SEQ ID NO: 14603 - DNA, 2078 bp, Sorghum bicolor
  Clone ID: SORBI-28MAY03-CLUS8371_1
cccgcacgagagccagccaccctcacgcttcagtagccccttcgctcctccgaaatggcggcggccacctcctcctccacctacctcgccatcgcccgcaaaaccctaaaccccgccccctccgtaggcacagccgccgcctccgtctccttccccgccacgcagcccccatgcctcctcgccgcctccgcggaccgccgccgcgccgtggctgcgaaggtctcgtcgccgtcggttatcggcaccgccatgccatcgctcgacttcgagacctccgtcttcaagaaggagaaggtgtccctggccggccatgaggagtatattgtgaggggtgggagggatctgttcccgctgttgccggaggccttcaagggaatcaaacagatcggcgtaatcggctggggctcgcagggtcctgcacaagctcagaacttgagagactcacttgttgaggcaaaggcagacgttgttgttaagattggtctccggaaaggttctaaatcgtttgaagaagcccgagcagcggggttcactgaagagagtgggacactgggtgatatatgggagactgtatcaagcagtgatcttgttttgctgctgatatctgattctgctcaggctgataactacgagaaaattttctcacacatgaaaccaaacagtattcttggtttgtcacatggatttctccttggacatttgcaatctctgggtcttgatttccctaaaaacatcagcgtgattgctgtatgccccaagggaatgggtccatcagttagaagactttatgttcagggcaaagagattaatggtgctggtatcaatgctagctttgctgttcaccaggatgttgatggaagggcaacagatgtagctctagggtggtcagtagctctaggttctcctttcacatttgctactactctagagcaggagtaccggagtgatatttttggcgagcgaggtattttgcttggtgctgtccatggcatggtggaggctctttttaggagatacacagaacaaggaatggatgaggactcagcatataaaaatacagttgagagcatcactggaattatatcgaaaactatttcaaagaaggggatgcttgaagtgtataactctttgaccgaagaaggaaagaagcagtttattgaggcctacagcgcagcatattacccatgcatggacatattgtatgagtgctatgaagacgtttcttctggaagtgagattagaagtgtggtgttggctgggaggagattttatgagaaggaagggcttcctgctttccctatggggaatattgatcaaacacgtatgtggaaggtgggtgaaagggtccgttctaccaggccacaaggtgatcttggtccattgcatcccttcactgctggagtgtatgttgcactaatgatggctcagattgaggtcctaagaaagaagggccactcttactcggagatcattaatgagagcctgatcgagtctgtggactcgttgaacccgtttatgcatgctcgtggtgtggccttcatggttgataactgctccacaactgctcgcttgggatcaaggaagtgggcaccacgcttcgattacatcttgacccaacaagcgtttgtgaccgttgacaagaaagcaccaatcaaccaagacctcatcagcaacttcatgtctgaccctgttcacggtgccattgaagtctgcgctcagctgaggcccactgttgacatctcagtgactgctgatgcagatttcgtgcgtccggagcttcgacagtcttcataagctcgtatggatcttcagtgtgtcctgcaatggttagtttgtaagaactaatatgtgtgggcttttgaactcttagattacctgtattgctcctgtttgaggaccagacaagtaaactcttggggtgtagtactgttgtggtttgcaagaataagaataaatggttgataccaaatgtctgattcggtattccctttttgatgtgaatgctgtagggctcatagctgaggctcgggatctaagtcttattctgaatatcatgaacccaaggttcgggctcaagc

SEQ ID NO: 14604 - DNA, 1241 bp, Sorghum bicolor
  Clone ID: SORBI-28MAY03-CLUS751_1
tcacgaggctccaatcaacaaaaccgcgcgagcacgagggaatcctccccctcgcgctcgcctcaccgctgcctataaatccggcccacgcaccgggcgagcggcgacctcgttccccatcggctccaatcaacaaggtgacgcgagcacgagcacccatcccctcctccccttcttccccgtcgtcgcgtgccctcgccgcagccatctgccatggcggaccagctcaccgacgaccagatcgcggagttcaaggaggccttcagcctcttcgacaaggatggcgacggctgcatcaccaccaaggagcttggaactgtgatgcgctcccttggccagaaccctaccgaggcagagctgcaggacatgatcaatgaggttgatgctgatggcaatgggaccattgacttcccagagttcctgaacctgatggcaaggaagatgaaggacaccgactctgaggaggagctcaaggaggccttccgcgtctttgacaaggaccagaatggtttcatctcggctgctgagctccgccatgtcatgaccaacctcggcgagaagctgaccgacgaggaggtcgacgagatgatccgtgaggctgacgtcgatggcgacggccagatcaactatgaagagtttgttaaggttatgatggccaagtgaggagcggtccccatgaaataagtatatctataaattgaagcgagttatcatgcacaaaagctgtactttgtcatgtccctttgagtacgcatcagtatcatgcagttggtaatgtctgagtagtggtcggttttaggtggtgtagtcatgggaacgcgacatcagatacctggtttcttttgattgtgatgttatcttgcattattgcacacctgttggagcttttaggatttgttgaagctcgtatttttcaggggttttggttcttttgtgcgagtcttgtatcttgtgtgcgttgcattgcattgttgtgttatagcttatgctggcatgtggccttgttatgtgatctggtgtgtgtctggattctgggaattcttgccggagttcacgaggcttcgtagttcgtactgattcctgtcgcattcgtaaaactactgtatattccaaacaaagatcaagcactgcagcgccgatgtgtgtgatttgccaaatttgaatcaacaacatatgggtgatgtgtggacgttgattgtgtggtatagtgtatgatttgccaaattggaatcacaacagcc

SEQ ID NO: 14605 - DNA, 1986 bp, Sorghum bicolor
  Clone ID: SORBI-28MAY03-CLUS94_1
cgccccccgcgtgcgcccctccaaccacccccacctctgcgaagcgaagcgaagcagagctagaagcagctcacactccacactcgtctcgcccggccataccccaaggcaagcaggggcacgggcaattaacaatggccaccaccgccaccccgcagctcctcggcggcagcgtgccgcagcagtggcagacgtgcctcctggtgctcctccctgtgctgctggtgtcctactacctcctcaccagcaggagcaggaacaggagcaggagcggcaagctgggcggggcgccgcggctgccgccgggccctgcgcagctgccgatcctgggcaacctgcacctgctgggcccgctgccgcacaagaacctccgcgagctggcgcggcggtacggccccgtgatgcagctccgtctaggcaccgtgccgacggtggtggtgtccagcgcggaggcggcgcgggaggttctcaaggtgcacgacgtcgactgctgcagccggccggcgtcgcccggtcccaagcgcctctcctacgacctcaagaacgtcggcttcgcgccctacggcgagtactggcgcgagatgcgcaagctcttcgcgctcgagctcctcagcatgcgccgcgtcaaggccgcctgctacgcgcgcgagcaggagatggacaggctcgtcgccgacctcgaccgcgccgccgcgtccaaggcctccatcgtcctcaacgaccacgtcttcgccctcaccgacggcatcatcggcaccgtcgcgttcggcaacatctacgcctccaagcagttcgcgcacaaggagcgcttccagcacgtgctggacgacgccatggacatgatggccagcttctccgccgaggacttcttccccaacgccgccggccgcctcgccgaccgcctctcgggcttcctcgcccgccgcgagcgcatcttcaacgagctcgacgtcttcttcgagaaggtcatcgaccagcacatggacccggcgcgccccgtgccggacaacggcggcgacctcgtcgacgtcctcatcaacctgtgcaaggagcacgacggcacgctccgcttcaccagggaccacgtcaaggccatcgtcctcgacaccttcatcggcgccatcgacaccagctccgtcaccatcctgtgggccatgtcggagctgatgcggaagccgcaggtgctgaggaaggcgcaggccgaggtgcgggccgccgtgggcgacgacaagccgcgcgtcaactcggaagacgccgccaagatcccgtacctgaagatggtggtcaaggagacgctgcggctgcacccgccggcgacgctgctggtgccccgggagacgatgcgggacaccaccatctgcggctacgacgtgccggccaacacgcgcgtcttcgtcaacgcctgggccatcggcagggacccggcgagctggccggcgcccgacgagttcaacccggaccgcttcgtggggagcgacgtcgactactacggctcgcacttcgagctcataccgttcggggccggccgccggatctgcccgggactcaccatgggcgagaccaacgtcaccttcaccctcgccaacctgctctactgctacgactgggcgctgccgggggccatgaagccggaggacgtcagcatggaggagaccggagcgctcacgttccaccggaagacgccgcttgtggtggtgcccaccaaatacaagaaccgccgcgccgcctagtgagcagagccgagcagagcaatggtcgacgacgacgacgacgacgacgactgaataagcgtgccaaagtttagtactacgtacgtacgtacctactgctactacgtacagctagccaacagtcagagttggacactgttggagctatcatccggtcctcttctttttgtgatacgtatttgttatgtgttttagtgccgcaaagcacaaaataaataaagcccatcacagtcgcgagttaaaaaaaaaaaaaaaa

SEQ ID NO: 14606 - DNA, 1450 bp, Sorghum bicolor
  unsure (1)..(1450): unsure at all n locations
  Clone ID: SORBI-28MAY03-CLUS17434_1
ggcatcagtgtgcaccgacgctcatgcatccagatcactaaacggcagcagcagcagcaacagcacgagccccctgcagtagccatgacgactaagcgctgctgcctgctcgtcgccacgctcctcgcggcgctgctggtctcggtcacagcccgcctcgacgtcggcttctacaacaagacgtgcccctccgccgagagcatcgtgcagcagaccgtggccgccgcgttcggcaacagctccggcgtcgctcccgcgctcatccgcatgcacttccatgactgcttcgtcagaggctgcgacggctcggtgctgatcgactccacggccaacaacacggctgagaaggattcgcccgccaacaacccgagcctcaggttcttcgacgtggtcgaccgcgccaaggcgtccctggaggcgcagtgccccggcgtggtctcttgcgccgacatcctcgccttcgcggcgagggacagcgtcgtgctcaccggtggcctcggctaccaggtgccgtccggacgccgtgacggcagggtatccaatgccacccaggccacgaacaacctgcctccgccgtttttcaatgccacccaactggtagaccgcttcgcctccaagaacctcacccttgaggacatggttgtcctctccggtgcacacaccctcggtgtctcccactgcagcagcttcgccggacctgccaacctgggcgaccggctctacaacttcagcggctcagctgacgggattgatccggcgctgagcaaagcctacgcatttctcctcaagagcatctgcccgtccaacagcagccagttcttcccgaacacgacaacgttcatggacatcatcacacccgacaagttcgacaacaagtactacgtcggcctgaccaacaacctcggcctctttgagtcggacgctgcgctgctaaccaacgcaaccatgaaggcgctggtggactcctttgtgcgcaacgagaccacatggaagaggaagtttgccaagtccatggtcaagatggggaagatcgaggtgctcaccgggacgcagggcgagatcaggcgcaactgcagggttatcaaccctgctagcgccaccgatgttcttgccagtcagtcaggttcttcaggattcactggagtggctgcaagttaaccataccggttgtcagttcatgtgcgtgcagtgtgtttggtgtgggatgtgatcgatattgtaataagtgatgagcaaattagctgtataacttgcttgctagactagatgaacacggagacagcacaaaaactgaagaaaaaagtaggcagtctgttgtacatcgcgtggtgttcaattgactctggtgtttgattgtgaggataaaaataaaactgtaccaaatactttttcccgggccaaacatgtatgaccatctgattatttagtagtgatacaaaaaattgnttaa

SEQ ID NO: 14607 - DNA, 789 bp, Sorghum bicolor
  Clone ID: SORBI-28MAY03-CLUS5555_2
gccggccgggccgggagcccccagagcagccgcatccacactacctgcctctctctctctcgtcccctggcggcggcggcggcggcgacaggatggcggcttccacggcgaggacggtgaaggatgtcaacccccacgagttcgtcaaggcctactccgcccacctcaagcgctccggcaagatggagctacctgagtgggttgacattgtgaagactgcgaggttcaaggagctccctccttatgaccctgactggtactacaccagggctgcatctattgcaaggaagatctacctgaggcaaggcattggtgtgggtggcttccagaagatttatggtggccgccagaggaatggctcccgtccaccacacttctgcaagagcagtggtgccctctcacgcaacatcctgcaacagctgcagaagatgggcatcattgatgtcgatcccaagggtggaaggctcatcacatcccagggaaggcgtgatctggaccaagtggctggaagggttgctgttgaagcttgagcagtctcatcttcggtttctatgatgtcatgtttgatggttgagatggctacactttatttgcatttttggattaggactttttagttcagagagctttaaggtttaatgcatctagctatggctccacactatattttacctgagtacctaatgtgatctcatcttcggtttgcaaagtgcctgagcctgtatccatgacctatcttccttttgctacagatctatatgataatataagtgtctgagctggtatccc

SEQ ID NO: 14608 - DNA, 800 bp, Sorghum bicolor
  Clone ID: SORBI-28MAY03-CLUS5555_1
gccggccgggccgggctccaaccctagccccagagcagccgacactacctgcccctctctcgtccggcggcgttcggcaggatggcggcgtctacggcgaggacggtgaaggatgtcaacccccatgagttcgtcaaggcctactccgcccacctcaagcgctccggcaagatggagctcccagagtgggttgacatcgtgaagactgcgaggttcaaggagctccctccgtatgaccctgactggtactacaccagggctgcatccattgcgaggaagatctacctgaggcaaggcattggtgttggtggcttccagaagatttacggtggccgccagaggaatggctcccgcccaccgcacttctgcaagagcagtggtgccatttcacgcaacatcctgcagcagctgcagaagatgggcatcattgatgtcgatcccaagggtggacggctcatcacggctcagggaaggcgtgatctggatcaagtggctggaagggttgctgttgaagcttgaggagtcatcttcagtttcaatgatgtcatgttgagatggctagactttaatcgcacctttgtcatgttttgatggttgagatggctaaacattattttgcacttttggattaggatttgagttcagagaactttaagatttgatgcatctagctatgtgatatcaaaactcattttggaaccaaatataaatatgacattgtatgccatgccttttcttccttttgctacagatctatatgataatataagtgtctgagctggtatccccttttcctgtcc

SEQ ID NO: 14609 - DNA, 2063 bp, Sorghum bicolor
  Clone ID: SORBI-28MAY03-CLUS1168_1
gcacgaggccctccccccgccccagccgagaccaaaccccactccagccagatctccgcctccgccgctgtcggcgagagcaccccatcagatccgccgcgatggcgttccgccgcatcctatccaccgcggtgcgccgccgctcggccgtcgccgccgcggcggccgggaacgcgcgcgaggcctccacgggcgtcgccgcggcgcctggcgtgctcgcccccgactcgaccccggtgcgcgctcccgtgttgccgtacgaccgcatcgccgaggccgtcaacgccaggctccggcggctcgagcacccggacccgcgcttcctccgctacgccagccccgtgccgtcccacgccgaccacacggccatccttgcggcgccggagacccgggtcaccacgctgcctaatggcctgcggctcgccgcggagtcgtccctcgccgcgcgcacggctacggtcggcgtgtggatcgatgcgggcagcaggtacgagaacgagaaggcagccggcgtcgcgcattttgtcgagcacatgctgttcaagggcacggggaagcgcagcgcggcgcagctggagcaggagatcgaggacatgggtggccacctcaatgcgtacacgtcgcgggagcagacgacctactacgccaaggtgctcgacaaggacgtgccccgtgcgatggaggtcctcgcggacatcctgcagaactctaatctcgaccaggctcgcattgaacgtgagcgcgaagtgatcctacgggagatgcaggaggttgagggacagtctgaggaagttatatttgatcatctccatgcaactgcattccaatatacatctcttggcagaccaatcctgggttctgcagataatgtcaaatcaatcaccaaagaggacctcgagaactacattgcaactcattatacagctcctaggatggttatcactgctgcaggtaatgttaaacatgaagacattgttgagcaggcaaagaagttgttcaataagctatcaactgaccctacaacgacaaacatgttggtcgctaaggaaccagcctcttttaccggttctgaggttcgaatcattgatgatgacatgcccctagctcaatttgctgttgctttcaatggagcatcatgggtagatcctgattctgttgcactgatggttatgcaatcaatgcttggttcatggaacaagagtgctggtggaggaaagcacatgggttcagagcttgtacagagggcagcaatcaatgacattgctgagagtgtaatggcattcaacacgaattacaagcacgagggtctttttggtgtctatgctgttgctaaggctgattgcttggatgatttggcttttgcaattatgcatgagatgagcaaattgtcataccgggttatggaagaagatgttatccgtgcacgtaatcagctgaagtcctcaatccaactccatctcgatggttcaactgctgttgtcgaggacattggccgtcagctgctgacctatggccgaagaattcctactgctgagctttttgcaagaatagatgctgttgatgcaagcactgtgaagcgtgttgcaaatcgcttcatctttgatcaggatgttgctattgcggcaatgggaccaattcaaggacttccagactacaactggttcagacgccggacctacatgctccgttactagatctatctgtcgggtgtaccatgtttacggtctgcaaagacaagataatattcgcctcttttggcgtcagtatattacaaggcctcagcactgcacattacgtgctggatggaggaattttttgagaatttgttttgtttcttgtcttcccagatctgtcaataataaacgataggcaggttcgactgacgtggctgaggccacccggtgttgtttttacaatgaatcttgacccttaacgtttttttgttggaaggtttttctttggcgaataattttatggagctggttatatgtaaagttggtacagtttagcttccccgtcatacgatggcaactgatcaaagttgtgaggccttgttttcttgc

SEQ ID NO: 14610 - DNA, 1169 bp, Sorghum bicolor
  Clone ID: SORBI-28MAY03-CLUS5274_1
gccggccgggttggggactctagtagagacaggacgcagctcaccgcacagccgggcgcacccaaatccccaaaccctagcggacgcgcgcacgcacgcggcaccatggcggcggcggcggcgcagcagaagatccggtggggggagctagaggaggacgacggaggggacctcgacttcctcctcccgccgcgggtcgtggtcgggcccgacgagaacgggctcaagaaggtgatcgagtaccgcttcgacgacgacggcaacaaggtcagggtcaccaccaccacccgcgtccgcaagctcgcgcgggcgcgcctctcccgcagcgccatcgagcgccgccagtggcccaagttcggcgacgccctcaaggaggacgccggctccaggctcaccatggtctccaccgaggagatcctcctcgagcgaccccgcgcaccagggagcaaagctgaggaaccagctgcatccggtgacccactggctatggcgagcaagggaggtgctgttctcatggtttgcagaacctgtgggaagaagggcgatcactggacctcaaagtgtccctacaaggaccttgcaccaccgactgaaactttcacggacaggcctcctacgtccgatggccctcctgcaccaggcggtcctgtgaagggagcatatgtgcccccaaccatgagaggtggtgctgataggaccggagacgtgatgcgccgcaggaacgacgagaattccgtccgtgtcaccaatctctcggaggacacccgtgagcctgacctccttgagctcttccgtgcgtttggccctgtcagccgtgtctacgtcgcggtggatcagaagactgggtcgagcagggggtttgggtttgtcaactttgttcacagagaggacgcggagaaggcgatcagcaagctcaatgggtatggttatgataaccttatcctccgagtcgagtgggcgacgccaaggcccaactagttttgccgctacttgctagaattgcatatttctgtcttgaattatatcagtatggttgtttgaaacactagtacctgtgccatgggggcgtatcctgtcgtaaaaacctgctgttgtctgtgttttggttggacgagaataattatatactcgctgttgtttttaatttgagttcacatgtcgtttgtgtc

SEQ ID NO: 14611 - DNA, 369 bp, Sorghum bicolor
  Clone ID: LIB3476-060-P1-K1-A5
cccacgcgtccgcccaaatccccaaaccctagcggacgcgcgcacgcacgcggcaccatggcggcggcggcggcgcagcagaagatccgcgcaccagggagcaaagctgaggaaccagctgcatccggtgacccactggctatggcgagcaagggaggtgctgttctcatggtttgcagaacctgtgggaagaagggcgatcactggacctcaaagtgtccctacaaggaccttgcaccaccgactgaaactttcacggacaggcctcctacgtccgatggccctcctgcaccaggcggtcctgtgaagggagcatatgtgcccccaaccaatgagaggtggtgctgataggacctgagacgtgatgcg

SEQ ID NO: 14612 - DNA, 1878 bp, Sorghum bicolor
  unsure (1)..(1878): unsure at all n locations
  Clone ID: SORBI-28MAY03-CLUS6616_1
gcgtaccgacaagggaaaggcagaaaaccgcgngaaaaattcgggggcgacggggtaaacgccatgaaaagtcgctgattggtgcgcgggtagcggtcgtcgccccctcggcctccctggccttcggcttcggctcggccggctctactcctgccctgccctgccctgccggcaaacgcaacaacacgaagcggggcgtggggagcggtgcgggtgcggggggcgaggatcgagggcaacgtggccgtggcgtggcacggccgcgaggggggagggcgcctttgcttgcaggagagagctgctataaaaaggcgcgcgagatccagatctgggccgatgcgaccgccctcgctgctctccctcaccctcgactccgcgctcctccgcatcgcccacatcgccgacctctcccacctccctgaccacctcgtcatcgacctcttccgtagaaccctcagtgctggtaagctgacagagaaagttctcaagttgtttctggcaactggctgtgaggaaatcatcttggctgttcagttgctcaacattaagcagccactcgtaccagtcctccccacaaggtgctctgagaggttctagacctgctgctgcttacatcattttgattacctgagaagatgcctttggaaattcaagatagtgaggtcgacattgtgattgcggcactccagcccaacctgaccactttctttgaggcatggcggccatttttctctcgtttccacatcattgttgtcaaagatccagacatggcagaggatcttcaaatccctacaggttttgatctcaaggtttacaccaagtcagatattaatggggtgcttggttcctcatccataaacttctctggtcactcatgccgttacttcgggtatcttgtctcacgcaagaagtatgtgatttcaattgatgacaattgcctcccagcgaaggacactgctgggttgactgttgatgctgttgcacagcacatggccaatctgaaaacacctgctacacctttctttttcaacacactctatgatccataccggaaaggtgctgactttgtccgtggttacccattcagcctgcgtgagggagttgagtgcatgctctcatgtggtttgtggatgcataatgctgactacgacccaatgactcatgttgtgaagagaaatcaacgaaacacaacctatgtggatgctgtgatgacagttccgcttggtgcgatgctgcctgtgagtgggataaatgttgcattcaaccgcgatgtgctggggcctgctatgttcccaggcctgcgtctccgaaaggaagggaagcacagatgggatactcttgaagacatatggaatggcttatgtgctaaagtagtttgcgacagcttgggatatggtgtgaagactggactgccttatgtgatgagaagtgatgcagaagcaggtaaagctctggagagcttgaaagattgggaaggcgtaaaaatcatggatgatgttcttccattcttccagtcgctcaagctatctaggactgcagttactgttgatgattgtgttaaggagctagctggaattgtccgtgagaagctaggacccaagaatgcaatcttcaccaaagcagccgatgctatggtggaatggaacaacctctggaaagcacatggagctcagaatgcgtagattggagtttgcgtgtcacctacagagcatctataattgtttggaatacttgtttttcagtttaaaattttccttgtggaactcatgaagctgaaataaacaacagtcctgtatgccgtgaatttggcatgagtcgttgagcatctcattgtatacgcttaagaattatgtaatgtaatgcatcttttgaacctgg

SEQ ID NO: 14613 - DNA, 460 bp, Sorghum bicolor
  Clone ID: LIB3480-013-P1-K1-C7
attgatttgagcaacaccaaagtttactggtgggcccagtcccaggcaattaaagagaagaagctcagtggcaaacttttattgtggccactacgtatacttatatttaatagttcaagccaccaccttcagcactggcaccaacatctgctttgccactatcccccaccttaccgccactagaaatagttgcatccgcatcagttttgccacctgcatctcctccagcatcgccacttgcggaaagattgggaaggcgtaaaaatcatggatgatgttcttccattcttccagtcgctcaagctatctaggactgcagttactgttgatgattgtgttaaggagctagctggaattgtccgtgagaagctaggacccaagaatgcaatcttcaccaaagcagccgatgctatggtggaatggaacaacctctggaaagcacatggagctcagaatgcgt

SEQ ID NO: 14614 - DNA, 1643 bp, Sorghum bicolor
  Clone ID: SORBI-28MAY03-CLUS7739_1
gcacacgacaggaaggaagacgaccctagctaaaccctagcgaagggaaggaaccaagaccatggatgcctccaagctccgcgagcttcgcgacttcgtcgaggcgtgcaagaaggacccttccctcctcgccgaccccagcctcgccttcttccgggattacctccagagtctgggtgccaaaattccacccgccgctgccgcctccttcgagaagcccaagagatcttccatggacgacattgatgatgatgatgatgacgacgatctggatatgagggatcccactcctgagccagacgagctcgatgaggagattgttgagtctgatcttgagcttgaaggagacattgtacagtctgaccatgatgacccaccacagaagatgggtgatccttcggtggaggtgactgaggaaaatcgtgatgcctctcaagaagcaaaaggcaaggctatggaagcaatgtctgaaggaaaactcgaagatgctattgaacaccttaccaacgcaattgtgctgaatccactctcagcaatcatgtatggtactagagcatctgtgtttataaaaatgaagaaaccaactgctgccattcgtgatgccaatgctgctctagagatcaacccagactctgcaaaaggctataaaactcgtggaatggcatatgccatgcttggcaaatgggaggaagccgctcgtgatctgcacacagcatctaacatggattatgatgaggagatcagtgctgtgctcaagaaggtggagcctaatgctcacaagatagtggaacatcgcaggaagtacgagaggctgagaaaagagagggaggaaaagagagcagagcgtgatcggcttcgtcgacgtgcagaggcacaggctgcttatgacaaggccaagaggaaggagcaatcgtcaagtcgctcatcaggaggtgcatctcccagaggtttccctggagggatgcccggtggaggtttccctggagggatgcccggtgggggtttccctggagggatgtccggtgggggtttccctggagggatgcctggtgggggtttccctgggagtggcatgcctggaggtttccctgggggtggcatgcctggaaatgttgatatgagtaaaatcctgaatgaccctgacctgatggcagcattcagtgacccagaggtcatggcggcgctacaagatgtgatgaacaatcctgccaactttgctaagcaccaagcgaatcccaaggtgggccctatcatcacaaagatgatggccaagttcagtgggtcccagtgattgttgtgtggcagtcagattttgtgagaagcaagcaaaggcccgttggacagtgaacaggtgttttctttttgtgcatctgggggtgcccgttggacagtgaacaggtgttttccttttgtgcatctgggggtgcgtttagcttgtgatgaagaacatgagtgaactttgtttttcttttttgtgcatctagagatgcgttgagcatgtgatgaaaaaaacaccaaatggctcgatggggatgtatgcagaaagttgctttcgaacttgaacttgccagaggaaatatttactcacgattctcaattcacagatgcggacaatttcttgtacccgtgtcttgtgctgaatt

SEQ ID NO: 14615 - DNA, 1079 bp, Sorghum bicolor
  Clone ID: SORBI-28MAY03-CLUS5451_1
caaaaccctacccgtcaccgcctccttatataaaaggctcgccctctgcgcgccggccgggccgggttcgcgcacacaagcaaaccctcctcccctccgccgcccgccgcccgctcgcccgaggaggaggaagagaaggcgaaggagtagcagcaccgggcaacatgaagacgatcctggcatcggagacgatggacatcccggagggcgtgacggtgacggtggccgcgaagctggtgacggtggaggggccccgcgggaagctgacccgcaacttcaagcacctcaacctcgacttccagctgcaggagggcgggcgcaagctcaaggtggacgcgtggttcggcacccgccgcaccatggccgccatccgcaccgccatctcccacgtccagaacctcatcaagggtgtcaccaaggggtaccgctacaagatgaggttcgtctacgctcacttccccatcaacgcctccatcaccaacagcaacaccgccatcgagatcaggaacttcctcggcgagaagaaggtcaggaaggtggacatgcttgatggcgtgaccatcctgcggtccgagaaggttaaggatgagctcatcctcgacggcaacgacatcgagctcgtctctcgctccgccgccctcatcaaccagaaatgccatgtcaagaagaaggatatcagaaagttcttggacggtatctatgtcagcgacaagggtgtgatcgaggaggagcagtgagcgacaacgtagctaaaatgcctggagatgatccagaagtgctacatctgcctggcatgttgccattatcgtttgggttgcaattttcggagactgaattttgttcttggttaggatgtgttatggagcatgttatcttatcctacatattgtcgtccctgtttaagaatatgaaccttgtttctcattccctaaagatagttgactgccagtgttgtggttgaaacgaaaaatggtaggtttattaactgatttgcgcattcgattggatcgccatgctgactgctacgagttcatcttgtttgaattttgcctcagttaaaattctgttttcgaaaggtc

SEQ ID NO: 14616 - DNA, 341 bp, Sorghum bicolor
  Clone ID: LIB5050-005-R1-XP1-E10
ccgggagttccttcgcgcacacaagcaaaccctcctcccctccgccgcccgccgccctcatcaaccagaaatgccatgtcaagaagaaggatatcagaaagttcttggacggtatctatgtcagcgacaagggtgtgatcgaggaggagcagtgagcgacaacgtagctaaaatgcctggagatgatccagaagtgctacatctgcctggcatgttgccattatcgtttgggttgcaattttcggagactgaattttgttcttggttaggatgtgttatggagcatgttatcttatcctacatattgtcgtccctgtttaagaatatgaaccttgtttctt

SEQ ID NO: 14617 - DNA, 1646 bp, Sorghum bicolor
  Clone ID: SORBI-28MAY03-CLUS1111_1
ccgcgtgcctgtaggtggtctgggaatgaccctgcctcgcttatatggctttatttatggatcataataagttcaataacacaaggctacaacacatacaacagtcacgttacaacagtcggagacagtactatgtcctccagtcctctcctgagatcaatgtagaccacgctaagagttacacttacaccgggtagtacagagcttaaggtggctgcagttggctgaggcggcacaggccagcccattgcccctgctgcacaccgccgccataataaaacggaagggtaactaagtgctgggcagcctagtgctacgcagcactgtcaggttaaccacgattacaattatcaaagcaaatgcagggtattgtcctaaacacacaatgcaacagagtcccaagctcccttatgtgcacctcatagcagaggcaccaggttggatctggcccttgttgtcgcagttcgctgccgtcggttcttggggggcagtgttcacctggcctgaattctcggcccccttttctgcctcagctggaggagcatctgtctttgtctcagccacaagcggggctgcgggttcagttgcacctccattctctttcttctccccctctgaagatgccagggaaggcaccacagattcagctgcctgaccgttctcggtcttctcctctttcttctcttcatcaacaattgctgggggagctgattcggactcagctggctttccgtcccctttaccctcagattctggggcagcaacattattaggttgtgcttggctttcggtgctttgttcagtcttctcagctgcatctacagcaggggccacctctttatcatcagccttctcagctgaatctacaacaggggccacctctttgtcatcagtcttctccgctgcatctacagcaggggcctcctctttcttatcttcaccttcctcagtcttctctgctacatctacagcaggagcctcctctttcttatcttcaccttcctcggtcttctctgcagcatctgcacttggggcctctttcttctcgtcttcagcattttcagcatccttcatctccacatcggtacctttaccttcctccgaagcaccatcttcaccagcctcatttacatcttctttttcctcctttttgcccctcttagagcttgatcttccccgtttaggggtcttctcaccctctgggttccaagttgccttgaccttctcgcttaagcgtgctgagcgtcggggagtatcactggttccccaatcaaactctgaagatgcagggcctccgggatgagctttcaggtactgcgtcagctgtctcttgctcttaatttcctcaccagttggggaaacaaaaagaacctcaaatcgtccaactcgagttaggacaagcttcttcgtccagcctgagggtgcgaggagctcggttgtgctggtctccttcttctccggcgtctcgtcgaccgccgccgccgccgccgccacgtgctcctcgccggttgccataccgctcgccgggtttcgagttccctcttcccgctctcgctgtcgcaattcgcaaaggctggggctggctgatgctgaattggggaatgggtgggttggactgggaacgggtgggtggggaaataacccag

SEQ ID NO: 14618 - DNA, 877 bp, Sorghum bicolor
  Clone ID: SORBI-28MAY03-CLUS867_1
cgctcgaggccggccgggccgggctctgaagtttcggcggcggcgtaggcagcggcggcgtgctcgtgatctcaacccccaggcgagctcggctccggtcacccgtcgatccacgcaaccatgtcgaggaggaagaccagggagcccaaggaggagaacgttacccttggacccactgtccgtgaaggagagtatgtctttggtgttgctcacatctttgcatccttcaatgacaccttcattcatgtcactgatttgtctgggagggaaactctggttcgcatcactggtggcatgaaggtcaaggctgatcgtgatgagtcatcgccttatgctgctatgcttgcttctcaagatgttgcacagcgttgcaaggagcttggtatcactgcgctgcacattaagcttcgtgccactggaggcaacaagaccaagacccctggacctggtgctcagtctgctctcagggctcttgctcgttctgggatgaaaattggacgcattgaggatgttaccccggttcccactgacagcactcgcagaaagggtggtcggaggggtaggaggctgtaggtgtcttcgccttgctatctgccatctcttggcactgccatctgggtagtgttgctgtttctaagcttgtcaagaggagctttaattttgctctatgtcgaggatcatttaccgttagtcgaatctgtgatgtgcaattgtgcatggataatgttttggttgaggaattgacattaagctaaaaatgcattttcactctacaaaaaaaaaaaaaaaagcagcccctatttgctgtctgatcggaacccgctttctgattacgagtttcagcgtgtcaggttatgacagtgtgttatgattgtgt

SEQ ID NO: 14619 - DNA, 795 bp, Sorghum bicolor
  Clone ID: SORBI-28MAY03-CLUS7996_2
gccggggccgggcggctagtgtctaccgggttcttccctgccgccgccgcgttctccacgtcgactcgcctccgccgtcgccatggggaggagaccagcaagatgctaccgccagatcaagaacaagccatacccgaagtcaaggtactgccgtggtgtccctgaccccaagatcaggatctatgatgttgggatgaagaagaagggagtggatgagttccccttctgcgtccacctggtgagttgggagaaggagaatgtttccagtgaggctcttgaggctgcccgcattgcttgcaacaagtacatgaccaagagtgccgggaaggatgccttccacctgagggtgagggtccacccattccatgtccttcgtatcaacaagatgctttcatgtgctggggctgatcggctccagactggaatgaggggtgcttttggcaagccccagggtacctgcgctcgtgtggacattggtcaggtcctcctttctgtgcgctgcaaggaaagcaatgctaatcatgctgaagaagccctccgccgtgccaaattcaagttccctggccgccaaaagatcatccgcagcaggaagtggtatgtgggaatgaagatcctttgctgttgaacccagtgtcatgtcacggcattgatgaaaggcttggatgacttgtttgcattgtcttttcaggttttaccaagttcacccgtgctgagtatctgaagtacaagagcgagggtaggattgcacctgatggtgtcaatgctaagctgctcggtgttcatggtcccctctct

SEQ ID NO: 14620 - DNA, 1053 bp, Sorghum bicolor
  Clone ID: SORBI-28MAY03-CLUS7996_1
ctccgatagagtctactgggtgcagctcatgatcctgaagcatatcaacaattcgccgccgcgttctccacgtcgactcgcccctagccgcgcccctgctcttcgccccgccgccgccccgccgccgtcgcctgcctccctcagccgccgtcgccatgggcagaaggcctgcgagatgctatcgccagattaagaacaagccataccccaagtccaggtactgccgtggtgtccctgaccccaagatcaggatctacgatgttgggatgaagaagaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttagggtccgggttcacccgttccatgtcctccgtatcaacaagatgctttcgtgtgccggggctgataggctccagactggaatgaggggtgcctttggcaagcctcagggtacctgtgctagggtggacattggtcaggtcctcctttctgtgcgctgcaaggacaacaatgctgcccatgctagcgaagctctgcgtcgtgccaagttcaagttccctggccgccaaaagatcattgagagcaggaagtggggcttcaccaagttcagccgtgctgactacctgaagtacaagagtgagggtagaattgttcctgatggtgtcaatgcaaagctgctcggtaaccacggcagacttgagaagcgtgctcctgggcaggctttcctcgaggccgttgcttaagtggaatccacagtgggactgcggatccagacgttttgctttagcctatcttactattttgctttgtggaacatgaatttcaagtgtctcggttattacagtgccttatgtgaaccaacctatcttgtgctgaacatcgctatgcatggaagtagttctcttttgtgtctgaatgctgagaattaaatgttttgcatccgtggccctcttctcggggacgagtagagaaatactc

SEQ ID NO: 14621 - DNA, 1621 bp, Sorghum bicolor
  Clone ID: SORBI-28MAY03-CLUS11868_1
cccacgcgtccgcaacaaactgatcaagcacggtgataagatcttggatgaagcaaacaaggtcttcctgggatgcacggtacagctggcaatcaaagtctctggcatacactggtggtacacggttccaaaccatgcagctgagctcactgccggatactacaacttagatgacagagatggctacagaaccatagcacacatgctaacaaggcatcctgcaagcatgaacttcacttgtgctgagatgagggacaatgagcagagttcagaggcgaaaagtgcacctgaggaactggttcaacaggtgctgagtgccggatggagagagggcctaaatctggcatgtgaaaatgcactcagtcgatatgatgcaccagatccagctccaagctcagtgaccaccaagcagagagcgagccagtgaggtctctgagagtgagaccgtagccagccagccagccacaatggcggggaacgcgctagccaactatgtccaggtctacgccatgctcccgctggatatcatcactgtcgacaacacgttcgagaaggaggacgagacaagggcgcaactgaagaagctgacggaggccggcgtcgatggggtcatgatcgacgtctggtgggggctggtggaggggaaggagccgggggtctacgactggagcgcctacaagcaggtcttcaagctggtgcaggaggccgggctcaagctgcaggccatcatgtcgtgccaccagtgcggtggcaacgtcggcgacgtcgtcaacatcccgatcccacagtgggtgcgggacgtcggcgaggacaatcccgacatcttctacaccaaccgggaaggggtgaggaacatcgagtatctcactcttggagtggacgaccagcctctcttccatggaagaactgccattcagctgtatgctgattacatgaagagcttcagagagaacatggcagatttcttggatgctggtgtcattgtggacattgaggtgggacttggccctgctggtgagatgaggtacccctcatatccccaaagatgcggatgggtgtacccaggtattggagaatgcatatgctctgagcatcaacaagaatggcgctccagaacacaagttgtatggattcacctacctccgagtatctgatgaactgttcgagggagagaactacaccactttcaaaacttttgtcaggagaatgcatgctaacctggattataacccaaaggttgacccagttgcaccattgaaaagatcaaagccagagataccaattgaagaaatcctagcagtagcacagccaagattgaagccatttcccttcgagaagaacacagacctaccagtttaaacactccaacgatgcaagctacaggaaggatcacaaggcacttcaaaatcaagataaacatgaagtaagcctactgtcgggcagtaggctagtaactaaataaaatgctgtgtggagcatattgcagtcatgtattgcaccaataatcttgtgttgttaaacatgaggcttgatgattttctgatgaattgtaatacccttggccttcctgttgttgtatgtatttggggcaatgaataaaaaatgtggctttgtgggttac

SEQ ID NO: 14622 - DNA, 1513 bp, Sorghum bicolor
  Clone ID: SORBI-28MAY03-CLUS1643_1
cgctcgaggccggcaaaggcaaatgaagagtttcagcacgagggagcgagaggactcctcacaaccctcctcccttccctcccgtaggggccaaagggttagagaggaagagaagtagtagttcccaagcctataacaagctcatcatcgtgattccagcaactgttctttcagttgtatagcttgtgttgggaaattcttgtgaccctattatattatttgtagctccccctttctgtcgtaatggcaggtctatctctgcagcacccctgggcattcgcgttcggcctccttggcaacgtcatctccttcatgaccttcctggccccgataccgacattctaccgcatctacaagaccaagtcgacggagggtttccagtcggttccgtacgtggttgccctgttcagcgccatgttatggattttctatgcactgatcaagtccaacgagaccttcctcatcaccatcaacgccgccggctgcgtgatcgagaccatctacatcatcatgtacttcgtctatgcgcccaaaaaaggcaaaatgttcacggccaagatcatgctccttctcaatgtcggcatctttggggtcatcctcctcctcacccttctcctctttaagggtgataagcgtgttgtcatgcttggatggatctgtgtcggtttctccgtcagtgtatttgtggcaccattgagcatcatgaagcgtgtgatccagaccaagagcgtggagtacatgcccttctcgctctctctctctctcaccctcagcgccgtcgtctggttcctctacggcctcctcatcaaggacaaatatgttgcgcttccaaacatccttgggttcacctttggcgtggtccagatggtgctgtacgtgttgtacatgaacaagacgccggtagcggttgccgagggcaaggatgccggcggcaagcttccctcagctgcagacgagcacgtcctcgtcaacatcgccaagctcagccccgcactccccgagaggagctccggggtgcacccagtcgtcgcccagatggcggcggttcccaacaggagctgcgctgctgaagcagccgcgccgccggcgatgctgcccaacagagacgtggtcgacgtcttcgtgagccgccacagcccggccgtccatgtggtgtagattctcgatcgatcgcgtgcatggcccatgcatgtttgcgcgcgccacacgtacgcttttaatatttgaacgagttgatgagaaatgatggagaatgattaaatatactagttataagtaattaattaactgccatggaagcatgctagctaatggatggaggcagagatcagagcatgtaggggaagctacatatatatatatgtataatatggggtgtgtattcatctatgccgctcactactgctaagtattatttccttggatatctgttattccttttcacgtgtaatgttttctaataagatgtaatcgatcccagactactgttgttagcagtatatatttggttttc

SEQ ID NO: 14623 - DNA, 871 bp, Sorghum bicolor
  Clone ID: SORBI-28MAY03-CLUS128_2
tctgttcatctagagcatcgactgctccgagaaaaccaccagagaagaagagaatagaagaatctagatagaatattgtaccttatatttggttttagattttttttaatgtgtaatttgatgatgtactgaacaggaaaaataaaactcatagaaaatgcatggtacagtgtcctcactcacgaagatagctatggaaggatgcatatagatctttggttcaacaatacgttgatagtaatctgtatatatgcttcccacagtagttttggttgattcttgtcttcatcgtcatcgtcgtcgtcgacgacgactggtagctgccgacgatgccgacgccatgatcagaacaggtacgccgtcggcgcgaacgctggcatggacgacgcgctctcaaggtgcctgtattcatcgctgcgcgcgcggggcagcacccgagcgacgtcccaggacgccgccttcctgaccctcgccggcccggcggcggcgcgcgcggcggacttggccgcgtcggtgctgtactcctcgtagatgtccccgagcgaggggcgccactgcgcggcggcggcggcaccgacggcggacctgttggcggcagcaatcctcctccggcgcctcctcgcggcggcggcggcgtctccggcagcggcggcgtggtccgcgggcggcgcgtcgtcgacgggtccagcacggcagccaaagggcacgaacgacaggagcctcatcagcttcctgcgcacgctcccctctatcccccggccggccggcccccccggacgtcggcgcctactgaccggccggaggaacgaacgaatgccaaccggcaatgagtggcccaaagaacttaaccaccaaggaaaaccaaccggac

SEQ ID NO: 14624 - DNA, 1191 bp, Sorghum bicolor
  unsure (1)..(1191): unsure at all n locations
  Clone ID: SORBI-28MAY03-CLUS128_1
cgtccgctttttttttttttttatcacaaacgtccaaatatacttcttcaatattctattagttatagtactattacatatatactagtaattatatacatgacatttacaccgtaccatgcatgcatgcgaagtgctaggtcatcgtgcatgcatggtgatgactgatgatgcatatgccacacatatgtgcatcactctacctcattcaaatcatcacatttatcacatatctatatagagtatagacacgtcacacacacacacgcatgcatatagtagtaatacacgcgcgcgcgctatctctcacgaagaagaagagaggtagctttattccggtccgaaggatgcatatagatccttggttctacaatacgttgatagtaatctgtatatatgcttcccacagtagttttggttgattcttgtcttcatcgtcatcgtcgtcgtcgacgacgactggtagctgccgacgatgccgacgccatgatcagaacaggtacgccgtcggcgcgaacgctggcatggacgacgcgctctcaaggtgcctgtgcaaaaagcatatgcatcgtgttcttagattagatcgagtcatcgaggtagaacagacatgaagaaatagcgtcgagaaactcatagaaaatggtcccggagaggaaataaaatcatggatgtgttgaatctccatcctatgttgtctctgacgatacgactctcgatattctttcatcgattcagatgcgttttgaacgggttccacgatcggcatatggatcacacacacgctggcagccgaggcgtggtccgcgggcggcgcgtcgtcgacgggtccagcacggcagccaaagggcacgaacgacaggagcctcatcagcttcctgcgcacgctcccctctatgttccccccggccggccggccctccgatcccctctctctcttgcctctctttcttatcctgtatctctcgttcttggccagttttttttcttgagagagagagagagcactccggcggcggcgagacctcgtcggcgcctactgaccggccggaggaacgaacgaatgccaaccggcaatgagtggcccagagagctgagcgacgagggagagcgagcgagccgagcgggctgttgggtgtattactactatatgcatgcgtgtgtgtgtgtgacntgtctatactctatata

SEQ ID NO: 14625 - DNA, 1096 bp, Sorghum bicolor
  unsure (1)..(1096): unsure at all n locations
  Clone ID: SORBI-28MAY03-CLUS5762_1
cctttcagaaccttccgtcgccttccagaagcccaccccctcagcaccactataaactgccctctcccgcctcgtcactccccacaccgagaaaaggagcaatccaagaaaccaacacagcgacaagcaaagcagcgatccgagatccgccagcggcagcgagagcgagagatggacgcgaggatgttcggtctcgagaccccgctgatggtggcgctgcagcacctgctggacgtgcccgacggcgacgccggcgcggcgggcggcgacaaggcgggcgccggcgcgggcggcggggccacgcgcacctacgtccgcgacgcgcgcgccatggcggccaccccggccgacgtcaaggagcttccgggcgcgtacgcgttcgtggtggacatgccggggctgggcacgggcgacatcaaggtgcaggtggaggacgaccgggtgctggtgatcagcggcgagcggcgccgggaggagcgcgaggacgccaagtacctgcgcatggagcggcggatgggcaagttcatgcgcaagttcgtgctcccggacaacgccgacatggacaagatctcggccgtgtgcagggacggcgtgctcacggtcaccgtcgacaagctgcccccgcctgagcccaagaagcccaagaccatcgaggtcaaggtcgcctgagctgagcggaccgtcgacagaaaccgaagtttggaagatatcggagcagtgccagtgagctgagaacctgtgcgtttctgtccctggatgtgatgaggaagaggaataatccgttgcactggtagtaagtggtagctgtagtagtgtgcttctgaagttgtgtgtgttttgcttccttcggtcgcgcggtgtctatctaccgatcctatctgatgtatcgactttggtttagtttcgtcttgaaccatgctgggtttgaagctttgtaatgcaaaaggagaatgttccgatgctttctcgataataaatctctgttcatctataaaaaaaaaaaaaaaaaaaaaaaaaannnnnannnanaaaaaaaaaaaaaaaaaaaaaatttttttttttttttttttttcaacggtaaaggcaaaggcaaagg

SEQ ID NO: 14626 - DNA, 636 bp, Sorghum bicolor
  Clone ID: LIB5050-006-R1-XP1-H12
cggccgacgtcaaggagcttccgggcgcgtacgcgttcgtggtggacatgccggggctgggcacgggcgacatcaaggtgcaggtggaggacgaccgggtgcttgtgatcagcggcgagcggcgccgggaggagcgcgaggacgccaagtacctgcgcatggagcggcggatgggcaagttcatgcgcaagttcgtgctcccggacaacgccgacatggacaagatctcggccgtgtgcagggacggcgtgctcacggtcaccgtcgagaagctgcccccgcctgagcccaagaagcccaagaccatcgaggtcaaggtcgcctgagctgagcggaccgtcgacagaacccaagtttggaaggtgtcggagcagtgccagtgagctgagaacctgtgcgtttctggatgtggtgaggaagaggaataatccgttgagtggtagctgtagtagtgtgcttctgaagttgttgtgtgtgtttgcttccttcggtcgcgcggtgtctgtctaccgatcctatctgatgtatctgctttggtttagtttcgttttgaaccatgctgggtttgaagctttgtaatgcaaaaggagaatgttccgatgctttctcgataaataaatctctgttcatctaaaa

SEQ ID NO: 14627 - DNA, 792 bp, Sorghum bicolor
  Clone ID: SORBI-28MAY03-CLUS139_3
gcgggggcctggcctgtcctgccgccgccgccgtcgccgccgctgctccaagcccgtgttccgctcctagccgcgccgccgccgcagcgaagcgctccagagaacttccgtcaacatggggaagacacgtggtatgggagctgggcgcaagctcaagacccaccgaaggaaccagcggtgggctgacaaggcatacaagaagagccatttgggcaatgagtggaagaaacccttcgcggggtcatcccatgccaagggcattgttctggagaagattggtattgaggccaagcagccaaattctgctatccgtaagtgtgctcgtgttcagcttgtgaagaatggcaagaagattgctgccttcgtgccaaatgatggttgcttgaactacatcgaggaaaatgacgaggtgttgattgctggatttggtcgtaagggtcacgctgtgggagatattcctggtgtccggttcaaggttgtcaaggtctcgggtgtgtctctgcttgcccttttcaaggagaagaaagagaagccaaggtcttagattgctcttgcactcaaaatcagcaagcatggagtctaaattggagagtgttagatgtttaagaagaatggttgcttgctatgtttacagtgcactcatgcaattgttaacctaagattttgttttgtgaaaacgatttctttaaacacactgcttctgttgagtactatcatgagttctattcgcctagcttgagatgctataatgctcttttctggtaaaaaaaaaaaaaaaaagcccctagggcc

SEQ ID NO: 14628 - DNA, 718 bp, Sorghum bicolor
  Clone ID: SORBI-28MAY03-CLUS139_2
ttaggggccgccgccctcgaacccgaagcccgccgcttacgaccgccgcaacgtcgccgaccctcacagccggtggtctcctacctccgccgccatggggaagacacgcggtatgggagctgggcgcaagctcaagacccaccgcaggaaccagaggtgggctgacaaagcatacaagaagagccacttgggcaatgagtggaaaaagccctttgctgggtcatctcacgccaagggcatcgttctggagaagattggtattgaggccaagcagccgaactctgccatccgtaagtgtgctcgtgttcagctggtgaagaatgggaagaagatcgctgcctttgtgccgaatgatggttgcctgaactacatcgaggagaatgatgaggttttgattgctggatttggtcgtaagggccatgctgtgggagatattcctggtgtcaggttcaaggttgtgaaggtatctggtgtgtcgctgcttgctctcttcaaggagaagaaggagaagccaaggtcttagattgctttcgatagtcaagaatggagtaaactgtccaggctctattatcaaacttaaaagttgtgctagcaacagagatgttaattctgagctgtattttttgttaacattgctatcgagagtttcgtttccattttgaagatattaatatgcatcagcatgtgccggttcactgagctgtatcttctgatatcc

SEQ ID NO: 14629 - DNA, 1555 bp, Sorghum bicolor
  Clone ID: SORBI-28MAY03-CLUS139_1
ggcgcctcccctccccagcggccgccgccctcgccgccgaagcccgccggccggccgggccgggctttttcgccgccgccgcctgatagctccagcgccctcgccgccggctactcggctgccgtactcccgctacgagttaggcatcaccttcgccgatccaacatgggtaagacccgtggtatgggagctgggcgcaagctcaagacccacagaaggaaccagaggtgggctgacaaagcctacaagaagagccatcttggcaacgagtggaagaaaccctttgctggttcatctcacgcaaagggaatcgtccttgagaagatcggcattgaggctaagcagcctaactctgctatccgtaagtgtgctcgtgtccagctggtgaagaatgggaagaagattgctgcctttgtgccaaacgatggttgcttgaactacattgaggagaatgacgaggtgctgattgcggggttcggtcgtaagggccacgctgtgggagatattcctggtgtccgtttcaaggtcgtgaaggtctctggcgtttccctgctcgccctcttcaaggagaagaaggagaagccgagatcttaaaatcctattccccctcaccacagtgaaacctgtaatgcttttggagttttgggcctgtggcccaccgcgcacctgtggggctctcataccagacctcattttgagatgaacctagcagttgttttgccatagttttgttgaggagcatctgaatttgaactatatatatccgaaactgccagtcagtgtgtgatctgagatgaacaaaaaaaaaaagacaatccataaaagggaaaaaaaaaaaaaaaggacaaaagctctgctgcacgcagtcccctcaattcatttgctgcttttgacaaaaacaaattggttaagcttgctggattttatcctaatgatttcacaagcttagagttgctccacctacctgctcaactcaatttgtacattactgatatgcataatgatgaaaggtttgcaaatgtgagaagtcttgctgagctttctgttaagcttgttgaaacaaacaagattggaagacatgcagttgtttacaggcttctaaaattggtgctagtgcttccagtggcaactgcaagtgttgaaagagtcttttcagtgatgaattttgtgaagaacaaactgagaaataagattggggatcaatacttgaatgattgtttggttacatttattgagcgggagttctttctacaagttaaggacaaagacatcatcacccgcttccaaaccatgaagaatcgtaggattaaagcaacattataatatttggagtcaagcagaggcgccagccagttgtgagaagtttggtgaagatctttgctatgctatgaatgagactgattgggcggtaacctgtaactcgcaaggcatcccttttcttcgggagtaatatgatgtttgccatattcagtagctcaaacccttgaaagtttagcaccaggctgttcaatgtaaccgtaacatcgcccttgatgatgtcccaccaggctttgaa

SEQ ID NO: 14630 - DNA, 559 bp, Sorghum bicolor
  unsure (1)..(559): unsure at all n locations
  Clone ID: LIB3481-049-Q6-K1-C9
gcgttcggtccttgnanaaaacggcattgaggctgagcagcctaactctgctatccgtaagtgtgctcgtgtccagctggtgaagaatgggaagaagattgctgcctttgtgccaaacgatggttgcttngaactacattgaggagaatgacgaggtgctgattgcggggttcggtcgtaagggccacgctgtgggagatattcctggtgtccgtttcaaggtcgtgaaggtctctggcgtttccctgctcgccctcttcaaggagaagaaggagaagccgagatcttaaaatcctattccccctcaccacagtgaaacctgtaatgcttttggagttttgggcctgtggcccaccgcgcacctgtggggctctcataccagacctcattttgagatgaacctagcagttgttttgccatagttttgttgaggagcatctgaatttgaactatatatatccgaaactgccagtcagtgtgtgatctgagatgaaccaagcagctgtggtcattccttgttggtacggtatgtttctgtctttgtggattctctgataaa

SEQ ID NO: 14631 - DNA, 1034 bp, Sorghum bicolor
  Clone ID: SORBI-28MAY03-CLUS2913_1
gccggccggaattagttgttcggctgcaccgctgcacgcctgcacctacaaatccagcagaggcggccggccgggcccggatcctcctcgcacccgcaaaccccccaactacccccagtctcaggagagaaccttccagaagcacaagaatccaaggccgtcgccttcctcgccgcgggggccgcctgagatcacataaacaatggtgaaggctgttgctgtgcttggtagcagtgagggtgtcaagggcaccatcttcttcacccaagagggagatggccctaccactgtcaccggaagtgtctctggcctcaagcctggcctccatggtttccatgtgcatgctcttggtgacaccaccaatggctgcatgtcaactggaccacactacaatcctgcgagcaaggagcatggagcaccagaagatgagaaccgccatgccggtgatcttggaaatgtgacggctggagcagatggtgttgctaacatcagtgttaccgacagccagatcccactgactgggccaaactcaatcatcggcagagctgttgttgttcacgctgatcctgatgatcttggaaagggtgggcacgagctcagcaagagcactggaaacgctggtggccgtgttgcttgtgggatcattggactccagggctgaaaatgatcgctggattttgggtgcctgagagtgtcgtctttgtctcctgccgtcgccaacagaccagcctgaactttcctagacatcgtgaaataagagtacctgatctatgatcagtgtatttgccattaagcacctgtagcaaccgatgaactaaactgtgttgaactatgctggatcgcctgagtatgtgctacgtgtcggttttgagaaagcacatgatctatgatcagtgtatttgccattaagcacctgtagcaaccgatgaactaaactgtgttgaactatgctggatcgcctgagtatgtgctacgtgtcggttttgagaacatcctatcgtttcgaatgtgcttttgtgaaacgtgtgtgttgc

SEQ ID NO: 14632 - DNA, 439 bp, Sorghum bicolor
  Clone ID: LIB3481-015-P1-K1-F5
cgtccgcttcactctgctcaaattgttgcttcgtataacctggtctccgaataccccggagtagagtagctgcggttggctggatctcagatcggtgatcacataaacaatggtgaaggctgttgctgtgcttggtagcagtgagggtgtcaagggcaccatcttcttcacccaagagggagatggccctaccactgtcaccggaagtgtctctggcctcaagcctggcctccatggtttccatgtgcatgctcttggtgacaccaccaatggctgcatgtcaactggaccacactacaatcctgcgagcaaggagcatggagcaccagaagatgagaaccgccatgccgggatcttggaatgtgacggctggagcaaattgggttgctaacatcagtgttaccgacaggcagatcccactgactgggccaaactcaat

SEQ ID NO: 14633 - DNA, 952 bp, Sorghum bicolor
  Clone ID: SORBI-28MAY03-CLUS3542_1
ctaaccccaacatccttgcgggagggggttgggggtggacatttagccaaggtcgcggaggtagcaaggaagcttggaatcctagtcatcgctgatgaagtatatgggaaatctggcacgaggggacacccctttcgtccccatgggtgtctttggccacattgcccctgtgttgagcataggatcactatcaaagagatggatagtgcctgggtggcgacttggttgggtagctgtatgtgatcccaacaagattctgctaaacacaaagatcattgcatcgatcacaaacttccttaacatttcaactgatccagcaacttttattcagggagcacttccccatattcttgagaacacaaaggaagattttttcaagaggatcattggtctgctagcggaaacatcagagatatgttacagagaaataaaggacatcaagtgcatcacttgccctcacaagccagaaggttccatgtttgtcatggtgaaattaaatttgtatcttctggaagggatccatgatgatattgatttttgctgcaagctggcaaaagaagagtccgtgattttgtgtccagggagtgttttgggaatggaaaactggatccgtatcactttcgccattgattcatcttctcttcttgatggtcttgagaggatcaaatctttctgccaaaggcataagaagaagaatttgcttaatggtcattaactgtatctgagttcaaaacttgttacccagttccatcgtttttcattgtatcatcaacaaatgtggaactttgaaatccttcagaaataataaatttaatgcttgcacatcagtatatgagtttcaggttgttacccagttccatagttttccattgtatcatcaacaaatgtggaactttgaaatccctcagaattaataaagttaatgtttgcatatcagcatatgcaagttagt

SEQ ID NO: 14634 - DNA, 487 bp, Sorghum bicolor
  Clone ID: LIB3481-036-P1-K1-B9
cgtccgcccacgcgtccgaagtattccaggcctgtacgtttgtgctcagaaatgctttatgaaattagcaatgcattaatgctggaatacaatgatgaatggtcttttattcatatgagcaaaatgtaacataggtgattcactaatatataaatgttgggatgattctcctttatcttcttatagatgttaatgaagaatagacagagagatatactccttagtaacttgtgagattttaggagtagcttttacgactagacttaattgtctaattgtttaggctagacaggtaggtatttgttactgtaagatactggttaatataagtgtctcatcttaaattgataccaacatctccttaatcttacatacatgtgtttgtccaatgcagggagtgtattgggaatggaaaattggatccggatcactttcgccattgattcatcttctcttcttgatggtcttgagaggatcaaatctttct

SEQ ID NO: 14635 - DNA, 1592 bp, Sorghum bicolor
  Clone ID: SORBI-28MAY03-CLUS4060_1
tactggaagcacgctcgtggtggtggcgtcgtcgtgtctccccgatcccctctcgtctcctcccctcgtcgtctcatcaattcaagatccaatctttgctgctgccactcggcgatccgatcgttctcgagcaaggtcggtggccatggctcgctgccgccgccacctcctcctccttgctctctttctcgccttggctgctgctgctccggggcaggcgcagagtcatggcgaagcctccgccgtcttcatcgacgccgcgtcgcaccgctacctgcgggaccagcaagccgacggccaggacgcttcaatgtcgttaaatgaagtttctgcggctgtttctgtcttgcttggttttgcagcgccaacctccctaccagcgatttcatcgtcgaagttgaacaaagtgcttcttcccaatccatttgatagaccgcgtgctgttttccttatgcaaattgctgggaccgatgcctcagcccctagcttcgtatctgaaggcagcaacattttcaagaccaggattgaaggtgcaaacagcgctgatacagggctttcagatacagatgatttaattgtcattcattcagatgaatctctagatctttctcgatcagattatcttgataatgaactttccagcttggcaaactggttggagggatcttatcagaagtctagcagcaaactagtcattcccttggagagtggaaacagtctcactttgctacttgataaggaagcagacatggaatttgtgtccagcttggcttcccttcttaagactatcgagagggcgatccaggttcacgaagatttctcaggtgtcatgaaccccgcagagctactagaatgccacttcacaggaataaaggctctggagaatgaatatggttccactgaaattgttaagcaggcaactgaagtagttcagagagctgtcaccaaatcattccagtccctacatgaagcatacaaagggaaaattgttgggctggtaatatccacaaaggaggcttcatcatccttaggatccataattgacgcaccttcttcactgcacatttcaagacgactagaagaagcaagcaagactaaagaagcctctgtggcacttgttcgaaagagtttggcatggattacagggatcatcctgcttgtttcaactctcataggggtttgcttgcttatgaacatgccacttaccagggacaccctcttgtactcgaacgtcaagattgattagtactcgaacgtcaagattgattagtttgaagggtgttcgcggaggccacagttggggttcaactttggcctgtgtagttatgggatggatttcggacggtagagatgtattcttatgctgtttacaaaaccggtgtacaatgggatactaggtgctacgtgctttttttgaatctgtgctgcgctgctgcctgtatgggttgttttgttgttgggttccggtaaataatccagagtggaacaaacgattaattgttgcagaatgctactgccttttccgaataaatctgtgacgattgtaatcgaattttcaacttgaataatagtgtagatgctatgtttgtcgc

SEQ ID NO: 14636 - DNA, 406 bp, Sorghum bicolor
  Clone ID: LIB3481-033-P1-K1-G5
cgtccgagacgagccgtttaaataggtgtcaagtggaagtgcagtgatgtatgcagctgaggcgtgctaacgaacaaacgattaattgttgcagaatgctactgccttttccgaataaatctgtgacgattgtaatcgaattttcaacttgaataatagtgtagatgctaaaaaaaaaaaaaaaaaaaaaaaaaaaaaaaaaaaaaaaaaagaagggcggtctaaaaaaaggaagctagctttacgcaggcctgcaatcaaatacgcttgcttttaaagggggcgaccttaatataagtgaccggaatttaacaaactggcggctggttaaaaactgcataacctgaactaacttaacttaattgaaattcatcttttttcagctagttcgctttataccaggtgg

SEQ ID NO: 14637 - DNA, 1421 bp, Sorghum bicolor
  Clone ID: SORBI-28MAY03-CLUS5545_1
cccactggggcggccgccgcaaacaaaaaccaagcgcacacagaggcggccgccgcagcccgcagcagcagcagcgacacgcaccccctccccaatcacgccaccaggctacgaggaggagcgagaccgcgcaccgcagatccgtggtcgccgctagggttccggcgagatggacgtggtgaaggcggcgcagctgtccgggcggacgctggaacgggtggtggtgcaccccctggtgctgctcagcatcgtcgaccactacaaccgcgtcgcccgcgacacccgcaagcgcgtcgtcggcgtcctcctcggcacctcctcccgcggctccgtcgacgtcaccaactcctacgccgtgccgttcgaggaggatgacaaggatcctaggatctggttccttgaccacaattaccatgagtcgatgttctccatgttcaagaggattaatgccaaggagcatgttgttggctggtacagcactggcccaaaactaagggagaacgacttggatgtccatgcgttattcaacagttatgttcctaatcctgtcctggtgattattgatgttcaacccaaggagctgggaatacccactaaagcatactatgctgtggaggaggttaaagagaatgctactcagaaaagtcagaaggtatttgtccatgttccttcagaaattgctgctcatgaagttgaggaaattggagttgagcaccttctaagggatgtaaaggacacaacaataagcacacttgctacagaggtcactagcaagcttgcagccttgaagggactcgatgcaaggcttagggagatccgaagctatttggatcttgtaattgacgggaagctcccactgaatcatgaaattttataccatttgcaggatgtctttaatctccttccaaatctgaacgtaaatgagctaattaaagcctttgcagtgaaaacaaatgacatgatgttggtgatatacctgtcttctctgatccggagcgtcattgctcttcacaatttgatcaacaataagatgctaaacaaggagcacgagaaggctgaggattcgaaaccgaccgccattcctactgctgccgggagctaaacatgcttttgatcactgattggtggctaagaaaagggatgaaacttgtgatgacatgttatcacggtcggtcgtgctcgaaccaattgtcttgaccttgaatggacattttgatgtttatttcatgtatgataaggtcaatggcaagagaaaccaattaaattgtacgagctttagatcatacctcaagttttctgtagatctcggtgctatttcatctgatgcatcatgtttcatgatgtagaatttcgtttcttgtgattgatttatagtgaacctgtacgttgtacgtcatgcaattcatctccgttcatgattg

SEQ ID NO: 14638 - DNA, 1811 bp, Sorghum bicolor
  unsure (1)..(1811): unsure at all n locations
  Clone ID: SORBI-28MAY03-CLUS6105_1
gcgtcagatctgcctaaatcttgacggcnaaaaaaaaaaaaaaaaaaaaaaaagttcgccgcacgagggacatctctcgagtttgtttgttgtactgggaatagcttggtgcttttaagtatatatataaccattgaaaatggtcagcgggaggcccgggaatggtgaattggatgcatggttcaagagcctcatggtgacctctagcagcgagagggggcaggctggaagtggtggcccagcgccaacattatcaggatggaaagaccttccgatggagctcctggtcaggataatatcgactgttggagatgataggatagtcattgtggcatctggtgtttgcacaggctggcgtgacgctctgggatggggggtcactaatctttcccttacatggtgcaaacagagcatgaataatttaatgatatctcttgcacacaagtttacaaagttgcaagttctcactcttcggcaaaacaaacctcagcttgaagacagtgctgtagagtctgttgccaattactgtcatgatctgcgtgagttagacctcagcagaagcttcagacttagtgaccgctccttgtatgcattggcccatggatgcccgcggcttacaagactgaacattagtggatgttccaatttcagtgatactgccttgatttaccttacctgccactgtaaacacctgaagtgcctgaacttgtgtggatgtgggaaggctgctactgacagagctttgcaggctattgctcagaactgtgggcagctgcaatctttgaacctaggctggtgtgatgatgttacagataagggtgtgaccagcttagcgtcaggatgtcctgatctcagagctgtagacttgtgtggttgtgttcttataacagatgagagtgtggttgctcttgccaacggatgtccgcacctgcgctcgttgggcctctacttctgccagaacatcacggaccgtgccatgtactccctcgcaaacagccgcgtgaagagcaagtgtgggaggtgggatgcagtgaaagacgggcttgcgaacctcaacatcagccagtgcaccgccctgacgcccccagcggtgcaggccgtctgcgactcgttcccggcgctgcacacctgccccgagaggcactccctcatcatcagtggctgcctcagcctcacgtcagtccactgcgcctgcgccctccacccacaccgtgccgcgagagcgctgatggccaaccatgcgtactaagcttgttggtggctttgcgctgatggttctcttgaatccccccgcttgcctggtggtggtggcgtcctccaggtgtagaggaagctccctgtgtacataaactcgagacttggtggtgtaataagacactgctgtggtaggactttgtgtgataatcatggagtggcgaatatctgtagcgtggcatgtgtactccagtgctacctggacattgactagaaatgttgtaatgtgtatttatttcatggactttgtagggttgcagtcagatctgcctaaatcttgacggcagatgcatggctctgttgaaatttttgcaaagggaaaaaaactaggggaattggtagaaattcacttcgacaggccctagactgggggaaactggaaaacccacccataaatgacttgggttttgtggttggcccttgaggattttgttgcaaatgagaaaaacatgtaacccacctgtatggttttgttgcaaaacagtccctttgtacatatgctcaaccaatctaactcattttcatcaatgggaactaccagtaaaacatatctactt

SEQ ID NO: 14639 - DNA, 1897 bp, Sorghum bicolor
  Clone ID: SORBI-28MAY03-CLUS6361_1
tactggagccccaggctaagttagactagtcctcttctagtcgcctctaccccgtgttgcttgcatctccccgtcaagcacgccgccgccccatcgtgccctccgcctcctcccgaacaaagccgtcgcgctgccttccttgccgtccaccgcaggcagtcgttctaggacttgttggtcctctcctgctgcccttctacggtggaggaggagaggagaggagcagagcggagatccaaccgttttccggctgatttcttcttcttcttctatctaattgctgggcaagttccgtcgatagtcgatactgcttgtgctgttgaactaatattaagttcctgctgccagcaaaaggagagcttccacagctcctatggcaaagccactcaatggcattagccgtagcagtatgccaaggtcgaacgagggtatgcggctcatattttcggcagttgtaggtgtcatgctgggttacctgtttgggatctccttccctacagtcaacataaccaagcttcacttcccttcgagtatcatctcttatattgaagatagaaactctggcatcacaacccagacattgttgaaccatgcttgggcatctgcaaacaatcgtaaaaagaatagttctgaatctaacactgatgaaattcccaagatttatgttcctacaaacccaaaaggtgctgagagacttccaccaggcattgtagtgtctgaaacagatctttatccccgaagactatggggtgatcctagtgaggaccttactagcgagccgaggtatcttgttacttttactgttggtattggacaaaagtcaaatattgatgcagcagtcaaaaagttttcagacaaattcaccattatgttgttccattatgatggtcggactactgagtgggatgaatttgagtggtctaaaagagcaatccatgtgagtgttaggaagcagacaaaatggtggtatgcaaaacgatttttgcatcccgacattgttgccagatatgaatacattttcatctgggatgaggatctaggtgtagagcatttcaatgcagagaagtacattgagcttgttagaaagcatgggttggaaatctctcagcctggtttgcagcctgataaaggactaacatggcaaatgactaaacgacgtggtgaccaggaagttcacaaagtaactgaggagagaccaggctggtgcactgatccacatctaccaccatgtgcagcatttgttgaaattatggcaacagtgttctccagaaatgcatggcgctgtgtatggcatatgattcagaatgacttggtccatggatggggtcttgactttgctctgaggaaatgtgtggagccggctcatgagaagattggagttgttgatgctcaatggattgttcatcaagcagttccttcacttgggaaccagggcaagtcagataatggaagagcaccatgggaaggggtaagagcacgctgcagaaaagaatgggggatatttcagacaaggctggctgatgcggagaaggcttattacctggagcgaggcatcacacccccgaattcaacagtagtttagatgaatacatgctcctcacatgccacggcaaggtttctgttgcgggaacctgctgcaaactggcatgttcatcgaagctgctgcagcccagggcaaatcccatatttgtatattaggagccccacgaatcgccatgattaatcttagtgtcgttcacttctttttaatgtcattttttggttagtgagactagctgcgatgtaagtaggagatatagcagggaccgtgatgatacgcatttgtgtattaatgacctgatgcaatatggatgttgataatccttttctcagtttcagtatgtaaattgtttgttct

SEQ ID NO: 14640 - DNA, 841 bp, Sorghum bicolor
  Clone ID: SORBI-28MAY03-CLUS572_1
gcagcacgagggcgcacactcacggtcagagaaaaagctccgacgacagctgagatggcacaagccatggcgtcgatgaccggcctctcgcagggcgtcctgcccagcaggcgcgccgccaacagggccagggcggccgccgtcgtcgtcagggcgtccgccgagggcgaggccgccgcggcgcagccgggccgccgcgccgtgctcgggctggtggccaccggcgtcgtcggcggcgccttgtcgcaggcggtgcacgccgcgaccgtcaattccatcaagatcggagccccgccgccgccctccggtggactccccgggactgaaaactctgaccaggcgagggacttcggcctccccttgaaggatcgattctacctgcagccgctgccaccggcggaggcggcggcgagggtgaagacgtcggcgcaggacatcatcaacctgaagccgctcatcgacaagaaggcgtggccgtacgtccagaacgacctccgcctcagggcctcctacctgcgctatgacctcaagaccgtcatcgcttcaaagcccaaggaggagaagaagagcctcaaggagctcaccggcaagctcttcagcaccatcgacgatcttgaccatgccgcgaagatcaagagcaccccagaggccgagaaatactttgcagcaaccaaagatgtgctcggcgatgttctcgccaagataggctagacggaagggctaataatggccatttaatttcgaacttgtgtttgttcatatggagccggcaatgtaccattttctgttgatattgtatcagaaagcacttaactatgatgctatcctgagttcttgagac

SEQ ID NO: 14641 - DNA, 1082 bp, Sorghum bicolor
  Clone ID: SORBI-28MAY03-CLUS726_1
cccgtccctgtccggcgcgagaggctccctgctataactgccgatcggtcgtctccggaccggcgggaaaggagaccacctcgcctcgtcagatcgaccgaccgtgaggaagcgaatcggctcgtcagcccgtcgccatggccgccgtggaggtgtgcgtgaaggcagccgccgggaagcccgacacgctcggcgactgcccgttctcgcagagggtgctgctcacgctggaggagaagaaagtcccctacgaggtcaagctcgtcgacctcggcaacaagcccgaatggtttctggagattaacccagagggtaaggtgcctgtgctcaaaggtgatgatggtaaatgcattgctgattctgatgtaatcacccaagtcatcgaggagaagttcccaactccatctctggtcacccctccagaatatgcatcagtgggatcaaagattttcccagcctttgtcaagttcttgaagagcaaggatgctagtgatggttcagagaaggcgcttctggatgagctgcaggcactggatgagcatctcaaagctcatggcccttacatcaatggggacaatgtgtcagcggctgatctaagccttgcgccaaagctcttccacctccaggtcgcactagagcatttcaaaggctggaagatcccagaaaacctaaccaacgtccacgcctacaccaaggctcttttcagccgtgaatcttttgtcaagactaagccatccgaggagcacgtgattgcgggatgggcgcccaaggtgaacgcataagtgccttctgctttggtgctacctggtggactccatccatttatctgatcagtcgttgtcagtggtgtggataggtgtcgcgtctgtagcctggatgcatgattgagttggaataatgcagtgccgtgtcttgagtactcagttctggctgttgccattgtgcatcttaccttctgttgccggttttgttcagagaccatggcatctcttgatcctatgctactgtaatgtgggtaccaaataatggagctgcttttgtgcttgtggtgtgcataaaaaaaaaaaaaaaaaaggccccta

SEQ ID NO: 14642 - DNA, 820 bp, Sorghum bicolor
  Clone ID: SORBI-28MAY03-CLUS2012_2
gccggccggggcgggacccccttcctcctccgcgccgccgccaccaccgcctcgcggccgcctgcggctccgctcctccacccggaagttggtgaaggtttcttgagcctgagaagatggtgctgaagacggaactttgccgcttcagcggtcagaagatttatcctgggaaaggcatcagatttattcgtgctgattctcaggttttcctttttgccaactcgaaatgcaagcgctacttccacaaccgcctgaagcctgctaagcttacctggacagcaatgtacaggaagcaacacaagaaggacatccatgctgaagcggtcaagaagaggcgccgtaccaccaagaagccatactcaaggtcaattgtcggtgcttccttggaagtgatccagaagaagagagctgagaagcccgaggttcgtgatgctgctagagaagctgctcttcgcgagatcaaggagcgcatcaagaagaccaaggatgagaagaaagcgaagaaggcggaggtgaccaaatcccagaaggggcaaacgaagggcgcagtccagaagggttccaagggccccaagttgggtggtggcggcgggaagcgctgaaagaactgaagtgtcattcccctaccttgcagctgctccttagcctaccctgttgcaccaaagccacttttgtagaacctcggttaaatttggaagactattctttcagtgttgcttgtgggtgttaaataccatgacaatagaacgtatttatatttatgttggaaaaaaatggtcgtcgttcatatgctgcaaaaaaaaaaaaaaaaaggccccta

SEQ ID NO: 14643 - DNA, 822 bp, Sorghum bicolor
  Clone ID: SORBI-28MAY03-CLUS2012_1
tgcgccggccgggccgggggaaccacgaacacactcgcctcctctctccgccgccgccaccgtcgcctcgcggccgcccccggctccgctcctccgctcggttggtgaaggtttcttgaagttgagaagatggtgctgaagaccgaactttgccgcttcagcggccagaagatttatcctgggaagggcatccgatttattcgcgctgattctcaggttttcctttttgccaactcgaaatgcaagcgctacttccacaaccgtctgaagcctgcaaagcttacctggacagcaatgtacaggaagcagcacaagaaggatatccatgctgaagctgtgaagaagaggcgccgcaccaccaagaagccatactccaggtcaattgtgggtgcctccctggaagtgatccagaagaagagagctgagaagcccgaggtgcgcgatgctgctagggaagctgctcttcgcgagatcaaggagcgcatcaagaagaccaaggatgagaagaaggcaaagaaggcggaggtgaccaagtcccagaagtcgcagtcgaagggcgcggttcagaagggttccaagggccccaagctgggcggcggcggcggcaagcgctgaaagaactgaagatgtcatttgctgctgaccttgcaatcgctcctcattagcctacctaccttgtttctccagagccagttttgtagtacctgtacctgggttaaatttgcagttcctttcaccgttgctttgtgggtgttaaataccgtgacgagaaaatggatttatctttgtgttgcaaaaaatgatggtcgttcatgtgctgcc

SEQ ID NO: 14644 - DNA, 872 bp, Sorghum bicolor
  Clone ID: SORBI-28MAY03-CLUS2349_2
accacttgtattgcattgcaatctagacacagcaggcacgagaccgtcagttagcccagcgagagtggagcaattaatggcaaccatcagcgccgccaccctcgtcggcgcggccgccgtcgccaggccgtctcaggctcaagggctgccgcagctgagggtgagaggcgagaagcaggtgcaccggtgtggcgccgccgactcgaggcggccgagccagcgggacgtcgacggcgggaacagcgtgaacggcaaggcggcaccagcgtcgtcgtctcctgcgggcggcgccgcgtcgtcgcttctggccgcggcgagcgcgatgacgacgtcgtcgcccgcgctggcgctggtggacgagcggatgtcgacggagggcaccgggctcagcctggggctcagcaacaacctgctggggtggatcctgctcggcgtcttcggcctcatctggtccctctacaccgtctacacctccgctcgacgaggacgaggactccggcctctcgctctgaaataatctacctagctgattcgtcgatcattcctagctacttgtatttttgttcagcctgaccccgtgtattgtagtccgtgtgtgagttcgatcgatctgtgcatgcgtgggtgcagacgaagcaagccatggttgtatgcgaccgtaactcagttgttgcatctcagatatggtacgtaatgacgagtacttaattagtactagggtgaagtcccgatctcgaaaaaaagtacttagcagtagttggtttatccattactcatccgttctaaattataagttattttggttttttctaatatatcaattttgctatgtttcagatatacattttaaatacccattaaagtctatgtgg

SEQ ID NO: 14645 - DNA, 723 bp, Sorghum bicolor
  Clone ID: SORBI-28MAY03-CLUS2349_1
gcgcggggatcgtgagtctttttcaaatgggaccgccgccaactcgggcacgggggccacagagcaaaagcaccacactccactatccagcaaaagagatccagaggcagcagtcatggccaccgtcagcgccgccgcggcgaccaccgtcgttgcccgcgccgcgatcgccaggcccaacgctctagggctgccccagctgagggcgaggagcgagagggtgcggtgcagctacgccaaggacgcggccgccgtcagcgccaaggccgctggcgcgtcgctgctcgccgccgcgggcgcggtgaccgcgtcggcggggcccgcgctggcgctcgtggacgagcggatgtccacggagggcaccgggctcagccttgggctcagcaacaacctgctggggtggatcctcctgggggtcttcggcctcatctggtccctctacaccgtctacacctccgacctcgacgaggacgaggagtccggcctctcgctctagatccatccatccatccatccaccctctcctgctgttaaaggatctgcatgtaaacatggtggtggcggccaccggtgtaatttcagacatggctatttgtatctaagcttcacttttgcgagatgttagcagctggattataagtaataatattttgatccggccgtggagattacgcacgcacgtagcaatagcaacagcaaaaaaaaaaaaaaaaaaggccccta

SEQ ID NO: 14646 - DNA, 3211 bp, Sorghum bicolor
  Clone ID: SORBI-28MAY03-CLUS40827_1
gcacgagggcagcagtcgcttccgtcccccttcctcttcctctcgtattcgcttcgccgcccaaccccagcctccaccgctgccttcccgaccgttctcgccgccaccgtctccgcgcctgccaccccgcgcggccggcgaccggcgccgacgcggccgctcgatccaaggccagatccgaacccaccctggtccgcatcacgccgatatttttcaggtttttggtacggatctagggttttcctgctgcgggttcgttcgattcgctcatggccgctgggcgccatgggggctacagggactgcgaggcgagggagcgggagctcgacgcggaggcctccaggaggagcaaggagcagcaccaccatctcggcggccgccaccgcgacgtggaccgccgccgcgatggcgggcgcagccgcagcggcgcccaggttcccccccggcccccgcccccggcgctcgcccccgcccaggagccgactcgcgggaaggcttggtgaccgtgagcctggcgaggtgctaagcggtagtgcatctgatgactccggtggcagaccgcatagagggagggagaatggcgtgcccggttctatcagggagggcgatgtggcagtaggctcagggatctcgtcgccgagcaagaagaggaaattctcacctataatttgggacagggatagcccaaagccaccacattctgatgcaacaagggacaagaacgtggtggaccctgggccctctgtgctcccgccgccccccccacggcctcagcttgtcctcggccccccgggcgggcccggggggtggtccccttcggcggccgagcctactgttggtacagagagtgctttgcagttgccggaacatgaggtgaataaggtgacagagctggaagaggagtatccaacaatgaggaacatatcgacttcaagatgggcgggtgctaatgatgatgaggaagatggggcagctccaatgaagaagaaaagtgtttctcctgcagacccctctgtggcagggcagtggaaaagaacaagtccagaacctggtgaagtctccggaggaaggacaatgtctaggtcatctgactcagggaaaatgggtaatgatgagaaagaagattatgaggtcgataaagatgactatatgaatgtcgacagggagcatgctagtgacagtgatacagaaaaccatatgtcagatactgactcagacaatgaaatacgcagacctgaaacccctgaaccagagaagccaccacacaggtgtatcaatatgcttcaaggttgcagaagtgttgatgagtttgagaggctcaacaaaattaacgagggcacatatggtgttgtatacagagcaagggataagaagacaagtgagattgttgcattgaagaaggtaaagatggagaaagagcgagaaggtttcccattaacctctcttagggaaataaatatcctcttgtctttccaccatccttcaattgtggatgttaaggaagtagtagttggaagtagtctagatagtatttttatggttatggagtacatggaacatgatgttaaaggtgtcatggagaccatgaaacaaccatatacccaaagcgaggtcaaatgtttgatgcttcagctgctagagggcgtgaagtatcttcatgacaattgggtacttcacagggatctcaagacctcaaatctcctcctgaataaccgtggtgagttaaaaatatgtgattttggactctctcgtcaatatgggagcccattaaaaccttatactcaactggttgtgactttgtggtacagggccccagaactgttgttaggaacaaaggagtattccaccgctattgatatgtggtcggtgggctgtataatggctgagcttcttgccaaagaaccattattcaatggaaaaacagagtttgaacagctagataagatatttagaacacttggcacacctaatgagaagatttggccaggctatgctaaattgccaggtgtgaaagtaaattttgtcaaacaaccgtataataggctaagggataagttcccagctgcgtctttttctgggcgaccaatcctgtctgaagctggttttgatctattgaacaggctgctaacttatgaccccgataagcgtatatcagcagacgacgctctgaagcacaaatggttctctgaagttcctctgcctaaatcaaaggacttcatgccaacattccctgctcttaatgaacttgacaggcgtaccaaacggtatctgaagagtcctgatcctctggaagagcaacgtttgaaagaactgcaagggaatataggcaaccgcgggctttttggctgatctagaagcacttgcttgggttcctgtctgtactaactgttatgcttcaccctgaatccccgaggtcagatatcttctgaggtgaggtgacatggacatgaagtatcacatcttctcggtgtctagcagcgactgatagtgttctttagcaggcttggtgccggtttaagtggataaggtttctccttgtggtccatcatagaaattttgttgcaggattaacacttcatccagattgatcataaaagcaaatataatctgcctgcatcgtaaggtgtggcgtgttggcttttattggttacaccagtttgccctttggaacttctgtatgtaaaatattccagattggtacgttgtaaacaatgtccagtgcgttggatttaaatttaaaataaaacatcatcattattagttttctttatgctccttgtgcattttcttttgatctttgcattttgtttgcaagagacgaaagaagcgcaggagaaggatgccttttgctttcaccaggaaatcaatggcattaatacaacctagaagctaagctgtggctgcttcaagataggaagcttgatggccgtcagcttgttgtacctaagtgactaaattatgtggagggccttcaaaagtgttcatcttttactagtgaaccatggcggtcactggtcagtgtactatccttccttgtacattaatgtaaccattcttctaaattatttggagactatttgtctgtatttttgtttgtagaggttgttgcttatcttcagttgagagttaacattgcttacagaaaaacacgaagcgaattggttccctgcgatatagtaaatcacaatgaatcaagtgaaagttagcatgt

SEQ ID NO: 14647 - DNA, 1020 bp, Sorghum bicolor
  unsure (1)..(1020): unsure at all n locations
  Clone ID: SORBI-28MAY03-CLUS1174_1
gccggccgggccgggnnnnnnnnnnnnnnnnaaaaaaaaaaaaaaaaaaaaaaaaaaaaaaaaaaactcttcctctcgattccgaagctgttctcgcccccagaaataaagcagctcctccggggggcggcgaaccacttcccatcgccaaaaccctagccccgatccggtcgaggagcgctgcttccttgccatggcgagcaccactagccaggcgagcctcctactccagaagcagctcaaggatcttgcgaagaaccccgtggatgggttctcggcggggcttgtagacgatagcaacgtcttcgagtggcaggtcaccatcatcggcccgcctgacaccctatatgatggaggctacttcaatgcaataatgaccttcccccagaactatcccaacagcccgccatcagtaagatttacttctgagatgtggcatccgaacgtttatcctgatggacgtgtttgcatctctattcttcatccacctggcgaggatcccaatggttatgagcttgcaagcgaacggtggacaccagtgcatacggttgaaagtatagttttgagcatcatttcaatgctttctagcccgaacgacgagtctccagcgaatattgaagctgctaaggattggagagaaaagcgggatgagttcaagaaaaaggtaaggcaatgtgtccgcagatctcaggaaatgctctgaaggaggaacatatggggagttgaacgagtgctgcaaccggtctgctgcaattcacagccaattacctcgtgccagcattcttttgcttttcccctgtatattttccgttcagtgtcattcgtatggtggtgttgggtctccttagacaaactcgggactgttgcttatcctaaaaattcgattgtattgtgtggcatgaaatgatcggtgtcgaagaatattttgaacatactgccacctaatcataattttcatggagaacatcataagaaagatgtgatggctgccaaatgtgtctttagctcatttccttgctg

SEQ ID NO: 14648 - DNA, 2456 bp, Sorghum bicolor
  Clone ID: SORBI-28MAY03-CLUS109_1
gcacgaggggctccgctccccggtcctctccccctgtcccccagggcgccccccggtgttcggtatccctcctggggcgccgtcgctcagcgaattcggcacgaggctgggtgcaccatagacctgactgatgcttctccccccttctcttgcagtctagcatccatttcacttcacaagggcttcttctttttactgaagtaaacaaaatcagagtacattcagcagtgcatctgctcctgaaaaaaaaaatcatgatgagacattcagaaataatgaagctattagcttttgtgctacttatgttgggatgccaacagtcttcactttgtctcgctgtcgactcccaagtcgaagcactggttgaaatgaagatgcaacttgtcgataaccgtggtgtccttagtgattggaaggataatcaaatgagcccctgctactgggaatatgttaattgtcaggacaacaaagtttcaacaataactttgagctcgtctgggttaacaggaaccttatcacccagcattgctaagctaacaactttacagcagctgaaactggataacaacaacataactggagggattcctccggagtttggaaacctatcaagtttgacaattctaaaccttggaagaaataatttaaatggatcgataccagactcccttggacaactttctaaactccaaattctggatctaagtcacaatcatttaagtgggaatatcccaagctctttctcaaatcctccatcattgaatgatattaatctagcatataataatattagcggtgaaatcccacaacatctacttcaggcggctcattacaactttacaggcaaccacttgaattgtggccaaaatttatttccatgtgaaggaggtagcacaatgacaggtggatcgaaaaattccaagctaaaggtggttattggaagcattgctggagcagtcactctttgtgtaactgtagctctagttttgctatggtggcaaagaatgcgttatcggcctgaaatcttcattgacgtgtcaggtcagaatgatcatatgcttgagtttgggcaaataaagcggttctcatggcgagagcttcagattgcaaccaactatttcagtgaacaaaatgttcttggcaagggtggttttggtaaggtgtataaaggagttcttccaggtccagacagtataaagattgcagtgaaacgactattcaatgtggagaggcatgaaggggaattggctttccttagagaagttgaattgataagcattgctgtgcacaagaacatattaaggttgataggattctgtacaacaccaacagagaggctcttggtctaccctttcatggagaatcttagtgttgcttctcgtttaagagatataaaattaaatgaaccagtattagattggtctacaagaatgcgaattgctcttggtgctgcccgtggtttggaataccttcatgagcactgcaatcccaagatcatccaccgtgacgtcaaggctgcaaatgtcctgcttgatgggaacttcgaagcagtggtaggggattttgggttagccaagatgatggacatagggaggaatacagtaacaacaggggttcgtgggactatgggccacatagctcctgagtacataaagacaggaaggccatcagtgaagacagatatctatggatatggtgtcatgctgttagagattgtgacaggagagcgtgcaattgcattccatcctgaccgtatggaagaagcaggggagatcatgctcattgatcaggtcaagctatggatggaagaagggcgactactcgacctagtagatcgcaatctaggtggcgtctacaaccttgaagagctggagaaggttacccagatagcacttctctgcacccacatggaacctagtcaacgccctacaatgtcagaggtcgtgcagatgctggaaggagagattgtcccagcagagcggtgggaggaatggcagctggctgagctccaacgacgacaacagcatgagatgaggcaacagggaaaactattcaacttcagtgaagagtctctaaacatccaggaagccattgagttgtcaactggcagatgagctgtcataagaaagtgacatgattttcactcgttccttaagtagaaaggctatatggaaatttcaggagtacgcactacaaatattgactattaggatttaggaatagtctataaggtcctgatgtaatagcttgcacaagtaactccatccaaatgctgttaatacagcgataggaccacacctagcttagaccatgtgtatattaagactatagactgttctacattttaattgcgttctgtattagtggataactctgaaattctctgttgggggggggtaaaaattaaacccttgaattcaaaatttagcttaaaaagccaaaaacttcagcaaaaa

SEQ ID NO: 14649 - DNA, 413 bp, Sorghum bicolor
  Clone ID: LIB3480-025-P1-K1-A1
ggagatttccttatcttcaatgaccataatgtgaattttctacctttgacagtaatggagttccaagtctagaaaagctgagatgaataggctgaacttacattgttgaaactttgttgtcctgacaattaacatattcccagtagcaggggctcatttgattatccttccaatcactaaggacaccacggttatcgacaagttgcatcttcatttcaaccagtgcttcgactgcagacaaaacagtcttatttctggggcccaaggagcagatgcactgctgaatgtactctgattttgtttacttcagtaaaaagaagaagcccttgtgaagtgaaatggatcctagactgctgcatcaatgaaacaaagtgtgtaagaagagagcaaacagagaagaatggaaggcaaat

SEQ ID NO: 14650 - DNA, 2296 bp, Sorghum bicolor
  Clone ID: SORBI-28MAY03-CLUS87_1
ccccaaggctccgctcccagcaactcgccactctccgccgccgcgcccttggagagcggcatgcgccactccgacccgccacagctggcgtctctcccggcaacggcgtccgcccaccccctccttccccaccagtacctccaccgccacctccgccgccgctaccccggctccctcttcgactccagatcccacgaccagccccggcgccgccccgaccagcagcagcacaagcagcggctcaacgaggccaccgacatcgtgacgaagttcgagaccacctccgcgggccccgcccattgtcgccccgatgcccaggccggcggcgccaagcgcgtgcgggtcgcgaacgacgctggcatcgacagcagcgaggaggccgtggaggacgcggtggagggggaggccgcgctggagaaaggcggctacatggaggacgtcgaggacaagcccgtcgtcatggagtccgacgaccccgaggcgcaccgcgcgccaacgtacgggtcggagagcgtaccggccgtgcaggacctcgtcgccacggacgatcagccggtgaccaacccggccatctggctcatggtcgtctccttcttcttcgcccgcggcttccacagggcgcggctctgcgagtgcgccgccacctcctacctcgtcggcatgtgcgataagccggcggggccatcggccgtgctggaggtgggcggggacggcgccgcaccgggggtgcgcatcggtgacatcgggggccccgtcgtctaggttcctgccgcgccgtgattcacgccgtcagccgggcgagagggtgaggacatatgctcgcggaagctggggccgtatttggagatgttgcaattccaggcagctagtagctccattggttcgggcctgaatggtgggaaacaaaatctgtggtgcttgaagctagcagaaaagtttggtgttattatcgcaaatccatgggtaacatggtttaaagctgctagtttgccagctattgtttctctcctagcaacgccatacttgctatacaaaatctttccccctgaaataaaggacacccctgaggccccggcattggctgcagagaagcagaagcagatgggtccggtgactaaaaatgaatgggctatgattggcacaatgattcttgcagtcgcgctatggatttttggggatgctattggtgtgtctagtgttgtggctgcaatgcttgggctctccattcttctcctgcttggtgtgctggactgggctgatatcttgaatgagaaatccgcatgggatacattggcttggttttcagttctggttgggatggcagcacaactcacaagcctggggattgtttcttggatgtcaagctgtattgctaacctgcttcagtctttctcattgagttggcctgcagcattttgtgttcttcaggcctcctaccttgtgatccattatctattcgcaagtcaaactgggcatgttggagccttgtactctgcattcctggctatgcatgtagcagcaggcgttcctagtgtgctttcagcacttgctttggcgttcaacacagatttgtttgggggaataactcactacagtagtgggcaggcagcggtatactttggagctgggtatcttgaccttcctgatgttttcaggattggttttatatcaaccttgattaacacattgatctggggaggtattgggaccttttggtggaaatttttagggctctactgacagcaggcgccgtcaacgtaccggtggtgttggaagtgatgacagcagctggattaagtggaggcaggacaacattgaattggataattcagttgagatgtgattctggggagatgagatggtgccattgtattgttactcccaaaaccgtttccccggtcagagggaagtcttgcaaatgtgaaatggaagaaaaatgcgctgctggtagttgcacttgcacggagttggagctgggctcgggggctgtttggaagctcagtatttatcctaaaacccttgtaaattacaggtttacgcgcgactgtcacaatatagtagagaaaagcgcgaccaatctctacgcgcatgatgccttagagcactcacaatgcagactctatcatagagtctaaagttatttattatctcgaacaatgtggacttagagtctaaataagacttggagttttattttttttatctctttcttaaataaatatgctatcccatcagtaaaatccctttaataatatgtaattaattatcttggcctccacttagttgaccaaaattt

SEQ ID NO: 14651 - DNA, 381 bp, Sorghum bicolor
  Clone ID: LIB3478-047-P1-K1-C9
tcgaattccgggcggacgcgtgggctaaaaacgaatgggttatgattggcacaatgattcttgcagtctccttatgggtttttggggatgctattggtgtgccaagtgttgtggctgcaatgcttgggctctccattcttctccttctcggtgtgctagactgggatgattgcttgaatgagaaatcagcatgggatacattggcttggtttgcggttctggttggaatggcagcacaactcactaacctgggaattgcttcttggatgtcaagctgtgctgccaagctgcttcagtcattctcgatgagttggccagtggcattttgtattcttgagggctcctactttctgatccactacctacttgcaagcccaactg

SEQ ID NO: 14652 - DNA, 461 bp, Sorghum bicolor
  Clone ID: LIB3478-009-P1-K1-F5
cttcgcgcgcgggttcgtcaagacgggcctcggcgaccgaatcgccacctacttcgtcaagtggctcgggagcagcacgctcggcctgtcctacgggctcaccatcagcgaggcctgcatcgcgccggccatgcccagcaccacggcgagggccggaggcgtgttcctgcccatcatcaagtcgctctcgctgtcggccgagagcaagcccaaccatccatcgtcacggaagcttgggtcctatcttgtgatgacgcaattccaggcaagtggtaactcgagtgctttattcctcactgctgcagcacaaaacctgttgtgcttgaagctagcagaggagcttggtgtattcattgcaaatccatgggtatcatggttcaaagctgctagcttgccagctctggctgctctgctagcaacaccatatttgctgtacaaaatcttcccctgaaacaaagaca

SEQ ID NO: 14653 - DNA, 923 bp, Sorghum bicolor
  Clone ID: SORBI-28MAY03-CLUS160_1
cgctcgatgccggccgggccgggcactccacccgcttcccgcagccactgcaaacccttgcgccgccgccgcctcacaggtaaggccgagatggtttccggctccggcgtgtgcgcgaagcgcatcgtggtggacgcgcgccaccacatgctcggacgcctgtcgtcgattatcgccaaggagctgctgaatgggcagaaggtggtcgtcgtccgctgcgaggagatctgcatgtcgggcggcctcgtccgccagaagatgaagtacctccgcttcctccgcaagaggatgaacaccaagccgtctcacggccccattcacttccgtgcccccagcaagatcctgtggcgcaccatccgtgggatgattccgcataagaccaagaggggagaggcggctcttgcaaggctcaagacctacgagggcgtcccgccgccgtacgacaagaccaagcgcgtggtcatccctgacgctcttaaggttctgaggctgcagcctgggcacaagtactgcctcctcggcgagctctctaaggaggtcggatggaactaccatgacaccatcagggagcttgaggagaagaggaaggagaaggccaaggttgcctatgagaggaggaagcaactggccaagctgcgtgtcaaggctgagaagacagccgaggagaagctgggatctcagctggagattcttgccccgatcaaatactgagaagctgtgctttcgtgcgtatcagttttgtggaacaactggtccattgttttaagtagtttggtaaaagtttgtgacagtataatcttgagtagtaaaccgtgttatccttctgcgactcctattttgaacacattttcatgctggtgaatgtactgtttggttttatcagatgtgcggtttgcatttgcattctgaaaaaaaaaaaaaaa

SEQ ID NO: 14654 - DNA, 1155 bp, Sorghum bicolor
  unsure (1)..(1155): unsure at all n locations
  Clone ID: SORBI-28MAY03-CLUS142_1
gggtaattaaatagtggttgaaaaacaacaatgcaatgcaagcagcagacgccaccgtcaccgcatgtttcaacaccaccacatacagaaaaacacaatttacaagctgacatggaaagaggagaggagagaaagctaagcagagaagaagccggcggccggggccaagcacgcacgaagtacagttctagctacgtgacagccagcactacacacaccatcccttgtcgacacaaagacagtttgtttgtaacaggacagaagccaagaagaaagaaatggcgtcgacggtggcaagcctctcaattccggcgaccaccttcgcggcggcggcggccggcgatgtgctcccaaggaggaaggccgccgccaccggccgcgtctggttccccgtggcgcggcgcggcggaggattcgccgtgaggtcgaccgggccggccacgccgtcgaacatctccgacaagctgtcggagagcatcaaggaggcggaggagacgtgcgcggacgagaagggcaccgcggagtgcgcggcggcatgggacaatgtggaggagatcagcgccgcggcgagccacgcccgcgacaacctcaaggagaacagcgacccgctggagaagtactgcaaggagaacccggagaccgacgagtgccgcatctacgacaactaataataagcgcgtgtgtacaagtaattaatcgatcacacgtgttattagtttgttaatgaatcaaacgtgttgagttattagtttgttattatgtataggcgacataaaaggaattgaaggttgtgtgggacataagaataatactcggggaggaggaatgatgaacacttgtatgaaactacttgaatgtatggctatatcatcattcatactaggatgacaagggcctccccggtatgaaattgggatggtatactagtatttttttggattactttcttgtggccaagcgtgtttaaagtttgggatggactgacaaatactttgcattgttaagaatccatcaagttcaagtaatctcatcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14655 - DNA, 1148 bp, Sorghum bicolor
  Clone ID: SORBI-28MAY03-CLUS1384_2
attccggtcgaccacgcgtacgcgaccgcgtcagaaaaggagtctgacatctcaaaactagagcgacagattacattatccgagataaagtacatggaggagataaagaccatgcaagtggagacaactgaaaagaatgaagcactaacagccaagttgcaggaacacgcagacctacagcatgagaaagatgagttggaacgacagttgctggaagttaggaaagaactggatggtgcctaccataccatagcaaatcaggaagaacaagcttctgtgagagagataaagtgggacgcttttaggaagtattcagaggatcgtctggaagctgagcagcagcgtgctgaggagctggaactacaagtagaagctcttaaacaacagctccaagaagctgagatccgttacaagcaaaaggaagaacaagtttctctaagggaggttcaatgggaagcggatcaaaatcattcactggaagctcagcgtcactatgccacggacttggagaaacaaatcgaagatcttacacagaagttacaatcagctgatgcacactacaagcagaaggtcacagaagtaaacaagagtgttgaattggagaagaaggtgcaggaccttgagcagaagctgcagctagcttattccaagtctgaggaacaggtaacggatgctgtggaatcgagatcccgtgaagtcagcctggattcatcaacaagttcagtcaaacagcaagacagaactctggctgctgacaaggcctcaccgagcccaaccctgcaagaagtacaggaaccttctggcatcatggctttcaagttcatcctgggagttgccctgctatccatactcattggtgtgtttcttgggaagcggtactagtgctcagtttgtggaagtcggttgatgcccatcagctcatggaagatcccactgttaatattgctctcagcgaaacttggttattaatttgtagctgaattggcttaaccagcagaagtttgaaaggattggtggccttggtggtaatggttcgacgactttctggaagaagtcggagatcttggaaagccttttattctcctggtggtgaggttttgtcttaattttcatctttttgagtaagggggggcaaggaatttgatttt

SEQ ID NO: 14656 - DNA, 1229 bp, Sorghum bicolor
  Clone ID: SORBI-28MAY03-CLUS1384_1
gcacgaggccgcccccaaccctatatctcccggccgccgctcctccctccccgccgccagccctatcttttcgatctcgcccactccgtctcccttacaggcggcggcggccagggctagcgcacgcggcggcaaccatggcagtcggcaagaacaagaggatctccaagggaaagaagggtgggaagaagaagaccgtcgaccccttctctaagaaggattggtatgacatcaaggccccgtcggtgttcagtgtgcgcaacattgggaagactctcgtgtccaggacacagggtaccaggattgcatctgagggtctgaagcatagagtctttgaggtttgcctagctgatcttcagggtgacgaggatcaggcttaccggaaaatcaggcttcgtgctgaagatgtgcaaggcaggaatgtgctcacaaacttttggggaatgtcatttactactgataaactcagatccctggtcaagaagtggcagacactcattgaagcccatgttgatgtcaaaacaactgacaactacatgctgcgcttgttctgcattggcttcaccaagaggcgtccaaaccaggtgaagagaacctgctatgcccaggcttcccagatccgccagatccgccgcaagatggttgagattatggccaaccaggcttctacatgtgacctgaaagagcttgtttcaaagttcattccagaagttattggtaaagagattgagaagtccacctccagcatcttcccactccaaaatgtcttcatccgcaaggtgaagatactcaaggctcccaagtttgatctcgggaagctcatggaggttcatggtgactacaaggaggatgtgggggtgaagcttgagaggcctgttgagggagatgaggctgggcaggaggttgctgctgccgagtagtttatttgctactactataatatctagaagattttggacagtaggttgcttatgatgtgaacttcatagaattgtattggctacctgtttgcttctggccctaagattgtctcaaaacaagtgttttaagattattgataagaagtgtttaagattatttttggtgacagaagtttgaaaggattggtggccttggtggtaatggttcgacgactttctgggagaagtcggagatcttggaagcctttttattctcctgttgttgagtttttttcttaattttcatctttttgggtaaggggggagcaa

SEQ ID NO: 14657 - DNA, 588 bp, Sorghum bicolor
  Clone ID: SORBI-28MAY03-CLUS1991_2
gttcgtaaactatagctagtttaagttagtgggtcaatacgatactatgtatttgctgtaaaaaaactaaattatgcacaaagttgtgctgaagtttgagtgctattctaacgcaggttagtgatgaaggtggcgggataccaagaagtggcctcccaagaattttcacgtatctgtatagcactgcaaagaatcctcctgagctagatagacctaatgtaggagtaactatggccggatatggtttcgggctcccaatcagccggctttacgctcggtattttggcggcgacttgcaaatcatctcaatggaaggatacggtatggtcatgtttcacttgatagtagacagtcagtcaatctaagcataacaaaatcaaccatggtctgcagttccatatcataaattgtcgcatcagacatgggaacataactactgtttctattcgtcgtctaggtaccgatgcttacctccacttgtcacggctgggagattcagaggagcccttgccttgacgacatatttctgtggcccccaataccactctttctctgtaattatgctgctcttcttcttgtaatccagtg

SEQ ID NO: 14658 - DNA, 1876 bp, Sorghum bicolor
  Clone ID: SORBI-28MAY03-CLUS1991_1
gggcttctactccgtgcggtgcggtgcggtgcggtgcgctttgctggtgtgtcctcgactcctcgtgcagcctcgctcgctggctgatcccaattcccacagggggccggggactggcggcggttgacggctgatagagttggcgcggagtgtgggtgatggcgtcggagccggtggcgcgggcggtggcggaggaggtggggcgatgggggagcatgaagcagacgggggtgaccctgaggtacatgatggagttcggctcccgccccaccccgcgcaacctgctgctctccgcgcagttcctgcacaaggagctccccatccgcttcgcgcgccgcgcgctcgagctcgagtcgctgcccttcggcctctccaacaagcccgccatcctcaaggtgcgggattggtacttggactcattccgcgacatcagatacttccctgaagtgaggagccggaacgacgagctcgctttcacacagatgatcaatatggtcaaaatgcggcacaataatgtggttccaacaatggctttgggagtgcagcagctgaagaaggaactgggccacgcaaggaaggttccctttgaattcgatgatcagatccacgagttccttgatcgtttctacatgtcaaggattggcatccgcatgctgatagggcagcatgtggctttgcatgatcctcaaccctctggtgtcataggcctcattaatacaagattatccccaatacaggtggctcaagctgcttgtgaagatgcccgtgctatttgcttaagggaatatggatcagctcctgatattaacatttatggtgatccaaattttacatttccatatgtcacacatcacctacatctgatgttatttgaattggtcaagaactctctccgtgcggtgcaagaacgggatatgaattctgatgaagatgttcctccagttagaattatagttgctgatggagaagaagatgttactatcaaggttagtgatgaaggtggcgggataccaagaagtggcctcccaagaattttcacgtatctgtatagcactgcaaagaatcctcctgagctagatagacctaatgtaggagtaactatggccggatatggtttcgggctcccaatcagccggctttacgctcggtattttggcggcgacttgcaaatcatctcaatggaaggatacggtaccgatgcttacctccacttgtcacggctgggagattcagaggagcccttgccttgacgacatatttctgtggcccccaataccactctttctcctgtaattatgctgctcttcttcttgtaatccagtgctggtctgcgaatattgttgtaataggccagccacctatagctatagttggtctcgatcttatagtccggcccctcagctctgcagcattggggaacacagcactgctacgtcctgcttgcttctgccatgtagtatgatctctctgccgggtttcagggggagaaaaatagagaatagtatgatccctccgtcgggtatcagaaaacagtatgatgatccctctgcctcccagaaaccagcgttgcaaatggggagaagcacccggacctatgccgatgagcacaaatttgagattattctcagcagctgctaatttcatagctgcatctcttgttgtacagtatataatctggatttgggctttgctacgctactccgtagcgacggtggactctcgatctttatggcaattatcacgtattaccttctaggaggtaatagagaaatataagaaaaatagagaattgtgttcctataaaaaaaaaaaaaaatcaaaaaaaaaaaaaaaaaagggggccgctcgcgatctagaactagtccccacgcgtccg

SEQ ID NO: 14659 - DNA, 589 bp, Sorghum bicolor
  Clone ID: SORBI-28MAY03-CLUS2803_3
gccggcggccggtgccctcatccaagtgtactcctcgcgccgccgccgccgcagttcgcttcgcgtgaccgagagctcgtcggcccccgtccacgcgagaagcgagagcatggacacccaggtgaagcttgctgttgtggtgaaggtgatgggcaggactggctccaggggtcaggtgacccaggccagagtgaagttcttggatgaccagaaccgtctcatcatgaggaacgtcaagggcccagttcgtgagggtgacatcctcacccttcttgagtccgagagggaggccaggaggctgcgctgaagccctggtggtcttagtggttcttgtatggtttcttggatgtcgtcgaatttgtgctatgtttgttgaactcgtgtgacccttgcaacacctgccttaagagtagtaagcctgataagattgcggttttgtttaatgatccttgtcgaaagtgcacttatgctgagacatggttatgctttggtatattagctcaatctatgcatgcattgaatactagctgaatctcaaggttttgttcttaaaaatgaacgctaaaaaaaaaaaaaaaaaaggccccta

SEQ ID NO: 14660 - DNA, 582 bp, Sorghum bicolor
  Clone ID: SORBI-28MAY03-CLUS2803_2
gccggccgccggccgctccgggagtgctctcctcgcgccgccgccgccccagtttccttcgtgtgcccgtgcgctcgtcggcctccgtccgcgactccgctcgagaagcgagagcatggacacccaggtgaagcttgctgttgtggtgaaggtgatgggcaggaccggctccagaggtcaggtgacccaggtcagagtgaagttcttggatgaccagaaccggctcatcatgaggaacgtcaagggcccagttcgcgagggtgacatcctcaccctgctcgagtctgagagggaggccaggaggctgcgctgaggtggttgtgtgtcctggtggttcttgtatggagttggatctcggcgaatttgagctatgtttattgaacttggtgtgagaacacctgccttatgattagtgagcctggtgataatgttgcaatttggttttatgatccaggttgaaagtgcacttgtgctgagacatggatattctttgctgtattagctcaatcgatgcatggattgaataccaaaaaaaaaaaaaaaaaacttccctaccaaaaaaaaaaaaaaagggccctaagg

SEQ ID NO: 14661 - DNA, 597 bp, Sorghum bicolor
  Clone ID: SORBI-28MAY03-CLUS2803_1
ccgggaacgcacgccggcgggccgcttcctcatccaagtgtactcctcgcgccgccgccgccgcagttcgcttcgcgtgaccgagagctcgtcggcccccgtccacgcgagaagcgagagcatggacacccaggtgaagcttgctgttgtggtgaaggtgatgggcaggactggctccaggggtcaggtgacccaggtcagagtgaagttcttggatgaccagaaccgtctcatcatgaggaacgtcaagggcccagttcgtgagggtgacatcctcacccttcttgagtccgagagggaggccaggaggctgcgctgaagccctggtggtcttagtggttcttgtatggtttcttggatgtcgtcgaatttgtgctatgtttgttgaactcgtgtgacccttgcaacacctgccttaagagtagtaagcctgataagattgcggttttgtttaatgatccttgtcgaaagtgcacttatgctgagacatggttatgctttggtatattagctcaatctatgcatgcattgaataactcgaaaaaaaaatgcaacctgctagctgaatctcaaaaaaaaaaaaaaaaaagttcccta

SEQ ID NO: 14662 - DNA, 2035 bp, Sorghum bicolor
  Clone ID: SORBI-28MAY03-CLUS3322_1
gcgaccagaccggacgccgaacgcaccagggtttgaggcatccccgaattcccccaccgccccccgccgccgccctcctgcttccccaacacccctcggccccgccgcctcccctcgcttcggtcctcggttaaccatccaggttctgtcaacatgtctgatagccatgagacggacaggaacattgagatttggaagattaagaagctgatcaaggcattggagtcagccaggggcaatggcacaagcatgatctctctaatcatgcctccacgcgatcaggttgctcgagtggctaagatgttaggtgatgaatatggaactgcttcaaacatcaagagtagagttaatcgccagtctgtgctggctgccatcacctcagctcagcagaggttgaagctctacaacaaagtgcctcctaatggattggttctgtacactggaactattgttactgaagacggaaaggaaaagaaagttactattgattttgagcccttcaagcctatcaacgtgtcgctctacctctgtgacaacaagttccacactgaggctctaaatgagctattggaatctgatgacaagtttggtttcattgttatggatggtaatggtactctttttggcacactaagtggcaatacccgtgaagtgcttcacaaattcactgttgacctcccgaagaagcatggtagaggaggacagtctgctctgcgttttgctcggcttcggatggagaaacgccataactatgtccgcaaaacagctgaacttgctacccagtttttcatcaatccagctacaagtcagcctaatgttgcagggttgattcttgctggttctgctgattttaagactgagctgagccaatctgatatgttcgatcagcgactccaagccaagatactcaacgtggttgatgtttcttatggtggcgagaatggtttcaaccaagccattgagttgtctgctgaaattcttgcaaatgtgaagttcattcaagagaagaagttaattggcaagtattttgaagagatcagtcaggatactgggaaatatgtctttggtgttgatgacacccttaaggctcttgaaatgggtgctgttgagaccctgatagtgtgggaaaatctggatgtcaacagatatactctcaagaacagttctactggggagatcactataaaacatctgaacaaagagcaggaagctgatcagagcaatttccgtgacccaactaccaatactgatctcgaagttcaggaaaaaatgtctctcttggaatggtttgccaatgaatacaagaagtttggttgctcgctggagtttgtgaccaacaagtctcaggagggatcacagttttgtagaggatttggtggcattggtggcatgttgcgctaccagctggatatccgttcttttgatgagctctctgacgatgacgatgtgtatgaagactctgattagcaatcagccaacctcatgcctgtgctggcccatggaaagacgcaacagctcgatcgcgctatatctatgcaggaacacacgaaaagcaaatatccaaagattaatgggcatgggccagcctcatcctcttcaggaggagcttaagacaaagatgattttgagtcactttaatggcagtattgtgaccagaagataccttaatcacaatcatcattgcagtaatgcgtcgagaagaataccgttgtcaagtgcacaaaccatggcagtaacgtgccaaaaaagttatcgtattttcaagggatgttaaatttcctatattcaccgtgctagttacagtgtcagggagttgtacctaaaaaggctaacgattgccgttgccttagtacttttatgctgtgttaacgtcttttgcgagtctggtggttgcttcaatgctttgtgactctgattgcaaactgctacacatgcagtttttgcaacgacgaagctatgatatggattacagttctgtgtcatcatgttgcctctgtttcacttttaaagaagtaacctggtgcaactattttgg

SEQ ID NO: 14663 - DNA, 936 bp, Sorghum bicolor
  Clone ID: SORBI-28MAY03-CLUS2865_1
gccggccgccgcgctcgcgcacgaggcagcagcactcgacagcgagaaaagtgaagcaaagcaacaaaagccatcgaccctacatccagccatcctctttgcttgcctgccgctacgagccaacgactcgatctccacaccacactccaatggcagcaaccgtgatggcctccatgacctccctcgccttcgccaccgccaccgccggcgcgcgtcgtgccggcgcgttcccggcgtcgtctgctgcgctcgcgccgcgccggcgcgtcatggtcgtgagggcgcagagcgaggacgtcgagccaacggagacgaccgcggccaccacctcctcgtcgccttctccggccgcggccgccactaccccgacgcccaaggcgaagaaggcggcgagccgggcggggctgtgggacgcgctggcgttcagcgggcctgcgccggagcgcatcaacggccgcctcgccatggtgggcttcgtgtccgcgctcgccgtcgaggcgtcccgcggcgggggtctcctctcgcaggccggcagcggctccgggctgacctggttcgcggccacggccgccgtgctctccgttgcgtcgctcgtgccgctgctaaagggggacagcgccgaggccaggagcggcgccgtcatgagcgccgacgccgagctctggaacggacgcttcgccatgctcggactcgtcgcgctcgccttcactgagtacctcaccggcgccccgttcatcaacgcctagatctagatgcatgccagtgcatgtatatgcagtagtaacttcgtaggaatattttgtactatgctagtagaactgctttccgtgtacgagcatacgtacagatggacgagctagtttttatgtacgttttggatcaaaatatatagctacgaaactatttgttgggaaacaaaaaaaaaaaaaaaaaaaa

SEQ ID NO: 14664 - DNA, 917 bp, Sorghum bicolor
  Clone ID: SORBI-28MAY03-CLUS486_1
ctcaatttttattagcctttggggatattggggataacagaatggcagtgaaaatgccaaaagcatgtagaaagcatctttgtaccagtggtagttacgactgtaggggcctttttttttttttttttttgtaaataacggacctctttattaattgatgactactacgtacatatagatattccactcagagatggcctttttatttactaataaaatcttattcatatgcggaaagtcatgcgcggtgcatgcatgcacacggacgtacgtgtctgtgtaagccgtcgatcacaatatataatcgatcagtagggcttgtgtcccacgatgttgccgcggggctcgtagttgcagatgatgaagacgccgcggttgtcgcggcagacgacgcgcgcgcagccgatgctagtgctggcgcgccacaccacctgcgtgtagtggccgcacaccttgccggcggcgcagctgttggtggcgtagctgtaccactgcttctcgtccacccacgaccgcaccgcgtccgccgccttccagtcggcgccggcggagccccagaagatgttctccccatacggcccgccggagtgctgcaggcggcagtcgccggcccgcttcgcggcgtagctctccgcgaactgctgcagcttcgtgctccaggtcaccgggccaacgccgacggcggcacgggcgttgttgtggggagtcaggtagttttggggcgagttctgagcgtaggaaggctgcacgacggtggcggcagccatggccaaggacacgagcaagacagcgacgagcttgttggatggctccatagtagtagaagctgcgacctagctagaggcagcagggagatgatcgaccctgtgtatgtgtgtgtgttttgtgcaagatcactgtcccggcccggccggcct

SEQ ID NO: 14665 - DNA, 2339 bp, Sorghum bicolor
  Clone ID: SORBI-28MAY03-CLUS247_1
gcacgacgtccgaggcctccgatttcggcaatgctgcggtgaaatcccgcacctccttccttcctctcccaccgaggaccctcgcgccaagagctgaacgggaagcgcacaacagtgtttcccctcgcccgtctcctttccctctccgcgattcttgtcgcattggtttcgttcccgcgagaaaggagggcccattcgagtttctccgatctctctctctgatggcgagcacatcttcatgcgaaacatccgcgtcgcatgcctttgcttacccgccgagatcatcctcggctctgtcttcgatgatctacatgatggcgagcagggggtcagcgaccgcccccgccgccgccgccgccgtcggggccgccgccaagccgcggggatcgtcgtcggccccctgcgcaagggtggccgccggcggcaggcggcgctccggggtggtggtgcggtgcgacgccggcgtggaggcccacgtgcaggcggtggccaaggccgccagcatcgccgcgctcgagcagttcaagatctccgccgaccggtacatgaaggaaaggagtagcatagctgtgataggcctcagtgtgcacacagcacctgtggagatgcgtgaaaaacttgcggttgcagaggaactatggccccgtgctattcaagaacttacaagtctaaaccatattgaagaggctgctgttcttagtacctgtaatagaatggaaatttatgtggtggccctatcatggaaccgaggtatcagagaagtagtggactggatgtcaaagaaaagtggtattcctgcttccgagcttagggagcacctgttcatgctgcgtggcagtgatgctacacgccatctgtttgaggtgtcggctggcctggactcgttggttctcggtgaaggacaaatccttgctcaagttaaacaagttgtgaggagcggacaaaacagtggaggcttgggaaagaacattgataggatgttcaaggatgcaatcactgctggaaagcgtgtccgctgtgagaccaacatatcatctggtgctgtttctgtcagttcagcagcagttgaattggccctgatgaagcttcccaagtctgaatctctgtcagctaggatgcttttgattggtgccgggaaaatgggaaaattagtgattaaacatctgattgccaaaggatgcaagaaggttgttgtggtgaaccgctcagtggaaagggtggatgccattcgtggggagatgaaagatatcgaaattgtgtacagacctctctcagagatgtatgaagctgctgctgaagctgatgtcgtgttcacaagcaccgcatctgaaactccattgttcacaaaagaacacgcagaggcactcccccttgtttctgatactatgggaggtgctcgcctgtttgtagacatatctgtccccagaaatgtcagcgcatgtgtgtctgaagttggcgctgcacgagtatacaatgtcgatgacttgaaagaggtggtggaagccaacaaggaggaccggctcaggaaagcaatggaggcgcagacaatcatcacggaagaactgaaacggttcgaggcatggagggactcgctggagaccgtcccgaccatcaagaagctgaggtcatatgctgacaggatcagggcctcggagctcgagaagtgcttgcagaaggttggtgaagacgccctcaccaagaagatgaggagagccatcgaggagctgagcactggcatcgttaacaagctcctccatggcccactgcagcacctgaggtgcgacggcagcgacagccgcaccctcgatgagacactcgagaacatgcacgccctcaaccggatgttcagccttgacacggagaaggcgatcattgagcagaagatcaaggccaaggtggagaagacccaaaattgaggccaggaagcaattttcctacccctttatctctatatatagcctctccagcctatttccaagtttttttatctttcgcttactgagccactcactgagatcgtcaactgtgtcgtgattttagagccatgtcagcgtgtcgtgaataacagcaatgtatcccaattccccactgaagaaagactatatatttatatgcattgattggagcaaatactactgtaaattaatacaatcatgggctcatggcaactgtagcttgacatctgagctaaagttttacactgtatttgatagtatgtagatgaggatcatagaattagggatttacagtgcataccatcagtacactggaagtctgcatttaatattgcttggattgtttgaaactcatgattctgagcaaggaagctgttcagtttt

SEQ ID NO: 14666 - DNA, 637 bp, Sorghum bicolor
  unsure (1)..(637): unsure at all n locations
  Clone ID: LIB3481-051-Q6-K1-A5
cccacgcgttcggcaatgctgcggtngaatcccgcacctgggtgggtgctctcccaccgaggaccctcgcgccaagagctgaacgggaagcgcacaacagtgtttcccctcgcccgtctcctttccctctccgcgattcttgtcgcattggtttcgttccctcgcgaaaggaggcggctttctgtcttccctgatgctatctagatgatggcgagcacgacgtcagcgaccaccgccgccgccgctgccaccaccaagtcgcggggatcgtcgtcggccctctgtccgagggtggccgccggcggcaggcggcgctccggggtggtgcggtgcgacgccaccggcgtggagtcccaggcgcaggccgtggccaaggcggccagcgtcgccgctctcgagcagttcaagatatccgccgaccgtgagtcccttgctctcgcctctggaaatccgccgccgttgttgccttgcctccctgtaagctgtaaccctgggatgcggggattgtggcctttctggtgatgggttctggtgcgcgatttgaggaatctttttgcgttgcgtcgaggacactgctgcagttggggttagttttggtttggtacgggccaaaacttgtgggtgaccgagtggtttg

SEQ ID NO: 14667 - DNA, 486 bp, Sorghum bicolor
  Clone ID: LIB3478-058-Q6-K1-C12
ccaagagctgaacgggaagcgcacaacattgtttcccctcgcccgtctcctttcccggtccgcgattcttgtcgcattggtttcgttccctcgcgaaaggaggcggctttctgtcttccctgatctatctagatgatggcgagcacgacgtcagcgaccaccgccgccgtcgctgccaccaccaagtcgcggggatcgtcgtcggccctctgttcgagggtggccgcctgcggcaggcggcgctcctgggtggtgcggtgcgactccaccggcgtggagtcccaggcgcaggccgtggccaatgcagtcagcgtcgccgctctctagcagttcaagatatccaccgaccggtacatgaaggaaaggagtaccatagctgtgataggcctcagtgtacacacagcaccagtggagatgcgtaaaaacttgctgttgcagatgaactgtagccccgtgctattcaagaactcactagcctgaaccata

SEQ ID NO: 14668 - DNA, 2209 bp, Sorghum bicolor
  Clone ID: SORBI-28MAY03-CLUS9002_1
atcagacaagtctctacagcctccatccagcacggaccccgcggcctgcctccctctccttcttctcccacccccagcccagcgtgcgcattctctctctctctctctccctcaatctcggcggcgactgggcgaccgaccaaccgtcgctgccctacgccaggtgccaccaaggtcttcttcgggcccttcgccggcgacgagcaccaccaggcaattagacttgcgtgagaaatggatgctactgctggttaattgtgatacggatttatatggacatagatattggggccatgtgtaagggcggaaactgtttctaccgcgtcaataaggagagctctgctgattctacaaggaagatccattccgcagtctctcacgatcggatggcatttgatacagcaagggcaacgaaaacagaggcatcaaagttgaagaacctaatctcggcatcattcaaacccttgtctctgaccattcccatcggcgacgggttccacgaatccttccctttcagccattgtcatttatagtagagaagggtctataagtaagccaaggttttttgttcttgttggcttgcgagaggaggccaaggttgaggtgctttctgctgcatctcataatgcttgctgtgtcacaagaacatcttgctcattcacagacgtgcttccgagcaaggatgcaactcaagcctcctacaagacccaaactctattcagggctcatgccccaggaggaattcgattcatactgtgatctaataccaggcttgcctgaagacttggcaaagatatgtcttgcccttgttcctcgtactcattttcctgtcatgggtgcagtttccaagaggtggatgtcatttcttgagagcaaggaactcatagctgtgaggaaggaggttgggaaacttgaggagtgggtgtatgtcttgactccagatgctggcgcaaaggggtcgcactgggagatcctagagtgttcagggcaaaagcagagccctcttccgcgtatgcctggactaaccaaagctgggttcggtgtggttgttattggtgggaagctctttattattgctggctattccgctgaccatgggaaagattgtgtttcagatgaggtttatcaatatgattcttgccttaacaggtggactgttcttgctaagatgaatgtagctcggtgtgactttgcctgtgcagaggtcaatggggtgatatatgttgctggcggatttggtccaaatggcgagagtttatctagcgtcgaagtttatgatctagaacagaataaatggacactgattgagggcctacggagaccacggtggggctgcttcgggtgcagctttgaagggaagctctatgtcatgggtggccgttcaagcttcacaattggcaactcccgttttgttgacgtgtacaatcctaataaccatgcctgggaccaggtcaagaacggctgtgtgatggtcacggctcatgcagtcctcggcgagaagctcttctgcatcgagtggaagaaccagaggtctctagcaatcttcaacccggctgacaactcctggcagaaggtccccgtgccgcttactggtagctcaagcactcgtttttcctttggggtacatgaggacaagctgctgctcttccctctggaggaagagcctgggtatcagacgctgatgtatgatcctgcagctccgatggggtctgagtggtgcacatcgaagctgaagccatcaggttcttgcctgtgcagcgtgaccatcaaagcctgatgatgcccttgaatgcgtgggatgcggcagttttagagttcttcatataggatggaatcccgcttgccttcatattttagagttcagatgaggctggctttgtttggtctcaagtgcaatcttgtttcttcaaattttagtttgtgtgtcgcatcgacaaataatgaataggacatttatgtttcagttcattgagttgctgaagcgtcatgatgtattctcatttcacctgtattgaactctggccgtttgggtcttgggttgatttgatcttttttgctggcactcacatgataacgacagcgtggtgttgtcaactgatgctcagtagaaaggtttatgttgttggacatgattaagtagttgccttttcttatttgcagctgaaagtatagcccgcgctcaaatttcattaatgagatgcaggattaa

SEQ ID NO: 14669 - DNA, 1768 bp, Sorghum bicolor
  Clone ID: SORBI-28MAY03-CLUS799_1
gcacgaggagatggtgttcgccaagggtgacccaggcatcgctgccttgtacgataaactccttgtttcttcagagctctggcctcttggggagagcgatccctagtcgtcactgccgtttgatttctcctcctcccccgcttccagaagcttcgccggctccgccatgcgttccgccgtcgtcgcggcgctcctcctagtggcagcggtcgcctccccggccgccgcactctactccgccggctcccccgtcctccagctcaaccccaacaacttcaaatcgaaggtgctgaactcgaacggcgtggtgctggttgagttcttcgcgccgtggtgcgggcactgcaagcagctggcgcccgcctgggagaaggctgccggcgtgctcaagggcgtcgccacggtcgcagcgctagatgccgatgcgcaccaggcgctcgcgcaggaatatggaatcaggggatttcccactattaaggtgttttcccctggtaaacctccagtcgattatcaaggagcaagagatgtaaagccaatcgtagagtttgctctgtcacaggttaagtcccttcttagagaaaggttgagtggtaaggcatcagcagggtcaaatggcaagacatctggaggttcaagtgagaaaagtgaaccaagtgcatcagtagaattaaattcacgtaacttcgatgaactcgttgtcaaaagcaaggacctttggattgtggaattctttgcgccatggtgtgggcactgcaagaaattggcacctgaatggaaaaaggctgcaaagaacttgaagggacaagtgaagctaggccatgttgattgtgatgctgaaaagtccttgatgagcaagtacaaggtggaaggttttccaactattttggtatttggtgctgataaggagagcccattcctctaccagggggctagagtttcatctgccattgagtcctttgcattggagcagttggaagccaactctggcccagctgaagtttctgagttgactggaccggatgtcatggaagagaagtgtgcttctgctgccatttgttttgtatcattccttccagacatccttgattcaaaggcagaaggaagaaacaagtaccttgagcttctgctctctgttgctgaaaagtttaaaaagagtccatacagttttgtctggacagctgctggcaagcaagcgaatcttgagaaccaggttggagtgggcggttacggctatccagccatggtagctctcaacgtgaaaaaaggtgcatacactccactccgtagtgccttccagcgcgacgaaatcatcgagtttgtgaaggaagcagggcgcggtggaaagggaaatcttcctctgaacggtgcacctacagtagtcacgtccgagccgtgggacggcaaagatggagaggttattgaagaggatgaattctcccttgacgagctcatgggcgacagctcctcagtaaacgatgagttgtgattctgatgattctggaactgatctgcgtttcgattagccagactgtaaatttgaggaactctgatgttttaagaactcattcctttagtggggtgatttttcaggtttcgggtgctagaatggtttaaaattaaagagaactgatgtgataggcaactctctttttttacgttttattttttggtccctgaaataaaagttagtttagacactccggctgcttgccacaacaaatggtctccgcttaagaacatgctctgttgctcccattggataagcccc

SEQ ID NO: 14670 - DNA, 403 bp, Sorghum bicolor
  Clone ID: LIB3476-012-P1-K1-C12
cggacgcgtgggtgagcaagtacaaggtggaaggttttccaactattttggtatttggtgctgataaggagagcccattcctgtaccagggggctagagtttcatctgccattgagtcctttgcattggagcagttggaagccaactctggcccagctgaagtttctgagttgactggaccggatgtcatggaagagaagtgtgcttctgctgccatttgttttgtatcattccttccagacatccttgattcaaaggcatcgctgccttgtacgataaactccttgtttcttcagagctctggcctcttggggagaagctgagggcaaattatgaagagaccaaacgtcttctcccttaggttgctggacaacaggatcttcttggaggggatttatacctg

SEQ ID NO: 14671 - DNA, 1761 bp, Sorghum bicolor
  Clone ID: SORBI-28MAY03-CLUS1159_1
ccccgcacgacggcgtcgcgtgctcgccctctcacctcgcacgagcactgccatgggggctagggtttgaacgccaccggtcgctgccccctacgtctccgagccatcaagccatcagttgcgaccctcgccgcgccgccgccgccgctacatccagttgacccgtgtgtgattaataattttgtgttcctgatcaccaaagcaaggtgaggctcaccaagtgatattcattgtgcacaaaggagagggccaagatagctgctaatggagattgacagcctcagggagggatttgatcgagttgctgagaaacgttcattatcttctgctaaagctctggaagctgttgatcaaatagtgaatgaagttgagcaggctattgtgaagctgcagatgatgaatacagattctactggaaatgttgaccacccatctatccttgcagaactgaaatctaagctgaatgaaatggcacctttgaaccaacttgaaggcagccaaaaggagctcaatggtgccctgagcaaatatctcaaggtccttgagaagtccttcaatccagatatatctaaggcatacagaaatgtggattttgaggttcatacggtaaacaatatcatagcgaatcatttctaccgccaaggcctctttgatcttggtgatatgttcgctcgtgagtgtggggaattaggtggaacttcattgaagctaccgtttcaggagatgtatgctatccttgaagccatgaaagcgagaaacctcgagcctgccctcagttgggctgccaaaaaccatgaccagctgttgcagaatgggtctatgctggagttcaagctttatcagcttcagtttgttgaaatactgtccaaaggaagtaggggtgagggcaaagatgaggctcttttatatgctaggactcacttggtcccctttgcagccgtgcacaaggaagaattccagaagctaatggcttgccttctatgggttggccggctggatcaatccccatattctgagttaatgtcatccgcgcattgggagaagctagctgaggaactcacccatcaattctgcagccttctgggccagtctagggagagcccactgagtgttgcagtatcagctggttttcaaggactaccaactctgctgaagctgacacaagtcatggctgcgaagaagcaggaatggcaagttatgaagcagctccctgtccccatagacatcgggccagaatttcagtatcactctgtctttgtgtgcccggtgctgcgggagcagtccagtgatgagaaccccccaatgcggatgccgtgtggacatgttgtctccaagcagtccatcatgaagctgtcgaaaagcagctcaaggcccttcaagtgcccctactgcccatcggaggctgtggcgtcgcattgcaagcagctgcatttctagatgtgctaatcttttctggctgcgcaaaacggcaaacctgttgttagcttcccctcctgttccctgttgcaccagtccaataacttatgtgcctctgtaatataaacatctacgtccggataaacatgtagtttcgtctgtatgtactaaactgtacagttgcatcttccagtgtgttgcttagttctgttctggagattcaaggaattggaagggggtgccgcatctcatgatgttacaaccatgtaggattgtaggttgtggactgggctggttgatgtaaagtggggccgtggagctcttctggtaccacagtaccacact

SEQ ID NO: 14672 - DNA, 1391 bp, Sorghum bicolor
  Clone ID: SORBI-28MAY03-CLUS13840_1
gctcacgcgtcaggtcccggtcccggtcccaggtccaggcaccttctcgctcggtcgctcggaagctttccccttcccgaagcttcgcaccgcctcctcctcccctaccccccgccgccgccgccgccgcggcgccttctagaatcatccagaggcgtgccggtgaagcgcgagagcggtgaggcatggcgacgcagacgggggtcgcggcctccaaggtcctcatcctcgtcggtgcagggatgacggggtcgatcctgctgcggaatggacgcttatctgatgtgttgggggagctccaggagattatgaagggtgtaaatcaaggaactgcttcgggtccctatgacattgcacttattcaagctcagattcggaatttagcccaagaagtcagagatttgacattgtcaaggcccattaccattctgaatggcaaatctgactcaggaggcggtttatcatcctacatactgccagcagcagcagttggagcaatgggttattgctatatgtggtggaagggattgtctctctcagatgtcatgtttgtcacaaaacgtaacatggcaaatgctgttgagagcatgtcgaagcagttggagcaagtttcatcagcactagctgcaacaaaaagacatctaactcaacgtcttgagaatttggatggcaaaatggatgaacaagtagaggtctccaaagctattagaaatgaggtcaatgatgttaaagatgacctgtctcaaattggatttgatatcgaatcgattcagaaaatggttgctggattggagggaaagatcgagttacttgagaacaaacaggacgtggctaatactggtatatggtacctctgccaagtagcaggtggtttaaaagatggaataaacgccaagtttttccaggaaaccggtgagaagctgaagctctcacattcagctcaacccgaaaacaagccagtgaagggacttgaatttttttcggaaagcaccaaggaacaggaagtagttgactccaaaccaattgcggtcacaatcgacgctaagaagcctgagaaaaccacagctgtaaagggcaccgcagtgcacaggtccatcaggttctcatatcggaaggaaggccttgcattgtgatcaaatcctctccgcttgagatgcacatggccttcctggttgcttttgtctaatagtcagaaaacatagaagaataacctgcatccggagtgacagaatttctttttccccggagtagacaggtgtgattatggtctgttttgaaactatcatttattatttttcttggattttgattcatttttgcgttttgatttgttgctgtgtacactgtaaagtcattcgaaagaataaataaaacacgattgttttctttgt

SEQ ID NO: 14673 - DNA, 854 bp, Sorghum bicolor
  Clone ID: SORBI-28MAY03-CLUS19434_1
ccgggaaagcagcagggcgccatccagtttccattagcaatcgcattcatcctcttttcgcagcagcagcagcacccagcaatcaaccaaacaaagcggcgatggacggcggcaagaagagccggaacccgcacaaggtccccgcggactaccgcagcgaccgcaagtcggcctccgggatgagcggcgaccccaagaagggcggccgcggcggcaagttcacctgggagggcgccgacggctacgccgacgaggacgtcggcctcgtctcctccaagaacgccaacaccaaccgcgccaccaagggtggaggcgccgccggcgccaagaaggacgacgacgacgacgagtaggccggcctctcgccgcctcggcccgccctccccccgtcgatcgccagcaagaaccaacaagtccttcctacctagtttgattccagtctcagttcgattctcgtgttgaataaatcatgatcgtgtgggtttaggtgtcgtgctcgcgagtaacactgagcacagagccactgggcgatccacgggccgtgcagggtctgtagatatcatctcatctgttcttcgctagtactttgctgatttgctcatgttcaggggcctggcctcgattcggttcttggatgaactgatttattagtttccggaatcgatgctttcattcagttagcgtctcctgctctccactgctcagtccctgctctggactgcgaaaattgaggacagatttctcttatgctttcagatgaggtgcaattacgaaagcaaaaattagcatttcgcaaactaactcgcagatccgtaactgaagaagacagcaaggaaggaattgggaggattgac

SEQ ID NO: 14674 - DNA, 462 bp, Sorghum bicolor
  Clone ID: SORBI-28MAY03-CLUS17295_3
gccggcggggccggcctctatatcttcagcctacagcataacaattgtccattccatctgaaggctgaaatgggtctctccaccaagctttttgcggtcctcctcctgctcctcattggtggttatactgagatgcagggaccagtgactgtggcattggcgaggaagtgccagtcgaagagcttcaaattcaagggaccctgctcgagggacgaaaactgtgcaaccgtttgcctgacagaaggttttaccagtggcaagtgcagaggcctacgccgccgctgcttctgtaccagggactgctagttgctttgcgtcctgcatgcatatgcatgtcctgaatggatcaggaaaatatgtatgcattaccaaatggaagtagcacatgaatgaagtaaataattgaacggttgagagcttaagcccgtatttcgagatttaaaaaaaaaaaaaaggccccta

SEQ ID NO: 14675 - DNA, 469 bp, Sorghum bicolor
  Clone ID: SORBI-28MAY03-CLUS17295_2
gccggccgggcccgggatctatatcttcagcctgcagcataacactccggccattccatctgaaggctgaaatgggtctctccaccaaactttttgcggtcctcctcctgctcctcattggtggttatactgatacgcagctgggaccggtgactatggcactggcgaggaagtgtgagtcgccgagccaccgcttccagggaccctgctccagagacgcaaactgcgcaaccgtttgccggactgaaggttttaccggtggcaagtgcaaaggcctacgccaccgctgcttctgtaccaaggactgctagttgcctcgcgtcctgctcctgcatgcatatgtatgcatgtcctgaacgcatcaggagaatatgtatgcattaccaaatggcagtagtacatgaatgaagtaaataatggaacgcgtctgttttggaccttgaaaaaaaaaaaaaaaaaaaggccccta

SEQ ID NO: 14676 - DNA, 561 bp, Sorghum bicolor
  Clone ID: SORBI-28MAY03-CLUS17295_1
gccggccgggcccgggatctatatcttcagcctgcagcataacactccggccattccatctgaaggctgaaatgggtctctccaccaaactttttgcggtcctcctcctgctcctcattggtggttatactgatacgcagctgggaccggtgactatggcactggcgaggaagtgtgagtcgccgagccaccgcttccagggaccctgctccagagacgcaaactgcgcaaccgtttgccggactgaaggttttaccggtggcaagtgcaaaggcctacgccaccgctgcttctgtaccaaggactgctagttgcctcgcgtcctgctcctgcatgcatatgtatgcatgtcctgaacgcatcaggagaatatgtatgcattaccaaatggcagtagtacatgaatgaagtaaataatggaacgcgtctgttttggaccttgaagtgttgagagcatcttctttcttatgaacaagtgttgagagcttaagcccgtacttcggtatttattagtaaacgaactctaaagccaaaaaaaaaaaaaaaaaaggcccctacaaa

SEQ ID NO: 14677 - DNA, 439 bp, Sorghum bicolor
  Clone ID: LIB5049-005-R1-XP1-H1
gccggccgggccgggatctatatcttcagcctgcagaataacactccattccatctgaaggatagaacaatgggtctctccgccaagctttttgcggtcctcctgctgctcctcattggttataatacagagacgcagggaccaatcactatggcattggcgaggaagtgtgagtcgccgagcctcaaattcaggggaccctgctcgagagacgcaaactgcgcaagcgtttgcctgactgaaggttttaccggtggcgagtgcaaaggcctacgccaccgctgcttctgtaccagggactgctagttttcctcgcgtcctgcatgcatatgcatgtcctaatcggatcaggaaaatatgtatgggttaccaaatggcagtatcatggatgaattgaataatgatacaagtgtaaaaaaaaaaaaaaaaaaggccccta

SEQ ID NO: 14678 - DNA, 2432 bp, Sorghum bicolor
  Clone ID: SORBI-28MAY03-CLUS2477_1
gcccgcgcccgggggcgcgcacgagggagagacgaatccgccttcttctgcttctgcttctgcctgcctgcctgccgcacaccgcagctgccgctcccaccacacccatcgcaacaactccgcatctgcatctcagcagcctcatcgccgtcggccgccctgcagcaccgagtcctgccaccgccatcgatcgatctcttcttccggtgccaccagcaagccaagggaaggattcggcatctccttcgatccgtcccggctgccgtcttgagtcctcaccggatcggatctgtactgggttttcaacaaggaggaggaaacaccttagggaatgcagaaagatgtgcttgcatgttgaagagctaccttgtgagggacttggcagggtagcacaccatattgattctttgccggctcttgatgaccttgcagctcaagagtacacgcatcttctcctacttgtgcttccgcacaatggggttcgatgtggcggctcaaccgtcttcttagatcaccatcttgggggagacggttgaagtcttcgcactctcagcctctttgctagttcctttccagtcaaggataagtaagtgctctttgtgtgcatagcatactacggcacgatggtggaacataaaggaaatgttctcatgcacaagtatgagatggggaaattgcttggtcaagggacctttgccaaggtttaccatgctcgcaacactaagacttctgaaagtgtcgcgatcaaggtgattgacaaggacaaggttatgaaagttgggctcattgatcaaatcaagagagaaatttctgttatgaagcttgtaagacatcccaatattgtgcaactctatgaggtcatggctaccaaaaccaaaatatactttgtgttggagcatgttaaaggtggagagctctttaataaagtgcagcgaggaaggctcaaggaagatgcagcgaggaagtactttcaacagctgatttgcgcagtggacttctgtcacagcaggggtgtttatcatcgagatttgaaaccagaaaatcttttgctcgatgagaatagcaacctaaaggtgtcggattttggtctaagtgcacttgctgaatgccaaagacaagatggcctgctccatacaacctgtggcacgcctgcttatgttgctccagaggtgattaacagaaaggggtatgatggtgcaaaggccgacatatggtcctgtggggtcatcctttttgtgctattggccggttatcttccattccatgacaagaacttaatggacatgtataagaagattgggaaagcagagttcaaatgcccgtgttggttttctaccgatgcccggaggcttttgctaaggattcttgatcctaaccccagcacaaggatctcaatggaaaaaatcatggaaaatccatggtttaggaagggcttagatgcaaagctgcttaggtataatttacagtctaagaatgcccctcaggtagacaagaatgcagattctgattcactaagcatcaacataacagcagagagcaagcaacaagaagaaaagaagcctaccaacatgaatgcatttgatataatatctctatcaactggtttggacctctcaggtttatttgaagaatctgacaacaagagagaatacaaattcacatccaccaacacaagctcaacaatcgtatcaaagatcgaagatgttgcgaagaatttgcgattgaagttgacaaaaaaggatggtggtttgttaaagatggaagcttcaaagcctggaaggaaaggggtgatgggtatcgatgctgagatatttgaggttagcccaaactttcatcttgtggagataaagaagacgaatggcgacactctagagtatcaaaaggtcttgaaccgagaaatgaggcctgcactaaaggacatagtatgggcttggcaaggtgagcaatcaaagcagcaacaaactatgatctagtgcaacgttttattaggcaatttccaatctttcatgtatttgtgtagttctcactttttcattattcatttttgttccccttgtattatcaacataaacttgtgttatcgtccaaggacagaattattttgaagtcatgtttatgctattataagagtttgcttttggaatcaagcagtgcatggaggtgacaggggagcttggctgccgacgtctcacgtctgcattcattggtgaaccaaaccagtgggctggggtggctcagcttcttgaaactgcttgttctgatgcgatgattgcagtctccctatctggaaaactatttattttagcctaaaacgactcgcatgttttagaggttacaaggcaacatcatgttgctgtcaggagtttgctcctggactaacatagaaagattggtaaggtagcaaaagtagaaattggaactctctagcttct

SEQ ID NO: 14679 - DNA, 876 bp, Sorghum bicolor
  Clone ID: SORBI-28MAY03-CLUS2858_1
gctcgtggctctcgcccttggccggcaccaacatggcgtgccggccggcgcggttgtactccaccacctcaccctcactctctcttccccggccatccgcgccagacgaactcagcacccgcgcgcagcaaggagagtccacacgcccatggccagcaccaacatggcgtcggccacctcgcggttcatgctggccgctggcgtgcccaccgccggcagcggcagcggcagcagcggccgcgtcagcttcgcgccggcgcccaaccagctgggcaggaggctcgtggtccgggctgacccggaagctccggctgaaccggcggaaggggagggcgccgtggccaccaagcccaaggccgagaagccgccgccgatcgggcccaagaggggcaccaaggtgaagatcctgaggagggagtcctactggtacaacgggatcggcaacgtcgtcaccgtcgatcaggaccccaacactcgctacccggtggtggtgcggttcaacaaggtgaactacgccggcgtgtccaccaacaactacgccttggacgaggtccaggaggtgaatgaacaaaagtgaggccggctcaaggggctccccggcccgcgcgcgctagctagctcccgtgtgatgatttgtagttgtgaaatgaggctgtgaagctgcatgctgtgctagctagcgtcacaaacatcgatcttatgtgtaatagcttaatctccataatcatcatgtaattgcttgcttcattcaccgtggactcaataatctctcttgctctaaaattatattgctgtattctttttttttgttcttgtgattttgtatgcatgcacataaatctctctctggccccaatatatatttgtggctctgct

SEQ ID NO: 14680 - DNA, 692 bp, Sorghum bicolor
  unsure (1)..(692): unsure at all n locations
  Clone ID: SORBI-28MAY03-CLUS1088_2
gtcattgttaggccccacggcgacgccggcctgaccagccgcatgatcatcattttcacgctacggcggttcgacgtgccgacgtaggcaaggcctgctttggcgtgaacgttaaccctgtcagcagcggcaggaagtccatcggcaccacggtcggcgttagcgtgaaagggggagtcctcgttaaggtcaaccctggctatggtaagaccggctgcacgacggttggtgtctggaagggcggagttggtgttaacgtcaaccctggctacgggaagcccggtggcaccactgttggcgtctggaagggcggcgtcggcgtgaacgtcaaccctggcaagcccggcggcactacggtcggcgtcggcaagggcggcgttggcgtcgacgtcaatcctggctatggcaagcccggtggcaccacggtcggcgtcggcaagggcggagtgggcgtcaacgttaatcctgccaagccgggcggtaccggcacaaccgttggcgttggcaaaggcggcgtgggcgtcggcgtcaatcccgggtacggcaagcccggcggcaccacggtcggagttggcaagggcggngtgggcgttcacgtgaacaacccgcagcagaagcccgtaaacgtcaacgcctggcctttgctgtaaatgtacgccgcattagagacgcaagtgcacgaagaccccagc

SEQ ID NO: 14681 - DNA, 1350 bp, Sorghum bicolor
  Clone ID: SORBI-28MAY03-CLUS1088_1
gcccgcggcggcgtcgctcgccctcatttccctggcaggagcgacctgtccaccaccgtctccgccgccgccgttgcagctgccgctgccgctgccgccctcgtcccacgcctcaccggccgccgatcggcgccggcatctcgcataccggagatctgccgcagaagaatccgatccaaaccccgtaccttttcttcctccccctccttccccattgtccccgccgctgccatggccaccgacggcgccgcctctgatgctgggtccaagaagaagctgctcatcttcgactccgaggaggatctcgcggtttctctggcgaagtacactgcggagctgtcggagaagttcgcggccgagaggggcgccttcaccgccgtgctctctggcggatccctcatccaggcgctcaggaagctgacggagccgccgtacctggattcggttgactggagcaagtggcacgtcttctgggtggatgagagggtcgtgcgcaaggaccatgtggatagcaactacaagctcgcctttgatgggtttctctccaaggtgccgattcctcctggacaagtttatgctataaatgatgccttgtcagctgagggagcagcagatgactatgaagcgtgcttgaagcagcttgttaagaatggtgtgatttccatgtcagcagcgactggatttcccaggtttgatctccagcttctgggaatgggacctgatggccacattgcatctctcttcggtggtcaccctcttgttaatgagaaagagaggtgggtcacatacattaaggattctccaaaaccaccaccagagagaatcacatttacatttccagtaatcaactcatctgcatatgttgcaatggtggtaactggagttggaaaggctggagcagtgcagaaagcactttcagacaagcaaacatcatcggatctgctgcctgttgagatggctgtactgcaagatggagaattcacttggttctctgacaagccagcagtgtccatgctgcagaacaattaaaatccatggtaatcttagctcgaagtttagctcataaataaaagatccaggggcctgcatagttgcattcgtcctccaggatttcatgtaagggagacttgagcctttgatgtagtagatattgtttcgaataatgtttcaaaaactcgtttggcttccagcttttctgaaacactgctcaataagtgtttggtttagtacttagttcactgttccgtgctagaagcatggataggaaatgtggctgcattttcgtccaggcttgccgttactggcatgtcccagttttaagtggttttcagtgttcgtgcattctcagtg

SEQ ID NO: 14682 - DNA, 202 bp, Sorghum bicolor
  Clone ID: LIB3478-051-P1-K1-F6
cgctcgccctcattacactgggagcatcgatctatctatcagctcgctcattggccatcttcgatcgtcttccatggagaggctcattgccggtctacttggcttcctatagattgcgtcagtacgaagctcatgcacctcgtgctccggatcaactactggcagccgctctcccgcactccagccgacctccttcaactct

SEQ ID NO: 14683 - DNA, 667 bp, Sorghum bicolor
  Clone ID: SORBI-28MAY03-CLUS8334_2
tcgggaagctgcatctgcatcgggtttagggtttctctcctaccgccgccacttccgctccacgcgcccaatccctcctcccttcaccttcaccatctccggcggccgcggcgcaagatggcgaccatagtgaacacgacggaggaggagccgatgctggccgtggtccgcttcaccgccgagctcgcctgggccgacgcgggcccggaggtcgccgaccccgaggtcacccgcctttgcctcgaggcgcaggagcacatcctcgcggggcgctggctcgacatggcctccctcatgctcgcctccgccgacctgctcctcacctccccgtcacgcgtcgcggacaaagatctggagtgcgttctctccgtcatctgcagcctcgtcaccaaggccggatccgaggacgaggcactacagatcaccaacctcatctgcagcaagctcatccagcagcctggcgacaagccagcgttgcgcctcaaagttcttttcagcttgtacaatcttcttctgagcccctatggcaaggcatttgtttacaagaaggctcttgagctcgccacggctggaaaagctgccgagtacatcattccatctttcaagaacatcgacagctttgtcagtgagtggggtattggcaatttggagcaaagggagctatacc

SEQ ID NO: 14684 - DNA, 2626 bp, Sorghum bicolor
  unsure (1)..(2626): unsure at all n locations
  Clone ID: SORBI-28MAY03-CLUS8334_1
aatgatggattcgaagcccaatgtatagctgcatctgcatcgggtttaaggtttctctcctcccgccgccacttccgcaccacgcgcccaatccctcctcccttcaccttcaccatctccggcggccgcggcgcaagatggcgaccatagtgaacacgacggaggaggagccgatgctggccgtggtccgcttcaccgccgagctcgcctgggccgacgcgggcccggaggtcgccgaccccgaggttacccgcctttgcctcgaggcgcaggagcacatcctcgcggggcgctggctcgacttggcagtcaaggggtccaggaactgcaatgatagatatttacatcatcactcgggcatgtcgatttccttttctgaaaatctctcctggctcgaactcgtgattcaccgaagtgtgggtgtccgacccagtttatcttaccagacccagtttgtcttagcacgagtgggtgggaggtcaaacaacccaccacatggccacaggtctgttcccagtatgaaggtttccattgcatatcttggaactcgcatggtatgttctaattgttgagctagttttgttatgtaattaactttaattccaatgtttactcctgatgctaggagcttgcttccagctgaagaacttgctcttgctgtcctctgataaaagaggtcaactcttttggtgcaacaaccgactttagccactcttgaagctcctcgccttcaaccttttcgttctcttctaaatatgccccgaggccttctagaactgcaggattagcacggataactgaaagagctacttccagtgacgactgtaaaagcacttttacttccctctgaacaagatcaactagatggccctgatctcttccccatggagagccaccagagtcatctaacccaccatttgacagtgtagcaagtgatattggcccgatgcgctgattaagaccatattctgctacagctttgtaggccatgtcagtagcacgtcttatgtcatctgctccacctgccgaaacccgtcctcctaaaacaacttcctctgctgccctcccaccaagaagtgttactaaacggccacgtagttcatcaacaaagagtaaatatctatcctctgtggtgggaggggtgtacgtgaagcctaatgcacctcctgatcttggcaatatactcaatttctccacacgtggctgtccaggaagaaggtttgctacggcagtccccacaagtgcatgaccaacttcatgccgtgcaacaacagctttttcattacccttcaatttagcatgttttttctctatccctgctatagatcgctcaaccgcacggatgaagtcaatcttttccaccatttctttatttaaccgcccagccaacaaagcagcttcatttaccaagtttgcaaggtctgctccagtaaaaccagttgtcattgcagcaatatcagctagatttacatctttactcagtggaagctctcttctgttcacatgaacttttagaattgattctctcccaaacctatcaggagcttcaaccataactacacggtcaaatctcccagggcgcctaagggcaggatccaaaacatcagctcgatttgttgcccccagtacaatgacagccgagttggtgtcaaagccatccatttccgtgagcaattggtttagtgtctgctcacgttcatcattactgacaatgcgatatcgaccatcacggctttttgcaacggcatcaatctcatcgataaaaataattgaaggtgattcctttttggccctagcaaataggtcacgtactcgagctgcgcccatgcctacatacagctcaacaaattcactagcagagcaacttatgaatgggacttctgcttctcctgctacggcttttgcaagaagtgtctttccagtccctggaagacccaccaataagacaccacgaggagggcgagcaccaagacgaatatatctgtctgggttccttaagaactccacgatttcttccagctcttcttttgcctcatctactccagccacatcagcaaatgtaactatatctgtactttcggaaacttttgtgccaccagaatttgaattcttcctattcctcaactgaccggctgaattctgagaaaagcttattggcaaccgctgcaaaactactgcaatcaatacaacataaataagagctaccagggcagaattgagcatgccgccggacctcttgtcccgcgtcccaaattcnnaaccatgttttccaccatcttctcgtacggtgtctttatgtccactggacgagtcgtcgtgaatgcaattctccttgaagctccagtgttatcatccnacagcatctgctccgcgctgtgttggtgtctgcaccacacggacctgggactcaacctctgccccgtgccggaacatgatgtgcaccccgtccacctcaaccttcttcacctggtccttgtctatgctccccaggaagtcgctgtatggaacactgacgtaggtggtctgcgggcggggctctgaaccaggcaacgcgatctctggccgaagcatgcgtagagcaaatatggcgaagccgagctggagcaggaggaagcccccctcgtgc

SEQ ID NO: 14685 - DNA, 2682 bp, Sorghum bicolor
  Clone ID: SORBI-28MAY03-CLUS1854_1
acaccaggcgcgctgccggccgacgcggccggcccagccgcccacccagccacactgaccacaacggccccggcccccagcggcgcccgtgggcgactgaacgcggctctgggcaaggttgggaccagaactcctttcatccgcttcagggtagtttccgatagcaaaaaaaggttcccagctgtgaagcaggcacgaacgctgccctgaccaacggtgaggcgctgccgggtgcggcccctggtggtgcccgggagctcccgcgagttcccgaaggcagcaatcagctccatggtctccatgaaagcgaccaccgctgtgagtgactcaagagagctgcactgagagagagagagagagagagagagagaggcggaggcttccgctatccgtggccaaaagatcgatcgagtagccagcaagaagaagaagaagaagaagaagaagaagagagatgaacgccgacttcggcgcacccaaggagctcgcgggggggctgcagcatcgacgggccctctaccagcctcccctcccgccatgcctgcaggggccgacggtgagggccgagtacggcgacgcgaccaccaccatcgaccccacctgtgcccaagccgtcgcgcaggccttcccgcacaccttcggccagccgctcgtcagctttgtcgcgccgtccgccgacgccgcagctgctgaggagcgccacccgatcagggtgggcgtggtgttctctgggaggcagtcgccgggagggcacaacgtcgtctggggcctccatgacgcactcaaagcctacaatcctcagagcgtgctctacggatttgtcggtggcacggagggactgtttgcaaacaagacgttggtgctcacagacgatgttcttgcttcctataagaaccaaggtggcttcgatttgctcggtaggagtatcgatcagatccgcactactaagcaagtgaatgctgcaatgacaacatgccgcagtctgaacttggatgggttggtcatcattggaggagtgacctccaattcagatgctgcacagcttgcagagacccttatacagaataactgtaagaccaaggtcgttggtgtgccagtttcattgaatggtgacctcaagaaccagttcgttgaaacaacagttggatttgatacagtgtgcaaggttaattcacagcttgtaagcaatgtttgcctcgatgcaatctcagctggaaagtactattattttgttcgtctgatgggacggaaagcatctcatgttgcctttgaatgtgcacttcagtcacacccaaacatgctcatcttaggagaggaagtagcattgtcaaaactcactctgatggaaattataaacaagatatgcgatggtgtacaagcaagggcagaattagggaaatatcatggtgtgcttgtaattcccgaaggacttatagaaagcattccagaaatgtatgctcttattcaggaaatcaatatccttcacaacaataatgttccggtggctgagatgtcatcacaactgtctccatgggcagctgctctgttccagttcttgccacccttcatcagaagagagctgctgctccaccaagaatcagataactctgcacagttgtcccagattgacacggagcaactgttagcccatctagtagaaacagaaatgataaagagaacaaaagaaggaagatacaagggaaggaagttcagttcagtttgtcatttctttggatatcaggctcgaggatctataccgtcaaattttgactgtgactatgcttatgctcttggacgtatctccctgcatatgatcacagttggattgactgggtacatggcaactgtggctaacctgaaagaccctgttgacaaatggagatgtgctgctgctcctttaactgcgatgatgagtgtcaagaggcatttacgtggccctggagcaatccctataggaagaccttccattcatccttcccccattgacctaaaagggaaggcttatgagttgctgcgagagaaggcttcaagcttcctcctcgatgacttctacaggactccaggaggcattcagttcgaagggcctggttcagacgcaaagcccatcacactgaccattgagaaccaggactacatgggcgacattgagatactgaaagagtatcttggcaaggttaggaccatggtgaagccagggtgctcccgggagatcctgaaggcagcaatcagctccatggtgtcggtgacggatgtgcttaccgtgatgtcccaccccctcaacaccgagctgcccctctaccatttcaagtgagcgagggcatcagtctgctttcgtctgggttatttgtagagtgctttttgtaacagcagaagattctgcttcattggctgccggtattttgtttgggtgagaagcactgggttgatgccaataaacaccgaaactgtccttgatcctgatcctgaactgtagttattgctggattggaaaatgcatgttttcgaccttggtcggctgcagtttaaagtgcaaaacccatctgatcgagatcgagtcaagctagttgtagtattggtggcagtattccagttttcaagaggtctctagaaatatccatagatgccatgtgagagtcaagctaatccatcctaaattataagatgtttgacattttttacatc

SEQ ID NO: 14686 - DNA, 2341 bp, Sorghum bicolor
  Clone ID: SORBI-28MAY03-CLUS5362_1
gcacgaggcaggagggaggagagagagagaggggagctagggttttgcccccccgccctgtaccacgctcaggctctgaacccctccggtccggtttgcggcggattaggctccaatggggaagtctccggcgaagtggatcaagtccgtgcttttcgggaagaagtcgtcgtcgaggtccggctccgccaaggccaaggatttatcgaagggtgcgagtaacaaagggtatgctgctgccgggaaggaacccgctttctccgagagctctccggtgatctcggagcctgtgcttgttagcgcccacaacgatgagaccgcgcgggaggtggccaaggctgagaattccagcgtgcaagaagaagtgccagtgactgatgtctgtcaagacttagagaagcagggcgctgtggggtctgattcgtccaatgatgctgatagggtgagggaagagcaagcggcagtgaaggcacaagctgccttccgtggttatctggcacgcagagcattccgtgccctcaaagggatcataagactacaggcgctgattcggggacatcttgtaaggaggcaagctgtttcaactctccgtgcaacatggttgattgtgaagtttcaagccctggtccgtggaaggaacgttagactttctcaagctttcattcaagcaactagggagctttccctagagaagtttgggggtgctaaacctggttcctggaaggagaagttgtcttcaaatgcatttgctcgcaagcttctatcttcaccaattgtggttgaggctcttcacttccagtatgatgaaatggaccctaattcagccttcaattggttagagaggtggacgataagtcatgtctggaagcccatttcccaaccaaagagggttggtgctgatgctaagccacatacaaggaaggccagttatgcaatggaaacagagtcagcgaaattaaagcgtaatgcacggaagagctctgcagtgccatctgaagcttctcaaacaaacaccaccattgaaattgagaagacaagacggaatccaaggaaattaagtagtactcctgctgagtcggttcctgatggccagttaacagaacttgagaaggttaaacgtagccttaggaaggttactaattccatggctgaaacctcaaagacacctaatccaacaactgagattcctgaccctcaagaggtccaatgtgagagaccactaagaagtgcaaagcaagttccaattcatcctgagaatcaagatcctcggaatgttaatctatcggacaattcaaagatagatattctggtacctgatatccagcctgacgtggaagatgcttcagatccagtcacaatcacaaatgaagaaaaagttgatgagccaccatccgttgttgctccagtggctgaaattatgccactgcaggacattaacaatgaagaaaatgctttggtgaatgatgtggaagagagatccaaagaagaacatccttctactgagagcctgaaaggcagcaagcggaggtcttcattctcaactaagcctgaatatccagaaaatggctccaaaaattctccagctttgccaagctacatggctgctacacaatctgcaaaggcaaaactgcgggggagtagttcaccaagacttagctctgattcagcagagaaaaacgggttcactcgtcgtcactcccttccatcctctaacaatggtaagatgatttcacattctccacgtacacaaaggccaacccttgctggtggcaaggatggagcaaaaggcgacaaggctatgctgtcatcaagagatgcaagcgagagaccactgaaagctgagtggagacgttgagatggcgaatgaaaccacaaatcctccatttgattagtgcaactgttttggtggatggatggcgtctgcagtttgctcggattgttttgcttgtgatgtaaaaaagatgttttcatcatcatccgcggcgatgaatgaacgaaccagctttgttgtgatgaatctgctgggagtcaacttatttatagggttttcggtcatgccttttgtgatgtatagctgaagtgttttccctgtttgctttggttcccagatcccaagacttttcccctccttgttgagagctgctgatgttagagagaacgagaacctgtatggattgagttgaacaatcttagtcctgtttgggcaatctgggctgcgttttgactgatggttgtgtgccattcatgattattgtgcttgaagcagtagtattcttttccaaaaaaaaaaaaaaaaaaaaaaaaaaaaaaaaaaaaaaaaaaaaaaaaaaaaaaataaaaa

SEQ ID NO: 14687 - DNA, 1486 bp, Sorghum bicolor
  Clone ID: SORBI-28MAY03-CLUS6254_1
cagttcgtttttctttttttttatccgtggtttatttttccccatcacgttgtgatattgcagccctcaacgctctgccagttccccaccctacgagcctttcctggtgaagcttccagagggtagggaggcaaaccaaattcgattctccttcttctcatctcaggttgccaggttggactccatggcggcggcgctcgcggtgacggacgaggtggcgctgccgatccgggcggtgggggatctggcggctgccgccgaggtctcgcgggaggaggtcgccgtcatcacccagtgcgcggcgctcggtggaaagttgccttttgaggatgcatcagttggtgcggttcttgcagtcattaaaaacgtggaaagcttgagggagcaattggttgctgaaatcagtcgggtgctgaaagctggtggaagagtattggtgcagagccctgcactctcatccagtcagaagccaaacactgatattgagcgcaagttactgatgggaggatttgctgaagtgcaatcttctgctgcaaactcgcaggatagcgtgcaatctgttacagttaaggcaaagaaggctagctggagcatgggctcttcttttcccctcaagaaagcaacgagggcccttcccaagattcaaattgatgatgactctgatctgattgatgaagacagccttttgactgaagaggacctgaagaaaccacaacttccagttgtcggggattgtgaagtgggggcagcaaagaaagcatgcaagaactgtacttgtggcagggctgaggctgaggagaaggttgggaagctagagctcactgcagaacagatcaataaccctcagtcagcttgtggcagttgtgggttgggcgatgcctttagatgtggaacctgtccttacagaggtcttccaccattcaagcctggcgagaaggtttccttgtctggcaacttccttgctgctgacatatgatggcatcatcagatacatgcaagtgaacatcggcaaaacgaggagataggaatacttctgtcaatttgttcgttcgtttggatgctacgttgttagttgaggtcgatgctcaccggtttacgttcaaaaaaaattgatgctcaccggaagaactgcattttaaatagcttctgttagccaatgcgagcgtgcgtgtgacttgtctttcggataatgtactcgtgccgattgtttgatactacaagacggtgatatcctacatattttctctcaagttggccaagcgcgcctcgacacaaacaagtgtgcatgtgttgtcagattttgcagccctgggtgtcgagaatattgctcacccatcgcaggccaggaatgatttgacattcgtttcgtgtcgtggttagtaaaatattttagttttgagttatagagaggatcaatgatctatgcaagaccaaacttttgtactgtacaacagaagaataacgatctatgtggcaagcatgctct

SEQ ID NO: 14688 - DNA, 996 bp, Sorghum bicolor
  Clone ID: SORBI-28MAY03-CLUS418_1
gcacgagggagagaactagtctcgagtttttttcttgtttattcgaaacgtggggggtgtgtacattgtaagtaatcttgtagcagtaggggctttctttgtttgttactcgagatgtgcccggctgccggccggccgggacgcactcgtcctgtgtgtccgtcctcccaccaccaccgcacgctccgcgctttcgctttctcccgtcttcccaagccttcgcttcgcttcgcttctcgctgcggatcccctctctgtttctagccatggccgggagaggtaaggcgatcggctcgggcgccgccaagaaggccatgtccaggagctccaaggccgggctccagttccctgtcggaaggatcgccaggttcctcaaggccggcaagtacgccgagagggtcggcgccggcgccccggtctacctcgctgccgtgctcgagtatctcgctgctgaggttctcgagctggccgggaacgcggctcgtgacaacaagaagacccgcatcgttccgcgccacatccagctcgccgtccgcaacgacgaggagctctcccgcctgctgggcacggtgaccatcgctagcggcggtgtcatgcccaacatccataacctgctgctccccaagaagtccggcggcggtagcgccaaggctgctgctggtgatgaggactagatccctgaccacgcctttcttccggtggtggcacttcctgtgggtgcggccgtatcaacttgtgcttgtgtagtagtacgttctagacttgccttaggtgttgtgttgggggatgtgttcctgtgtaccgctgctaaactaggttactcttgtgcttgctaaggattagttctgtatttgttgctataaacggtgcatcctttggatgactggttgatcaaacctggtattccaatttacagattgtaatggatgggttcaaatttttggtcagtccagttgaaaattgtgaaactgttgtgctgtgcagttttgaaattca

SEQ ID NO: 14689 - DNA, 2205 bp, Sorghum bicolor
  Clone ID: SORBI-28MAY03-CLUS833_1
gcacgaggcatcaccccactaagaaagatggtgttggtgggaaaactgaacaagacaatcatgaaggtgtagactttttaccatctcaagagtggaaaaaactagctaatgggaatagcaagattcctggtacattagatgactatagaaagcttgtagttccaataattgaggagtattttagtacaggagatgtagaattggcagcttctgagctaaggggtcttggatctgatcagtttcagcattactttgtgaagaagctcatatctatggcaatggatcgtcatgacaaagaaaaagaaatggcgtcaattctgttatcttctttgtatgctgatctactgagctcctacacaatcagtcaaggttttatgatgcttctggaatctacagaagatctgactgttgatataccagatgctactgatgtcttggctgtttttattgcacgggctattgttgatgaaattttacctcctattttcctcactcgggctagagcactacttccagaattttccaagggcattcaagttctgcaggttgttgaaaagagctatttgtcagctccccaccatgcagagttggtcgaacgcaaatggggtggaagcacacactttactgtagaagaagcaaaaaggaggattcagaatattctcagagagtatattgagagtggagacatagatgaagcctttaggtgtataagagagcttagccttccgtttttccatcatgaggttgtgaagcgtgctctcaccttcgctatggagaacatatcctcgcagccattaatccttaagttattgaaggaggctgctgcaggttgcttgatcagtcctaatcaaatctcaaagggtttttctcgactagctgagggtgttgatgacctgagtcttgatattccttctgctaaagctctttttgacaagctggtttcaacagctatggctgaaggatggcttgatgcttcttttggtaaatctgctgcccctgacgaagagatgcaaaatacaagtgctgtaaagatgaagcattttaaagaagaatctgcccacataattcatgagtattttctctcagacgatgtcccagaacttattcgaagccttgaagagctctctgctccagaattcaatcccattttcctcaagaagcttgtcacacttgctatggacagaaagagtagagagaaggagatggcctctgtactcctttcttcactgagattagaattgttttcgactgaagatatcatgaaggggttcataatgctcttgcagtcagcagaagacactgcccttgacattgtcgatgctccaagtgaacttgccctcttcctagctagggcagtgattgatgaagtattaattccgctgaatttggatgaaatcagcattaagcttcgcccgaacagcagtggtagccaaactgtccagatggcccgtgcgctactgtcagctcgccactctggtgagcggatactgcggtgctggggtggtggcactggatgggctgtggaagatgccaaggacaagatcactaagctcttggaggaatacaacacaggtggtgacctgggagaagcctgcagatgcatccgtgatcttgggatgcccttcttcaaccatgaggtggtaaagaaggcactagtcatggcgatggagaagcagaatgacaccagcatcttggccctgctgcaggagtgttttggcgaggggctgataaccatcaaccagatgaccaaaggctttgcccgtgtcaaggaaggccttgatgatctcgtcctcgacatcccgaatgcccaggagaagtttggagagtatgtggagcttgcaacagagcacggctggctgctgccaaccttcgaatccattccctgagcttcactactggcgataccttccctgtgtgtacatttgtgcccatgatgtcattagctccataccaaagttttcctgttattagtttacttatgttactgtatactggaggattgtaggatggatgtggtgtcccttgttgagatagtgttctattggtctggtctgggagggtacttttgagagttaaaagaataaaaccatttcgtttcaggttatgagatgtatcccgtaacctttggtatttttgtaactagctccgcatggtttctggttatctgggcatctgccctttcagcaatgctgctcgttttcacct

SEQ ID NO: 14690 - DNA, 3103 bp, Sorghum bicolor
  unsure (1)..(3103): unsure at all n locations
  Clone ID: SORBI-28MAY03-CLUS813_1
cttgcagcgagcttgcactgcatgagtacaagtctgcgactaacatgacagagcagtttgctgcattagcagcattatcccaaaatccaggcccagttcgtgatgatgccctcttggatttctataacaagtggcaggatgactacttggttgtaagcaagtggtttgctcttcaagctacttcagagattcctggaaatgttgcaaatgttcagaagttgctgtctcaccctgctttcgacatgaggaatcccaacaaggtttactcgctaatcggtggattctgtggctcacctgtgaacttccacgcgaaagatggatctgggtacaagttcttgggtgaaattgttttgcagcttgacaagataaaccctcaggtggcctcccgcatggtttcagcattttctcggtggaggcgatatgacaagaccagacaagatcttgccaaggcccagctggagatgatcgtgtcggccaatggactctccgaaaacgtgtacgagattgcttcaaaaagcttggcgggttagttttgggcagttccagggtagtgccgagtgccgagtggttgtgcttaactgaaaatctcttttgttggcaaaatgacaagtagagtaataaacaggcgtgctgaagttgcatgaactgaacaaatatagtgtgatgactgatgatgcccgctttgtgggggtttggatcatgcatacttctgcactcagtgtgaagcagaagggtttcggaagattaccttctttcaggatcgcccggatgttatggcaaaatatacttgccgtattgaagctgataaaactttgtatccagtattattgtccaatgggaatcttattgagcagggagaccttgagggtggaaagcattatgcactgtgggaggatcccttcaagaaaccaagctacctgtttgctctagttgctggtcagctgggatgccgggaggattcatttgttacatgctctggccgcaacgtaacactaagaatttggactcctgcccaagatttaccaaaaacagcacatgctatgtattctctcaaagcagcaatgaagtgggatgaggaggtctttggtctggagtatgatcttgatttattcaacattgttgttgttcccgatttcaatatgggagcaatggaaaacaagagcttgaatatatttcaatctagacttgtgttggcatcaccagagactgccactgatggtgattatgctgcaattttgggtgttgttggacatgagtatttccacaactggactgggaatagagtaacttgccgtgattggttccagctaaccctganagagcgcctggccgttttcagggatcacgagttctcttcggatcttggctgtcgtacggtaaaacgtattgctgatgtctccaaactcagaatctatcaattcccacaggatgctgggcctatggcacatcctatccgccctcattcctatatcaagatggacaacttctatactgtgacggtttacgagaagggtgctgaagttgtcacaatgtacaagaccatgtttggagcgtcagggttccgaaagggcatggatctttatttccaaaggcatgatgggcaagctgtcacttgtgaagacttctatgcagccatgtgtgatgcaaataatgcacaactgccaaactttttacaatggtactctcaagcaggtacgcctatagtcaaggtggcatcttcatatgatcctagttctcagacattctctttgaaatttacccaacaagaaccacccactcctggccaaccagttaaggagcctatgtttatacctgttgctgttgggcttgttgnaccctactggaaaacatatgcccctcacttccgtttacagtgatggaactctccaaacactctctactgatggccagccagtcttcactactgtgctgcagtttaaaaagaaggaagaagagtttatatttaagaacattcccgagaggccagttccttctttgttgaggggatatagtgctcctgtccgtctagattctgatctcagtgagagtgacctatttttcttgcttgccaatgactcagatgaatttaacagatgggaagctggccaagttttggcacgtaagttgatgctcagtcttgtagctgacttccagcaacagaaaacactggccctaaatccaaaatttgttgatgggattagatcaattctgcgcaacacaagcttggataaggaattcattgcgaaagcaataactttgcctggtcaaggggagattatggatatgatggaagttgcagatcctgatgcagttcatgctgtccgtaactttattaagaaggagcttgccttgcaactcaaagatgatcttcttgcagctgtgaaaagcaacaggagttctgaggcttacacatttgaccatgatagtatggctcgccgtgcattgaaaaatacatgccttgcataccttgcatcattgaatgagccagatttcactgagcttgcactgcatgagtacaagtctgcgactaacatgacagagcagtttgctgcattagcagcattatcccaaaatccaggcccagttcgtgatgatgccctcttggatttctataacaagtggcaggatgactacttggttgtaagcaagtggtttgctcttcaagctacttcagagattcctggaaatgttgcaaatgttcagaagttgctgtctcaccctgctttcgacatgaggaatcccaacaaggtttactcgctaatcggtggattctgtggctcacctgtgaacttccacgcgaaagatggatctgggtacaagttcttgggtgaaattgttttgcagctggagatgatcgtgtcggccaatggactctccgaaaacgtgtaccagattgcttcaaaaagcttggcgggttagttttgggcagttccagggtagtgccgagtgccgagtggttgtgcttaactgaaaatctcttttgttggcaaaatgacaagtagagtaataaacaggcgtgctgaagttgcatgaactgaacaaatatagtgtgatgactgatgatgcccgctttgtgggggtttggatcatgcatacgctcgtt

SEQ ID NO: 14691 - DNA, 483 bp, Sorghum bicolor
  unsure (1)..(483): unsure at all n locations
  Clone ID: LIB3476-052-P1-K1-F2
ccggtcgaccacgcgtccgcatcattggaggggctgtacaagtctactggtaacttctgcactcagtgtgaagcagaagggtttcggaagattaccttctttcaggatcgcccggatgttatggcaaaatatacttgccgtattgaagctgataaaactttgtatccagtattattgtccaatgggaatcttattgagcagggagaccttgagggtggaaagcattatgcactgtgggaggatcccttcaagaaaccaagctacctgtttgctctagttgctggtcagctgggatgccgggaggattcatttgttacatgctctggccgcaacgtaacactaagaatttggactcctgcccaagatttaccaaaaacagcacatgctatgtattctctcaaagcagcaatgaagtgggatgaggaggtctntggtctggagtatgatcttgatttattcaacaantgttgttgttcccgattt

SEQ ID NO: 14692 - DNA, 1990 bp, Sorghum bicolor
  Clone ID: SORBI-28MAY03-CLUS2009_1
gcacgagggcttcctccattccacgtcctgaaagggtttctccttggcagctcgagcctgcagtcagccctccccctgtcaatccacttccagtacacaggcccaagaggcctcgctctaatgctgtagcttctctggctgagtcttcagctccaacaaaagaagctgctccgaaggtcacattagagactcaacaacatgccctgcaaaggcccttgcagacccaggataatgcggccccaaaaagtggttttggtgataacagtgagttggacgctgctcataagtcagccctgcgaccatcagggtttgatctagagaagaacaccattggcatgcagaggaagctgggttcagatagttggatgcatatgaacagacctgaaggatacaatgaaatgttatctggatatcaacaacctaataaagatgtacagaatccacagggtttctgttctttacctgatcagattgctgccggtcgtcctaatttctggcacaccgtaaatgctcattatcaagaccagcaaggcaatcacaatctattccctggttcatggtccatgatgccttcaagtactggctttgggttgaacagacagagctatccaatgatgcaggaagttggtgggttgtctcagagtgctacgaacaccaagtttgggaatggagcttatgctgcactacctggtcatggcattgatcaatactcttctggatggtttgggcacatgatacctggtgctcgcatggacgatgtccagccacgcgtgattaagcctcaacctttggtccttgctcatggtgaagctcagaaaatgaaaggcaattcatgcaagctttttggaattcaccttgatagcccagccaaatctgaacctttgaaatctccaccaagtgttgcctatgatgggatgccacaaactccagcagcagctgaatggcggatggttgattcaattgaagcagacagatgttctgatccacttaagatgccaaagcaactcgatgctacacaggtagatcctgttccagagaaatgttcacaagtttcaagaggcacacagtgcaaatcacaaggtggatcaactaggagctgcaagaaggtccacaagcaaggaatcgcacttggcaggtctgtggatcttacaaagttcaatggctacacggaattgattgctgagctggatgagatgtttgacttcaatggggagctgaaaggttctaacaaggaatggatggttgtgtacaccgacaatgaaggtgatatgatgctggttggggatgatccctggaatgagttctgcaacatggtccacaagatcttcatctacacaagggaggaggtccagaggatgaatccgggcaccctgaattcaaggtccgaggacagccttgctaattcaatggaaaggggctctactgctagggagacacctggcagcctatccgcctcttcccttgactctgagaactgctaatgcctttgcagctggtcgtctgaagtaacaactgggaggaaaaggcaatgtatccataggtttcctagtggagcttaaatgcttttcttttatatatgcattggacgagcccatagtaccctagtatttatagatggtgctcgtcctggtggtctaagttgaaccctcttattcgctgcagttttggtttctcctttcggtgaggtaggttagttggttcgcttgtcgtaccacctaatgtacgcgtagcaaaccaagcgaagccctcccgcgctttccctcggcacaaagcgttgtacatatatcatctggtaatcgtctctcctgtgtcccgtgcttaaagcttcgctgctgggttgctgtttggaggccccgccgttcctccctctagtttgagtcttgtttgcacttgcagaattgggggcttgaacttttctactgctggtgtagtgattgaccaatcatgctgagctctcctttcagcttaaggttccagatgttttccgctt

SEQ ID NO: 14693 - DNA, 436 bp, Sorghum bicolor
  Clone ID: LIB3481-038-P1-K1-C1
cgtgcgatcaagaggactttgctgcactacctggtcatggcattgatcaatactcttctggatgggttggggcatgatacctggtgctcgcatggaccatgtccagccacgcgtgattaagcctcaacctttggtccttgctcatggtgaagctcagaaaatgaaaggcaattcatgcaagctttttggaattcaccttgatagcccagccaaatctgaacctttgaaatctccaccaagtgttgccagttttggccctcgaagagggtcagttgttgtcctgactgataggtccagtttgacagttttaggaggtatacttgtgctgagtgcatgcatacacgattctgtacagtccaaaactcggttcgtgttggtaccgtggtcgatcttgttgcaagtaggttcaccaaaaggttgagcaatgtactgttgg

SEQ ID NO: 14694 - DNA, 2313 bp, Sorghum bicolor
  Clone ID: SORBI-28MAY03-CLUS1882_1
ctccacctccaccgccgctctcctctcctctcctctccagtctccaccccggtccgcggccccccgccccccccccccccccctctcccacctccccgcgcgtgcgccgctgccgcgagatccggggcgcgatgtggcgcacctgcgtctcgcggcgcctctccagggccaaggcctccgcctccaggctcctctccacgggcatcgtcgtcctacacggtggtggaccacacctacgacgcggtggtggtgggggccggcggcgcggggctacgggcggcgatcggcctctccgagcacggcttcaacaccgcgtgcatcaccaagctcttccccacgcgctcgcacaccgtcgcggcacagggaggcataaatgctgcgcttggaaacatgagtgaagatgattggaggtggcatatgtatgacactgttaagggaagcgattggctcggtgaccaggattctattcagtatatgtgcagagaagcaccaaaagctgttatagagcttgagaactatggattaccattttcaagaactgaagagggaaagatataccaacgtgcctttggaggacagagcttagattttggcaaaggtggacaagcctaccgttgtgcatgtgctgctgacagaacaggacatgctatgctacacacactatatggtcaagcaatgaagcacaatactcaattttttgtggaatactttgcattggaccttctcatggacaatgaaggaaagtgtcagggaatcattgccttaaacatggaggatggaactcttcaccgtttccgtgcttctaatacaattctagccacaggaggttatggcagagcatatttctcagcaacctcagcacacacttgtactggagatggcaatgctatggttgcacgtgctggtttacctcttcaggatcttgagtttgtacaattccatcctacaggcatttatggtgctggatgcctgattactgaaggttcccgtggtgaaggtggtatccttagaaatagtgaaggtgaacggttcatggaacgatatgctcctactgcaaaagatcttgcttctcgtgatgttgtttcaagatcaatgacaatggaaattagagaaggacgtggtgtagggccattgaaggatcacatttatttgcatctgaaccatctgccgcctgaggttctcaaggaaaggcttcctggtatttctgaaactgctgctatttttgctggtgttgatgtcaccaaggagcccattccagttttgcctactgtgcactacaatatgggtggtataccaacaaactaccatggggaggtagtggatatcaagggtgataatccagatgctgttgttcctggtctaatggctgctggtgaagcagcctgtgcatctgtccatggtgcaaataggctaggcgcaaattcacttcttgacatagttgtttttggcagagcttgtgcaaacagggtagcagatatttctaaaccaggtgagaagcagaaacctctggaaaaagatgctggagagaagaccatagcctggttggacaagctgaggaatgcgaatgggtcattgccaacttccaagatccgtctgaacatgcaacgtgttatgcaaaataatgctgctgtgttccgtacacaagaaacacttgaagaaggttgtgaactgattagcaaaacatgggaaagtttccatgatgtgaagctcagtgatcggagtctcatttggaactctgatttgatagagacccttgagctggaaaatcttttgataaatgcatgcataactatgtattcggcagaggctcggaaggaaagcaggggagctcatgctcgtgaagatttcacgacaagagatgacgagaagtggatgaagcactcactggggtactgggagaacgagaaggttcgattggcatacagaccggtgcacatgaacacattggacgatgaagtagagtcattcccgccgaaagctcgtgtctattgatcgattcgagcctcacacctcaggaattccttgtaaggtgttaataaagcagatgggcattcctggctgagaacatgacctcaatttgtgtccctcttttttttctgtggttctgtaatttgtctaatttgctagaaataaaagggtaaggtagaacacaagctaatgcctgactgacgtttgtgtacatgaattttgcatgggttacttgttgatgcctacctggtgtcctgaactcatgatgattcaagaatgtttggtgaatagtgagtgattcatggtgtgatgttggttgacaacgtagaaaaataatattatcca

SEQ ID NO: 14695 - DNA, 323 bp, Sorghum bicolor
  Clone ID: LIB3480-038-P1-K1-C7
cgcgtccgtataggtaaagtagaacacaagctaatgcctgactgacgtttgtgtacatgaattttgcatgggttacttgttgatgcctacctggtgtcctgaactcatgatgattcaagaatgtttggtgaataaaaaaaaaaaaaaaaaaaaaaaaaaaaaaaaaaaaaaaaaaaaaaaaataaaaaaaaaaaaaaaataaaaaaaaaaaaaaaaacttaatataattttccttctaaataaaaaaacataaaaataaataataaaaaatttaaataaatattaaatataatggggcggccgttttaaaaattcaacttttt

SEQ ID NO: 14696 - DNA, 2042 bp, Sorghum bicolor
  Clone ID: SORBI-28MAY03-CLUS4596_1
gcacgaggagcacgagggaggagactcgctgaggcaggaggaggcgggccggcgcgctaactggagcatgatggggaaggcgctcgtcggctctgctgttttcctcctcctggccgcgctcggggcggcgggggcctctgccgcggacatcacccgggccgacttccccgcggggttcgtcttcggcgtcggctcgtcggcgtaccaggttgaaggtgcagttgcagaggatggaaggaagcctagcatctgggacacattcacacataaaggatattctattgacggtgcgacaggtgatgtaactgcggatcagtatcataagtacaaggaagatgtaaagcttttgcatgagctgggtgttgatgcctacaggatgtcgattgcctggcctcgacttattcctgatggccgaggagctgtcaatccgaaggggctggagtactacaacaatctgatagatgaactccttagctacggaatacaacctcatgtaacgatctatcatttcgattttcctcaggctcttcaagatgagtacaaggggctgcttagtcctagattcatagaggactacacagcatacgcagatgtgtgcttcaagaactttggcgacagagtgaagtactggagcactgtcaatgaacctaacatcgaaacgattggcggatttgaccaaggaatcctaccaccacagcgatgctcagcccccttcggcttcggttgtgatgaaggcaactccaccacagaaccgtacatagcagcacaccaccttgtacttgcgcatgcatctgcagtgtccctatatagagagaagtaccaggctgagcaaggaggacgaattgcacgagccttgcttggttggtggtatgagcctgcaacggagactcccgatgatattgcagcagctgcaaggatgaatgatttccacgttggatggttcatgcatcctatggtgtatggagactaccctccagtgatgaggaagaatgttgggtccagactgccatccttcacgaatgaagaggcaaaaagggtaaagggatcttttgattttgtcggattcaaccactatgttgccgtctacgtgaaagctgatcttagccgactagatgagaaagtgagagattacatggctgatgcagctgtggcatatgacatgccgttcctcaagtcaaggaaccagttcccgttcgggttggggttgacggctgattttacgacgcccaccccctgggctctcaagaaaatgctgaagcatctccaagtgaaatacaagaaccctgcagtgatgatccatgaaaacggagctgctggacagcctgatccatccggcgtgaacacctacgatgacgaattcaggtcacaatatctccaagattacatcgaagccacgcttcaatccatcaggaacggatcaaacgtgcaaggttacttcgtgtggtcattcctggacgtgttcgagtacctgttcggctaccgcctccggttcggtgtctgtggcgttgaattcaactcgacggcaaggacaaggtatcagaggcactcggccaagtggtactccagcttcctccgtggtggcgagctgaggccagtggctctacctgagggagcatattcacagtgatcaacaacacgctccagctcaagggggatatctggtaaatttttttgaatggcaatgtatggtaaattggtgatcaacactcttggggtggaaagaatagagaatgtataagcacggttagttgggtggtatatatagcagtgcctaaatatgatttccttgggtaaatatggtacgagttaaataagctggttttagcgtgtggttgggtgcttattggggttttaagatggaaaagtcagccgtttataggaaaaaaggacaaaagactgtgataatgtaatggtactgttggcacataaaattatccaaaatctataacggattccgtcgttatgtttctcatatgctgtaaacattgataccgtttgctttatatcagtaaagcagaagaaactccttttctaaaaaaaca

SEQ ID NO: 14697 - DNA, 585 bp, Sorghum bicolor
  unsure (1)..(585): unsure at all n locations
  Clone ID: SORBI-28MAY03-CLUS1460_3
cgaggagcagctggagcagctccgtcgccggcggcgggtacgggtacggcgaggccgccgagtacacggagaccacggtgacggaggtggtgtccaccggcggcgaggacgagtacgacacgtacaaggtccgggagaaggagcacaagcacaagcagcacctcggcgaggccggcgccatcgccgccggcgccttcgcactctacgagaagcacgaggcgaagaaggacccggagcacgcgcaccggcacaagatcgaggaggagatcgcggcggcggcggccgtgggatccggcggcttcgccttccacgagcaccacgagaagaagaaggaccacaaggaggccgaggaggccggcggcgagaagaagcaccacttcttcggctgatttctcccgtcgacaacgtgcgtgcacgtacggccatatgtatgtatatgtgcgtgtatatgtatgttgtacacgtatatgtatcttcgngtgcgtgtgatgagagtgagatcgagaaaccgagagggggggccgcgcgcccggtcgccgtacattgatatgcgtgatgaataagtggctactatatatggaatct

SEQ ID NO: 14698 - DNA, 805 bp, Sorghum bicolor
  unsure (1)..(805): unsure at all n locations
  Clone ID: SORBI-28MAY03-CLUS1460_2
cgcgtccgccccgaattgtcactcgctcgatctgtttcctccagcaaattaaaggtcacatctcgatcactatccactactgcacacagcacacatggcggaggagaagcaccaccaccaccacctgttccaccacaagaaggacgaggagcagctggagcagcccgtcgccggcggcgggtacgggtacggcgaggccgccgagtacacggagaccacggtgacggaggtggtgtccaccggcggcgaggacgagtacgacacgtacaagaaggaggagaaggagcacaagcacaagcagcaccccggcgaggccggcgccatcgccgccggcgccttcgcactctacgagaagcacgaggcgaagaaggacccggagcacgcgcaccggcacaagatcgaggaggagatcgcggcggcggcggccgtgggatccggcggcttcgccttccacgagcaccacgagaagaagaaggaccacaaggaggccgaggaggccgccggcgagaagaagcaccacttcttcggctgatttcatttctcccggcccatcaatcgtatacgtcccgtcgacgacgtacgtgtgcgtgcacgtacggccacatgtatgtatatgtatgttgtacacgtatatgtatctacgcgtgcgtgtgagagtgagatcgagagactgagaggtgngnccgcgcgcccgctcgacgtacatgtatatgcgttctggatgaataagcggttactatatgtaacctgtcgtgtatacgtgtgtgtatatgtacctgtgtatgattgtggtatatgatgactg

SEQ ID NO: 14699 - DNA, 950 bp, Sorghum bicolor
  Clone ID: SORBI-28MAY03-CLUS1460_1
ccgggactcatatccaattgtcactcgctcgatctgtttcctccagcaaattaaaggtcacatctcgatcactatccactactgcacacagcacacatggcggaggagaagcaccaccaccaccacctgttccaccacaagaaggacgaggagcagctggagcagcccgtcgccggcggcgggtacgggtacggcgaggccgccgagtacacggagaccacggtgacggaggtggtgtccaccggcggcgaggacgagtacgacacgtacaagaaggaggagaaggagcacaagcacaagcagcacctcggcgaggccggcgccatcgccgccggcgccttcgcactctggtgtccaccggcggcgacgacgagcacgaggcgaacaaggagccggagcacgcgcaccagcacaagaacgacctcggcgaggccggcgccatcgcctccggcgccttcgcactctacgagaagcacgaggcgaagaaggacccggagcacgcgcaccggcacaagatcgaggaggagatcgcggcggcggcggccgtgggatccggcggcttcgccttccacgagcaccacgagaagaagaaggaccacaaggaggccgaggaggccgccggcgagaagaagcaccacttcttcggctgatttcatttctcccggcccatcaatcgtatacgtcccgtcgacgacgtacgtgtgcgtgcacgtacggccacatgtatgtatatgtatgttgtacacgtatatgtatctacgcgtgcgtgtgagagtgagatcgagagactgagaggtgggcccgctcgacgtacatgtatatgcgttctggatgaataagcggttactatatgtaacctgtcgtgtatacgtgtgtgtatatgtacctgtgtatgattgtgatatatgatgactgaaaaatgcgtacagctctgattttgcttatgtgtt

SEQ ID NO: 14700 - DNA, 2049 bp, Sorghum bicolor
  Clone ID: SORBI-28MAY03-CLUS8095_1
gcacgaggagtatctggtagtgccacggctagtcgccgcgcactctttttcccctatcgcgtccccgctctactggaacaagagcctgactccttcagccccaagcaacgttgttagcatctctcaagaatggctagatagtggagatgagcaaggcggagttggttgtcgataaatgcgaagttgacaaaaggctaaatcatcaaaaagggaaaatggcgacttatatgttgctcttgcgtggatttcagtgtgtacacccagtgttctttcccggcatattttgctgagtggatatccccagcgggtcgcgaagtgatggagcagagaacccgctacggtcaatcacgatcttgtatacactgcaggggcaacatcagggataacacatcatgacacatcttcattgatagtatctccgacaaccaattctcgggttggatttccctctgtctataaatccacctatttatttttttcgtacatatgcactgcctagtatcgggcccttaagtaacatactggcaaacaaccttcttgttagcccgacttttcactacccttttttcaacattgttgtatgtattagacattttatgttgggatctatttatatgtgaacaaatttgatgttgaaaaaaaatcattgatagaaatgtactgtatattttttaaaatatttgctaattattttggagtgagacattcttgtttccagttatgtactatgcaatgattcagttcatctcatccgtattaggttcgttctgcatagaaccaatgagggtggtttcagtaggccttctttacggcactacacttgtgtgaggatattttttcttttagtctgtaaagtatttccagtggcttttacgtctacagttttctttctctctttttgaactgccgacagtttcctttcaggtctgtcatgttcctcagctatgtagaatatcacaccggagtggtttggtgaagacgaaaagtatgttcgagcattgctctcattagctgctaatgtatcaccaaccatcatctttgtcgatgtaggtcctggcttgcttgggctgccgacctgggccggcccgctcgtgcctttgagaaagatcaagaatgaatttatgacacactgggatggactcttgtcaagaccagatcagagaattcttgttcttgctgcgactaaccggccttttgatcttgatgaggctatcatccgtaggttcgagcgaagaatcatggtaggtctgccatccatggaaagtcgggaactcataatgcggcgacttttgtcaaaggagaaagttgatgaagggctggactataaggagctagcaaccatgacagaaggatatagtggaagtgatctcaagaacctgtgcacgacggcagcatatcgccctgtgagggagctaatccagagggaaagaaagaaggagctggagaagatgaagcgtgaaaaaggaaaaactccatcggatcttccagagaagaaagaaaaggaggagaccatcattctaaggccgctgaacatgacagatctgaaggaagcgaagaaccaggtggctgcaagtttcgctgcggaaggcgccataatgagcgagctgaggcaatggaacgagttgtatggtgaaggaggctccagaaagaagcagcaattgacatacttcctctgagcaacatgaacatcacacgcaaaaaatgtatggacataatttgcaaaagtagagtagagcacaaaatagccatgaggaaaataggccgaacatgtataagaacataagaaacggggagtgttaggggacaagagttcaggccgtaaaatccagtttctggtgtaggacaaggaagaacaatttttatctccacctaaattccagtttgcctgtgctggttgttgtattacactctaataatgaatctgcagtgcagattgctcttttttcgttgttttctctttgcctggtcgcatcatccttttgtataggtataaactggtaggttgtggctagcagcgaaaggtttacgtagcagcttatttctatataa

SEQ ID NO: 14701 - DNA, 486 bp, Sorghum bicolor
  Clone ID: LIB3478-012-P1-K1-H1
gccatatgtggaggtggcactctaccatgaaccttcacggcactattggtgatcgatgttgtcacctatgttcctcaacaagcaccggagtatatcacaacaaagaatcgttgttggcatctatgaagaatggctaggtagtggagatgagcaaagggaagttggttctcgataaacccgttgttgacaaaaggctaaatcatcaaaaagggacaatggctacttatatgttgctcttgcgtggatttcagtgtgtacacccattgttcttgccctgcatattttgctgcttcaatatgcccagcgggtcgcgaagtgatggagcaaagggaaagctactgtcacccactctgacgtatcaacaacttgggcatcgtcaaggaaaacactagaggccttatctagaatgatactgtcacccacaacatattctaggttgggaattctttgtgtctataaacccacattttgattttttagtagaga

SEQ ID NO: 14702 - DNA, 358 bp, Sorghum bicolor
  Clone ID: LIB3476-043-P1-K1-H1
ggctaagggagcaacaggtttcagcggttgtcctactcaatctaatgtctcttgcagtccggctccatggaaggtaccatgctctctcagaatagtcatgctccatccctccgaacaccacttttatatataataatgttgcagtgaagctttccttcttttaaaaaacaatggtaaagactaatgctttagcactaataggttatggggctgattagttgattgatcagtttgggtatcattgatttatatataataatctttacttacccttaattcattggaataaaaaatgcatggttatttttaggtttcacacttctaatggcttccttctggattcaatactggttttttt

SEQ ID NO: 14703 - DNA, 1638 bp, Sorghum bicolor
  Clone ID: SORBI-28MAY03-CLUS5709_1
atcgctgccgtacagagaagatagcagggggcgcactcacaaaccctagatcggcttctccttgctccgtcgttggtcgtcgtcggcggctatggcggtggaggcggcgctggcctggtacgaagagttgcgagagaaggacgatatgcaggagaagatcagtaatgagatcaaccaactctggttgggtacgaggaacaaggaattctcacaaggcttgagcaaggcggagctccggaagaagcgggccgagctcgagaaaaagtgcgatgccttgtcgcagaggtactggcaggtcgtttttgagatggggtcgaagccggatttctcaggcatgaccgaggccgagcgagcggagacggcggagaagctgaggagcgacgagctgcggtatgcgcgccgccttacggaagaaggcgaccccagggctttgagcattgaagcctttgttcccatcctcgacttcgatcctaagcaagggggtcgctactacaaccgctacaccctcgtcgacctcaccacattcgacctcgatgaagagtcacccattggtccgatgcaatttactgattccccccacaaagtaatcgagaccgaccacttcaaactgtctggggctgtaaacttcttgtctgtcaaggtagcctcttcagatattggcttcccaatccatgtgtatggcactgtcattgtcagggacagcatcgatgagaggtgtgtttatcacttccgctgcgaccctgaccattgccaactcatcaattctgaggctgaatcgttgatcttgactgggccgaaacgtgggctcgcattgtgtggttacatgtatgtggagattgatctaaagatcaaggatcatctaggacagtccagagaatttagtaaaggactcttaagcatcagtgacccaacaaattgtgcatcgatggtatctatggtcgaaactatatcccttgctaccaggctcagtactgtggatgtgacttatgcagttgtgaatcgtgcagcggagggatttattgcagttaaagttctgcagggaggtttccatggaaaaatcaccgcatacaccaccagcgtcaaggacatacttgtgctttatgacagcaaagaggctgatgctatgacctttgatgattgtggagatatcctgcagcttatgcggcctgtcgtatctgtccacgttgaggatttcctgataattgttttccacaccagtgacggtaaatcagagagcatacaattcgctccaatgttcaacggcagagacgaaggtcaaattactgttggtgctaccaagatgtgtgtgaagcttgcttggtcagtaatgaaaccttgactgtgctgttaagcttcgttggtaggacccttgatgcttcactattgtagctacgtctggttcagtgatgctgcagtcatcttaggttatgcaaaattagtgggaccttataagtaagacagtgtgtgtaactaccctattgtgcttggctgttatatttgaaccaatttctaccgtgttgggtttgttgaccactatataaatctaatatctggggcttgttatgctgaaccactatctaatatgtggggtttgttcgctgaacgactaacctatggctatttgggtgaactaagcag

SEQ ID NO: 14704 - DNA, 383 bp, Sorghum bicolor
  Clone ID: LIB3480-014-P1-K1-D4
cacccattggtcccatgagacatatcgattccccttacaaaaaagagagctactttctccgcctgtgtaaggcagtaaacttcctgtctgtcaagataggctgttctgatgttggctacccaatccatgtctatggcactatcattgtcagggacagcatcgatgagaggtgtgtttatcacttccgccgcgacagtgacaattgccaactcatcagttctgaggctgaatcactgatcttgactgggccaaaacgcggccttgcattggcaggagatatctatgtggagactgatctcaagatgaaggatgacctagtccaggacagagaacttagtaaaggactgataatcatcaggggcacaccaactcgtctatttgag

SEQ ID NO: 14705 - DNA, 1748 bp, Sorghum bicolor
  Clone ID: SORBI-28MAY03-CLUS598_1
agaggcctgagccggcacggcagtccgcccagttttcgtttcgttttccgaggccgatgacccatgtcccgttcccgttgtagctagtacactgtacgctgcacacctgtcatctcaagataaagctgctatcccccaacatcccccactggagcctggaggctgctggtgctggagctccccagtgcccgtgctgaccaccgccacctctcgccactgcccgtcgatcgtcgtccagctccccagccccaccgtccgtgtggaggaggagcttctgctgcaagtggcgtatcgtatccctttcccttctagaataatgcagagcgccgcggctttccggccgtgccccgccggcgccggcgccgggcagctggtgagccgtaatcctagccggggccccctcctcccggtcccggcccgcccgctccgcgtcgtcgtctccgccgctaccactcgcgctctgggtctcgggcggctgcgcctgtcagcctcgccggatgatcggtccggccagcgacaggtgtcgtgtggcgcggccggggacgctgtggcggccccgagtgcggaggaaggcggcggcttcatgaagacgctgtggctcggctcgctcttcggcctctggtacctcttcaacatctacttcaacatctataacaagcaggttctcaaggttttcccataccccataaacatcacagaagctcaatttgctgtcggatctgtagtatctttgttcttttggaccactggtattattaagaggccaaagatttctggagcacagcttgtagccatcctacctctggctattgttcacactatgggcaatctcttcaccaacatgagccttgggaaagttgcagtatcatttacgcacaccatcaaggctatggaacctttcttttccgttcttctttctgcaattttcctcggcgagtttcctactgtttgggtagtagcatctcttcttccaattgttggtggtgttgcattggcatctcttactgaggcatcctttaactggattggcttttggagtgcaatggcttcaaatgttacctttcaatcccggaatgtactgagcaagaagctcatggttaagaaagaggaatccttggacaaccttaatctcttctctatcattacagtgatgtcatttttcgttttggcccctgttaccttctttactgaaggtgtcaaaattactcctacatttttgcaatctgctggtctgaatgtaaaccaggtccttacaaggtctcttcttgctggactgtgtttccatgcataccaacaggtgtcttacatgattttggcgatggtgtctcctgtcactcattctgtgggcaactgtgttaagcgtgttgtggtcattgtaacatcagtgttgttcttcaggacacctgtttctcctatcaactctctcggtactgcgattgcacttgccggagttttcctgtactcacagctcaaaagactcaagcccaagccgaagactccttaaatagctagggattgtattttccatctctcttgtgttagtggagtcaagcagttccatatttcaagtgcctgaattttaagataattttaggcaacactcttgtacaaactagtacaagtaaattgttacttttatgatttgttatttgtctttgtaccataatatattaaaattttgttctaatctaactatagaaacaattgtaaaatgtctttgtgccaaaatgaatcagattttattgggt

SEQ ID NO: 14706 - DNA, 1269 bp, Sorghum bicolor
  Clone ID: SORBI-28MAY03-CLUS6138_1
gctcgcgacccagaacgcagaacacaccaaactcgctcgttctcgctactcgcgtcttctcgtcgacagctccaactccgaaaccctactccgccggtgatgtcgtcatccggcgccccggccccggcggcggcgatggccgttgacgaagcggaggacgatcagctcgcctccatgtccacggaggacatcatccgggcctcccgcctcctcgacaacgagatccgcgtcctcaaggacgagttgcagcggacaaaccttgagttggagtcgttcaaggagaagattaaggaaaatcaggagaaaattaagctcaacaagcagctgccctacctcgtcggcaacatcgttgagatcttggaaatgaaccctgaggatgaagctgaggaggatggtgctaacattgatttagactcacaaaggaaaggaaaatgtgttgttctgaagacctccacaagacaaactatattccttcctgttgttggactagtggaccctgacaagctaaagcctggtgatctggttggagtaaataaagatagctaccttatactagatacattgccatcagagtatgattctcgagtccttgtattatatttattgatgagatagatgccattggcaccaagcgatttgatagtgaagttagcggtgatcgagaagttcagcgaaccatgttggaattactgaatcaactggatggattcagcagtgatgagagaataaaggtcatagctgcaacgaaccgtgctgacatccttgaccctgctctgatgcgatctggacggttggaccgaaagattgagttccctcacccatctgaagaagcaagagctagaatcttgcaaatccattcaagaaaaatgaatgtaaatcccgatgtcaactttgaagaattggctcgctcaacagacgacttcaacggagcacagctaaaggcagtttgtgtagaagctggtatgctcgctctacgccgggatgctacagaggtaacacatgaggacttcaatgaaggaatcgtacaggtccaggcgaagaaaaagtcaagcttgaactactatgcttaagctatactttatgcaaaaatgtggaccacaagttgtttgtaacactactgtatggatgatcgaagctacgtttttacgtttgctttgagagtgcaagtttttaacattatcaaagatttttattcagcctcaggctacctcagaaaactgtttggtgagcgtgagtttatcaatcgaatatgttgcattggggcgctct

SEQ ID NO: 14707 - DNA, 2075 bp, Sorghum bicolor
  unsure (1)..(2075): unsure at all n locations
  Clone ID: SORBI-28MAY03-CLUS591_1
agaccacaccccgcgcaacccccaacgcaccgccgctgccgcctcccgcctcgccggagagaacaggagaaccgaccccggggcgcagggccgcctcggcaacagattccgcaaccgcgcagcagcctgcccccttcctcctccctcccctcggggcgtggccgagttgtaggcaatcacggctagcgttgcagccccccggcgcggccccccagctgcgcaggtggagccaacggggaccatcgcctccgccgtcgcggcaagccccgccccgcacggcggccgcggggcgctgccctcggccggaggaagcccgtccgatctactcttcctcgccggcggcggtcggaccctctgagccgccgcagccgctcctttctctctctctctctctcacccccaccccttcctccttgtctagcgaatagcccctctctcttagctaacccccccccgacccccgacgagttctcaccccgagagtaaacccacccacccacccgccggcatggagatgaagctcaccatcaagagggtgcccaccgtcgtctccaactaccaggacgacgccgacaagccgcgcgccggctgcgggaggaactgcctcggcgactgctgcctgcctgcttccaagcttcccctctacgcgttcaagttgaatccggcaaagcgctcgcaggagggtgctgcttcaaccaagctgcttgttgatatcctccttagcgagtgggaagacaggatggcccgaggcttattccgctatgatgtcactgcctgtgagaccaaggtcatccctggcaaccttgggtttgttgcacaactcaatgaagggcgccaccttaagaagcgccctactgagtttcgtgtggaccgtgtgctccagccatttgaccctgccaagttcaatttcaccaaagttggccaggaagaggttctcttccaatttgagaatggtgatggtgatgacagctatttcctgaatgacgctccaatcattgctgttgatcgtgctccaaatgttgttgctatcaatgtgagcccaattgaatatggacatgtgcttctcattcctcgtgttctggaccgcctgcctcagaagattgatccagagagcttcttgcttgcactgcaaatggcagctgaggcagctagcccttacttcaggcttggttacaatagcttgggtgcctttgccaccatcaatcacctccactttcaggcatactacttgtcagtgcctttccctgtcgagaaggcagctaccctcaagatccctctttctgaggacacaatgaagaatggagtgaccgtgtccaagctgataaattatcctgtgagaggcctggtatttgagggagggaacacactggaggacctggcaaatgtggtttccaatgcttgcatttggctgcaggacaacaatgtgccttacaacgtgctcatttctgactgtggaaagagggtcttcctgttcccccagtgttatgcagagaagcaggctctgggtgaagtgagccaggagctgctggacactcaggtgaacccagccgtgtgggagataagtggccacatcgtgctgaagcggaggagcgactatgaggaggcatctgaaacctctgcgtggaagctcctcgctgaggtctccctctctgaggagcgcttcgaggaagtgaaggcgtacatcttcagcgctgctggcctggttctgtctgacgaggaagaggaggaagccagtgagggcaagggcaccaccacctttgctcctgtcccagtttccccaatgcctgtcgctgaaggctgcctcgtccaccagtgagtccgtggactggctgttgtgtgttcccggtctcctatagctgtgccgtaataaaggtccgttggcacggtatatgcttgcgagcccttgtgctctgctgctactttgctctcgtttgtgtcctgctgctctcgtggtgaactcggtaattcagtgctctgcaatattaagcagaggctattgtattgtttgggtcgtttgttaattattactagaactaaatgaaatgtgataaacattactagatcaaaannaaaaa

SEQ ID NO: 14708 - DNA, 525 bp, Sorghum bicolor
  Clone ID: LIB3481-005-Q6-K1-D8
gcgtccgagaatctggactgaattggtggaactctctttgtgatgttctaacaaacttttatctcttcaataatgcagtgttatgcagagaagcaggctctgggtgaagtgagccaggagctgctggacactcaggtgaacccagccgtgtgggagataagtggccacatcgtgctgaagcggaggagcgactatgaggaggcatctgaaacctctgcgtggaagctcctcgctgaggtctccctctctgaggagcgcttcgaggaagtgaaggcgtacatcttcagcgctgctggcctggttctgtctgacgaggaagaggaggaagccagtgagggcaagggcaccaccacctttgctcctgtcccagtttccccaatgcctgtcgctgaaggctgcctcgtccaccagtgagtccgtggactggctgttgtgtgttcccggtctcctatagctgtgccgtaataaaggtccgttggcacggtatatgcttgcgagcccttgtgctctgctgctactttgctc

SEQ ID NO: 14709 - DNA, 1552 bp, Sorghum bicolor
  Clone ID: SORBI-28MAY03-CLUS6155_1
ctgttggccgctgcggcacgagtggagatcgttccttccttctgctatcctctccgcgtcttggtcgtctcgtcttcctccctccgtcccttcctcccccaacagaggcacagagcagagaatggggagcggcgagaagaccgtcaccgcttatggcgagtacacctatgctgagctggagagggagccctactggccaagtgagaagctgaggatttcgattactggtgctggtggtttcattggatcccacattgctcgccgtctgaagagcgagggccattacatcattgcctctgactggaagaagaatgagcacatgaccgaggacatgttctgccatgagttccaccttgttgacctcagggtcatggacaactgtctgaaggtcacccaaggtgtcgaccatgtctttaatcttgctgctgatatgggtggcatggggttcatccagtccaatcactctgtgatcatgtacaacaacaccatgatcagtttcaacatgctggaggctgcacgtatcaatggtgtgaagaggttcttctacgcttcaagtgcatgcatttaccctgaattcaagcagcttgacacaaatgtgagcctgaaggaatctgatgcctggcctgctgagcctcaagacgcctatggcttggagaagcttgcaactgaggagctgtgcaagcactacaccaaggactttggcatcgagtgccgcgttggccgcttccacaacatttacggcccttttggtacatggaaaggtggtcgtgagaaggcaccggccgccttctgcagaaaggctcagacatccacggagaggtttgagatgtggggtgatggtctccagacccgatccttcactttcatcgacgagtgtgttgagggtgttctgagattgaccaagtcagacttccgcgagccagtgaacatcggaagcgatgagatggtgagcatgaacgagatggctgagatcgtgctgagctttgaggataggaagctgcccatccaccacatccctggtccagagggggtccgtgggcgcaactctgacaacacccttatcaaggagaagcttggctgggccccaacaatgaagctcaaggatgggctgaggttcacctacttctggatcaaggagcagatcgagaaggagaagacccagggggttgacatcgcggcgtatgggtcgtccaaggtggtgtccacccaggcgcccgtgcagctgggctccctccgtgccgctgatggcaaggagggcctctgagcgatgagacttcgtccatcagttcaccgcgtaccgtagtgggatatgacatactgtttggagagtttggacggtagaatatactacagtagcagcaaaaatactcttgggccccttttttgggggttctattctatttttctatctattcaccgctccattaatttatgccatgcatcttgttcatttttgcatgtcttctgtaccttgtttgaactcctttggccatgaccggcaataaaattttccctgtttctgctgtaaaaaaaaaaaaaaaaaaggccccta

SEQ ID NO: 14710 - DNA, 2107 bp, Sorghum bicolor
  Clone ID: SORBI-28MAY03-CLUS7982_1
gcacgaggggctgctcgccccctccaccctcgctgtgtggggggcggcctccccacgggtgggtgttgccgaggtggctgcctcctgggcggcgccccgaatgaagcttgcgccttggctggacactggggtcttggcaagctgattgctttctacgatgacaaccacatttccatcgatggagatacagagattgcattcacagaggacgtgagcacccgctttgaggctcttgggtggcacacgatctgggttaagaatgggaacaacggctatgatgacatccgtgcagccattaaggaggcgaaggcagttactgacaagcccaccttaatcaaggtgactaccacaatcggttttggatcgcccaacaaggccaactcatacagtgtgcatggaagtgcattgggtgccaaagaggttgaagcaaccaggcagaaccttggatggccctatgagccgttctttgttccagaggacgtcaagagccactggagccgccacacacctgaaggtgctgcacttgaggctgattggaatgctaagtttgcagagtacgagaagaagtatgcagacgatgcagcaaccttgaaaagtatcatcacaggagagttccctactggctgggctgatgcgcttcctaaatacactccagagagcccaggagatgccaccaggaacctctcccagcagtgcttgaatgcacttgctaatgttgtgcctggtcttattggaggtagtgctgatcttgcgtcctccaacatgactctgcttaagatgtttggtgacttccagaaggatacggctgaagagcgcaatgtccggtttggagtcagagaacacggaatgggcgccatttgcaatggcattgctctgcacagtccagggtttgttccatactgtgctacattctttgtcttcactgattacatgagaggtgccatgaggatctcagctctgtctgaggctggagttatctatgttatgacccacgactctattggtcttggagaagatggtccgacccatcagcccattgagcacttggtgagtttccgtgcaatgccgaacatattgatgctccgccctgctgatggcaatgagaccgccggagcatacaaagttgcagttctcaacaggaagaggccatctattctcgctctttccaggcaaaagcttcctcacctgcctggtacctcaattgagggagtcgagaagggtggatataccatctctgacaactcaactggcaacaagcctgacctcattgtgttgggtactggctctgaactggagattgcggaaaaggctgccgatgagttgaggaaggaggggaagacagtccgtgtcgtctcatttgtttcttgggaacttttcgatgaacagtcagatgaatacaaggagagtgtcctgcctgcagccgtcaccgcaagaatcagcattgaggccgggtctactctcggctggcagaagtatgtcggagcccagggcaaggccattggcatcgacaaattcggtgcgagtgctcctgccggaacgatctacaaggagtatggcatcactgtggagagcgtcattgcggcggccaagagcttttaagagttaacaacaacagtcttgagttttttgtcatcattgatgccaaaggaacactgtacctcgaggtcttgtgccccaaagcttggaataaacaatggagggagcggaaggatgcctgcatttggagcgcgtgagtggtattttaggcctgtaataaacaatgccttttccatttatgttggttttattcggtgaccctcacacgaacacgattcatgaaggtgagcctggttattaattaaatcgggtgctggtttttggtaacatgcattggcaatgaccttactgtcttgcagagcgatgcttcattctttgctggatcgtgggtttaagtcgcactgtgtcttagttgttgcattttttttgctcttttattgatacagttttctactggcttttatggtacataacatttatatattgagctcaataatgtgatgtattttcttctggtttctctcgaaatcaaaccaaacttggtttgcaattgcaacaaacttgttcagtc

SEQ ID NO: 14711 - DNA, 1082 bp, Sorghum bicolor
  unsure (1)..(1082): unsure at all n locations
  Clone ID: SORBI-28MAY03-CLUS107037_1
gcacgagggcagggctagcaatctctcaagctcacagcgccaagccttccctgccgtgacgaagagctagctaagagcgaaagcaagatggtgaagctcgcgttcggaagtgtcggcgactccttcagcgccacctccatcaaggcctacgtgtccgagttcatcgccaccctcctcttcgtcttcgccggcgtcggttccgccatcgccttcgggcaactgaccaatgacggcgctctggaccctgccggtctggtggcgatcgcgatcgcacacgcgctggcgctcttcgtgggcgtctccatcgccgccaacatctccggcgggcacctgaacccggccgtgaccttcgggctggccgtgggcggccacatcaccatcctgacgggcatcttctactgggtggcgcagctgctgggtgcctccgtggcgtgcctgctcctcaagttcgtgacccacggcaaggccatcccgacgcacggcgtgtccgggatcagcgagctcgagggcgtggtgttcgagatcatcatcaccttcgcgctcgtgtacaccgtgtacgccaccgccgccgaccccaagaagggctccctcggcaccatcgcgcccatcgccatcggcttcatcgtcggcgccaacatcctcgccgcggggcccttcagcggcggctccatgaaccccgcacgctccttcggccccgccgtcgccgcgggcaacttcgccggcaactgggtctactgggtcggcccgctcatcggcggtggcctcgctggcctcatctacggcgacgtcttcatcggcggcaactaccagcaggtcgccgaccaggactacgcctaagtgctccggccgtctgggctgtttggatttgaattgaacgcagcgtttggatctgcgtcgtcgtttgctttgctcttcgccacgttaaatggtttgtatgtaatgtgtgtcgatgatatctcgtccatgcatatggtcctttgtattcagttccctttttttttcggggtaaaatcgatgtaaagatctcgtccgatctgcggttcttgaagtgaaaaaacanaatgtgatttacgtttcgagtt

SEQ ID NO: 14712 - DNA, 1972 bp, Sorghum bicolor
  Clone ID: SORBI-28MAY03-CLUS838_1
ttcgtatgcatatatgtcacacgccgcgatccaaccagccgacgactcatcatcattaccaccgtaatcccagctattacctagtaggctactacccagctcagaccgccgccagccccacccacgacggccagcagcaaccggatggataccacgacgaaggggtagcagcaggtggagagcctgctgttgggtatggccgccgtggtctctgccatgatatccccgagcagccagcagccgtaggacgtgtagccgaccatctgggccctggccatcgtcccgcacttcgcctgcagccagctcggcgacctggggcgggccccggcgtcgttgggcttcaggctcgtcttcgtccttgcgaactccgtccggatcggccgggtcagcagcgggacggccatccgctcggcgccgtgccgcgcgtagccccccgccacgccggccccctccccgccgtgcccgagaatgcggcgcccgcccgccgccgtccccggccccgtcgccggcagcgtctgggacgacatgctcggcttctaccggcagcccgccccgatcctcctcgtggcgaccggcgtcccgctcgccgtcatctacgccttctcccgcccgatcctcgtcctcctcggcgagtccccggcgatcgcgtccgccgccgccgtcttcgtgtacggcctgatcccgcagatcttcgcgtacgcggccaacttcccgatccagaagttcatgcaggcgcagagcatcatggcgcccagcgcctacatctccgccgccacgctcgccgtccacgtcgcgctcagctacctcgccgtctaccggtgggggatgggcctgctcggggcgtcgctgatactcagcctcagctggtgggtcatcgtcgtcgcgcagttcgtctacatcgtcaccagcgagaggtgccgcctcacgtggacgggcttctcgtgggaggccttctcgggcctgcctagcttcttcaagctctcggtggcgtcggctgttatgctctgccttgagacatggtactttcagatacttgtgctcattgctggactcctcaaggatcttgagcttgccttgccatcactctctgtctgcatgacaattacagggtgggtgttcatgatatcagttgggtccgatgcagcagccagtgtacgagtgagcaatgagcttggtgccggcaacccaaaggcggcgtcgttctctgtggtcgtagtgacactgctctccttcgtcctgtcggtgctaatctccatcgtcatcctgctgtgccgggactacatcagctacatcttcaccgagggcgaggacgtgtcgcgggcggtctccaagctcactccgctgctggcggtcaccctcatcctcaacggcatccagcccgtcctctctggggttgctgtggggtgtggatggcaagcgttcgtcgcatacgtcaatgttggttgctactacatcgtcggcatcccccttgggtgtctcctaggattctattttgacctcggagcagcgggtatttggagtggtatgatcgggggcaccttcatgcagaccttgatcctggtgtgggttacatacaggaccaactggaccaaagaggttcaagaagcacagaaaagattaaacaaatggaatgatggcaaggctcctctattgtcagcccaagaatgaaataagtcttccatgttgccaaaaagccaagaatgagacatgcatggatatgagctttactgatgcccctcgctcggcaggctcagctagcagaggcggaattcgatgtcaagtagcaattccatatcctgaaatgtgtagaaggagatggctgaaattattcttgcatcgctcaatttgatcaattttatgttccattatcgttcactgatgcgactgcatggtagtcgtcagtgataatttttgttggaactcctgaaacaaaagtgggttgctctctattgatgacattggaaaattcgct

SEQ ID NO: 14713 - DNA, 1760 bp, Sorghum bicolor
  Clone ID: SORBI-28MAY03-CLUS7780_1
gcacgaggcttcttccttctcccaaccggctcaaaaccctagcccaacaccgcagggtcgccgacgctcgcccggccgccgccactgccgccgccggggacgatggcgaagcctcggcgcggccgctccgcgtctcgctcctcctcgggctcttcctcccgctcgccgtcccactccgtctcctccggctccgtctcgtcgcgctcgcggtcgcgctcccgctccttctcgtcgtcgtcctcgcagtcccggagccgctctcctcctccggctaagcgcggttcgcctggagcacggaaaggccgatcaccttcaccgccccctaaaaagggttcaccctcaaagaaagtccgttcgccatcaccaccacctaaaaaggcttcaccccctaggaaagcgtctcctgctgagtcagctgttctctgcattgatcatttatcaaggaatgttaatgaggctcacttgaaagaaatatttggaaactttggtgaaatagtgaatgtggagctttcaatggaccgaatggttaaccttcctcgtggctatggatatattgaattcaagaagagagctgacgctgagaaggctcttctttacatggatggtggtcaaattgatggaaacgttgttaagttgagattcactcttcaaccacgccaaagggctgcatcacctatgaaagctccgccccctcctccaaaaagagatgctccccagattgaaaaaggtgttaccagtgctgaaaaggatgcccagcagcgtcctagggaatcatctccacgaaggaagccagcttcacctccacggaaacgatctccaaatcgaagggctgaatcacccaggcgtccacctgacccatcacctaggcgtcgtcctgattctccgcctattcgtcgccgaccagatccttctcctgtcaggcgtggggacacacctcctcgcaggagaccactgtctccagttagaaggcgttctccttctccaccacctaggaggcataggtcaccgatgcgtccttcacctaggaggggacgtggcagcccgtcaccacgcaggcgctcccctgggcctcttaggcggcggtcgccacctccaaggcggttgaggagcccaccaagaaggccgccacctccacgtcgctatagtcgctctcctcctcgccgaccccttcgctcccgctccagatcaatttctccaagaaggggacgagggcctccgttgaggcgtggtaggtcagactcatcatattctcgatcacctactccaccgccaagaaaggggccaagaagggtatcaaggagccgcagccctagaaggcctcctagaggaagaagcatctctagtgacagccgaagcagcagttcaccttcccctagacgcggcaggtagaaggaacccgtggcattgtgtatccggcaggtaaagccttttatcccttgactctatctgtatcgtttgcctgtgcttgtgacttgctgtgagctcaagtgttggttcgaggagaggatacgagaaccctacggcaatgcttccagtggatctgctttaacatgcccggtggactctctggcttgtgatttgtactcgagacaaagttacctgctatgtgggcttatgtacttgattgtactgaagtattttgaagttcttaacttgtttccgcacaggagtctggttctaaaaaattatgtggtaaaccattgtgctaattggtgtctgaagcgttatttgatccttcgtttaaggtgtccgaaagtttt

SEQ ID NO: 14714 - DNA, 1924 bp, Sorghum bicolor
  Clone ID: SORBI-28MAY03-CLUS947_1
accaacccagcggcagcagcctcctccatcctctcgctcgcttggcagcattcccattcgaggacagcggtgagagggggaggaaaggcaagatgttcatcgagagcttccgcgtcgagagccctcacgtgcggtacggcccgacggagatcgagtcggagtaccggtacgacacgacggagctggtgcacgagggcaaggacggcgcctcccgctgggtcgtccgccccaagtccgtcaagtacaacttccggaccagcaccgccgtccccaaactcggggtgatgcttgtggggtggggaggcaacaacgggtccacgctgacagctggggtcattgccaacagggaggggatctcatgggcgaccaaggacaaggtgcagcaagccaactacttcggctccctcacccaggcctccaccatcagagttggcagctacaacggggaggagatctatgcgccattcaagagcctcctgcccatggtgaacccagacgaccttgtgttcggaggctgggacatcagcaacatgaacctggctgattccatgaccagggccaaggtgctggacattgacctgcagaagcagctcaggccctacatggagtccatggtgccacttcccggcatctatgacccagacttcatcgccgctaaccagggctctcgcgccaacaatgtcatcaagggtaccaagaaagaacaggtggagcagatcatcaaggatatcagggaatttaaggagaagaacaaagtggacaagatagttgtgctgtggactgcaaacactgaaaggtacagcaatgtatgcactggtctcaacgacacaatggagaatctgctggcgtctgtggacaagaacgaggcacagatctcgccatcaacactatatgccattgcctgtgtcatggagggggtgccgttcattaatgggagccctcacaacacctttgtgccagggctgattgatcttgctattaagaacaactgcttgattggtggtgacgacttcaagagtggacagaccaagatgaaatctgtcttggttgatttccttgttggtgctggaataaagcccacctcaattgtgagctacaaccaccttggaaacaacgatggcatgaacctgtctgcccctcaaacattcagatccaaggagatctccaagagcaatgtggtggatgacatggtctcaagtaatgctatcctctatgagcctggcgagcatcctgatcatgttgttgtcatcaagtatgtgccgtatgtgggagacagtaagagggctatggacgagtacacctccgagatcttcatgggtggcaagaacaccatcgtgctgcacaacacctgtgaggactcactcctcgccgcacctatcatccttgatctggtgctcctggctgagctcagcaccaggatccagctaaaagctgagggagaggacaagttccactccttccacccggtggccaccatcctgagctacctcaccaaggcacccctggttccccctggcacaccggtggtgaacgctttggcaaagcagagggcgatgctggagaacatcatgagggcctgcgttggcctggccccagagaacaacatgatcctggagtacaagtgagcgaagtggcgtggcctatatgcaggaggctgctggaagggaactagaatggcgagattagctgtgggattgtattggcttctcgtgttttcttttgcgttctttcctggtcattgctgttacgcttgtgtatttgtcggacccgtaactatcagggctctgctattagcggcacgaagcctgtaatagtatcaggtatcgtatgataatttgatggagggtgctagtttccctcggcattcctagtgttcattgcaagtttcctcgacgcctgttcggattttaaatgttatatcact

SEQ ID NO: 14715 - DNA, 1149 bp, Sorghum bicolor
  Clone ID: SORBI-28MAY03-CLUS3346_1
ttccgaaattgcgtcgcagtcaccgcgttcccctcccgagcacgcaaccatggcgcgcccaccgtcagccaccgccgcgctcctcctcctcctcgtcctctccctccttgccgtcgcgcactgccggaccgtcgcagtcgtcgcagcagaccacgccgccgagcccgaatcaaccgccgccggcgccgtggccgtcagcgacgagaatgggctatccaaccccaccctccccgccgaggcgggcgccagcgccaccgaggaggaggtcctcccggcggagcagcagcagcatgggttagaattcctccgcctgccgtcccaccggcaccaccgccaccgcccctgcagcctccaccaccacctctggtggaagcgccaccacggcgtctaccgtgacgcgccgctcaggttccccatggcagaggaggtcagggaggcggaggaggtgaagcccgtggccgagccggacccggatcgttctctcccagacagtgacggagacggggagctggtggccagcaaggagccgtcgttcgccgacgccgacgggcacgaggaggacggcgagcacgcatcggcggtcagggcgtggaagaaagaaatgcttacatgattgtgtgctcgacatggtacggtgtgtttcatgtgattctatgcacgcatatacctttctgattttttttttcggagatcgtgatattcaataatacgcagtgattttagttatttattgctgcgagttgagcacggcggggacaacgacgacgaggatgaagatgaacaggtggaagagatggtccggcggttcaggaaggcgatcatgaggagaaggaggttcggccacggtcacggccacggccacggccacggccaccgcgaccacagccaccgccatgccgaggacgccgagaagcaggcagatggagaagaggagagtggtgtgctggcttggatcaaggccctcatgaatcggttctagagctgtacgtctcgatcgttcgagcgatccgatccgtagtccactcacggtcatatggctgctgctcgcttctgattaccatcccgcatcttgctgtgtgttatagtgtgtttcttccataccacggtgtggtcgatcgtcttacgcatgcacttgtacgacagtacgta

SEQ ID NO: 14716 - DNA, 1831 bp, Sorghum bicolor
  Clone ID: SORBI-28MAY03-CLUS31273_1
aaaaaaaaaaaaaaaaggacgacagagagacaggaaactcctcttcctctccagtctccaactccctcctcacccagatccagatctcgcggcgaggcgagagggcggagaggccgccggaatcggattggcaaggacatcaggagtcacacttagcaagatggtgaagatatgctgtcttggtgctggatatgtcggtggcccaaccatggctgtcattgcactgaaatgccctgctattgaagtttgtgttgtcgacatctcagttccacgcattgcagcatggaacagcgaccagctcccaatttatgagccaggccttgatgatgtggtcaagcagtgccgtggcaggaacctatttttcagcaatgacattgagaagcatgttgctgaggctgatatcatctttgtctctgtcaacacgccaacgaagacccgtggtcttggggctggcaaagctgcagatctaacctactgggagagtgcagcccgcatgatagcagatgtggccaagtctgacaagattgttgttgagaagtccactgtccctgtcaagactgctgaggccattgagaagatcttgacacacaatagtaagggaattaacttccagatcctctcaaacccagagttccttgcagagggcacagcaattgaggaccttttcaagcctgatcgtgtgctcatcggtggtcgggagactccagaaggccagaaggctgttaaggctctgaaggatgtctatgccaattgggtccccgaggatcgcattctcacaaccaacctatggtcagctgagctgtccaagcttgcagcaaatgccttcttggctcagaggatctcttcagtgaatgcgatctcagctctgtgtgaggctactggtgccaatgtggcagaggtagcctatgctgtaggcaaggactcgaggatcggacccagattcttgaatgctagtgttggttttggaggctcctgcttccagaaggatatcctcaaccttgtgtacatctgcgagtgcaatggactgcctgaggtcgctaactactggaaacaggttatcaagattaacgactaccagaagagcagattcgtaaaccgtgtggtgtcttccatgttcaacactgtatctggaaagaagattgcagtgcttggctttgcattcaagaaggacactggtgacacgagggagaccgcggccattgatgtctgcaagggccttcttggagacaaggccaagattagcatctatgatccacaagtgactgaggaccagatccagcgtgatcttgcaatgaacaagttcgactgggaccacccaatccacctgcagccaatgagcccaactgcagtgaagcaggtctctgtgacctgggatccgtatgaagccaccaagggcgcacatggtatctgcatcctgactgagtgggatgagttcaaggctctcgactacaagaagatctatgacagcatgcagaagcctgcgttcttgttcgatggccgcaatgtaattgatgctgagaagatgcgggagattggcttcattgtttactccattgggaagccccttgacccctggctcaaggatatgcctgctgtggcttaagtggtagaaatcctagacaaaatgttgctgtttgttcgagggctccaatctgcatccacattccctgccctttcatcccctatagtgggtcatataggtcatagtgaacagggtcgtttgcccttgtgttttgactgtaatgtacttcaaatggatgtattatcttttgttgtctggttacagataaatgaataataaatagcaagagttatcagatgatctctatgg

SEQ ID NO: 14717 - DNA, 1063 bp, Sorghum bicolor
  Clone ID: SORBI-28MAY03-CLUS274_1
gccggccgatcccgaagggagtagtgatcaccagccgtcttgccccgatcctcacctgctgctgcagccatggcgaccaccgcggcgctctccacggccgccaaccccacccagctctgccggtcccgcgctacgctgggcaagccagtgaaggggcttggcctggggatgggcagggagcgcgcccagagcatcacgtgccaggcggcgagcagcatccccgccgaccgcgtccccgacatggagaagcggaagctgatgaacctcctcctcctcggcgccatctcgctgcccaccgtcggcatggtcgtcccctacggcgccttcttcgtccccgccggctccggcggcgccggcggcgggacctacgccaaggacaagctgggcaacgacatcacggtggatgagtggctcaagacgcacggtcccaacgaccgcacgctggcgcaggggctcaagggtgacccgacgtacctggtggtggagcaggacaagacgctggccacctacgggatcaacgccgtgtgcactcacctcggctgcgtcgtgccgtggaacggcgccgagaacaagttcatctgcccctgccatggatcccagtacaacaaccagggcaaggtggtccgtggaccggcgcctctgtcgctggcgctggttcacgccgacgtcgacgacggcaaggtcctcttcgtcccgtgggtggagaccgacttcaggaccggcgaggacccgtggtggaaggcatgaggaggatcccacaccagcggtgctcagtgctcacagatgacctatgtatggtgcctcctgtgtcgctgtgatgaggtcatagacttgccttgcgttcgttctccaagggcgtacaaactcacttgcttcttgcctccaaattatatatatgtacacaaactgtatgaaacaccaacagctgtttttcatctcttcatatactgaggccatttggtcggtggaggcggcgccgtccctcgaatgagggagttaagacaggcaggtggaaccccaggtggtctgcatcgtggcaacagggttttatatgatgcagatc

SEQ ID NO: 14718 - DNA, 618 bp, Sorghum bicolor
  unsure (1)..(618): unsure at all n locations
  Clone ID: LIB3481-043-Q6-K1-B12
gcgttcgggggtgtcaactacgccggcgtgggggggggggggggtggcggcaacggctacggctacctcgggatggtcgtcccctacggcgccttcttcgtccccgccggctccggcggcgccggcggcgggacctacgccaaggacaagctgggcaacgacatcacggtggatgagtggctcgagaggcggggggccaactaccgcacgctggcgcaggggctcaagggtgacccgacgtacctggtggtggagcaggacaagacgctggccacctacgggatcaacgccgtgtgcactcacctcggctgcgtcgtgccgtggaacggcgccgagaacaagttcatctgcccctgccatggatcccagtacaacaaccagggcaaggtggtccgtggaccggcgcctctgtcgctggcgctggttcacgccgacgtcgacgacggcaaggtcctcttcgtcccgtgggtggagaccgacttcaggaccggcgaggacccgtggtggaaggcatgaggaggatcccacaccagcggtgctcagtgctcacagatgacctatgtatggtgcctnctgtgtcgctgtgatgaggtcatagacttgccttgcgttcgttct

SEQ ID NO: 14719 - DNA, 329 bp, Sorghum bicolor
  Clone ID: LIB3478-024-P1-K1-E11
ctcaagacgcacggtcccaacgaccgcacgctggcgcaggggctcaggggtgacccgacgtacctggtggtggagcgggacaagacgctggccacctacgggatcaacgccctaagctacgccagcgggtcgtcgtcggtccctttgctaggtattcgtggaccggcgcctctgtcgctggcgctggttcacgccgacgtcgacgacggcaaggtcctcttcgtcccgtgggtggagaccgacttcaggaccggcgaggacccgtggtggaaggcatgatgaggatcccacaccagcggtgctcagtgctcacaaattacctatgtatg

SEQ ID NO: 14720 - DNA, 692 bp, Sorghum bicolor
  unsure (1)..(692): unsure at all n locations
  Clone ID: SORBI-28MAY03-CLUS1277_2
gtccgccgccgttcgccgacccgtgggcagccgccgagcaagcagcagcagcagcagccatgccgccgaagctcgacccgtcgcaggtggtggaggtcttcgtccgcgtgacgggcggggaggtgggcgcggcgtcgtccctggcgcccaagatcggcccgctcggcctctccccgaagaagatcggcgaggacatcgccaaggagacggccaaggactggaagggcctccgcgtcaccgtcaagctcacggtacagaacaggcaggccaaggtctccgtcgtgccctccgccgccgcgctcgtcatcaaggcgctcaaggagcccgagagggacaggaagaaggtcaagaacattaagcacagcggcaacatcagcctcgacgacgtcgtcgagatcgccaagaccatgaggcccaggtccatggccaaggagatggccggcaccgtcaaggagatcctcggcacctgcgtcagcgtcggatgcaccgtagacggcaaggaccccaatgacctgcaacaggagattgatgacggcgaggtcgagatcccatccgcttgaagactaggcatcgaaggagactaccattggtgctgctgaaagtggtggagaagtggggccgnttncttcgnctcgccgacccgggccttcacttcttcaaccccttcgccggggagtgcgtcgcgggcgccc

SEQ ID NO: 14721 - DNA, 868 bp, Sorghum bicolor
  Clone ID: SORBI-28MAY03-CLUS1277_1
ctgtgcggcgctcgagccggccgggccggggccgccgctcgaaccctagcactcgcaactaactgctgctgccgccgccgccgccacctccacgccagcagccatgccgcccaagctcgacccgtcgcaggtggtggaggtgttcgtccgcgtgaccggcggcgaggtcggcgcggcgtcgtcgctggcccccaagatcggcccgctcggtctctcccccaagaagatcggagaggacatcgccaaggagacggccaaggactggaagggcctccgcgtcaccgtcaagctcaccgtccagaaccgacaggccaaggtctccgtcgttccctccgccgcggcgctcgtcatcaaggcgctcaaggagcccgagagggaccgcaagaaggtcaagaacatcaagcacagcggcaacatcagcctcgacgacgtcgtcgagatcgccaagaccatgaggcccaggtccatggccaaggaaatggccggcaccgtcaaggagattctcggcacctgcgtcagtgtcggatgcaccgtcgacggcaaggaccccaaggacctgcagcaggagatcgacgacggcgaggtcgagataccgtccgcttaagaaggcttggaggcgaggaagtaattctcactacctagatttttcccttatttagttgaggtccttgtgctatttttgtacctttggatcccgcctatatttgtgtgcactagtagttaatcttgtgataagacttcgatgtttctatcctgcatctaggttatgttgtgagttcggaatggagttttaagcatcaacaatgcaacttttagtacatcctgtctggcgaaagtttcataaaaaaaaaaaaaaaaaaggccccta

SEQ ID NO: 14722 - DNA, 2054 bp, Sorghum bicolor
  Clone ID: SORBI-28MAY03-CLUS48_1
ccaaaccgcgcagactgccattacacaactaaggactagcttgtgaagattatcatgaagcagacttcccaaaatttttaataacagaaacagtttatacctatggaatgaaacaaacagctacagatactcacggtgaagtaaaaaatatgctacaacaacagaagaacaggccttcttatttctcaaatcattcctgccttcttcagcagctccagataaaaggcccaagaaacttttggttcctccaaaggcttgtactaactaaatttcttggggaaaacttattgagactgttggcctgatttctccgtggttgtactctcaggttcttggcctgatttctccgtggttgtactctcaggttctcgagactgtttggtagctgcaccatttgcagatggctcactagctagagtttcttggagagaaccatttccagtcccgactactttggcagttgtttcgacttcgacggcctgtgctttcagcatcttttctttctcgagatcttgctttgccagggttgaaaactgtgagtcgagggaccttacagcacccagccatgcaagaacaatcaccagaagtattccaccaaggtagggtgtcgaattcgcaagagatccaaatgacaggatcatgaactgctggatcaaagcacctccagatttccccaaggggttgcagacaacgtcaatagctgctttacctttaaccttcatatcctcatccaaaggaatgtatgccatctctttgcaaggatcaaacagactgtactttgcactcttactgaaaatgttctgcattgctccaacatagactgccgcaagcaaaggtgtcatcacaaacgtgtgcatagggagagtccttggcccaccaaacaatatcagtgagtagcaccgcacgcgggagagaagttacactacaatagtgatggtagcataaaccctggtcacgaacaagcttaggatgcggattgtgcacacttgacatttggcagttttgtgtccggaacacttgatgcatccttggaaacaaaacctcttgatagtcatggggatgttgcgacagttcctgatgatgattcaattcaccactcagatggcagtatccacgatgacgaaagcaacgtgacattagcgcctcctgctaaagcataagcgaatcctgccaatgaatatgttacttctgcggcaatcagcaatgtggagaatcttgacatcacatcagcacagcaatctgaaagagccaatttcctggatctcacgagcagtactgaatacaacctatgatcaaaagcacaacatcagccatcacaactcttgggtttgatgggacggtcccttcacatttcaaagatggaaatcagtttatttctcttcagcagaatgagaaccctgcaatgtggatgcatggagctggttcgcgagggatgcccccacttgcagccagtaccatgtatggctatcaagggcagagtcatcaggccggccttcggcagggccagctaccttcacaatttggctctgcgcttgggcagtcacagccaggcctgggccctgaacacagaaaccctagcgatagtaacctaagtggtgctgctcaggctaaccaaatgtggccgaatagctactgatccatccccttgtcaacttttgtggaaggcggtcctgttgtgtgtgcaaccccagagaggccatgcaatgcttgtggtctgatccaggcacgcggataccagctgtgtgcatgagttggtgtcgtgacattttgagaggcacaagagatatatgttcgagcatgttctacctgtagggtttctaggatatggccaaaaatgtagctcgatctatttattcaaattctgatagagaaaggatggttcttttttctattttatttttccttttttgctgtttaaatattttgtgacaataaaaccgaaatatctaacacagcagcaccattagttccccaggaagcgaaagataggctatttttgcaccaccagtattgcgtgcctcttggatcgaattttatgattgagatcgttattg

SEQ ID NO: 14723 - DNA, 2360 bp, Sorghum bicolor
  Clone ID: SORBI-28MAY03-CLUS503_1
acgcctccagagtcctgaccgccaccgccacttccacttcgtcctccaccacctctgcttccacttccagccttcccacgcatccgccgccccaatcgcgcgcgccacgccccctggactgcccgccctcccctccttcacttcctccaaggccaccccggtgagtcggccacatggttcttcgggttctctggatgagccggaccccccgtcttccccaattctaaggttctcccgtgtcatgtttagtgttgttgggggcttgaagagcatgagtttagattggggagcataggtgttggtggggttctgctctcgtcgcgttggtggggacctccaaagtagtgctgggatgtatcgcgtttgggattttctgggtgatggccgtcttccccaccgtcccgttcatgcctgttgggcggacggctgggtccctccttggtgctatgctaatggtcctgttccgcgtcatctccccggaggacgcgtattccgcgattgacctcccgatcatcggcctgcttttcgggacaatggtcgtcagcatcttccttgagagggctgacatcttcaactacctcggaaacctgctctcgcggcagagcaccggcagcaagcacccgctgttccgagtctcctccgtgtccgcgtctacccgcgcgctcttccccactcacacatgctgcgctgtcctcactgagttcatcctcaaggttgctaggcaaaacaaccggccaccacagcctttccttctggcccttgccactagttcaaacatcggctctgctgcgacgccgatcgggaaccctcagaaccttgtcatacctgtggattgtgggatctcttttggccagttcttgctgcgagtttttccagctttgattgttggggttctgacaaacgctgctatcctccttttgtacttctggaaatacttgtcggtggagaaggatcaggagggtgggcaagccacaggaccagaggtggttgccgacgatgaggttacttctcatcggttcacaccggctagaatgtcacatgtttcttctctgaatccagatgatgaggattgcataagtgaaccaatcatcaggagcaacagtgtcagatctagtgtgaatgagaacctgagaagcagaagcgtcaattctgaggctgacattcagcttgccatcaagtctctgcgggcatcaagcatgtcgcatgaggtggtagaggtctcgacagtccctgatcggaaagatgaaggtgcatcctcaaggaagttcacaagaagtgctagccagcaaaggagtgtgataatagaggatttggcacccgccccagagatgaatggggaaaaggagaaagaaactgaagttgcagagaagagatggaaaatacttgtctggaagactgctgtttatcttatcactcttggtatgctcattgcacttctaatgggactgaacatgtcctggactgcaatcactgcggctcttgttcttctggcacttgattttacggatgcacaggcttgtcttgagaaggtgtcatactcactgctgatctttttctgcgggatgtttatcactgttgatggattcaataaaacgggcataccaaacacactatgggagttagtggaaccatattcacgaatcgatagtgctagaggtgttgctcttcttgctgtggtgattctcatcctttcaaatgtggcctctaatgttcctacagtcctgttgctcggtacaagagttgctgcatcagctgctgcgatttctcatggttcagagaggaaagcctggctcatccttgcatgggtcagcaccgtggctggcaacctcacccttctcggttctgccgcgaatctgattgtctgcgagcaggccaggcgtgcccagttcttcggctacaacctcaccttctggagccacctccgattcggggtcccgtcgaccatcatcgtcacggcgattgggctactcatcgtcatcagttactgaagcagctgaaggcagaagagcatagtgtacgagaagcagaatggataaaaatccttccaataagaagtacatgtaaattaggcttgctctataactcaagtgtgtatcagtacgtttatgtctccgtctgtgctgctgctagtgagcagacagcacatggctgaccgtgtagcttgcatttccattgcaaaatagggttaatgaagaatgctttggtaatatgattttacagtctgacaagacttgtgaagcagagatagtgtaccatcaagagaatacttctggaagcatatgcgaaattcatatatatttgggtttcaaatccagtctgcttctggaacaaaaacttactggaaattcgtatatctgaaa

SEQ ID NO: 14724 - DNA, 1975 bp, Sorghum bicolor
  Clone ID: SORBI-28MAY03-CLUS9947_1
gcaagggcggcggctggccttggtccagtggccgctgcaagcaaaggttcgccgccagcctccggccggaggaactcccccccctcctcgcccgacgaagaaggcgaccgccctccggcgaggccacgtagacgtcgcctctatggggagccctccgccccgagatcgggatttgagctctagcagtacccagagttgagctatggctggggcggcttcgtcgcttggtccggcaccggtggtggtaagcgtcctgccgctgtgctggcccctgctacggcagccccgaccccgaccccaccgtgaccagcgccccgcgcgcaacttcaaccgtcgcgcgcggcggctcgccgcggtggtcgacccttacctgtcggtgaccttcgaggagtacgagggcgggcgcatcaagagcagcgaggccttcgacgagatcaagtcctacctgaccacggcgagcacgcgcgacgtgcgccacctcagggccgaggccggcggcggaggtccgcggcacggcgccgacacagacaaggacaagcgcgtgttaagcatagccaaggtgacgggcgaggaggtcgccgacgccttccggggcgccacggtctggtggtcggccgccgccgtgccgccgcccggcgacaccaccgtgccgtggagccgtgccgcgccgcgccgagcgccgcttcttccggctcgagttccacgagggccaccgcgacctggtgctcaacgactacctcccgtacgtgcgcagggagggccgcgccgtcatggccaagaaccgccagcgaaggctctacaccaacatcctcaaggaaggcttcgatgacggttactaccaagacgtttggacgcatgtcccgttcgagcaccccaagacgttcgacaagctggccatggacccagcgaagaagaaggagatcatcgacgacctcgacatgttcaagaagagcaaggactactacgctcgcgtggggaagccgtggaagcgcgggtatctcctgtacggtccgccgggcaccggcaagtccaccatggtcgccgccatggcgaaccacctcgagtacgacgtctacgacttcgagctcacgtcggtgaagaccaacaccgacctccggaagctgctcatcgagaccaagagcaagtccatcatggtgttcgaggacatcgactgctcgctcgacctgaccggcaagcgcaagagcaaggaggaggaggagggacggaaggacggcgacggcgacggcgacgacgctgctgcggcggcgaaaaagaagcaggaggaggacgccgccaagagcagcaaggtgaccctgtccggcctgctcaacttcatcgacggcatctggtcggcgtgcggcgaggagcggctcatcgtgttcaccaccaaccacgtcggcaagctggacccggcgctgatccggacggggcggatggacaagaaggtcgagatgtcctactgcgactacgagtccttcaagttcctggcgcggatgcacctccgcgacgacgacgtcgtcgaggcgcacgaggcgcagtgccgccgtgttagagcgttgctcgaggaagtgaacatggtgcccgtcgacgtcggcgagcacctcacgcccaggagccccggcgaattcgaagacgccggaccgtgcctcgataggctggtgaccgcgttggagaaggccaaggaggaggagggtgcgagactaccgcctaccggggccacaggcacaacctgatgtcaacggcattggcatcgttgtggacgatgatagtaataactaggtacgctagggcgttggttgctactccggtgactcgatcatctgttgtttatctttttgcttattatctttttgctttcaatcaagaataaactagtgtgcagttgcgcagctaatggctatcagtgtgtcctgctcccaaatcagggtttgggtgaacttcagcagatctagaggaaatatatcccttaaaattt

SEQ ID NO: 14725 - DNA, 1310 bp, Sorghum bicolor
  Clone ID: SORBI-28MAY03-CLUS8458_1
aattagcgctcatcaccccccgccaccctcccggccggagtggcacaagtgtccttcctcctccggcgtcctcctctgccctcctccagtcccaccacccccaactcctccggcttcactgcggcgcggggcttcgctccggatcggctcgagcagaagaaaatgcaacgggcagtgcaagccgtcaggtcacatggcagtgtgcttaaatacgctgttctacaacacatcagcgctcccaaaccagcaatgcttcctgctgtcttttctcgtttcatgtcagtttcatctgctcgcctagaggatagtggatttgaaactgccactgtatcagatgtcttgaagtctaaagggaagagtgctgatggatcttggctctggtgcaccacagaggatactgtctatgatgctgtcaaatcgatgacgcagcacaacgtgggagctttggtggttgtcaaacctggagaggctaaatcaattgctggcattgtcactgagagagattatctaaggaaaatcatagtgcagggaagatcttccaagtcaactaaggttggcgacatcatgaccgaggagaacaaactgatcacagtgaaccccaacaccaaagtcctgcaagcaatgcagctgatgacagacaaccgcatcagacacatcccggtgattgacggcacagggatgctggggatggtctccatcggcgacgtcgtgcgcgcggtggtcgccgagcacagggaggagctgaaccggctcaacgactacatccagggaggctactaggacgactgtcatgtgcagcgacgcaacccccagtgaagtccgcctttgtgaaatccaataacaaggaacaatgatgatgacgaaatatgctgtgtttccgtggacaatgctgttaagttggccaaggttttcctttctttttttcccccgcgtgttctatgtgtatattgccaaaggcatgcgtgagcaatgcgcccggtgccgtgctggggcgcagagacgatctgaatatctgatggtggaaacaccggaaataaaaagcgtgccgccgtgtgcttcctttgaaggaatgaaagatgttcgtgttatgaattgtttattgttgtatgtacgtcgtctgctggctgctgctgctgttggggagtctgtaaatgcgtctgatatgggtttatgcagactttcagaatcataatgtatattggtcacgcgagccaatgtttgcctggttgaccctcaaagtttaatagttcaagcctgttccggggatttgcctgtgttgacccccaaagcctaaaagttgaatagttcag

SEQ ID NO: 14726 - DNA, 2115 bp, Sorghum bicolor
  Clone ID: SORBI-28MAY03-CLUS18446_1
ttggaattccagccttttgagaactccccttctccgccactacccaagctctcccttgtacccccacaccgccgccgctgctgctagggagcttccatccgcgcgcctacaacgagagctagcagcagtagcggccgctatcttgtcgctccggcaccggccgtgtacccaagccccagcccagatgccgcagatggacgggcccgctgatcagatcgccgccggctggttcgccgcggagccggctgccgagcggcccgtggcccttcccaggaccggctcgtccagtcgcctcaacgcgcaggcgccggagttcgtgccacgggggccgccgtcgccggcgccggcggttgtggtgccgcctccgccgcaggtgatccgcatgttcgccgcgcctcccccgcctccgcgggctgcctttttcgccgcgccgccgccccggccgttcgagtactacgcgcctgtggcgggacgcggcggatttgctgccaaggagcagcaggcgccggagcctgagccggaagcggagatgctcccgcccgccgcggtgaaggcggagccggtggtggatgggctcgacgacgaggtggtgcacaagatcaccaagcaggtggaatactattttagtgacatcaaccttgcaactacagaacatttgatgagattcattaccaagggtcctgagggctatgtgccaatatcaggaattgctggttttaagaaagtaaaagcttccgtgcataacaatgtgatgcttgctgcggctctccgaacctcatcaaaacttgttgtaagtgatgatggtaagagagtcaaacggcaggagccatttacagaatctgatttgcaggagctccagtcccggattgttgttgcagaaaatcttcctggtgatccctcctaccagaatcttaagaagatattttcagctgttggcagtgtgatttcaatccgaacttgctatcctcagactccaaatggcactggtcctgcaactaatagatctgccaagttagatatgctttttgctaacaagctgcacgctttcgtggagtacgaaactcctgaggatgctgagaaggcaattttggagcttaatgatgagaaaaactggagaaatgggcttagagttcgtttgctgaatacttgcacggtgaagggggcaggcaaaggcaaaaaaggtgtgcatgaaactgatggaaatggtgaggaggatgtctccacttcgaaccattcaaacgagaaattgtttgaagaatcctctcaactgttagatgtactgccagaacacttgtttgatgagaacttcaacgacaaagaagttcccaaacgcggcaaagggcgcggccgcggtggcagagggcgtgggcgtggcaaccatcaatataacaataaccagcaccaccagaacaaccagcagcactacaatcaccatggcaacaaccaccttggtgggaaccgtggcagcccccaccctgttggcactccaccgcataacctgataaccaagcccgagcagtacccgcagctgccgattggggccaacaagcttccaccaggcccccgcatgcctgatggcacccggggtttcaccatgggcagggggaagccacaagctgtgctacctggtttgtgtgctgttggtgagtcttgatgtaatggactagtgttggtggtgaggggcatgcggattgctgctcatatgcttgtatatcattggtgggagtatttgtgcgtgaaacttcgttgcggatacagtgagttggtgttgccaaaaccagatggtttggttcgtgtgttaccatctatttatatttgtgtgcctgggcaatttggtcgttgggaacagggtatctaccatttttttttgaaagattggtatctatcatagaagaggacaaggaatgagagcataggctttgtttggatgtccacttacaacacttgaggtgagtacatgagcaatcaaacaagcactaagtgtgatgagttagtccgctgtttcatcattttggttcgagctgtcggtggtttagtttcgctgtgtatctttcatgtatgagcttatgtgtttacgttatactgccaccttttagaaagtgaaaaacctcgtgc

SEQ ID NO: 14727 - DNA, 2634 bp, Sorghum bicolor
  Clone ID: SORBI-28MAY03-CLUS2243_1
gcacgcgccccgccccctccccctcctcctgccgtcctcgatctcgtctcctcctcctccccaccctatccctcccggcgggcgggggaggaagcgagcgacgatggcggcgctggaggcggcgaggtcgtgggcgggctccgtcatcccgccggagctcgccgccgccgcgggcggagacccgctcgccgcgctggcggccaccgccgcggccctcgtcgcggggctgcttatcctcgccgtctggttccgatccggaggcggcgcgccgtccaagccggtcgccgcgccggtacgcccgccgccggtcaaggtggacgccgacgccgacgtggacgacggccggaagcgcgtcaccatcttcttcggcacgcagaccggcaccgccgagggattcgccaagtccatggcggaggaagcgagggcgcggtacgagaaggccgtgttcaaagtggtggatctggatgactatgctcaggaggacgaggaatacgaggagaagctgaagaaggaaaccgtggtgctgttcttcttagcaacatatggggacggagagccaactgataacgcagcaagattctacaaatggtttactgagggaaaagagaaggaagtttggctgaaggatcttaaatatggtatttttggccttggaaacaggcagtacgaacattttaataaggttgcaaaggtgctcgaggagctactagaggagcagggtgggaaacgtcttgttcctgttggccttggagatgatgatcagtgtattgaggatgatttcactgcatggaaagaactagtgtggccagagttagatcaattgctccgcgacgaggatgacacaactggcgcatcgactccatatactgctgctattcctgaatacagagttgttttcattgataaatctgacctgtcattccaagatagatcatggacactagccaacggtactggtgtgattgatattcaacacccttgcaggggcacgagggctgttcggaaggagctgcacaaaccagcttcagatcgctcttgtatccatcttgagttcgacatttctggcactggtcttgtgtatgaaaccggagatcatgttggtgtatatgcagaaaattctgttgagactgtggaggaggctgaaaggctacttgacctttctccagatacgttcttctccatccatgcagatgcagaagatggatctcctcgtaaaggaggaggttccttggccccacctttcccatctccatgtaccttgcggactgcgcttctacgatacgctgatctactcaatccaccgaagaaggctgctttgcttgctttagcttctcatgcatctgatccagctgaagctgaacgacttagattcttggcttctcccgctggaaaggatgagtactctcaatggataactgctagtcagaggagccttattgaagttatggctgcattcccttcagctaagccaccactgggagtgttttttgcagcaatagctcctcgtctgcaaccacgatactactcaatttcatcatctccaatgatggctccctccagaattcatgtaacatgtgcattagtttatgggccttcaccaacaggaaggatccaccaaggagtttgttcaacatggatgaagaatacaattcctctggaatatagtgaagaaagcagctgggctcccatctttgtgaggcagtcaaatttcaaattacctgctgacccatccactccgattatcatgattggtcctgggacaggactggccccttttagaggcttcttgcaggaaaggttagcactgaaacaatctggaacagaactgggcacttcaatccttttctttggatgcaggaaccgtaatatggactacatatatgaagatgagttgcaaactttccttgaggagggggctctttctgagctaattattgcattctctcgggaagggccaacgaaagaatatgtgcagcataagatggtagagaaggccacagaaatttggaacatcatctcacatggtggttacttatatgtatgcggtgatgccaagggaatggctagagacgtacacagaatgcttcatacaatagtccaagagcagggatctttggatagctccaaaaccgagagctatgtaaagagcctgcagatggaaggcaggtacctccgtgatgtatggtgacacatcacccccaatcagccatagcttctagcgtgtggaattaaagctggctttgcgtgtatatgccaatccagtcgtcagctttggaaatgaagcgtgccattgattatatactgaaatgagttgatcagtgtaattctttgacatctaactatttattattatatgagatgggaggaactgagggagagaataagtgctgttgtagatttgtagaacttaaaaatttatgtatccctgacaagtttgtagccaaggggatacatcatacagtttgagatgaggacattatgtatactgtttgagacgaggacattatgtatactaagtactttagaaggccacctaaaacaaattttgcatctgtttttttaaaggcttgtgtttgtcatgcgtaaaaaaaaaaaaaaaaaaggcccctagcccgtgactgaagtactatttcg

SEQ ID NO: 14728 - DNA, 437 bp, Sorghum bicolor
  Clone ID: SORBI-28MAY03-CLUS1575_2
cggacgcgtgggtacgccggcatcgggtggtgcatctggaggagcaaggaggacctccccgacgagctcatcttccacatcaactacctcggcgccgaccagcccaccttcacgctcaacttctccaaaggctcgagccagatcattgcgcagtactaccagctgatccgcctcggatttgaggggtacaaggacgtcatgcagaattgccaggagaacgcgacggtgctgaaggagggcatcgagaagatgggctagttcgacgtggtgtccaaggactcgggggtgccgctggtggccttctccctcaaggacagctccaagtacactgtgttcgagatctccgagagcctgcgccgcttcggctgatcgtgccggctacaccatgccccgacgccgagcacgtggcgtgatgcgcgtcgcatccgcgaggactt

SEQ ID NO: 14729 - DNA, 1989 bp, Sorghum bicolor
  Clone ID: SORBI-28MAY03-CLUS1575_1
gacggcccccgcgaccacatcagccccctccgcccccaccaccccgccctcccacgcagcccccctccagggccaccgcgcgcacgtacgaagtctgccgtggtgctacccgatgccgtcgccggctcgctcacgcgcctgtacggcacgatcgcgtcccggtacgtgcggccggccgtgccgagctagaccgcgcgcgcgaacacgatcgccgaggaggtggcctccacggtcgccgccaccgacgtgaagccggacgggcccccggccctggagtccggctcggtcggcgccccgcgccggggggtccggatccaccagcggtccaccgcgccggggaagcagcaccaggtcgacatggacgagctcctgctccacggcgacctggggcggcagcgggcggccctgctcgcaccccgcctgcaggcaccgcgcggccagctccgaatggcccctgaccaccggacccccgacccgatgggggactacgtcgtctcccgtgttccctgcaacggctgtggagaggagaacggctactggagtcggaacccgggggacctcggaaacactgatactggcggcgctaccatggaagacggaaaggcaaaccaggtggaaggaacaggaggaaagaaggtgacaaacccaacattgtcactggtgctaatggtcaggtttgctgggagaaatttgcaaggtattttgaagtagaactgaaggaggttaagtgatcccaagcttattatgtcatgcgccctgtcaaggctgttgagatggtggacgagaacactattcggggtgccccggtcgggggcgcccctctcactggagagtttgaagatgtcaaactattcgacgaccttcttacaagagcgggcgtgggacctccgtgggatgtgcctattcatgtcgatgctgcgagtggaggattcctagcacctttcctctaccctgaacttgagtgggacttcaggctacctttggtgaagagcatcaatgtcagtgggcacaagtatggccttgtctatgctggtgttggctgggtcatctggcggagcaaggaggagccgcctcatcgccccgttctccctgctcaccccccagggcctcgtgggatacaggaacatcatggagaactgccacgagaacgccatggtgctcaaggaaggcctggacaagtcgggccgcttcaacagggatacaaaaacatcatggagaactgccaggagaacgcggcgatactgcgggaaggcatcgcagcgacggggcggttcgacgtcctgtccaaggacacgggcgtgccgctggtggccttctcgctcaaggacagcagccggttcagcgtgttcgacatctccgagaacctgcggcggttcagctggatcgtgccggcgtacacgatgccggcggacgcggagcacgtggcggtgctccgcgtggtcatcagggaggacttcagccggagcctctgcgagcggctcgtctcggacatcaagaagatcctgcacgagctggacgcgcgcgccacccacgccgtgacctgggtctccaccgccgccgccgccgctgtgcaggcggacgacggcgccgtcgtgggaaagaagagcgcgctggagatcgagcgggaggtcgccgcgaggtggaggaacgctgtgaacaagaagaagacgggggtctgttgatgcgtgacgacgggagagccgagggtgtgagttggatgtttcattcaccatggcagcttcgtttgcatgtgcgtgcttgtgtgtgtgaagacgctggatgcggttggtccagttccgtgtaggtgtagccccggggcacgtccagttacgtgtgtgtgcagtgtgcacaaggtgttgtgagcggtatgcggtatgtaaatgttggatttgtgtcactgttcaagtccatcgttacacttcagactatttttcttttcaataatgacgagatttaccgtacttaagacaaaaaaaaaaaaaaaaaaaa

SEQ ID NO: 14730 - DNA, 1579 bp, Sorghum bicolor
  Clone ID: SORBI-28MAY03-CLUS3285_1
ttgttttgcttggtacaagattaacagcatactgcacattgacaatgaaggtctgtcccaaaatacacaaaatttcacttattctaaagaatagacaagattttattctgtgtaccagacaatcacacctttatttgactacaaaacaaataatacatcgactccaggtctgcccttttttttcgtcggcatctaacaagagggaatgggcataataataagtcccaggtttataataggcaagcaattgtgccagcatcaaagcaggcattttgtacatatatagcggtgggggttctcagaagatgaacaccacactgtcatggacccgggacttctggttctgagcgacacattcagagatccacatcaggtttctgatctcttgctcacggagcctgatgtaagcaaagaacacagcatagtggaactgctgctcaaaggacaagcatagcctcttgacttcctcctcataaaatgccttatccaacatctggctttctccgtatgaaatcctggaaaatatagactggtatggtgggtacttctccattgcaccacgaacctggtcaacatcttcacaaacggccagttcttcgtgaccatatgggtacaataaaccaaagttggagtacagcttcctgcggtcatctcttgtcaactcagtaccaatactatttatagtaatgttaacagctcttctgtcagcttcaaatgaaaggagatcacacatgatctcagctgttgcaccacctagtttctggcaaaatttgtagaagtcctcaagatatgctttgtagagagtgttcctcataatctcaatattcatgtcatccaaatcctcagatgtaatgcactctgagaagtaaggggccagtggtgtatcgactagaaccagtctataaagctcacgcatgttttgagcaacagcaagtgatgcaatgctgtcaaacatgcccaatgggtggcatttctccaaaagttcattaacatctctctcatgtagtgtcccagttacaataaggacaacattgtcaatcatgtggccataagttatatactgcaagaacgtagatagtggttcagtggcctggcacagcatgtgcttgtactcatcgaccagtttaagagtgcacttctccacaatcgtcgttgtgtgcaagggtgaaggttcgttctggaggtagggcccgtactcggtagcggtgaggtgcatcttaatgtcgtcgagggtctcgcactggcagagattgttgtagtcggcggcggtgaggagacccgagcggttgccccgcacgatggcctccaggaacccatcgtgtatgttgaacgacagcatctcccacccgtacatcgtcgccgccgcgggctccggctcgctcgccggagacaagacctcggtgggggagacggcagcagtggcggaggggtaggcgccggcgcccggcggcggggaggcgggatcgggagggagggaggtcgacgaagatgagatccgggaggtggggtcgcgctcggtctccggatgcggtagaacacggagacgtttttattccagggggctcgttgccgcagcagc

SEQ ID NO: 14731 - DNA, 1000 bp, Sorghum bicolor
  Clone ID: SORBI-28MAY03-CLUS1747_1
ccgcgaagcccgcgggcccgcagctgaaaacccaccgcaccatttcaacctctcttccctaacctcgccgcggcacagcggtttcactgctcccctcacctccgctcccgaacggccggtctttgcatggcagcagcagctagttccaaggggcgggcgatcgctggaagcttcgtcagccgcgtcctggccggcaaggccgcttccccgaggagggccgtgcacgcctcggcgtacgacaagaacctggaggaccaggtgcggccggcgttcgtgccggacgatgtgatcggcggcggcgccgggaaccccgacaagtactggagcccgcacccgacgaccggcgtgttcggcccggcggcggtggaccccaagctggccgctgctgctggcgcgccggacgctgccgccgcgaatgctgcgggaggcacggtgctggaccagaaggtgtggttccgcccgctcgaggacgtcgagaagcccccacccgtcgcctgagcggcgctagctgtgccagcccacactgctgaattgctgataaggagagcctggcgctgatacacctatcactctgctcagctgggctccctccctgcttatcactgcagtatagtagcagtgcttgatagcggtgtggctgtgctaataccagcattatcaatataagtatataaatactggttttatagtagtgtagtagtagtatcaggcatggcgtgcatcagaactggctgtgatagtagcaacgtgatgctcgtgcctgtaataagaacaagcaggagatgtttgcctgtgctgcttgtgcctgtgatgtaccggtgttgttatcagtgttataagtacttgggtccactggtttgtgcctgtgtttcttacccatgacgcagttcatatactccatccatcccaaattctccattcgcctgttccacggcggaacgtcgacagcgtcatggactccaggactcaggcacttgtgtgatctgttgccagcttcaac

SEQ ID NO: 14732 - DNA, 1266 bp, Sorghum bicolor
  unsure (1)..(1266): unsure at all n locations
  Clone ID: SORBI-28MAY03-CLUS551_1
gccggccgggnctgggacctcacaatgccaccccagcctgctccaaatatccatccagtggcagggacccagatcctatcccttcctacgccggctcacctggaatagtcaccacattccttctcgccgcggacgcgcgtgaggtgagtgtgagagacgaccaccacacccgcgacaacaacaatggccctggagacgtgcttcagagcgtgggcgctgcacgccgcccctgccgctggtggcaaggacagcaggctcctcgtcgtcggcagcagcagcggcagcggcagtaacctggttctgccgtcgaagcgggccgccgccgccgcggtcgtcgcgccgctgtccgtcggccgcgtcgccacgcgccggccgcggcatgtctgccagtccaagaacgccgtcgacgaagtgctggtggcggacgagaagaattgggacgggatggtgatggcgtgcgagacgccggtgctggtggagttctgggcgccgtggtgcgggccgtgcaggatgatcgcgccggtgatcgacgagctggccaaggactacgccggcaagatcacgtgctgcaaggtgaacacggacgagagccccaacgtggcgtccacctacggcatccgcagcatccccaccgtgctcatcttcaaggccggcgagaagaaggagagcgtcatcggcgccgtcccaaagtccacgctcaccacactcatcgacaagtacatcggcacctcatgagcatataatagctcactgttgtatcgtaatattgggatcgatcgatgcgtgcatgaacaacttaattaaatacataagtgtccatatgctcgcgcatatacaccacccatgtatctcctctagtcttgcatacggatgtcatgatcgacgcgttaattaattcaggcagggcagccatctgctactgctcagttattatatgtatgtatacttctctatatgtcaaatccaaagtacattaattagtttattaagtgcatgatttcacttcatcatatgttagtataattcatatgtgtatatattgttggtgatgtgcccaggaggcaatcatgcctattatgggttggatatccataaatgggctaaaccataattcattagtttatagtaccaataatgtgcccataataggtgaagatgaaacatgcaatattagtttgtaccatatttgctgttgccgtagagatagaaagttatccgcttgtacaaaaatgtaccaacaccccatgaaaaggacaacttttggtc

SEQ ID NO: 14733 - DNA, 678 bp, Sorghum bicolor
  unsure (1)..(678): unsure at all n locations
  Clone ID: LIB3481-041-Q6-K1-A12
gcgttcgccggctcacctggnatagtcaccagggggggggtggccgcggacgcgcgtgaggtgagtgtgagagacgaccaccacacccgcgacaacaacaatggccctggagacgtgcttcagagcgtgggcgctgcacgccgcccctgccgctggtggcaaggacagcaggctcctcgtcgtgggggggggcagcggcagcggcagtaacctggttctgccgtcgaagcgggccgccgccgccgcggtcgtcgcgccgctgtccgtcggccgcgtcgccacgcgccggccgcggcatgtctgccagtccaagaacgccgtcgacgaagtgctggtggcggacgagaagaattgggacgggatggtgatggcgtgcgagacgccggtgctggtggagttctgggcgccgtggtgcgggccgtgcaagatcacgtgctgcaaggtgaacacggacgagagccccaacgtggcgtccacctacggcatccgcagcatccccaccgtgctcatcttcaaggccggcgagaagaaggagagcgtcatcggcgccgtcccaaagtccacgctcaccacactcatcgacaagtacatcggcacctcatgagcatataatagctcactgttgtatcgtaatattgggatcgatcgatgcgtgcatgaacaacttaattaatacat

SEQ ID NO: 14734 - DNA, 1942 bp, Sorghum bicolor
  Clone ID: SORBI-28MAY03-CLUS2292_1
gcacgaggcccccctcgaagccaaagcttccacattccaccagagcccgagatcgtagcagtcaccacgccaacaaaagcagcaaagcaaaagctaccgtcaccgacccgacgttccaagaaacgaaacggccatgatgatgatgggagggggagctcacgcgccgccgtggcagcagtcaccggcggccagcatggacgcggatgaggcggcgtcgccgtacgcccgcccgggcgcgccgcaacattacctgccgtcaaacgaggtgtcggcggcggcggcgccgcccgcgccggaccccgcggaggcacccctggcccccgcgggggacccggacgcctcccacgaggtccggatgcacgaggtcaaggtgcggcgtggctcccgcgggcggagccacgactggacggcctgcccctacgcgcacccgggggagaaagcccggcgccgcgacccgcggcggtaccactactcccgcgcggcgtgcccggacttccgcaaggccgggtgcaatcccggcgacgcgtgcgagtactcgcacggggctttgccgtgctaagtgcgaagcttccaggcacgactgcacaacaggagaagaaatttcaggggaaaaaaccaaaaacaaaaaagatttttctcttagatttcgactaagattctcccgatctttctacatatgttcctctctgtgtgaatattcttggatggatggttgttcaagggagggcagggaggtaagaggcaggaagacgggcatgtcagtgaagtgtgaaggtagaagaagcctaggaggagacaagaggtggcagcaaaacatggtgtggggaaaatggatcaagaagacatggcaggcgaccatgcatgtatatgagttatctagatgtacatagcgtatgtgttcgtgtgtgcgtgtgcgtgtgtggaggtgtagcgtggagggaggcgatcatggcggcgatccaagaccggagaagaagaagactgggatttatgtcaccgccggcgcctccggtgaggttatccgggaagcaggcctggaacttctaatttccgcaagcgattccagaaaaagcgtcgtctttcgagttgatgtttactcgcattccagcgttcattctgccgtctgccggacgttcaagctcgaatgacgttgttattactgccctgtaagtttctcaagctctttctccggggatcgcccgactggcatcaggactagggcgtgcagggcgacgagctgcactagtttcgcatttctgcgtcttacgcgttccacgtgcaatccccggcgcccgtgcccacccccgccgagccagacgtctcgtgggtgaactctcttgtcaaggacggccacgccggcgacatatttgcgcagtggccggagcaggagcagatggtggcctaatttgattcaccgatcatcactggctcatagcatctagctgaccaaagttctttccttcaattattttttcccctttgtttgcttaatttgattcatatgagatgttttttactagtacatatatataggctgttcacaataatatttgttcatcaacaagaagcatatatggatgcccaaagggagctctatattgatgaggaaggaagaacaaccaatcttttactacttccatcggtttatatataaatagttgtacacacgaattcctacatacaaagagtttatgtttatattcctgtcccagcatgcattcccgacagcgggtgttgtacttaatattgtagtagtagtaggtgctgaaatctcattcacccgctattggaggtgaatttcccatgtaatcttttgctcaagtaaatggtttaatgaaatctatgtctattattaatatcgccctaaaaaaaaaaaaaaaaaaaaaaaaaaaaaaaaaaaaaaaaaaaaaaaaaaaaaaaaaaaaaaaaaaaaaaaaaaaac

SEQ ID NO: 14735 - DNA, 360 bp, Sorghum bicolor
  Clone ID: LIB3481-006-Q6-K1-F6
cccggtcgaccccgcgtccgatcgcgggcggccgcgcgccggccacgcgctcgctcatgtcgcagcagtccaccaccggcgcgccgtccatgctctccgactggggatcgccggacggcaagctggactggggcgtccagggcgacgagctgcacaagttccgcaagtcggcgtctttcgcgttccgcgggcaatccccggcgcccgtgcccacccccgccgagccagacgtctcgtgggtgaactctcttgtcaaggacggccacgccggcaacatatttgcgcagtggccggagcaggagcagatggtggcctaatttgattcaccgatcatcactggttcatatcatctaactgacc

SEQ ID NO: 14736 - DNA, 1817 bp, Sorghum bicolor
  Clone ID: SORBI-28MAY03-CLUS6486_1
gcgcacgccgttccccacgccccccagctctcgcaccaggcacgctcacgcgccgcgcaccgaatggcccctgctaacgtgcgcgcggcgcaggcccctagcgccgaccgcaggttaagtacgctggtgcgtcacctgctgccttcctccccacgaagaacagcagcagaagcagcagccgacgcctccgccaccctcgaatcgttccccaccatggcgtcgcagggatcctccgtcttcgccgcactcgcgcaggccccggaggaccccatcctcggagtgaccgtcgcctacaacaaggatcccagccccgtgaaggtcaacctcggcgtcggcgcctaccggaccgaggaagggaagcccctcgtgctgaatgtggtcaggcgcgccgagcaaatgttgatcaataacccgtcacgtgtcaaggagtacctaccaatcaccggtttggctgaattcaataagctgagcgctaagcttatctttggtgctgacagtcctgctattcaggagaatagggttgctacagtgcagtgcctatcgggtactggttctttaagagttggaggtgaatttcttgcaaggcactatcatgagcgcactatctacatcccacaaccaacctggggaaatcacccaaaagtattcaccttatctggattgactgttaggagctaccgctactatgatcctgcgacccgcggtcttgacttcaaaggactcttggaagacctcagttctgctccttcaggttcaattgtactgctgcatgcctgtgcccacaaccctactggagtagatcctacccttgatcagtgggaacagattaggcagctgatgagatcaaaatcactgcttccgttctttgacagtgcctaccaaggctttgcgagtggaagtcttgacaaagatgctcagtcagtgcgaatgtttgttgctgatggtggtgaattgctcatggctcagagctacgccaagaacatgggattgtacggagagcgtgttggcgctttgagcattgtatgtggaagtgccgatgtagctgttagggttgaaagtcaactcaaacttgtgatcaggcctatgtattcaaacccccctcttcatggtgcctctatcgtggctaccatactcagggacagtgagatgtacaacgaatggactctagaactgaaggccatggctgatcggatcattagcatgaggcaacagctatttgatgcgctgaaatccagaggaacccctggagactggagccacatcattaagcaaattgggatgtttactttcactgggctgaatagcgagcaagtggcattcatgaggcaggaataccacatttatatgacatctgatgggaggatcagcatggctggtttgagcatgaggactgtgccccatcttgcagatgccatacacgctgcagttactcaactgaaatgaggacagtatgacagctttcatgaataaaatctgaatcacctagaacaatgttctaagaactcagccggcggtatttcctggttgacctactgtaatctgccttgagataggagtatgttttttactctgttgttggaacagttttgtactggcagattcaaattcaaatattatggtcatattgtgctttcggaactccaaataaatacgcgcatgcaattttgctccaccggtgctaaatgtttatcctacaacaacctgcagtagttttgaaggcttgactttcctattgtacggttcctctgctcaaaagttttctaattgttgtatgttgctacttgctcttcgtgacagccaagggtgaaatagatgcc

SEQ ID NO: 14737 - DNA, 2261 bp, Sorghum bicolor
  Clone ID: SORBI-28MAY03-CLUS6954_1
gcacgaggccgccccccccatccgtttcgctttccccacagtctagcctagatcgagcgcgacccttctctctcgatccgacgccggccgacgacccctagccggcggcgaccatggcgttcggcgagcgcgtcaccaccttcgaggacagcgacaaggacagcgagtacgactacgactgcggggactccggacctgtctttggagctgttgtagtggctgatggtatcatgtatgaacttgttcgtgttcgagttcatcacctcagtggggatattattcgtcatgatgctgatccagatacaattcaagcttatgaggaaacagctgggcagatggttagtgacacagttaagctaccgtgttagaaagcatcacctcggttatcttttgtattgcctagtttcacaattgttcgaggatccagctgtaggtgaagaagctctagtcggaaaattcaagaaactgtatgacgaccttacagccggattccgcaacctagaagacgaagcacggtgaatattgtacagtccgccgtgtcaacaataagaccaaattccccggaaggttccgggagcagtctgttttgttcagcctgaggttgtaaattcggtatcagattttcccccaccaacactgtttatttctgtaccttgttttcctctggtgcttgacgggcactgtttttatgtaccattattaatttattgtaagatactggtgcacatgtccatagttgaataagcgcgatgcccattagcttgaccattacaattgctacttattattcttattacacacctcatctagcagtgcagcgtttactggatgcgctattcgcctcagttcttggaagcactggagcttttggaggagggattggttttagtaaaactgtcatcagtcaggcacttaataagtactccaattccgaagctggtggtgatgttgggtgtagtgagagaggaaatgagatggctgagtttctcatggacacaacccagttgacgatgacatgtgaagaggctggtgaggagtcagtcatgaagagaacaacactggtggctaacacatcaaacatgcctgtcgctgctcgtgaagcctccatttatacaggaattacaattgctgagtatttccgtgatatgggctacaacgtcagtatgatggctgactccacatcccgatgggctgaggcattgcgtgagatctcagggcgtttggctgaaatgcctgctgatagtggttacccagcttatttggctgcacgtttggcatccttttatgaacgtgctggtaaggtaaaatgcctgggaagtccagacaggactggcagtgtcacaattgttggagccgtctctcctcctggtggtgatttttcagaccctgttacctcagcaaccctcagtattgttcaggtcttctggggtttagataaaaagcttgctcaaaggaagcatttcccatctgtgaattggctcatttcctattcaaaatactccaaggcccttgagtccttctatgagaagtttgatccagatttcattgatattaggacaaaagcacgtgaggtgttgcagagggaggacgatctaaatgaaattgtgcagcttgttggtaaagatgcgctggcagaatctgacaagattacgctggagacagcaaagcttctgagagaagattatttggcacaaaatgcatttaccccatacgataagttctgtccattctacaaatctgtttggatgatgcgcaacattattcacttcaacacattggcaaatcaggctgtggagcgggcagctggtactgacggacaaaagataacatacagtgtcataaagcatcgcttgggtgatctattttatcggctagtatctcaaaagtttgaggatcctgccgaaggcgaagaagctttggttgccaaatttaagaaactgtatgatgaccttaccaatgggttccgcaatctagaagatgaggcacggtgaagtgttgtagattttgtgtaaacaataaggaccgccagatgttttatataagatacggaggttgtagattgagatcatgtatgagaattttccccaccgctgctccatctctttgccaccactgttttagtcatcagtgcccgatgggaccctgtttatttcaatgtatcatttattgctatcattgtaataagcgatgggcatgcttgtagttgaataagtacaatgtccatgtattcaaacatcagcatcatgtttatttgtttgtgg

SEQ ID NO: 14738 - DNA, 498 bp, Sorghum bicolor
  Clone ID: LIB3478-012-P1-K1-E7
accaaggcctgtttcgtcaaagcttgctgctgacacacctctcttaacaggacagcgtgtgctcgatgcattgtttccctcagtgcttggagggacatgtgctattcctggagcatttggatgtggaaaaactgtcattagtcaagcactttcaaagtattccaattctgaagctgtggtttacgtgggttgtggggaacgagggaatgagatggctgaggtccttatggacttcccacaattgacaatgacattgcctgatggacgtgaagagtctgtcatgaaaagaacaactcttgtggctaacacctccaacatgcctgttgctgctcgtgaagcatccatttatacaggaattacgatagctgagtatttccgtgacatgggatataatgtcagtatgatggctgattctacttcccgatgggctgaagcattgcgtgaaaattcaggacgtttggctgaaatgcctgcagaatagggctaccctgcatattt

SEQ ID NO: 14739 - DNA, 1751 bp, Sorghum bicolor
  Clone ID: SORBI-28MAY03-CLUS14600_1
gcaccactgggccagcctcccagccccgcctcccaccccctccccacactccttcccgctcaccgagagccagagggggcagccaaagccgtgccgcaagcccgcaaccacaaagaccttgctccccctaattttttccccgaagctcgcctgcgtgccgctcgtgccctccgctcccccggtccggtccgccacaccaataatccatgcaccggcccgctgcggcggcgatatgcggtggcggcttcttctccgggttcgtcccgccgtccggtgtggcggctgcagcggcggccaccaggaggaaccaggagcagcggccgaccgtgaggggcggcctgctgtggcgagggccgggccataggtgagcgccgccccggaggtggtggttattctgcgggtatggctactgcgagtgcggggggttcacaacaaagaaagtggctccgacctgtgccggtgctggaggcgcaagccagttgcatccgctacattttgtcgcggtagttatatatggtagattacatatatatgcttttgccagttgaactctatgaccatgtttatagtatgttgctgcgtggtgcgtctatgattggaagcgagtttgagactgattcaataatttaccttgcctatgcctgctggactgtagtgtgcgtactgcatgttatgtgtatatatatatatggtgtgcttatgtatggcttggctctgacaacactgctgaggaggcgcctagggcgtacgatgctgaagctcgcaagggccggggccggccagcgccggccatctgtcccgccggagttccaggtgctccggagtcacctgcaaagccttccgggtctgctgctgcgtagcctgctccgcccccaaaggcctgtgctgatgaggttttcagtaacctgaacaatgacaacaatgatttgttcgcaatgtttgcgttcaatgacaataaggttcctgtgaagccagctgaggttgccagtttcctccctgcagtgaaacctctggtgcccagtaagagatctgcgactaacatgctttctgaccagaacagcaactcctatggctcttctgactttgggtgggacgatgacaccatgacctcaggctacacctttgctcccaataatgctataccagcatcttacatgcaaggtggagagtcaaagagaatgaggaacaactatggtgtagccatgtttcagggaaatggcgcccccagtctcgcacaagtcatgcctggttttgatcctgagatgaactatcagccattgccttatgttgagagcagctcatcagatgcatcaatggacagccttctaccacaggatggggcaagcaatggggatatctggagccttgatgagctgctcatggcagctggtgcttattgagaagctatggttattatcagtgtggcgtgttaacagcaaaaaaatgtaaggcgcccatactgccttttttgttttccccacaccgcgcacatctcttgtagaagatttacttctgccgtgaatggagtttctcagcttcgttttatttttatgccagggctcctacctgtggtgatgctggaggggcaagccagttgaatccgctacattttgtcgcggtagttatatatggtagattacatatatatgcttttgccagttgaactctatgaccatgtttatagtatgttgctgcgtggtgcgtctatgattggaagcgagtttgagactgattcaataatttaccttcct

SEQ ID NO: 14740 - DNA, 449 bp, Sorghum bicolor
  Clone ID: LIB3480-022-P1-K1-C6
cggacgcgtgggatcagccattgccttatgttgagagcagctcatcagatgcatcaatggacagccttctaccacaggatggggcaagcaatggggatatctggagccttgatgagctgctcatggcagctggtgcttattgagaagctatggttattatcagtgtggcgtgttaacagcaaaaaaatggctcctacctgtggtgatgctggaggggcaagccagttgaatccgctacattttgtcgcggtagttatatatggtagattacatatatatgcttttgccagttgaactctatgaccatgtttatagtatgttgctgcgtggtgcgtctatgattggaagcgagtttgagactgattcaataatttaccttgcctatgcctgctggactgtagtgtgcgtactgcatgttatgtgtatatatatatatggtgtgcttatgt

SEQ ID NO: 14741 - DNA, 1079 bp, Sorghum bicolor
  unsure (1)..(1079): unsure at all n locations
  Clone ID: SORBI-28MAY03-CLUS7130_1
ggccccatgatggtagcttgccaatggaacatgtcctcaccaacaggacctgcactgcaggaggtgggcgggtcctagtgcaggtccttcaactccctcaggatcctcttcgacgccatcgatcaaacccgatcggtgccgtttctcaggctcccgctcccgaattgaacctcaagactcagccccctttttttttttttttttacagaaatatgatgattaacgaagcaacatcagataacggaatggtcaggtagaacagactaccagacacaacggacttcacaaggtaatacatatgagttcaacaggacacaatagccctcaaaagtccattcatacttgctgggacagagtgacttgactggttatttaggtgataacgatttttggggtcggcacattcaccagtttggccagcttgtagccacacttctagcccatggcatacttctgcgtccaggagcgtgcagtggactcatacttggccctgtcagtcttgtacatgtgagcaatctcagggacaagaggatcatcagggttcgggtccgtgagcagcgaacagattgacaggagaaccttcgatatggttaaagcagggctccactgttccttaaggatgtcaaggcaaatgctgccgttgctgttaatgttcgggtggaaaaccttggtgcgaaaagacacctttggtggcttgaaaggataatccggtgggaagtgaatgttcaccaagaataccccacctgcaaatgggctgtccgagggccccatgatggtagcttgccaatggaacatgtcctcaccaacaggacctgcactgcaggaggtgggcgggtccttctgcaggtccttcaactccttcaggatcctcttcgacgccatcgatcaaacccgatcggtgccgggggggatcaggcgggggtggcgcgggatcggtgcagcggccgcctccctctcttctccgaggcgcgcggcggcgacggcgtgtcgcgggggctcgggccacaaacgggaggaagcgaggagtcgggggatttttttttttttctttttttttttttccccggcnnccggccggc

SEQ ID NO: 14742 - DNA, 2083 bp, Sorghum bicolor
  Clone ID: SORBI-28MAY03-CLUS637_1
gcaccacacttccccagctcgtcgcctccgctaaccagccgagacgcagcgggcgagcagccctacttcccctcttcctcccattagcagcagcagcgtcgaccagcagagcacaagccggcagcgattgagcgagggaggaacacgatgagcggcggcggtcaggatctgcagctgccgccggggttccggttccacccgacggacgaggagctggtgatgcactacctctgccgccgctgcgccggcctgcccatcgccgtccccatcatcgccgagatcgacctctacaagttcgacccatggcagctccccaggatggcgctgtacggcgagaaggagtggtacttcttctccccgcgggaccgcaagtacccgaacgggtcgaggccgaaccgcgccgccgggtccggctactggaaggccaccggcgccgacaagcccgtgggcacgcccaagccgctcgccatcaagaaggcgctcgtcttctacgccggcaaggcgcccaagggcgagaagaccaactggatcatgcacgagtaccgcctcgccgacgtcgaccgctccgcccgcaagaagaacagcctcaggttggatgactgggtcctgtgccgcatctacaacaagaagggcgggctggagaagccggcggcggtcgccggcggcgaccacaagccgatgttcgcagcggccgcggtgagctccccaccggagcagaagccgttcgtggcggcgccgggcgggcttcccccattcccggacctggcggcgtactacgaccggccgtcggactcgatgccgcggctgcacgcggactccagctgctcggagcaggtgctgtcgccggagcagctggcgtgcgaccgggaggtgcagagccagcccaagatcagcgagtgggagcgcaccttcgcctccgaccccgtcaaccccgccggctccatgctcgaccccgtcgtcggtggccacgccggcgacccgctgctgcaggacatcctcatgtactggggcaagccgttctagacgaagacgacgacgcgatcgaaggtcatcaatcaaaggggggaatttatttaaaaaaaaagaaggcgctgcggttggttggttgatctgtcttgggcagcgcaatgcaatgcgacgcaaccgctcggtgtgggcttgactcaggcgagccgccattgttgacctcgttgaggaggagataggttatgaaactatagctggattggataaggcggcaatgagaccgtgtggccccgccggaagggagggagacggacggatggcacagtgcattgggtggtcgatcgtgcgcggcatgtgtgtgtgtgtgtgttcttgtacatatacatacagtacatgattggttcagtgcagggtttctgttccttcattggttagtagtaattctattttataaggtcctgtagttgcaatctccaatgggggtaggtagtgcaggctatatagatactccatttgtcatcgtcaagcttcgagtagcacagagtatattgtagctgttggctctttgaaaaaactgaaacgggaattatgttatttcgatcattttgctggtcgcgtctgaagaagtgctgttcgtctgtattcaactatcatgttcgcttggctgcctgaaaggcttgcagcggtgctgtatgctggagttgtgcttatggacgaagaaacgtttgtgaaccacacgttgaagggggcaaaaacgtgctgtggcagacaaaggtctgccgaacacactgaaaaccgtgagacactagtgaacacgttgaaaaacgagggggagatttgagagtcggcaggcagaaggtggtcaatccgcacgtgtaggcagggaggcggcgacggcggtgagtgggccggcgagcgggcggccaagcctggacttccacatgtcccgacgggatcgtcttcgggcctatcaccactgcacacgcccggcgaactgtcaaatctcatatcgtctctcctgtgtggctgggtgtgactgtggaacatgtcccaacgatttatggatacatcctattactagtgtggaacatgttttgtatttctaattctaatctaa

SEQ ID NO: 14743 - DNA, 651 bp, Sorghum bicolor
  Clone ID: LIB3481-042-Q6-K1-C9
gcgttcggccaagcgcgcgcggcaaccaaccaaccatggcgggcgggcgggcgggcggtcggccagatcgagcagccgcgcgccgcctgatcgcccgcgcccgcgaacaaatgaccacacgcgcaccgaatccgacgaccgacgtcacgtcggcacgtcgacatcatctccaagcctcctctccaatctgcaatccaacgcgtagtaaaaagaaaaaccaatcagcttcttcgattgactttgtcgtctcacttgaatttcgcgtggatttggtggctgaaatctttgtttcattgattatctttgcagctggatgactgggtgctgtgccggatctacaacaagaagggcgtgatcgagcggtacgacacggtggacgacgacgccgacgacgccgtggcagaggacgtcaagcctgcgccggcgtccaggaataacccgcgcgggaccgccagtggccgcggcggggcagcagcagcagcggcgccgatgaaggtggagttcccggagtacggtgggtactacgactacgacgacctcgaggcgacgccgtcggcggggatgctgtgcttcgatcgcccgtcggccgcggtcccgacggccccagcctctgcgcccgcgcccgcgcccgggccggcgctgtcgtcgtcg

SEQ ID NO: 14744 - DNA, 1046 bp, Sorghum bicolor
  Clone ID: SORBI-28MAY03-CLUS17346_1
gtgggggccggccgcgccggccggccggccgggccatcaaaattcaccagtacctagttaattcttgtgagctcgccggaagaagaacaagccaataagcttccacttgtcatggggactctgcctcgctgcctgctcgctggcatctgcgccgccgccctgttagcggcagtagtggtcgcccatggtgccgagcccgagacggcgtcaatggtcgtcggcttggccaagtgcgccgactgctccaggaagaacatgaaacctgaggcggtattcaacggcctccaagtggctgtcaagtgcaagaacgccgacggcgtgttcgtgaccaaggccttgggcgaggttgacaggaccggcgccttcagcgtccccctcgcggctgacctcctccgcgaggacggcgagctgaagcaggactgcttcgcgcagctccacagcgcagccaaccagccatgcccaggacaggagccgtcatggatcgtccggtcagcaaccagcgagtacgacgacgacaagacgaagaagaccttcgtcgcagtggccggcaaggtgcactacccatccaaggagtgcgcctctgcgttcctctgctaccatttcttcaagaagcacctcctgcacaagaagcccaccgtgatgagccctcacatccacaagaagccggcggtgccagagtacaagccgccgacaacgacgacgcctgtgccggtgtaccactcgcccgtgccggagtacaagccgggccacccgacgccgactccgatctaccatcctacagctgagcacaagacacagaaccatgagacagacactgagaagttcaagaagctcctccccttcatcaagaagaaccccttcttctttcccaagttccccaagttccctgggggcaaggagatcaaggcgtagaaaaatgggtgagagacgaaatgtactctgttcgtctgcatctactgttatgttatgtagtgtctgcttgcatggattatcattaccaccagctggtctcccgctcaaataaaaacttttgttacgttctgatg

SEQ ID NO: 14745 - DNA, 1817 bp, Sorghum bicolor
  Clone ID: SORBI-28MAY03-CLUS2784_1
cggtcccccccgcgccagccccctcccctccccccgcctcccgccgccccgccccgccccctccgcttgggcttgatctccccacaaccgcaagcgaccggcgtcatatccactccgctcctgatctctcctctattcttcagtgcagcagcatcagcagcaggccgcccggcccacgcccgcctccgatccgctagctgctccctcgccgtccggagatggcctccgccgccttcgccgtctcctcgccggcggcctccgccgtcgccgcgcgatccaaggtgcttggacgtggagctaatctggggagaaatagaactggctgccgcgtcggtatcacgcggaagaactttggccgtgttatgatggcccttgcagtggatgtttctcgttttgaaggagtgccaatggctcctccagacccaattcttggggtttcagaggcttttaaagcggataaaaatgatctgaagctcaatcttggtgttggtgcctataggacagaagagttgcagccctatgtgctcaatgtagtcaagaaggctgaaaagcttatgttggagaaaggagataacaaagagtatcttcccattgaaggtttagccgcgtttaacaaagcaacagcagagctattgcttggagctgataaccctgttattaagcaagggctggttgctacaattcagtctctctcgggcactggatcactgcgtctcgctgcagcattcatacaaagatacttccctgaagctaaagtaatcatatcatcgcccacctggggtaaccacaagaatatcttcaatgatgctagggtaccttggtcagagtaccggtattatgaccccaagactgttgggttggattttgagggaatgatagctgacattgaggctgctcctgaaggatcttttgttctgctacatggttgtgctcacaacccaactggaatagacccaactcctgaacagtgggagaaaattgcagatgtcatccaagagaaaaaacatatgcccttctttgatgttgcatatcagggttttgccagtggaagccttgatgaagatgcattttctgtcaggctttttgttaaacgtggcatggaagtgtttgttgcacaatcttacagcaagaatcttggtctatattctgaaaggattggtgcaataaatgttgtgtgctcagcaccagacattgcagatagggtaaagagccagctgaaacgattggcacggcccatgtactcgaacccccctattcatggtgccaggatagttgccaatgttgttggtgatccgactatgtttggtgaatggaaacaagagatggaggaaatggctgggcggatcaagaatgtaagacagaagctctacgatagtttgtctgcgaaggaccagagtggcaaagactggtctttcattctgaggcagattggcatgttctcctacactggcttgaacaaagcacagagtgataacatgacagataaatggcatgtttacatgaccaaggatgggcggatctcattagctgggctgtccctagctaaatgcgattatcttgccgacgccatcatcgattccttccataacgtcaactaggttgaggtacaaatagttgagggtcaactaggctgggatttttgggtccttccagctatacagtttttccttgtattccatttggtgtaactttgattaaataaattttgtcaaaactcatgtgcttattttacttgtaaaatcagtacgtggctacaggatcgtaacacttgaatgaaacaatgacattaccgatattaattggcccccatattctcc

SEQ ID NO: 14746 - DNA, 751 bp, Sorghum bicolor
  unsure (1)..(751): unsure at all n locations
  Clone ID: SORBI-28MAY03-CLUS5264_3
cccataagtactctcctctcgccggccggccgggccgggacttcctttctcctccccacctcggcggccggcctcctcttcttctcttcacccacacgcaggtcatcgagatgtcggcggcggaggcgaaggcggcggtggtcccggagtctgtgctgcggaagcgcaagcgggaggagcagtgggcagcggacaagaaggagaaggcgctcgcggacaggaagaaggcgctcgagagccgcaagatcatcttctcccgcgccaagcagtacgcccaggagtacgacgcccaggagaaggagcttgtgcagctcaagcgtgaggcccggctgaagggtgggttctatgtaagcccagaggccaagcttctgtttgtggtccgcatccgtggtatcaatgccatgcaccccaagacccgcaagatcttgcagctcctgcgtttgaggcagatcttcaatggtgtcttcctcaaggttaacaaggcaaccattaacatgctgcgcagggtggagccatatgttgcgtatggatacccgaacctgaagagtgttagggagttgatctacaagagaggttatgggaagctgaacaagcagaggattccacttagcaacaacaatgtcatcgaggagggccttgggaagcacaatatcatctgcattgaggaccttgtgcatgagatcatgacagttggcccacacttncaggaggcccacaacttcctctggncatttaagctgaaggcgcccct

SEQ ID NO: 14747 - DNA, 1105 bp, Sorghum bicolor
  Clone ID: SORBI-28MAY03-CLUS5264_1
ctggacttcctttctcctccccacctcggcggccggcctcctcttcttctcttccccacacgcaggtcatcgaggtaggctttgctgcgccagcctccgcttcctttctcctcccacctcggcggccggcctcctcttcttctcttcacccacacgcaggtcatcgagatgtcggcggcggaggcgaaggcggcggtggtcccggagtctgtgctgcggaagcgcaagcgggaggagcagtgggcagcggacaagaaggagaaggcgctcgcggacaggaagaaggcgctcgagagccgcaagatcatcttctcccgcgccaagcagtacgcccaggagtacgacgcccaggagaaggagcttgtgcagctcaagcgtgaggcccggctgaagggtgggttctatgtaagcccagaggccaagcttctgtttgtggtccgcatccgtggtatcaatgccatgcaccccaagacccgcaagatcttgcagctcctgcgtttgaggcagatcttcaatggtgtcttcctcaaggttaacaaggcaaccattaacatgctgcgcagggtggagccatatgttgcgtatggatacccgaacctgaagagtgttagggagttgatctacaagagaggttatgggaagctgaacaagcagaggattccacttagcaacaacaatgtcatcgaggagggccttgggaagcacaatatcatctgcattgaggaccttgtgcatgagatcatgacagttggcccacacttcaaggaggccaacaacttcctctggccatttaagctgaaggcgcccctgggtggcctcaagaagaagaggaaccactatgtggagggtggtgatgccggcaaccgtgagaactacatcaatgagctcatcaagaggatgaactagtctcttgtatcccgtgagaatgcattctatgtcagcatggttgttttactctagtaagtttatggataatgatggatatgcaattttggtgttccatggctctaatacagcaagacttcccactaggaattgtgtcctgtttacgtttgcagttgcagttgcttcttggcgattttgtttaaaaaaaaaaaaaaaaaaa

SEQ ID NO: 14748 - DNA, 776 bp, Sorghum bicolor
  Clone ID: LIB5050-001-R1-XP1-D10
cccggggagctcatcaagaggatgaactagtctcttgtatcccgtgagaatgcattctatgtcagcatggttgttttactctagtaagttgatggataatgatggatatgcaattttggtgttccatggctctaatacagcaagacttcccactaaaaaaaaaaaaaaaaaaaaaatcactgttacttccaccaacaaggctcctcgactcgtcctccgtcacgctctgccctgatccaagacactgaaccccaccgacgccatgcagctcttctactacctctctgctctcggcagtctcgccgccgtttcggccctacccctcgatctctctgagacagcgacaccatcacgagtcgagtccctcggagctctcgacgcgggcgtcggatctgtgtctgggtctgggtctgaagcgccatccgtcgcccggatcgtctactggccgaccattgcgactgcccaggcgccgctcgctgacgccgatccggccaccccggctgcgagcccatctgcagccctcaccaactcggagcggatccagcgtggtttgccattgaatgcgccaagcaacctgtggacagagaagcgggctctgcagccgcggttcagcgatgcgccagcccggacctcgacagacacattcgtcttcaaacatgcaccgacggggccacctgcggaacaggatgcaccaccgacaccctcgacaaccccgcccgatacggaatcgcctcgtaccgaaccgacgcacaacgccagaacgcaatcgacgactg

SEQ ID NO: 14749 - DNA, 325 bp, Sorghum bicolor
  Clone ID: LIB3480-003-P1-K1-E8
cccaaacctagcccgcgcgcgggcgcggatctgagttttcgttgggctctctgcgcaaatgtctgcggcggatgcgaaggcagctgtggtcccggagtctgtgctgcggaagcgcaagcgggaggagcagtgggcagcggacaagaaggagaaggcgctcgcggacaggaagaatgcgctcgagagccgtaagatcatattatcccgcgccaagcagtactcccaggagtacgacgcccatgagaaggagcttgtgcagctcatgcgtgaggccctgctgaagggtgggttctatgtaagcccacaggccaagcttttgtttgtg

SEQ ID NO: 14750 - DNA, 498 bp, Sorghum bicolor
  Clone ID: SORBI-28MAY03-CLUS3885_2
ggcgtccgcggacgcgtgggctggtccaaatcgccgttcgtcgtctcctaccgagggtacaccgccgacgcctgtgtccccaccggcggcgacgtcggcaccccgctgtcgtgcctcgctgggacggaccggtggatgaaccgccagctcgacgccgccgagtggggcaccgtcgcgtgggccaagaagaactacatgcactacaactactgcgacgatgggtggaggttcccgcagggattccccgccgagtgctcccgaaactgatctgctattattgttcttgcttcctgttccttgattcgtgtttgttcttgaacaggatagctcagatgttgccttcccatgtacattttggcaccccaacggagcttcggtggctgcgcaggtcgacgacagaccccggcggggtggtagccgcggcggcgcaagcacggtcatggcgacccggccggcggcggaggaaggcgaggcgaacacattggtgggattggtcgc

SEQ ID NO: 14751 - DNA, 1278 bp, Sorghum bicolor
  Clone ID: SORBI-28MAY03-CLUS3885_1
gcacgcccccgccagctacaccccaccaccccacagccctgtcctacacgtccattcccgcccttccacgaagctctagaccggagccgcagagcgcggcgaagccaccttggcggcgcgctctcccgcccccctgctcgcggcgaccctggccctcctggacgcggcgaccgtcgcgtccgcggactcgtggctctacgagaaggtcaccacggacggcaacgtccgcccggcctacgacgcggccggcccgcaggtggcgccgctcagcctgtaccgccgctccggcgccgccctcaacgcgaaggagccctacctcgacggcgagttcagcgtccagatgaggctcagccccggcaactccgccggcaccgtcgcctccttctacctcgcctccggcgacgccgacgggcacgacgagatcgacagggagttcatgggcaacgccacggggcacccggtggtgctcaacaccaacgtgtgggccaacggcgacggcaagaaggagcaccagttcgacctctggttcgacccggccgccgactgccacacctacaccatcatctggaacccgacgaacgtcatcttcaaggtcgacgacctcgtcatccgggtcttcaagcgctaccctgacctgccctaccccggcgggaaaccccttgtcggtgccccccacgctgtgggacggcagctactgggcaacgcagcaggggaaggtgaaggtggccgggcccaattcgccgttcgtcgtctcgtaccgaggctacaccgccgacgcctgtgtccccaccggcggcggcgacgtcggcgcgccgctgtcgtgccccgccgggacggaccggtggatgaaccgccagctcgacgccgccgagtggggcaccgtcgcgtgggcaaagaagaactacatgcactacacctactgcggcgatgggtggaggttcccgcagggattccccgccgagtgctcccgaaactgatctgctgctattattgttcttgcttcctgttctcctcctcgattccggtgtttgttctttggtcacctctgttattgattgatgaacctggttcgctcgtcatgttgccttcccattgacaatttggcacgccacactactagggttctaggatatttctttaattttgtgattttgtgattaaaaagcagccctgccgaaacgtgtgggcggttgtacacacccagtttttccctgaacagcagagcatgtaatttttatcgtgcttttggatatatatacaggccatgcagccatgtat

SEQ ID NO: 14752 - DNA, 454 bp, Sorghum bicolor
  Clone ID: LIB3476-053-P1-K1-H4
atgctacccacagctagtgtctgatcaagctcatcatttccaagaagccgagatccaggccagccgatcgagcactagcgacaacacacatccatcaacgtacagctatggcgcggccggcggcgtggactccgcctgctctgtcgcctgcggtcgccgtcctctgcctcgtcggccggtccacctccgaggagttctggctcgacgagttcaccacggacggcgacgtccgcaaagactacgacggttctggccggaaggtggcgtcgctggtcctcgaccagagttctggcgctggcttcaactccacccgcaagtacctattttgcgagttcatcgtcgagatgaagctcgtcgccggcaactccgtcggcactgtcaccttcttatacctgacgtccggcgagggcgacttgcacgacgagatcgacatggatgtcatggtcaactccag

SEQ ID NO: 14753 - DNA, 1479 bp, Sorghum bicolor
  Clone ID: SORBI-28MAY03-CLUS44181_1
aaagcaatagcaaaagcaaacctgtgacggctgcagagcaccggcaaggttttgttaccgcgattttcctgggccatggatccacggcacggcggctactgggagagctcctcggaggacgtgacgaggccgctgctgccgacgcacgacgaggacaggccgacgacgacgggggagctctcctcctggtcagggctccggacgctgctcgccagcaagtacctggcggtggcgtcggggccggcagcgtgcgcgctgatctgcgcgctggtggacctcggcgggcacgccgcggcgcgcaacatgctcggcgtgctggcctgggtgttcctctggtggatcacggacgccgtgccgctcgccgtcgcgtccatggcgccgctcttcctcttcccggcgttcggcatctcctcctccgacgccgtcgccaaggcctacatggacgacgttatttccctcggccttcgaaccttcatcctcgcactccccatcgagcattacaacaacctccgtctccttgccttcaacggtacggccgtgctctgcggggcccggggtctgccgcaccacctgctgctggggatctgcggtccgccagcgttcatcagcaggtggaacgatcacactccggacagcgacactgcgatgcatcatgcggagcggcaagaacgacggcgagaagctcatggactggggcaagtgccggaagctgcagtggaacatcatcctgctcctcggcgcgggcttcgccatcgccgacgggttcaaggcgagcggcctgacggacatcctctccgaggcgctgggcttcctgcgcggcgcgccggtgctggcggtcgcgcccgtggcctgcgtcttcagcggcgtcatcacggagttcacctccgacgacgccaccaccacgctggtgctgccgctgctcgccgagctgggcaagtccatcggcgtgcacccgctgctgctcatggtccccggcgccgtcggcgcgcagctgtcgtacctgctccccacggggtcccccgggaacgtcgtcgggttcagcacgggctacatcaccatcagggacatggtggtcaccggaacgccgctgaaaatcgtcggcgtcgcagctctgacgatcctgctgccgacattgggttctctggtttttggcatggcatagcagtcttaggagcttgcacaggatacgatcagatgttttgcaatactcggtcgtaaactgcaggtttaaaaccattggacaattagcctactactagtactagtatgttcatcaagctgtacagtgcgtcgtcagtgccattgcgtctcatgcattggcccaaggaggattcggggtcataattaattgttcagctatgagtccggatagatatttttagttaaagattcgatatgcattcatgcatatctggaatttgtatagtatactagtatcctcttgtaatttcaattcgttgcaattttctctaccttgtc

SEQ ID NO: 14754 - DNA, 1019 bp, Sorghum bicolor
  Clone ID: SORBI-28MAY03-CLUS747_1
gccggccgggccgggtcgcgccgccactcccctcccgacccactcgcccaaaaccctagcgctctcgcccgctcgacgccgccgccggagcgagctccccatcttcctccgtcaaccatggcgacccagatcagcaagaagaagaagttcgtcagcgacggtgtgttctacgccgagctgaacgagatgctgacgcgggagctggccgaggacggctactccggcgtggaggtgcgcgtcacgccgatgcgcacggagatcatcatccgcgccacgcgcacgcagaacgtgctcggtgagaagggtcgcaggatcagggagctgacctctgtcgtccagaagaggttcaacttccccgagaacggcgtcgagctctacgccgagaaggtcgtcaaccgcggcctctgcgccatcgcgcaggctgagtccctccgctacaagctcctcggaggccttgccgtccggagggcttgctatggtgttcttcgcttcgttatggagagtggtgctaagggttgtgaggtcattgtcagtggaaagctcagggcccaaagagccaagtccatgaaattcaaggatggctacatgatctcatctggtcagccagtgaatgagtacattgattcggctgtgagacacgtccttctcagacagggtgttcttggtatcaaggtgaagatcatgctcgactgggacccgaagggcaaggttggtccaatcacccctcttccggacctggtgaccatccataccccgaaggacgaggatgagctgcgccctccggtcttggcacctgaggtctaaggtcccaaaagtgtccttgatatggcagtttgatcgggtcctagctaggtttctatcttatgataagggcaatgctaagacagttggttaccttaagctttgtggacagatgctatgtattggtttctgtgttacttttgtttaagctaagttttgccgagacaagctacattgatatgtacctgatgaaattgtggttaccttattgtatgata

SEQ ID NO: 14755 - DNA, 1797 bp, Sorghum bicolor
  Clone ID: SORBI-28MAY03-CLUS7303_1
cccctcgccccccgcgacgcacccccccggccccggatcccgctcacacgccgcgtccctctcatagggagcctcccgatcccgatccttcctccacctccccgacgctggggcccgggccggcgcgtggccggtgcttgggcttggaccgcccccgtcatggatcgcgccgagctcaccaccgagcaggttctcaagcaagatattccatggaagccttacatgtcacctaagcttgtctccggaacatacctttacatgttacggcggtatgaccataaaccgtagagccagcgatcacctctacatgaggagaatgcgcaagcgtatctccgacttttcctgaataaccaccggcccatctctgaccaagtgtctctggaaaacgtgcttgccctcactgatgaaatgcctacaacaaatgctaagcctgcagcacaggtatatgatcaagcacttcctgatgaagatgtacattagcctgactaaaggttgtctggtaaaggtaattaggttcttccctgaagcaggttgtggaaattgactgctgtattgagagaaaggacgtctcttctatttagctccatacctactggaccagcttctcataataattgcagacttacaaaaatacatggtgtatttttatccagtatatcttattgttatttgaatcttgagatcgatgtataataaataataagagccataccatgctcgatgtaataaagtgtccatgggcttgttgattcgttccattgcctctccactttgctcagagaaccatatgttaggacatgcacgaggcaagctgatggcatcaagctgctcattcctttgatatccccagcttccacacaacagtcaattcagctcctttatgaaacttgcctctgcatctggcttttatccttttatgatgctgcagttgattatttgtccaccacaagggttatgccaagactagtagaggttgtcaagggctctactaaagagaaggtggtcagagttgttgtgttgtcctttcgtaatttgctggcaaagggtgcatttgctgcacagatgatcgatcttggattgccacaaatagtacaaaacttgaaagctcaagcatggactgatgaggatctgttagatgctctgaatcaactagaggtgggactcaaagaaaacctcaagaagttgagttcctttgataagtacaaacagcaagttcttcttggtcatcttgactggtctccaatgcacaaagatccaagtttctggcgtgagaacattaacaattttgaagaaaatgatttccagatcctacgagttctcatgacaatcattgacacatcaagtgacaccaccgctcttgccgtggcctgctacgacctctcacagttcctccagtaccatccatctggccgaattgtggtggcagacctcaaggccaaggaccgagtcatgaagctcatgaatcatgagaacactgaagtgaggaaaaatgcgctgctctgtgtgcagaggctcttccttggcgcaaagtatgccagtttcctgcaggcttgagagaaactgagtcttttgtatttagatccagaggacccctggccatttctcagaatgtctgttgagaacgaaaaaccttgaaaattcttttccagtatatcctattgttatttgattcctgaaactgattgtataataaataatcagagccataccatgctcgttgtaataaagtgtccatgggcttgttgattcatttatgtaaattttgaaaaaaaaaattagcaaacctctttttttgtt

SEQ ID NO: 14756 - DNA, 515 bp, Sorghum bicolor
  unsure (1)..(515): unsure at all n locations
  Clone ID: LIB3476-043-P1-K1-F10
ttctaattcaaagagcaaacttacttcaatacatgatgtattgagaggtttagttgattggctctgttcacagctgaggaatcctacacacccgagctgctctattcctacttctatccattgcctctccactttgctaagagaaccatatgttaggacattatttgttcaagctgatggcatcaagctgctcattcctttaatatccncagcttccacacaacagtcaattcagttgattatttgtccaccacaagggttatgccaagactagtagaggttgtcaagggctctactaaagagaaggtggtcagagttgttgtgttgtccttccgtaatttgctggcaaagggtgcgtttgctgcccagatgatcgatcttggattgccgcanatagtacanaactngaaagctcaagcatggactgatgaggatctgttagatgctctgaatcaactagaggtgggactcanagaaaacctcaagaaagtgaagttctttgataagtacaaaca

SEQ ID NO: 14757 - DNA, 1045 bp, Sorghum bicolor
  Clone ID: SORBI-28MAY03-CLUS66801_1
ttcacggtgccggtgatgagcaaccccgggtaccaggtcgccgagcgcctgctccacgcgaagcgctactgctggtggcggcggtggctgctcggcatcgtcgtcggacccccccccctggatgcccgcgacgacgaaccccgcgtacggggtcgccgagcccctgctccacgggaagcgctactgctggtggctgaggtggctgctcgtcatcgtcgtcggactcgccgccatgtacgtgcccaacttcacggacttcctggcgctcgtcgggagcagcgtctgcgtcctcctcggcttcgtgctgccggcctcgttccacctcaaggtgttcggcggcgagatggaatggcccggagtggtatccgatgtcctgctggtcgtgatcggcctcttgctcgccgtgttcgggacgtacacgtcgctgctgcaaatcttccactcgtcaagcgcttgatcgccgcaccttctgctacgcacggaggattaatttccttcctccgcgcactagattcaggtaccttggtcgcgctcctgtgttcagagaagtggattagaggattaggaggaacgaacgccaatctcagcagttcgtcctcgtccatttgggcctgtggatttcgcagagcaggttactgtgcaggtgttgttcgtgagtgacttgtacgggatggggaaggtaaaatctgtacacttttgttacgacagatttcaggtactcccggtatagcaatgtaataggagtgtgtcaatgtgtcctagatgttcctcctgctgtgcacgatggattcgatgaaaggacaagaattttcacttcgtgatcgtgagtggccacatatttggttgcagtgctaatttcacttgtgaattggtcctttgcccctccgaggcagtcctagctgctaggtctaacggacaagttccgagtttgtatcacgattcatgtgtacacttaaatttcggtttccttttcatttgtaaggctattctggattgtatcgctacttgtcaaggtatactcaatccagtccttacgagcaatgct

SEQ ID NO: 14758 - DNA, 2174 bp, Sorghum bicolor
  Clone ID: SORBI-28MAY03-CLUS15334_1
tactggaaaaaaaaaaaaaaaaaaagccacccccgctccttccctgactcgccctcctcggccggcgtctcctccaggcgccggcaggggcatccgatacgacgcagcggcaagccggagcacgctgcggttccttctaaatcccgaggcgcaggcgggcgcctcccccggctctcttttgtcgatgctggtgttctcgagcgacggccacggctgcggcttctagtaggatcaaagagatctgcaactgtaggatatcacagaacaattcttgaggtactcactgcagcctaatcatatggaggagtattcagataggggatcaaaagcagaaattgcatatctcaggaggggttccagattctcttctagaaatcaaagttcagaagagaggactaataatcacagcagcgacaaaccgggaagcagcactagattcaatcctatgaaagcaagaattggcgataatcaagaaagaccaagatatgtgcgtgattcatttaaatcttcaagctcaaaggtggcacctgcaagctcttccaaatttccacttagcaagtttgaggaaaggcgaaggcaacctttcttgccagggtttgacaatgctggaagtagtagaagaaaggttgatgccaagcggctagtgggtagtaagaaaattgctgtagacaatgagagttcagacactctgcaaggtgaatcggaaggttttactaccgaacaagtaccttatccagaaggctctcattttactggtcattcaggtgtttcttcatatacagtcaagtccttggtccaaactgcttcactaagttctaggacacagagacagaaacacaaagaagtgaatatgggtactccaggagcatgttcttcgtctctgactaatgggtcttctatacctggaaattctaccatgggtgtgaggccagcttatggtcatgttagtggagggcaggtacgtggtcttaaaaaccttggttgtacgtcagtgcctgatgctcagccatcaggttgcccatctgagtctgttagtagtaggaggttcgagttcatgagaaagagggcttttgaccaggaaaactcttccagatcaaggagcttaagtttaggtctttcacctcctacagatattcacaatactggtcacagaatcagaatgaatgaacaatcactttctcaacaaataccacaaagaagcagcagaaaccatcaggaaccagcagtttcagttaggacgagacggccttctcctcatgccactaggatgagtgttcctgatgaaagagcagatggtatgctttctctgcatgagtcacccacaagaaatgtacagccagctcaggaacatctttcattggaagaagtctccactgagagttcaataaggccattctttgtggaatttgataataacattttctcatctagtcgtcgccgttgctcgaatactcgagctgaaaggcaattgctggtgctggagactaatctattttttggtgcttttgcctcctatgatcggcatagagacatgcggatggatattgataatatgtcctatgaggaattattggccctggaagagagaataggctctgtaagcacagctctttcggaagagcagttcacgaaatgcctcagaagaagcatatatagtcaagtcgcttcagaagtgagcaaatcaaccgttgatgacatgaaatgcagcatatgtcaggaagagtacatggagggcgaagaagttgggaggctgccgtgcgagcactggtaccatgtgtgctgcattggccagtggcttaggcagaagaactggtgtccagtgtgcaaagcgtcggcagtgccttccaagggttaaaaccgccgaggacgttggaaggcttgtaaactggcgtgtgtccgagagatccatgaactgttatgaacatattatacatgtgaacttgtgaagaataataagtagcatgcatgggccgagttcacggacagtttatgagcatcaaacttcttgttggaactggaaagctattctgctttgcctgtctccttgttcatccgccaccgcttctgggtcgtcgacggcggcatttctgctgccggccgcgccacttgcggggcgggggtgggaagacgcacgatcgacatgggcgctgacgctgcctggagaaaataggggt

SEQ ID NO: 14759 - DNA, 1940 bp, Sorghum bicolor
  Clone ID: SORBI-28MAY03-CLUS5532_1
ccaagattcataagcaaggggttgcgcttggcagatctgtggacctctcaaaattcactgactgcgattaactcaaagcagaattagacaagatgtttgaattcaatggcgaattagtatctgccaacagaagctggcagatcgtttatactgacaatgagggtgacatgatgcttgtgggggatgacccgtgggaagagttctgtagcatagtgcgcaagatctacatctatacgaaggaggaggtccagaagatgaactcaaaatcatctgcgccaaggaaggaggagcctctaacagtgggtgaaggatgcgccgccacaaatgagtaggatttgcctgcctgcagcaagcaattttagataactaggttgtgtgaaggaagccgacgatgcatgatgaactcatcgtgccaggtgcctgggtcccaaccaagtaactcctgaaatcttttgcttgtccgtagcgaggttttagttgtgaacgtagtagaactgtctccatttgcttctccgcagtttgctcttggcagcaagtttaagggccaagtcttattactattgttattgctgatttgctcttctgccttctgatgtaaatatttatgtactcagtcccagcctgtagtaagtagtaagtagcaagcagtggcagtacctttggtattaaccagcagctattcgcggcattttaatcccctgtaagtgtagctctgtagcgcgagataaatggcaaacactggtatatgtatgtctgatcttctcaactgaatgttattataagagttatagaggggaaagcccacactaactttcagcagagacctgctatggatagttggatgccaatgggaaggcgtgaaacggacttcaaggactcacgttccgccttcaaggatgcccgcactgcctctcaatcatttagagatacacaggggttcttcatgcaagcttatgatgacaatcatcaccgtctttctttcaacaaccagtttcaggatcagggttcagctcatcgctttgcggatccatacttctatatggcccaacaaccttctctgactgttgaatcaagcacaaggacacaaacagcaaacaacgacttgcgtttctggggcgaccagaattcgatctatggtaatccaggtgatcaacagcagcagggtttcagctttggacaaaacccatcaagttggttgaaccagccatttccccaggttgaacagccacgagtggttaggcctcatgcaacagttgctccatttgatttggaaaagaccagagaaggcagcgggttcaagatctttgggttccaagttgatacaaccagtccatctcctgcccagttgagctctccattatgtgctatccgggagcatgtggtacaaacccgaccatcggcaccagtgaatgaattgcaacctgtgcaaaatgagtgcttgcctgagggatctgtaagcactgctggaactgcaactgagaacgagaaaaacattcagcaagcccagcaaagttcaaaagatattcaaagcaagtcccagggtgcttcgacaaggagctgcacaaaggttctttggcaaaaggtgacgattgacgattctctcatcgtgccaggtgcctctgtcccaaccaagttaatcctgaaatcttttgcttgtccgtagcgaggttttagttgtgaacgtagtagaactgtctccatttgcttctccgcagtttgctcttggcagcaagtttaagggccaagtcttattactattgttattgctgatttgctcttctgccttctgatgtaaatatttatgtactcagtcccagcctgtagtaagtagtaagtagcaagcagtggcagtacctttggtattaaccagcagctattcgcggcattttaatcccctgtaagtgtagctttgtagcgcgagataaatggcaaacactggt

SEQ ID NO: 14760 - DNA, 593 bp, Sorghum bicolor
  Clone ID: LIB3478-056-Q6-K1-C11
agagcctgcttcatcacctccagttaatccactcccgctttcttctagagtaaaaagacctagacaaaatgctcctccaccttcacctgaagcatctgttctcacaaaagaaagtgcagccaagatcgatattgactctgctcaaacacaacatcaaaattcggtcttgcaaggtcaagagcaaatgaccttgaggaacaacctgactgaaagcaacgactctgattccactgttcaaaagccgatgatgtggtccccatcacccaatgggaaagcccacactaactttcagcagagacctgctatggatagttggatgccaatgggaaggcgtgaaacggacttcaaggactcacgttccgccttcaaggatgcccgcactgcctctcaatcatttagagatacacaggggttcttcatgcaagcttatgatgacaatcatcaccgtctttctttcaacaaccagtttcaggatcagggttcagctcatcgctttgcggatccatacttctatatggcccaacaaccttctctgactgttgaatcaagcacaaggacacaaacagcaaacaacgacttgcgtttctggggcg

SEQ ID NO: 14761 - DNA, 2455 bp, Sorghum bicolor
  Clone ID: SORBI-28MAY03-CLUS185_1
aaaaaaaaaaaatacaacggtcccgcctcccacctcagtacctctacctcacccacccagccatcccccaagaaggcaagaactatctactcatcagccatggcgccgccgtcggtgtcgtcctcccacctcctcatcaccgcctcgctcccaaagcccaagccttcctccctccgcccgccgcggctccctctcgccaagcccctccccacgggtgcggcgctcctcgctctcgcggcctcgcccgcgctcgccgccgacgcgcctacccccgccccggttcccccggctccggctcccgcgcccgagctccaggccgaggcgcccacgccgaccgccaatcccttctccacctccctcctgacagcccccaagccctccgcggcggcctccgacctccccgagggcgcgcagtggcggtacagcgagttcttgtccgccgtcaagcggggaaaagtcgagcgcgtgcgcttcaccaaggacgggggcctgctccagctgacggccgtcgacggccgccgcgccaccgtggtggtccccaacgacccggacctcattgacatcctcgccaccaacggcgtcgacatctccgtctccgagggcgagtccgctggccccggcggcttcgtcgccttcgtcggcaacctcctcttcccgttcctcgccttcgcgggcctcttcttcctcttccgccgcgcgcagggcgggcctggcgctggccccggcgggctcggcgggcccatggacttcggccgctccaagagcaagttccaggaggtgcctgagacgggcgtcacgttcctcgacgtcgctggtgcggaccaggccaagctcgagctgcaggaggtcgttgatttccttaagaaccccgataagtacaccgcgctcggagccaagatccccaaggggtgcctcctcgttggtccgcctgggactgggaagaccctcctcgcgcgtgccgtcgctggggaggctggggtgcccttcttctcctgcgcggcctctgagttcgtcgagctcttcgtcggtgtcggtgcctccagggtgcgcgacctcttcgagaaggccaaggccaaggcgccctgcattgtcttcattgatgagattgatgccgtcgggaggcagcgtggtgccggacttggtgggggtaatgacgagagggagcagaccattaatcagctcttgacggagatggatggcttcgctggcaacagcggtgtcattgtgcttgccgccaccaataggcctgatgtgctggactcggcactcctccggccagggaggttcgataggcaggtcaccgttgacaggccagatgttgcagggcgcgtcaagattcttgaggttcactcccgaggaaaggctttggcaaaagatgtcgactttgagaaaattgctagaaggactcctggtttcactggtgctgacctccaaaacctcatgaatgaggctgccatccttgctgctcgccgtgatcttaaggaaattagcaaggatgagatctctgatgctcttgagagaatcattgctggccccgagaagaaaaatgctgttgtttctgaggagaagaagaggcttgtcgcttaccatgaggctggtcatgcccttgttggcgccctcatgccagagtatgatccagtagccaagatttccatcattcctcgtggacaggctggtggactcacattctttgccccaagcgaagaaaggctagaatctggattgtacagcaggagctatcttgagaaccaaatggctgtagcccttggtggcagggttgctgaagaggtgatctttggccaagaaaatgtgacaacaggagcttccaacgattttatgcaagtgtcacgtgtcgcaagacaaatggtcgaaagatttggattcagtaagaagatcggccaagttgcgattgggggacctggtggaaaccctttcttggggcaacagatgtcgagccagaaggactactcgatggcaactgctgatgttgtggatgctgaggtgagggaactcgtggagaaggcctactctagagcaacgcagatcatcaccacgcacattgacatcctccacaagctcgctcaactcctgatcgagaaggagactgtggacggggaggagttcatgagcttgttcattgacggccaggctgagttgtttgtcgcttgagaattgagatatcacaaggcgtacggctagctagctcgtcgcagtgtatatgcttttgagtgatttgtgcgagagcaatcacaaagggaaatggagagcccagcttgtaggaaccacattgatgtagccaaagatgtttttgcatacctgtatagcactagctgattgtaaaaagcatctactgactttgagcaagtaaaatgtcactgcttacaattatagcacacggttgacctgtctccagtgaaaatagatatgctcatctcatgctactgggctaaaaaaa

SEQ ID NO: 14762 - DNA, 1088 bp, Sorghum bicolor
  Clone ID: SORBI-28MAY03-CLUS19465_1
ggcatagcgaaatccgaaatcttttcacatgccttagtggaacgaccacgcatgtccaattttaaacggtcccaaccacacccttaaaacggtcccaatatggagttgctcttactaaataaacttccactactagtggaccgcatgcgccctgaacagcactaaccagcaaccacgaaaatcaccgacaatacacagttactatcaccaacacaactttgcacattaccattggcaaaataaatataaagtgcagaccatatcaagttactgtgaagagatagcagctaggacaagacctcttcagacttcaagggagattcgcaagatggaggggaagagcaggctgccggaggtgaccatcgtgccggcggcaaggccgttggctggcgacggcaccatcgacgcggcgaaggcagcggcagcgccgggcaaggagcccatcagccctggtactccgtcctcggcggacgccggccgccgcggcaaagagaggcgcgcggtggaggccgtcccgctccctgggtggaagctcgacgccctctgccaggagtcttgcccgtcgccgaccatgagggcgcgcttcccctacttctgaagcttcccgttgcagtcctgcatgagtttcgtttcgagcggcaacattgcatcttgtgctttggacgtctgactgatggcgttcttgggtgtttgcttgctcaggatttttctttcgtgcatcagtgtatccacatgcatgtattatgtatatatatgtattatgagtataaagatctgtgagctttgtgtcagattgcacagcacagatgatgaaccatcagttgattccaccaaaagtgattgccatgtggatttgctcacatcaggaacttggatggcggtgtcctggccgccctgggccaggcacacaacggccgcgccccgggatcgcgggacggcggtgcggagcgcgctccacgtcggcgccgggacgcctcggcggagcgcgaggcggggcggggcgacggtggcggccggggaaggcgacggcgacgcgggcgcggcgacggcgacggcgaggcgggaggccatcgcggtggatggacggg

SEQ ID NO: 14763 - DNA, 1759 bp, Sorghum bicolor
  Clone ID: SORBI-28MAY03-CLUS14310_1
ccgggcccaagagcccaaggcagctgagagcctcctccctcctccctcaggtagcgagagagcgagctcctctgccctctgcacctacaggcctctctccttcgttcctcctccactccaggaccgccgtttctccattattgactgctcgatccgtgtgctacctagagcagcaagagggagaagcaagcaagagggagatcgatcgagatggctttcctcaacatggagcagcagacctgggccttcacctttggtatcctaggtaacataatctcactgatggtgtttctttcgccactgccgacgttctaccgcgtgtaccgcaagaagtcgacggagggtttccagtcgacgccgtacgtggtgacgctcttcagctgcatgctgtggatcttctacgcgctgctcaagtccggcgccgagctgctggtcaccatcaacggcgtcggctgcgtcatcgagaccgtgtacctgggcatgtacctgctgtacgctcccaaggccgcccgggtgctgacggccaagatgctgctggggctcaacgtcggcgtcttcggcctcgtcgcgctcgtcaccatggtgctctccaatggcggactccgcgtcaaagtgctcggctggatctgcgtcagcgtcgcgcttagcgtcttcgccgcgccgctcagcatcatgcggcaggtgatccggaccaagagcgtggagttcatgcccatctcgctctccttcttcctggtgctcagcgccgtgatctggttcgcgtacggcgcgctgaagaaggacgtgttcgtggcggctcccaacgtgctgggcttcgtcttcggcctcgcgcagatggcgctgtacatggcgtaccggaacaagaagcccgccgcggcggcggtgatcatggtggaggaggtgaagctgccggcggagcagtacgccagcaaggaggtggcaccacccgccgcggcgcacgagggcagcagggcaagctgcggcgccgaggtgcaccccatcgacatcgacactctgcccgtggccgacgtcggccgccaccacgactcgcaggccgtcgtggtcatcgacgtggacgtggagcctgcagccacctgcgccgccgcggcggcagcagcaggaggagttagaggtgacggtgcggccggcgtggtgacggcggggccggagcagccggcggcgatgaagcccgtcgacatggccattgccgtggaggcctaggatggttaaaagtctagtagctagtagcagagtgagtcgatatcgatcacagttcagtagtaaaaaatttctcaaggaagggcaatggcctgctactactacgctacagcagcggccagatgtactggctgcatgcatgcaggcccgttgacctgtcaagatggaattgcatggaagtagccggggacctagctatttaggcgagtagcgccttggcacccacgggctagccgtactggcctgtgtgatgaactggctggagatactagagattgagatgagataatgcgagcgagcgagcgacagggttaattggttcatcagattcagaactcagaaagacggctagctgctaggctctctgtctgtctctactagatctctctgtgtgttgtgtgtgtgtgtctgtaatcgattcccatcagcttgctgccgccctgtgtgtcctacagtagtagtctgatgattgttttcattccattcatgccgtcacagtaatcacctaggaatggacgattcaaaaaaaaaaaaaaaaaaa

SEQ ID NO: 14764 - DNA, 782 bp, Sorghum bicolor
  Clone ID: SORBI-28MAY03-CLUS1286_2
gccggccgggctgcgacccagaatccgcgaaccacagacgcacacaacaccactcaagcttgctgctgcactactgccgaatcgtacgtgagacacatggctgctccgaagggcgcgacgctggcgctggccgtgctcctggcggcgaccgtggtggctccgccggccgcggtgcgcgcggcgatgtcgtgctccacggtgtacagcacgctgatgccgtgcctgccgttcgtccagatgggcggcatccgcagcctgctggcgcaggccaacaacaccccggaccgacgcaccatctgcggctgcctcaagaacgtcgccaacggcgccaacggcagcgacacctacatcaaccgcgccgccgcgctgcccagcaagtgcggcgtctccctgccatacaagatcagcaccaacgtcaactgtaacacgattaactgaggcgtcgtcctgtgcgaggaatgcatcatggctgattgagagtaataaaataatgctactggtttggtatttgaagctagatcgagtctgggctagatcgagttgtgcctgtgtctcgagtcatttatggtgtttaggaatcgtctacacagtttgtaaccgtgtgtcgtggatgcatgttgccgcgagcagagtagccatgaactggtgtgtgccggtgtgccctgctgtgtaatttctatgtaatgtgttggtgcttcgatccagatgtataccctcgaagtcttggaaatgttagattgttgcagtatcattaccgaaaaaaaaaaaaaaaaaagccccta

SEQ ID NO: 14765 - DNA, 802 bp, Sorghum bicolor
  Clone ID: SORBI-28MAY03-CLUS1286_1
gccggccgggccgggacaccagaatccgcgaaccacagacgcacacaacaccactcaagcttgctgctgcactactgccgaatcgtacgtgagacacatggctgctccgaagggcgcgacgctggcgctggccgtgctcctggcggcgaccgtggtggctccgccggccgcggtgcgcgcggcgatgtcgtgctccacggtgtacagcacgctgatgccgtgcctgccgttcgtccagatgggcggggccatgccgccgcagccctgctgcggcggcatccgcagcctgctggcgcaggccaacaacaccccggaccgacgcaccatctgcggctgcctcaagaacgtcgccaacggcgccaacggcagcgacacctacatcaaccgcgccgccgcgctgcccagcaagtgcggcgtctccctgccatacaagatcagcaccaacgtcaactgtaacacgattaactgaggcgtcgtcctgtgcgaggaatgcatcatggctgattgagagtaataaaataatgctactggtttggtatttgaagctagatcgagtgtgggctagatcgagttgtgcctgtgtctcgagtcatttatggtgtttaggaatcgtctacacagtttgtaaccgtgtgtcgtggatgcatgttgccgcgagcagagtagccatgaactggtgtgtgccggtgtgccctgctgtgtaatttctatgtaatgtgttggtgcttcgatccagatgtatcccctcgtggtcttggaaatgttagattgttgcagtatcataaaaaaaaaaaggccccta

SEQ ID NO: 14766 - DNA, 321 bp, Sorghum bicolor
  Clone ID: LIB5052-002-A1-XP1-C4
ccggccgggctgcggaactggtgtgtgccggtgtgccctgctgtgtaatttctatgtaatgtgttggtgcttcgatccagatgtatcccctcgtggtcttggaaaaaaaaaaaaaaaaaaaaaaaaaaaaaaaaaaaaaaaaaaaattactgtgatttaggaaatgaaaaatcaagctaagctggaatcatatattactacttccgtcttcgtcttgttgggttgtgacgatttacaagaaccttttacttgccggtgatttctggaaatcgagaagttcatcatatttcctcacaaaaaaaaaaaaaaaaaaggccccta

SEQ ID NO: 14767 - DNA, 1429 bp, Sorghum bicolor
  Clone ID: SORBI-28MAY03-CLUS4298_1
aaagagaaggtgagagtggattcgacaagagggggaaaaaaaacaggcctgtgcgagagagaggcgagggcaactcaggcgacgcgatggcgatggcggcgctgcgacgcgaggggaggcgcatcctcctctcccccaccgtccccaacccgtctccggcggccgcttccgctgcggtgacgcgatcctccgccatctcgcaaccggagatggctccacttggtgcacggtctatttcaactcaagttgtgaggaaccggatgaagagtgtcaagaacatccagaagatcacaaaggctatgaagatggttgcagcatcaaagcttcgtgctgttcagacgaggactgaaaattcacgtggcctgtgggagcctttcaccgcccttcttggggatgctcctagcgttgatgtcaagaagaatgtgattgtggccattacctctgataagggactctgtggtggtattaattcaacatcggtgaaagttagcagggcccttcacaagttgacatctggtccagaaaaagaaagcaagtttgttatattaggagaaaagggaaaagttcagctggttcgtgactcaaggaacagcattgaaatgactgtaactgaactacagaagaatcctatcaactatacacagattgctgtgctggccgatgacatattgaaaaatgtggaatatgatgctctgagggttattttcaacaagttccattctgttatatcatttaagcccacaatggtaacaatactgtcccctgaggttgcagaaaaagaatcagaagctggtgggaagatgggtgacctagattcttatgagattgaaggcggcgagacaaaatcagagatattgcagaatctagctgagttccagttttcttgtgttctgtacaatggtgccctagagaatgcatgcagtgagcttggagcccgtatgtctgccatggacagctccagcagaaatgctggcgatatgcttgatcgtctaactctcacttacaacaggacacgccaagcatccatcactacagagcttattgaaattatatctggtgcatcggcccttgaaggatagagactggactttttcccgtttgtgttcctctcccatgaagctgcttttcttctgaggctcagtttcaaccctttctatttcacttttccttgagaaacgtactcatgctttgttgcaataattaggccaacgacaatgatggtgccatgcgcccttggcacattgcagaaagaatgttaaacagctatggtgaatggctggttttcataaatgatgatgatcaatatatgtatttttgcacatgattagcaagttcatgttgtattgatggggtgactaatgcctgccaaattgagcgatataacgatatataatgcgtcattaatgacatttgttcgatctgaacttcc

SEQ ID NO: 14768 - DNA, 1536 bp, Sorghum bicolor
  Clone ID: SORBI-28MAY03-CLUS2086_1
cgtccgatcctcccaagctcgaaaggcttttttcgtcctcttattaccagtaaattaaaattaccaaagcaaagcaaaaggctagagttacatacagcctcggccactgcaaaaaccatcacggcgcagtagcacatattttacacgtgtacactttctgtcttggcactctgacacgggtgcaccacacgtcggctgagaccaactacgaacatgccctaggaaaaaactgtcaccggctgccggcgccggccacggtgggcatcgatcaggccgtcacgccaagccgacgagcttctcgctgatctcccacagcttcttggccttgtcggagtcgctggcctcctcggagagctggttctcgaaggacgccgagttcttgttccagctccagtacacgccggacttggtcaggctggggtcgctcaccacctgcgccagccgcttcccggcctcctcctcggagacgtaccccttggtgatgtacttctggaacggcgggaagagcagccggaacagcgggatgtgctcgcggaacaggcccgtggtggcgatgcagcccgggtagagcgacgcgaaggtgacgcccgtctcctcgtggtaccggcggtggaactcctgcatcgtcagcatgttgcacaccttgctgtccttgtacgccttggcgccgtcgaactccccgccgtcgatcatcaccgagctgccaatgccgttgaggccgccggcgaggccgcgcaggtcacccaggttcgccttcggcggcacgttccccgccagcgtgttcgtgttcccggtgatggagccgacgatgatgaggcgcttggaggggtagtcggaggactggaggtcgctgaggagctcgcgggcgaggaggaagtggccgaggtggttgacgccgacgctcatctcgaagccgtcggcggtgtaggacgggtccgtggcggtgggccggtacacggcggcgttgcagaccacgacgtcgatgggcatctccagctggcgcacgttctcgacgaactgccgcacgctgtcgagggaggccaggtccaggtgcatgatggtgtagctgccgtccgccatgccggcgcccttggccgcccgcgccgccttgaggaagtcgcggcaggccatcaccacgtgccacttgccggtctccgccagcgccttggccgccgcaaggcccagacccgacgacgcgcccgtgatcaccacacgccctgccgcaccgtcttcttcccgtccttggtcgccgtgctcgaccccggcgtggccacaggcgccgtcgccacctgcgtcctcaccgacagcgacgccgcctgcagcttcttctgggggacgctgaggaatgccgtgtccttcaccgcggcggcgaggctgcccttcttggggacggagagagtggaagggaggagcgccgcctgaagggccatggccgatgcggggaggctggagccgagttgagctgggcgacgacagcgatcgagatgcgctgctgtctgtggcgaagtgactctgttcggaggcggtcctcgtgct

SEQ ID NO: 14769 - DNA, 298 bp, Sorghum bicolor
  Clone ID: LIB3476-046-P1-K1-C5
aatcctcagtcctcactcaggctgctctctctcagctcgtgctctctcgatttctccgctcgacatggcgctccaggcggcgacgtccttcctcccctccgccctctccgcgcgcaaggaggggtcggtcaaggactcggcgttcttgggtgttcgtctcgcggatggcctcaagctggagaccactgctctcggcctacgcaccaagagggtgagcacgtcggtggccatccgcgcgcaaacagcagcggtgtccttcccatcagtgacccccgcgtcgccgtcaggcaagaagacc

SEQ ID NO: 14770 - DNA, 960 bp, Sorghum bicolor
  Clone ID: SORBI-28MAY03-CLUS5953_1
ctgtgcggcgctcaggcggcaggttcgatagagattggaacgcctgatcccttccggcggccgggcctggcaccccgagcaggaggcggacaaggtaagcagccgcagcagccggaaccctagcgccgccgccgcatccgcagccatgggtatcgacctcgtcgccggtgggaggaacaagaagaccaagcgcaccgcgcccaagtccgacgatgtctacctcaagctcctcgtcaagctctaccgtttcctggttaggaggaccaagagcaacttcaacgctgtcatcctcaagaggctcttcatgagcaaaaccaaccgcccaccaatttccctgcgccgccttgtcaagttcatggaaggaaaggaggagaagaacattgctgtgattgttggcacagtcacagatgacaaaaggatccaggaggttccagcaatgaaggttactgccctgaggttcaccgagacagcaagagccaggattgtcaatgctggtggggagtgcctcacatttgaccagcttgctctccgtgctccacttggcgagaacacggtcctcttgaggggccccaagaatgctcgtgaggcggtgaggcactttggcaaggctcctggcgtgccgcacagccacaccaagccatatgtgcgctccaagggaaggaagttcgaaaaggctcgtggcaggaggaacagccgtggattcaaggtttaaaaaagttgttttgtggtccttgtgcgtgttgccatcagcatagtgcaaccgttctgtttgatcaatcgacagtaattagtaatcactttctaccgagagtagtagcacaatttgttgtcctggtttgaattttgaaagatatttgaaggatttcgtcgccttatctactggttactggttgagcaagaagacaatgatctgttgcacctcttatcagagccttgcatcttaaaaaaaaaaaaaaaaaa

SEQ ID NO: 14771 - DNA, 479 bp, Sorghum bicolor
  Clone ID: SORBI-28MAY03-CLUS5395_3
ggagaactagatgacacagctgctttcaagaactttaataagtatggttcaggcttttgatgtacctcacagatcaccgttgcctcctgcatattagtcataccagtcatttttatgtgaaaagtataggtttttctactgtattgccaatcataacgaccactgtttttcatgtacaggtggggtgacattgagttccctctaccttttggaagagttctcagtccctcagaaagctttatccacgaactggatgagaagacaagtgcttctctgaaattcacagtactgaacccaaaaggacgcatttggacaatggttgcaggtggtggtgctagcgtcatatacgcggatactggtggtgatttgggatatgcttcagagctaggaaattatgcagagtacagtggagctcctaaggagggagaggttctgcagtatgctagagtacttctggattgcgctactggtgatcctga

SEQ ID NO: 14772 - DNA, 1633 bp, Sorghum bicolor
  unsure (1)..(1633): unsure at all n locations
  Clone ID: SORBI-28MAY03-CLUS5395_1
gcacgcgcgaatcccgaacagcaccggtcgtcgcccgctcgctcgttgcagctacgcacgcacgcacgcacggcaccccacctactcctcctccccttcccttagcttccagaaggcggttcggctcgggccggcggcgatggcgcggaagaagatccgggagtacgactccaagcgcctcctccgggagcacctcaagcgcctcgccggcatcgacctccagatcctctccgcgcaggtcacacagtcaacggatttcaccgagcttgcaaaccaggagccatggctctcatctatgaagttggttgtgaaacctgacatgctcttcgggaaacgtgggaagagtggacttgtggccctcaacctagatcttgcccaagttcgccaatttgtcaaggagcggttgggtgttgaggtcgagatgggtggctgcaaagctccaattacaaccttcatagttgagccatttgtgccgcatgaccaagagtattacctttcgattgtatcagaaaggcttggcagcaccattagtttctcagagtgtggaggtattgagatcgaggagaactgggacaaggttaagactatctttcttccgacagagaagcaaatgacacctgacgcatgtgctcctttgatcgccaccttgccattggaggtccgcacaaaaataggtggtttcattagaggtgtattttctgttttccaagacttggatttctcatttcttgagatgaacccattcaccttggtaaatggtgaaccgtatcctctggatatgagaggagaactagatgacacagctgctttcaagaactttaataagtggggtgacattgagttccctctaccttttggaagagttctcagtccctcagaaagctttatccacgaactggatgagaagacaagtgcttctctgaaattcacagtactgaacccaaaaggacgcatttggacaatggttgcaggtggtggtgctagcgtcatatacgcggatactgttggtgatttgggatatgcttcagagctaggaaattatgcagagtacagtggagctcctaaggaggaggaggttctgcagtatgctagagtacttctggattgcgctactgctgatcctgatggccgtaagagagcccttcttatcggaggaggtatcgctaacttcaccgatgttgctgcaacatttaatggcatcattcgggctttaagagagaaggaatccaaattgaaggctgcaaggatgaatatttatgtccggagaggtggtccaaactaccaaactggactcgctaaaatgcgcaccctaggcacggaacttggcgttccaattgaggtctatggaccagaggccaccatgactgggatctgcaaagaagccattgattgcatcatggccgcataaatcacaatgtagttgtgcttgaagttgcatccgttttgtaccagacgttcaatgtaagcgattgttccggtaaaacagagaacgatcattgtcatgagtaaactcggcctttgtaacacaatttatgcaataatcaagatcttggtttggggggctctgtcgcccttctatggggagccggtgaggtgtgaacgtataatgcacttgtgatcccaangattgaag

SEQ ID NO: 14773 - DNA, 560 bp, Sorghum bicolor
  unsure (1)..(560): unsure at all n locations
  Clone ID: LIB3476-021-P1-K1-B2
cccacgcgtccgcgaatcccgaacagcaccggtcgtcgcccgctcgctcgttgcagctacgcacgcacgcacgcacggcaccccacctactcctcctccccttcccttagcttccagaaggcggttcggctcgggccggcatcgacctccagatcctctccgcgcaggtcacacagtcaacggatttcaccgagcttgcaaaccaggagccatggctctcatctatgaagttggttgtgaaacctgacatgctcttcgggaaacgtgggaagagtggacttgtggccctcaacctagatcttgcccaagttcgccaatttgtcaaggagcggttgggtgttgaggtcgagatgggtggctgcaaagctccaattacaaccttcatagttgagccatttgtgccgcatgaccaagagtattacctttcgattgtatcagaaaggcttggcagcaccattagtttctcagagtgtggaggtattgagatcgaggagaactgggacanggtaagactatctttcttccgacagagaagcaaatgacacctgacgcatgtgctc

SEQ ID NO: 14774 - DNA, 1489 bp, Sorghum bicolor
  Clone ID: SORBI-28MAY03-CLUS1288_1
gccccaggaccaggaggaaatggctgccctctctccacgtctccacggccacgcccgcaggcagcagcagtcctagtcgtctctctctctctctccccgctctgcctcggcttcccgccggcgggaggatgaaggtcaccgtcgtgtcccggagcggccgggaggtcgtcaagggcggcatcgacctcaaggactcggccaaggtcgcggatctgcaggaggccatccatgccaggacaaagaagtattatccttctaggcagcggctcaccctccctcttcaacctggaaaaggtgggaagccagttgtcctcaatccaagggccagcctgtcagaatactgcgagaagggttctggatcattgacagtggtcttcaaagatttaggaacacaggtctactacagcacgctgttcttctttgagtacttgggtcctctcatcatctaccccatgttctattatttgcccgtctacaaatacttcgggtacgagggagaacggatcatccaccctgttcagacctacgccatgtactactggtgcttccactacttcaagaggatcatggagacattctttgtgcaccgtttcagccacgcaacatcaccccatgtcaaatgtcttcatggggatgggtgaccacaggaccttcggcgcttacattgcttactactgcaaccacccgctgtacaccccagtaagtgatctgcagatgaagattgggttcggtttcgggatcatctgccagattgcaaatttctactgccacatcctgctgaggaacctcagaagcccaagcggcagcggcggttaccagatccctcgtggcttcttgttcaacatcgtgacatgcgccaattacaccactgagatctaccagtgggtcgggttcaacattgctacgcagactgtggcaggttacatcttccttatcgttgcagcagctatcatgaccaactgggcgcttggcaagcacagccgtctgaagaagctttttgatggcaaggatggaaggcctaagtatcctcgccgctgggtgattctccctccattcctgtgaacaggtggtggctgttggtcggcccattgggattcaatgtttacagcatccccagcacacagaagttccaattcttgaatgtcatgcgaacaattgtactaatcacgcctttttaggggttgaacttcgactttgttgtccaaaatttctaatccgaaaaattggagcgtgaccctccacagagctcagcccaccatcgtagcttcttaatgagaatacctatgaggtcgacgcagccaattcaagcatacaaaatcgccgtttaactgctggggaacaatataggtgttgtaaagtgacagcaaggtatgcataccgctagagaattttggaacattctgcgcgtgcccatctgatatcatgagctgcaattaccatgcttgtctcagatattattatagaaccgatctttgtacacggctcattc

SEQ ID NO: 14775 - DNA, 283 bp, Sorghum bicolor
  Clone ID: LIB3481-019-P1-K1-G10
cgtccggaagcacaccgatgcttcaataaggaactaaaaattgggcaaaggatgatgacaatatctacagttggtgttcctaatacgagtgaagatgctagcgtctcataagcttcagtcaacactggctgtcagtctgcatgccccaaatcagaagctgcgggagacaattgttcctagtgccaagtcttaccccttgggagcactgatggatgactgcaagaaatacttccttgaaactgggcgcagagtatcctttgagtacactctgctagctgggatc

SEQ ID NO: 14776 - DNA, 2409 bp, Sorghum bicolor
  Clone ID: SORBI-28MAY03-CLUS5552_1
gcgcgtagctcgcactagcattttcaggcggcttcttcttcctcccgtcgtcgcccccgcagatcccgcaccgaccgaccgatccccttccccttcggcgcggcgcagagccgagtcgaccacgaccacgaggcgtcgtcgcggagcagtcggagccattttcgctgctccccaaccccacctccggccaaatttgtcaagttactgtcgatgctccagatatagtgaaaaactatgggcgaagttagtgatgataattccaacatgtcctttctaaatagaatcgctacaagtgttgtaccgctgtagaaagagtagaagggggctggaaattctgggataaactataaaggctttgaagagctttgccaaaatgatcaagcaaataaggaggttcagcaatcactatcaaaggccgcgaaagcagcgaggctcgagaaattcgaggtgccagcgaagatcatgctgttgcctgaaccgtggacaccggagtctgggctggtgacagcggcgcttaaactgaagagggagcagataaagaccaaattcaaagacgatttggacaagctctaccactgaagaagcgacagagggtggttttgcacctatgcgtccagaaagcttgtgttgccaaaagctccctggatgaaactttactgacctgcacgagtggtgtttgtgcgtgtatccttgccgatacacaggagcttgttcttctgtttctgtgaggaaaaataagcccagtgttggaacgatcttgatttgtatagcttcacgtcgtgggattttaattttgttctagcgatagaggatgttcaatttcacccccgtttacggccagtgttccttttcacttatgagttatgatatgacgctaaggatagtgtaaattatgttttttccggacatcattgtctttcactgaagtagaggtgctaggcaagacatctcatgttgatgcaagattaccttcaagctctgatactgcagttatcatgtatacaagtggaagtactggtcttcccaagggtgtaatgatcacacatggcaacatggtggctacaactgcagcagtcatgacaatagtcccaaaccttggcaagaatgatgtttatctggcttaccttccattggctcatgtctttgaactagcagcagagactgtcatgttagcttctggtactgctattggatatggttcagcattgactatgactgatacatcaaacaagattaagaaggggacaaaaggagatgtttctgtactgaatcctactcttatgatttcagttcctgcaattttggatcgtatcagagatgcagtgtttaagaaagttggtgagaagggtggcctgacaaaaaagctgtttgattttgcatataagcgaaaccttgcagcaattgaggggagttggtttggatcttgggcaccggagaggatgatatgggataacattatttataaaccaataagggcaatgcttggaggacgggtaagatttgttctttgtggtggtgcacctctatcaagtgacacgcagagatttatgaatatatgtctaggtgtcccagtgggtcaaggctatggattgactgaaacttgtgctggagcagctttcactgaatgggatgacacaagtgtgggtcgtgttggtccaccgcttccttgctcctatgtcaagcttgtttcgtgggaagaaggtggttataggatttctgattctccgatgcctagaggagaggtcgtggttggtggacacagcataacaaaaggttatttcaacaacgaagcaaagacgaatgaagtatacaaggttgatgagaggggcatacgctggttctacactggtgatattggtcagttccatcctgatgggtgccttgagattattgacaggaaaaaagatatagtaaagcttcagcatggagaatacgtgtctcttggcaaggttgaatcggctctagcaacaagcaattatgtggagaacatcatggtttatgccgatccatttcatagttattgtgttgccctggttgttccggcacaccaggccttggagaagtgggctcaaaattctgggataaactataaaggctttgaagagctttgccaaaatgatcaagcaaataaggaggttcagcaatcactatcaaaggccgcgaaagcagcgaggctcgagaaattcgaggtgccagcgaagatcatgctgttgcctgaaccgtggacaccggagtctgggctggtgacagcggcgcttaaactgaagagggagcagataaagaccaaattcaatttcacccccgtttacggccagtgttccttttcacttatgagttatgatatgacgctaaggatagtgtaaatgatgttttttccggaccttttttgcttggtatcatcttctatag

SEQ ID NO: 14777 - DNA, 410 bp, Sorghum bicolor
  Clone ID: LIB3476-007-P1-K1-G5
ggtttatgccgatccatttcatagttattgtgttgccctggttgttccggcacaccaggccttggagaagtgggctcaaaattctgggataaactataaaggctttgaagagctttgccaaaatgatcaagcaaataaggaggttcagcaatcactatcaaaggccgcgaaagcagcgaggctcgagaaattcgaggtgccagcgaagatcatgctgttgcctgaaccgtggacaccggagtctgggctggtgacagcggcgcttaaactgaagagggagcagataaagaccaaattcaaagacgatttggacaagctctaccactgaagaagcgacagaaggtggtttgcacctatgcgtccagaaagcttgtgttgccaaaagctccctggatgaaactttactgacc

SEQ ID NO: 14778 - DNA, 2010 bp, Sorghum bicolor
  Clone ID: SORBI-28MAY03-CLUS1340_1
cctaccgcaccactcttgtgtcctcctaaaaccctaacccctccgccgcccctcggcctaccagcagctgccgccgccgccatcagccggcgagatggcgctgtacctgctgttcgagtcagcctccggctacggcctcttccacgcgtacggcatcgatgagatcgggcagagcgtggaggccgtgcgctcctccgtgctggacctcgaccgcttcggcaaggccgtcaagctcaccgccttcaaccctttctcctcggccgtcgacgcgctcaaccagtgcaacgctatctccgaagggatcatgaccgatgaactgaggagctttctggagctgaacctgccgaagcctaaggagggaaagaaggccaaatacagcctcggcgtcgtcgagcccaaggtcggctcccacatctccgaggtcaccggcatcccctgccagagcaacgagttcgtccaggaactcctccgcggtgtccgcctccacttcgaccgtttcatcaacgagctcaaggattctgacttggagaaggcccagcttggcctggggcatagctacagcagggccaaggtgaagttcaatgtgaatcgtgttgacaacatggtgatccaggcaatctttctgttggatacacttgacaaggacatcaattccttctccatgagagtcagggaatggttctcatggcacttccctgagcttgtcaagattgtgaatgacaattacctatatgccaagcttgctaagttcattgtgaacaaatctgatttggcggaaaaagatattccggctttggctgatatagttggtgacgaggacaaggctaaagaaattgttgaagcagcaaaggcttcaatgggccaggatctgtcaccagttgatttgatcaatgtccagcaatttgcccaaagggttatgaacctgtctgagtatcgtaaaaacctttatgaatatcttgtgactaagatgaatgatattgcacccaacctcacatcgttgattggtgaagtagttggagctcgcctaatctctcatgctggcagtctttcaaaccttgctaagtgcgctgcttccacccttcaaatacttggtgctgagaaggccctattcagagcactgaaaactaaaggaaacacaccaaagtatggacttatattccactcctcctttattggtcgtgcttcaaccaagaacaagggcagaatggctcgttacctggcaaacaaatgctcaattgcttcacgcattgactgctactcggaggctagtacctctgtctttgggcaaaagttgcgcgagcaagtcgaggaaagactggaattctatgacaagggtgtcgcccctcgtaaaaaccttgatgtgatgaaagccgctattgacagtatggtcaatgacacctcaatggatgatgataaccataagactgatgcatctgccaagaaaagcaagaaaaagaagaccaaggctgaggctgatggtgatgcgatggatgtggacaagccctcccacgttgctgatggagaagccgaacctggaactgagaagaagaagaagaaaaagaagcataagctagaggaggcacaggaggagaacggcgcagcacatgctaatggtggcgctgaagagaccgagacccccaagaagaagaaaaagaagagccgtgaagtttctgaagaagctgaacctaagacggccactgaggggaagaagaagaaaaagaaggccaaggctgaggatgacgagtagccaagtgatttgttgtattgcgtatgaatccaagagtatttgttgaaaaccgagataaacacctagcttctagttcatgaggcgtttgatgcaatccaacacaactatgaagttttcctatcgtcgtgcttgtatcttttttattggataggctagttaactctaatgactgcgtatgatcacgctgcaaaacagcagaaccaaacagaagccctttggtgtacgattgttgagtgcgaaaactgagattggaaagcatcttc

SEQ ID NO: 14779 - DNA, 1730 bp, Sorghum bicolor
  Clone ID: SORBI-28MAY03-CLUS1405_1
gttatcttggccctccacacccaccatcccattcagtttgcctctcttcttctcttcaagtcccagccacaaggcttggactcttggagggaagaagacaagcttagccaaagaacaaacgccgccggcacgcacgcagagatggcgatctgcagcgcgcacactaccaccacctccctgcactccccatgcacgaccaccgtctccaacgcagctggcttcagacagaggcaagtcattttcttcaccagcagcagcaaccgtaggagctgcggcggcggcggcggcggcagaaggcatcacggaggggcacggaccagctgcttccaggtctcatgctccgtcgacaagccggtggtgattggcctggcggcggactccgggtgcggcaagagcaccttcatgcgccggctcaccagcgtctttggtggcgccgcggtgccgcccaagggcgggaacccggactccaacacgctcatcagtgacaccaccacagtgatctgcctcgacgactaccattccctggacaggaacggcaggaaggagtacggtgtgaccgccctcgacccaagggccaacaactttgatctcatgtatgagcaggtgaaggcgatcaaagatggccaggcagtcgagaagcccatctacaaccatgtcactggcctcctcgacccgccggagcttatcacgccgccaaagatttttgtcattgaaggtctgcacccaatgttcgatcagcgtgtgagggacctcttagatttcagtatctacttggacatcagtgatgaagttaagtttgcatggaaaatccagcgggacatggcagagcgtgggcacagccttgaaagcatccaagccagtatcgaggccaggaaaccagattttgatgcttatattgatccgcagaagcagtatgctgatgctgtgattgaagttctgccgacccagttgattcccggtgacaatgaagggaaggtgcttcgtgttaagctcatcatgaaagaaggggtgaagttcttcaacccagtttatctctttgatgaaggatcgagcatcagctgggtgccttgtggaagaaagctcacatgctcttaccctggcatcaaatttgcctatggcccagacacttactttggaaaggaggtatccgttctggagatggatgggcaatttgacaaactagatgagctcatctacgtggagagccatctaagcaacctctcgaccaagttctacggagaggtgacacagcaaatgctaaagcatgcagacttcccaggaagcaacaacggaactggtctcttccagaccatcattgggctgaaaattagggacctctatgaacagattgttgctgagagggctggtgtaccggcggaagcagccaaagtttaatgatgcatgcattcagatctcctatcctaaaactacagctcttcaagctcaatgagaacaaccaccttcacatctcttcttgtaattagttcggatatatggcaagctaggaggaggtagaagaaatgtcattgcagaaactcaggaaaaccacgtgcaatgaaatttctagaaatccctctccttggagggcggtcttatataatcgcttcttcacttgtttagacgtatatcttcttccatacttcattgcagaattgaaagaaattaaaataaaagtgcctactactatcaagtgtaggaatttgaattcatccatacttgtattgttggtt

SEQ ID NO: 14780 - DNA, 1411 bp, Sorghum bicolor
  Clone ID: SORBI-28MAY03-CLUS9288_1
tactggagtgcaccaccagcaaagggctttgtagtatctgcttagcccggccttctagtggtagactagtagtagcaagtagcaacacgacgcgcgcggccggccggcgagaatgatgagcggcagccgtgtattattcgtcgtggccgccgccgtgggcgtgctgctcgccgccgctgccgtctcctcgaggcccgtcgtcgtgcctctggctactggccgccctggtgccggcggtaacgacgagctgtccgtgtacttccacgtggagtcgtgcccgcagctggagacgatcgtgcggtccgccgtggacgcggcgctccagcagaacgtgcggctgacggcggggctcctccgtgtgttcttccacgactgcttcccgcagggttgcgacgcgtcgatcctgctggacaacggcgagcgcggcctcccgcccaacgtcggtctgcagcaggaggccgtgcagctggtggaggacatccgcgccaaggtgcacgcggcgtgcgggcccacggtgtcgtgcgccgacatcaccgtgctggccacccgcgacgccgtgagcctgtccggcgggccctccttcacggtgccgctggggcggctcgacagcgtggcgccggcgtccagcaacgacgtgttcacgctgccgccgccgacgtcgaccgtggacgcgctgctgtcggcgttcgccagcaagaacctgtcggacccggcggacctggtggcgctgtcgggcgcgcacacggtggggaaggcgcggtgcagctcgttcggcgacgtggcggggccggccaccgacgacatcacccggtgcgtgacggccacgtgctccgcggccggcgccggcgacacgctgcgggacctggacttcctgacgccggcggtgttcgacaacctctacttcatcgagctgacgctgaagaagaacaagggggtgatgctgccgtcggaccagggcctggccacggacccgcgcaccagctggctcgtccagggcttcgccgacaaccactggtggttcttcgaccagttcgggacctccatggtcaagatgagccagctcaagggaccgcaggggaacgtcggcgagatccgccggaactgcttacgcccaaacaccaacagcgatgtcgatatcgccgccgccactgcttgagtgctccgaccgacctcggatccatccaccgccagtgtcagtgtcactcctgtgtgtgtaacaacaataaataaaaaacaacgcccgtgccgtgagcgcgggcacgtggttgtccacttgtagcagtcaccaccatgtcggcgtccgtccacgtcgcactgccgatttttgttcaggctcagatctgaatctgatcagatcctgccgcgctgttatttataagcaatatatataggtttcattacaggccacctg

SEQ ID NO: 14781 - DNA, 2495 bp, Sorghum bicolor
  unsure (1)..(2495): unsure at all n locations
  Clone ID: SORBI-28MAY03-CLUS3102_1
gcacgaggctcccctcgactccatcctcatcttctactcatcctcatcctcctctccctctcgatctcaagagccagcaagaacgcggcatctagctacctagcaagcaagcaagctttctcttcggattcattcatggagatcgtcgacgccgacaacctgagcgccaccgagctccgcctcggcctgccgggaaccagcagcagcgacgactggcagaagaagccgtcgccctccgtcggggccaagcgcgctctggacgacaccaggagcgaggcctcggggaccagctcgccggccaccgccgcagacctcgacctcgaccacgaccacgacgccgcaccgcctcccaaggcgcaagtcgtcgggtggccgccggtgagggcgtacaggaagaacaccttccaggcggcggcggcggcggccaagaaggccgaccagcagcagcagcagcagggaggagggctgtatgtgaaggtgagcatggacggggcgccgtacctcaggaaggtggacctcagactgtacaaggggttcagggagctcagggaggagcgggacgccctcgtctccaagtccttctcggccgccgcggcggagggcggcgaccaccagcacgccatcgcgtacgggcacgcgcgccgcccccgcttgcgcctcgcagtccgcccccggggtgtgctccgcgccgcttgcgaggagctcgggagaaggtgcatctaagtttcttaatgagcaaattacaaaagcagtggttacaggtcccagcgtacttcaatgattcacaaaggacagcaactaaagatgctggtcgcattgcaggactggaagttctccgtattataaatgaaccaactgctgcatcattagcctatggtttcgagaagaaaaataatgaaacaattctagtgtttgatttgggaggcggtacctttgatgtatctgtattggaagttggagatggtgtgtttgaggtgctttccacatcaggtgacacacaccttggtggtgatgactttgataagagaatagtagattggcttgctagcaacttcaagaaagatgaaggtatcgatcttctgaaggataaacaagcccttcagaggcttactgaggcagcagagaaagctaagatggaactgtcaacgctgacacaggcaaatattagcctgccattcattactgcaaccgctgatgggccaaaacacattgaggcaaccctctcgagagccaaattcgaggaactatgttcagaccttatcgacaggcttaaaactcctgttaataatgccttgagagatgccaagttgtctgtcagtgatctagatgaagttattcttgtgggtggatccacccgaatccctgcggttcaagaacttgtgaggaagcttactgacaaggatcccaatgttacggtcaaccctgatgaggttgtttctcttggggcagctgtgcagggtggtgttttggcgggagatgtgaaagatgtcgttcttctggatgttactccattgtctcttggtttggagacattgggtggagtgatgacaaagattatccccaggaataccacattgcccacatcaaaatcggaggtattctcaacagctgcagatggacagacgagcgttgagattaatgttctccagggagaaagagagtttgttagggacaacaagtcccttggaagcttccggttggatgggatccctcctgcacctcgtggtgtcccacaaattgaagtgaagtttgatattgatgcaaatggtatcctctcagttgctgccattgataagggcactggaaagaaacaggacatcaccatcactggtgctagtacgctacctaaggatgaggttgagagaatggtagaagaagccgataagtttgccaaggaggacaaagagaagagagatgcaattgacaccaaaaaccaggcggactctgtggtctaccagactgagaagcaactcaaggagcttggcgacaaagtccccgctcccgtgaaagagaaggtggacgtgaaactccaggagctcaaagacgccatttctggtggatcaacacagagtatgaaggatgccatggctgctttgaaccaggaggtgatgcagattggccaggcaatgtataaccagcctggtgccagtgctgctgggcctactcctggcgctgaggctggacctacgcctggtactggaccagcgcagaatgatggggatgttattgacgcggacttcacagatagcaattgaggggtgatcgatgcatgaccatgtgctgagcaagattggcattgagtgaacaaatagttccttttttgtgttgggattgttactgtaggctctagtatggagttgatagagatagtgtttcgcgaacttttcctgtgattttgtctcaacaattagctaaatgctatataaagttgaaagaagggcataagggttttattcannnnaaaaaaaaaaaaaaaaaaaaaaaaaaaaaaaaat

SEQ ID NO: 14782 - DNA, 488 bp, Sorghum bicolor
  Clone ID: LIB3481-018-P1-K1-B2
cgtccgctcctcatgcaagaagctcaggataatgaagggctctgaggccaggtgatcgttgatgcataaacagaggctatggacacatcacgacatgggaaacggatcgaagagcacagatcgtgcctgaggaaggagctgtgtcgtggcttgagctctccagtgttgtacaaagagatgtttgtttctgaatccaagagggagaaaggtctctgaagcgtgtatataaatcttagctagctgttttgtttcatgtcaagttttgtatgagcgaaggctgtaaaaaaatgacaaatgaaatgagaaatttgactaaatctggtcattttcctctccacatccttcgaaaaaagttctctcacaggttctcctctctgtatgagataaattactttcctgtcactgaggttttgcataatccctgtcattaccctgagctataaatcaaaatgaacactgtcccaacgcagcgtttattttttcagacc

SEQ ID NO: 14783 - DNA, 1921 bp, Sorghum bicolor
  Clone ID: SORBI-28MAY03-CLUS38928_1
gttggcgatatctcagcgtgctcttgcggggcgccctttctggcgccgcagtctgctgactcgttccgcacgaggttgcgctttcgatctaggtgctataagccacggaaacaatcacaggagccgcagcctactactaggcgggagctgagcagcagcacttgcaactcgcaagcgctagcaagagagagagggccggggcatagagagactcttggaagggttcagagggctcaagggagaagaggaggagaggagagacacggggttcggagttggaggagatggagagcccgcggagccccgaggcggagatcggccaccgcgtggaggacctctgggaggtggcggagccgcagctgtcgccgtcggagaagctcaactcctgcttcgaggacatccccgtcgcgtccttcccgcgcacacacccgtcgcaagtcattgagattccttcagatgcaagtcttgctgaaactgtagaaatattatccaaaaacaaaatcttgagtgcacctataagaaatgttgaggctccagaagacgctagttggatggacaaatacatcggcattgtggaatttgctggtattgccatgtggttgctcagtcagtctgatgctgcggttaatgggacagttggttcgggagcaggatcacctgtctccaatctagtttctaggctgggctcattcacattcagtaggacatcatctggccgggtagaaactgctactgattctgaatcagatgaagcagcgtcagttggtgggagcttttttgaaaccctaacttcctctgagttctacaagaatacaaaggttggcgatatctcagggagcttccgctgggcaccatttcttgcactgcagacatctgacacattccttaccatgttgctgcttctatccaagtacagaatgaagagcctgccagttgtagaagtgggaggagataagattgagaacattatcacacaatcctctgtcgtacacatgcttgcagagtgtgttgggctctcctggtttgagagctggggaactaagaaactctctgagctggggcttcctatcatgaaaccatcaaaacttgtcaaggtaaacgaagatcagccagttctgaaagctttccaactgatgagggaaaagggagttggtggcctgccagtcatggacacaagtggagcaaaagcaattggtaatattagcatcagagatgtccagtatcttttaaccgctcccaagatatacaaagagcacaggtcaatcacgacaaaggatttccttagtgctgttcgacaccatctccaggagcagtgtgaggcctcaccattgctgcatgatgtaatcacttgcaaaaaggatgatacaattaaggacatcatactgaagctggactctgagaagatccacaggatctacgttgtagatgacaaagggaacaccgagggagtcatcaccttgagggacataatctccaaactggtgcatgagccgcgccattactttggggatttctttgatggtgttgttcccctgcctgcaaacagcactgtatgacacaacttcacggtccaatcacactgatgtatctgtgcaaatgtacattttgagctattcttctgaaggttgcttgtagtatattccttttcacagccttcttagttctcaggtaaactgaccattgcctacatggagaaaagaactaatgctctaaggatggatggcaatgttgtacattgaataatttgggaacttacctgagtttcttttcatgttctcatgatgacattgttgaatgtcttccttcttgctaaagatgtggttcactagatttggctttgtcatgctgcaaagcaaaattctgagggagaagaatgtattttatcttgttcttacccttggggtcaggctctttcgttgtc

SEQ ID NO: 14784 - DNA, 1048 bp, Sorghum bicolor
  Clone ID: SORBI-28MAY03-CLUS45579_1
atactcatcaggacgcgcaataaagctatatatctcgagctagctagctggtgtgtagtaataaaataatgggcgttgccatggccatcaggacggtggtgttgctccccgccgtgctcacgctcctctccttcctcctcctacccttggcctccctggcgctgacgcaggacttctgcgtggccgacctgacctgcagcgacacgccggcggggtacccgtgcaagtccagcgtcaccgccaacgacttctactaccacggcctggccgggcagggcaagatcaacccgctgatcaaggcggccgtgacgccggcgttcgtcggccagttcccgggcgtcaacgggctcggcatctccgcggcgaggctcgacatcgaggtgggcggcgtggtgccgctgcacacccacccggcgggctccgagctcctcttcgtgacccagggcaccgtcgccgccggcttcatcagctccggctccaacaccgtctacaccaagacgctgtacgccggcgacgtcatggtgttcccgcagggactgctccactaccagtacaacgccggcaccggccccgccgtcggcctcgtcgccttcagcagctccaaccccggcctccagatcaccgactttgccctctttgccaacaacctcccgtccgccgtcgtggagaaggtcaccttcttggacgacgcgcaggtcaagaagctcaagagtgtgctcggcggcagcggttaaaacttgtttttttctcgatggaacgaagctgagcatatggtcgtcgatcgtcgccttggtctgtgtacgtcgtcatggaatggaacgtgtctgcatgcatgcgtcgtgcacctgtcgtcaatgtcaaagtagtcgtggtgtatttcatcttaccctttttattcatgtatgtacttttcattcaaggatgtatttgcagttccattgcagtttgctgcaagggaagagagtaaaatgtgcatctgattggttctaattatctgtgtggtccatgtcatttgtaaagctatataatgactgctcatttggttccc

SEQ ID NO: 14785 - DNA, 1482 bp, Sorghum bicolor
  Clone ID: SORBI-28MAY03-CLUS44757_1
gcacgagggccaaggccaataagtataagcgcggatcgagctagctagctagccagctcggagtcggagcacgcctagacaccaccaggctagcagcaatggcggctcggctcgccgtcgcgttcctcgccgtgtcctctgccttcttggccgtctctggccagaagttcaacgccatcttcagcttcggcgactccatgtccgacaccggcaacctgtgcgtgaacggtccccccgccggcctcactctcacccagcccccctacggcgagaccttcttcggccgcgccacctgccgctgctccgacggccgcctcgtcgtcgacttcctggccgagaaattcggtctgccgctgctgaagccgtcgaagcagggcggctccgacttcaagcagggcgccaacatggccatcatcggcgccaccaccatggactctggcttcttccagtctctgggcatcggcgacaagatctggaacaacgggcccctcaacacccagatccagtggttccagcagctgatgccgtccatctgcggctccacgcaggcctgcaagtcgtacctgtccaagtcgctgttcgttctcggcgagttcggcggcaacgactacaacgcgcagatcttcggcggctacacgccggagcaagcgagcgggcagagcggcaccatcgtggacgccatcggcaagggcgtggagcagctcatcagcctgggcgccatgtacgtggtcgtcccgggggtgctccccgtgggctgcttcccgatctacctcaccctgtaccagacctccaacgccggcgactacgaccagtacggctgcctgaagcgcttcaacgcgctgtcggcgaaccacaactcgctgctgcagagcaaggtgtcgagcctgcaggccaagtacccaggcgcgcggatcatgtacgccgacttctacagccacgtctacgacatggtcaagagccctggcagctacggcttcagcaccaacctcagggcatgctgcggcgccggcggcggcaagtacaactaccagaacggcgcgcgctgcggcatgtccggcgcgtacgcctgctccaacccgtcgtcgtcgctcagctgggacggcatccacctcacggaggcggcgtacaagaagatcgccgacgggtgggtcagcggcgcctactgccacccggccatctcggcctagagcgagctccgggaatcggggggctggttggttggtgctggtggtggtggttcgttaatttgctggccgggcctctcaagttaggggaaggggaatcagattaattgtatttgtttagatggaatcgaagcgggcaagaagatgatggaggtgatcagcaagaaataatcaatggaagcatagtaattctctcgtgttcatcatgtgacaccaatgctaataccactcgtgtagcatgcgattttataaggctatttatgcgttgaatttgaatatattcggggggcagggtggc

SEQ ID NO: 14786 - DNA, 985 bp, Sorghum bicolor
  unsure (1)..(985): unsure at all n locations
  Clone ID: SORBI-28MAY03-CLUS346_2
aaatcattacaatttgtctcatacaaaaagattgctcttctattctcncacgctatagtctcaattcacagacccgcctcaaatcagcggatcatcaagccttgcatcccttgtgtcccctcttcagtaactttgttagcttgtattgtgttgatagcactggcaatgtttcccctccaaactccaagctttgtgcgcagaccatgccactgtgccatcccgaagatcctctccatatgccgactgacgatgacagtctggttaagctggtcaatcttgcaatccaatatcttggatgcaattgcctttacaatccattgctccacctcatcatcattgatcctaagttcaacagtgattgcagaatagggaatttcgccagagcaacggctgctcagatcaagcaaagacatgaggcgcatcttggtcacgcactcctcatggacgagtccataactctttcagcaaggcagagtttgcagtctgaaactccaagtaggaatcaagcctcttagtaaggaatatctttagaagctcataaaccaactgatacttttcgtccttctcaagctgtgaaacagctggcatattgagcaaatcacactgaaagagattaggcaaaatgagaacaaagaggttgctgtcgatgcattcttgcctgcgaccacagctcgagatgccattcagtactccatggatctgtatgcgcagtacatcttgcaaagcttgaggcagtagattgcaagcaactatttatcggggcgtcttggattgagcgtgattttaataagtcgaaacgcttgatattgtgtgcgaaccttggaattgagaacaatgtcactaccctatactgctttcctacttgtactccttttttgttattaatttataaatgagcgtccatacgtataccgtgtggcttcatgggtcttcgtctacccaagtaaaaaaaaaaaaaaaagggcgacgctcgccaacctagaac

SEQ ID NO: 14787 - DNA, 1245 bp, Sorghum bicolor
  Clone ID: SORBI-28MAY03-CLUS346_1
cggcaaaatttgcgaagtaccaaaaatatcagtgaaggaaatttatcaggacagagtgcatcacgtagaaaaacatgtgccttgcactgcacgacgctcctttccaatttcaaggaacaacgatactgcttgctgcgcttagccgctttccaacatgggcacaggatctaagtaaatcattacaatctgttgcatacaaaactatggctcttccaatctcccccctgaagtgtcaatctcttctctgtccaggaggtctgtagctgctcatccgtggcatgatcttgagatcggtcctggtgctcctgctgtattcaatgttgttgttgagatcacaaagggaagcaaagttaaatatgagcttgacaagaaaactggactgattaaggttgatcgagtcctctactcatcggttgtataccctcacaattatggtttcattccgaggactctgtgtgaagacaatgacccaatggatgtgttggtcctgatgcaggagcctgttattcctggttcgtttctccgagcaagagcaattggccttatgcccatgattgaccagggtgagaaggatgacaagataatagcagtctgtgctgatgatcctgaataccgtcactacaatgacatcagtgagctgtctcctcaccgcctgcaagagatcaagcgtttctttgaagattacaagaaaaatgagaacaaagaggttgctgtcgatgcattcttgcctgcgaccacagctcgagatgccattcagtactccatggatctgtatgcgcagtacatcttgcaaagcttgaggcagtagattgcaagcaactatttatcggggcgtcttggattgagcgtgattttaataagtcgaaacgcttgatattgtgtgcgaaccttggaattgagaacaatgtcactaccctatactgctttcctacttgtactccttttttgttattaatttataaatgagcgtccatacgtataccgtgtggcttcatgggtcttcgtctacccaagtaactagctgtgtggagtaatgaaaggatgtctagcgtccgttgttttgctgttgtgaatgagatggcactccctaggcctgtgggaggaggccgaggtgtagctgtagcccattgccaggcgtcgtttggaacatgggaagttttccccattcctgtatcttatgggtgaaataaaatttatttaaaattgaattaataagttaatgagaattttttgtttgtttttttt

SEQ ID NO: 14788 - DNA, 1079 bp, Sorghum bicolor
  unsure (1)..(1079): unsure at all n locations
  Clone ID: SORBI-28MAY03-CLUS17380_1
gcggccgctccgaggcnncggccgggcccgggaaaaaaaaaaaagaagggcaggccgggatcacccatattattgagaccaactagcaacctagaaagtggaatacactagcaacatagcaacaatggcggccaagatattttccctcgttatgctccttgctctttttgcaagtgctgctaccgcgacctatatcccgcaaccgcactgctcacaaatttctatagctgcccctcatcccgcatacctcccaccagtgtgcgcaaacccaatgctacaaccctatgggctccaacaggcaatcgcagcaagcatcttacagtcatcacccttgttcatccaacaaccatcggccctattgcagcagttgtccttggtgaatttgttggcacaaagcatcagggcacaacaactgcagcaactggtgctaccttcgatcaaccaagtaacggtggcaaaccttgctgcgtactcccagcaacagcagtttattccattcagccaactggctgcagtgaaccccgctgcctatttgcagctgcaacaactacaacaattcagccagctagctgctgcgagccctgccgccttctggccacaacaacagctgctgccgttctacccgcagggtgtggctaacgccgccaccctcttacaactacaacagttgctctcattcaaccaactggctgcagtgaaccctgctgcttatttgcagctgcaacaactactacaattcagccggctaggtgctgtgagtcctgccaccttctggccacaacaacagctactgcgattctacccgcagggtgtggctaatgccgccaccctctttcagcaacaacagttgctgccattcatccagcttgctctggcgaacccagcaacgtcctgccaacagcccttcattggtggtgccctcttttagatttcttactagttgtagttcaataatgaagtttttaggctatcatgtctgaggcttctcagaaataataaattatgcttctagattttcctacaaaaaaaaaacaaacaaccataataataaaagaaaaataaaaaaaaaagggccccta

SEQ ID NO: 14789 - DNA, 704 bp, Sorghum bicolor
  Clone ID: LIB5050-004-R1-XP1-F5
ccgggattattgagaccaactagcaacatagaaagtggaatacactagcaacatagcaacaatggcggccaagatattttccctcattatgctccttgctctttttgcaagtgctgctaccgcgacctatatcccgcaaccgcactgctcacaaatttctatagctgcccctcatcccgcatacctcccaccagtgtgcgcaaacccaatgctacaaccctatgggctccaacaggcaatcgcagcaagcatcttacagtcatcacccttgttcatccaacaacagctgctgccgttctacccgcagggtgtggctaacgccgccaccctcttacaactacaacagttgctcccattcaaccaactagctgcagtgaaccctgctgcctatttgcagctacaactactactacaattcagccagctaggtgctgtgagtcctgccaccttctggccacaacaacagctgctgccgttctacccgcagggtgtggctaatgccgccaccctctttcaacaacaacagttgttgccattcatccagcttgctctggcgaacccagcaacgtcctgccaacaacccttcattggtggtgccctcttttagattgcttactagttgtaattcaataatgaagtttttaggctgatgtctgaggcttctcagaaataataaattatatatttctagattctaatgtgcg

SEQ ID NO: 14790 - DNA, 2978 bp, Sorghum bicolor
  Clone ID: SORBI-28MAY03-CLUS5944_1
gcacgaggccggaggcgggtggaccagggcgggtcgtgctgcgggcccgcgcaattggcctagggaccctcctggctggtgtcgcgcggcctccgggcacccgggtggtcccgactccctcggacctgctctaccgcgtccggtctgtgtccctcctccgtcgtgtcctcccctccagcatcacaagaaggctggtgcaagcacgagactgattcgtgtatctgctgtgctgacaaatggtgcctatcttctcaatgtggattgtgaccattacttcaacagcagcaaagctctgagagaagcaatgtgcttcatgatggatccggctctaggaaggaaaacttgttatgtacaatttccacaaagattcgatggcattgacatgcacgatcgatatgctaatcggaacatagttttctttgatatcaacatgaaaggtctagatggcattcagggtccagtctatgtgggaacaggatgctgtttcaataggcaggctttgtatggatatgatcctgttttgactgaagctgatctggaacctaacattgttgttaagagctgctgtggtagaaggaagaaaaagaacaaaagttatatggatagtcaaagccgtattatgaagagaacagaatcttcagctcccatcttcaacatggaagtcatcgaagggcgtgctatgaagagtgagtatgaagagttcaaagtaaggatcaatgcccttgttgccaaagcacagaaagtgcctgaagagggctggaccatggctgatggaactgcttggcctgtgaatactccaacagaccatcctggcatgatccaggtattcttgggccacagtggtggtcttgacactgatggaaatgagttgccgcggcttgtctatgtctctcgtgaaaagaggccaggcttccagcaccacaagtgggcgcgtgccttcgcggctctgccgtcctgacaaatggtgcttatcttcttaatgtggattgtgatcactacttcaacagcagcaaagctcttagagaggctatgtgttttatgatggatccagcactaggaaggaaaacttgctacgttcagtttccacaaagatttgatggcatagactcacatgatcgttatgcaaaccggaacattgtcttctttgatattaatatgaagggtttagatggcattcaaggacctgtttatgtgggaacaggatgctgcacgcgtccgcccacgcgtcctggcacgcgtccggtattgactgaagctgatctggaacctaacattgttgttaagagctgctgtggtagaaggaagaaaaagaacaagagttatatggatagtcaaagccgtattatgaagagaacagaatcttcagctcccatcttcaacatggaagacatcgaagagggtattgaaggttatgaggatgaaaggtcagtgcttatgtcccagaggaaattggagaaacgctttggtcagtctccaattttcattgcatccacctttatgactcaaggtggcataccaccttcaacaaacccagcttctctactaaaggaagctatccatgtaatcagctgtgggtatgaggacaaaactgaatggggaaaagagattggctggatctatggttcagttacagaggatattctgactgggtttaaaatgcatgcaagaggatggcaatcaatctactgcatgccaccacgaccttgtttcaagggttctgcaccaatcaatctctctgatcgtcttaatcaggtgctccgttgggctcttgggtcagtggaaattttgctcagcagacattgtcctatctggtatggttacaatggccgactgaagcttttggagaggctggcttacatcaacaccattgtttatccaatcacatccattccgcttattgcctattgtgttcttcctgctatctgtctccttaccaataaatttatcattcctgagattagtaactatgctgggatgttcttcattcttcttttcgcctccatttttgccactggtatattggaactcagatggagtggtgttggcattgaagattggtggagaaatgagcagttttgggttattggtggcacctctgcccatctcttcgcggtgttccagggtctgctgaaagtgttggctgggattgataccaacttcacagttacctcaaaggcatctgatgaggatggcgactttgctgagctatatgtgttcaagtggaccagtttgctcattcctccgaccactgttcttgtcattaacctggtcggaatggtggcaggaatttcgtatgccatcaacagcggttaccaatcctggggtccgctctttggaaagctgttcttctcgatctgggtgatcctccatctgtaccccttcctgaagggtctcatgggcaggcagaaccgcacaccaacaatcgtcattgtctggtccatcctcctcgcgtccatcttctccttgctgtgggtgaagatcgatcctttcatctccccgacacagaaagctgccgccttggggcaatgcggtgtgaactgctgatcgagaccgtgactcttatttgaagaggctcaatcaagatcgtctgccccctcgtgtaaatacctgaggaggctagatgggaaattttttgttgtagatgaggatggatttgcatctaagttatgcctctgtttattagcttctttggtgccggtgacggtgctgctgctgcggactaaaaatcatggagccttttctaccttgcctgtagcaccggccagcagcgtaaattgtgaattttgcattttttttatacgtggtgtttattgttttagagtaaattatcatttgtttgagggaactgttcacacgaactatatggcaatgctgttatttatacgcagactgatacattctttgtattgtgagcaaacagtcagaacactgtaatttcttagcacaactatataaaaaggcagctgttgtactgttcc

SEQ ID NO: 14791 - DNA, 1875 bp, Sorghum bicolor
  Clone ID: SORBI-28MAY03-CLUS77_1
acagccggcacaggagcaaggggaggccagtgctctcctgtattggcctcagagacttgcctggcatacatatcccacagaggccggagctgatcctgatcgcgcacgctcagcacctgcttgagggcatggctgcaaggagggctgcttcctccgtcctctctcgcttcctcctcacaaggccttcgccttcgccttcgcctgcttctgctgcttctcccgccggcaaatccgccctcctaggagcagggggccctcttcacaggttcagcactgcaccggcagccgctgctgccaccgcagaggagccaatccagcccgccgtggaggtgaagcacacccagctcctcatcaatggcaacttcgttgacgccgcttctgggaagacgttcccgacgctggacccccgcaccggcgaggtcatcgcgcgcgtcgccgagggcgacagcgaggacatcgaccgcgccgtcgccgccgcccgcagggccttcgacgagggcccgtggccgaggatgaccgcctacgagcggtgccgggtgctgctgcgcttcgcggacctgatcgagcggcacgcggaggagatcgcggcgctggagacgtgggacaacgggaagacgctggcgcaggcggcgggcgccgaggtgcccatggtggcgcggtgcatccggtactacgccgggtgggcggacaagatccacggcctggtggtgccgggcgacggcgcgcaccacgtgcaggtgctgcacgagcccgtcggcgtggccgggcagatcatcccctggaacttcccgctgctcatgttcgcctggaaggtcggcccggcgctggcctgcggcaacaccgtcgtcctcaagaccgccgagcagacgccgctctccgcgctctacgtcgccaacctcctccacgaggctgggctccccgagggcgttctgaacgtcgtgtccggcttcggtccgacggccggcgccgcgctctgtagccacatgggtgttgacaagcttgcgttcacgggatcgacgggcacggggcagatcgtgctcgaactggcggcgaggagcaacctgaagccggtgacgctggagctcggtggcaagtcccctttcgtcgtcatggacgacgccgacgtcgaccaggccgtcgagctcgcgcaccaagcggtcttcttcaaccagggccaatgctgctgcgccgggtcgcggacgttcgtgcacgagcgcgtgtacgacgagttcgtggagaagtccaaggcccgcgccctgaagcgcgtggtcggcgaccccttcaggaacggggtcgaacaggggcctcagatcgacggcgatcagttcaacaagatcttgcggtacgtccagtccggtgtcgacagcggcgccaccctcgtcaccggcggcgacagggtaggcagcaggggcttctacatacagccgacggtgtttgccgacgccaaggacgacatgaagatcgctcgggaggagatattcgggccggtgcagaccatcctcaagttcagcggcatggaggaggtgatccggcgcgcgaacgcgacgcactacgggctggcggcgggggtgttcacgcggagcctggacgcggccaacacgctgtcccgggcgctgcgggcgggcacggtgtgggtgaactgctacgacgtgttcgacgccaccatcccgttcggcggctacaagatgagcggcgtcgggcgagagaagggcgtctacgccctccgcaactacctccagaccaaggccgtcgtcacgcccatcaaggaccccgcctggctgtaatcacacccgtccctcaccggcgctgcgccgattctcgcagagaatgtgaccaataaaacaaccgtttataaacaaaaaaaaaaaaaaaaaa

SEQ ID NO: 14792 - DNA, 1746 bp, Sorghum bicolor
  Clone ID: SORBI-28MAY03-CLUS796_1
ctactggatcagcaacgaactcagaagtctccaaccaaccaccgcatacaatccccaatcccgcgtccccgaaccctcgagttctcacgggctccggccagattcgtgcagtctaagcttcgaatcgacgcatggaggcagcagtagccgcggcgctcaggtcgcccaccgccgccggcccctcgcggcggtccgcggccccgggccccagctcgctcccctttgaccggaggcgcagcttcgcctttggctccatcaagggtctcgggcggcagcagctcacgtctaggactaggaggcgaagcagtgtggtcagggcctcctggtccccctcggagtctctgccaccgtcatcgtcgatcgcgccgctcaggatggaatcaccggcggggcagctactctcgcaaatcctccacacgcacccgcacctactgtctgccgccgccgagcagcagctcgagcagctccagaccgaccgcgaggccgagaaggagaaggagaaggagagcgaggctggcgacaagtcgaccccgacaggtggcgacctcgtgctgtacaggcgtattgcagaagtaaaggagaaggaacggagaaggactttggaggagatactctatgctctggttgttcagaagtttgttgaagctgatgtttctttggttccagcactctcacactccatcgattcttctggaagagttgatcagtggacagaaactgtggaagagaagcttcaacgtttacactcgcccgaggcctatgaaatgatcgagaatcatctctctctcattctggggcagcgtcaaggtgatgccactattgcagccataagtaagctccgagttggccaggtctatgctgcatctgtgatgtatggttatttcctgaagagagttgatcagaggtttcagcttgagaagacaatgaagagcctcccttggggatcggaagaggaagatagtgctttgaatcaagttatgacgaccgactcgatgccttcagctcgggtttctagctctcatccagagatgggctcatggactgcacccgacttcaacgcaggagggcctagccaatctatcaagccttcccgccttaggtcgtatgtcatgtcatttgattcagatacgcttcagaggtatgcaacagtcaggtcaaaggaggcctttggcatcattgagaagcacacagaagcactatttgggaaaccagagattgtaatcacacctgaaggcgcagttgattcctccaaggatgagcatattaggataagcttttctgggctgagaaggctgatcctagaggctgttactttcgggtcgttcctctgggacgttgagagctttgtggattccaggtaccatttcgtgaccaactaagatggtcatcctaactgaagaacgattcatggtttacgcatctggtctgaatgtctatgggcttcggaaagactgttgtacaatgatgttagactgttaccacaccccttactgtacacgatggtatcaatgatttgcccagttttatggcatcacagtattgtaaagaccaaatgtcattagccgttaggttctattaacatctgtgctgcccggggtgcgtagcaatgtattttttcactatccccgctgcaaattgtaagaagaattctaggctgctaggcaacccttcagcaaacctattattctcgttgcagattgcatgttgatttgagttctctcttcttgggagcacggccatttcgta

SEQ ID NO: 14793 - DNA, 471 bp, Sorghum bicolor
  Clone ID: LIB3478-020-P1-K1-H2
cccacgcgtccgcggacgcgtgggttttttttttttttctcgagaagtgctctctttttcactggtcaccacaccataattatctactgggacttgttgactccctgatatcacatcctcatcatcatcaccgtcatcgtcgatcgcgccgctcaggatggaatcaccggcggggcagctactctcgcaaatcctccacacgcacccgcacctactgtctgccgccgccgagcagcagctcgagcagctccagaccgaccgcgaggccgagaaggagaaggagaaggagagcgaggctggcgacaagtcgaccccgacaggtggcgacctcgtgctgtacaggcgtattgcagaagtaaaggagaaggaacggagaaggactttggaggagatactctatgctctggttgttcagaagtttgttgaagctgatgtttcttttgttccaacactctcacactccatcgattc

SEQ ID NO: 14794 - DNA, 906 bp, Sorghum bicolor
  Clone ID: SORBI-28MAY03-CLUS10252_1
tggatgatgatcgatcggtgttattatgcaaagaagcaacgttatcacgagcaaatgaacatcatgtacatataatcccacgctgcgcctccacggtcaccaagaagacttgataataaaattacacatggatcatctatcaaaccatgcatgcatgcatggcgccaccagcagctaacttatagtaataattcatataagaagaacacgcaagtcctttaagcatgcgacggaggattagatgtcgaaggattccttgccggtgaacttgacctcgatggggctgacgttcttgccgatgctgcggaagttctgcccaacgccctgcctgccggcgttgaccttctccgggtagacgccgtccttggggtggaggtactgcacctcgccgttggggaagacgcggtagaactggtagttgatcttgtacttggagcgcagcctggtgccgagcgccaggcactgctccttgcgcgccagcttcaggaggtttggaccctcccgcatgatggcggcgccgcccgtgggcatctcgaacacctgctccttcggggacgtccacgtgatcacgtagaactcctccacctgcgccttccggagcagcccgcccgtgctgccgccgaagatgggcgacggcgtgttggggtccagctgcgggggcacgaaacccttgggggcctcctcagtcaccgccgccgccgccggtccgtcgtcggacgcgcggagcggggccggaccgcgggacgacggcatcgcgagctgcgagctcagctgccgtggcttcgcccaggcggccgccagcaggtggcgcgtggcggcggaggcttgcgtggccatggccatgggcgcgcggcggagagcttcttggaaggaaggagatgagagagtagtggcctggatcgtgaa

SEQ ID NO: 14795 - DNA, 2031 bp, Sorghum bicolor
  Clone ID: SORBI-28MAY03-CLUS1511_1
atcgcatcgcagcgcccccaacacccgtgttgtccgttaggaaaggaatcgatcccatcccatctcttcggtgcgagagagaaatctaggctgccgcctcctttttcttcggtgaaaggaaaggagaacagggaggaagggatttcttggttccccgccctcggattgggaaaatcagaatttctcgaggtcgctagttgcagcgaggtccgggccttcgtgggatttgtaaattggatgtgctaatggagtccaagggtggcaagaagaagtctagcagtagtcgttcctccctgatgtacgaagctccccttggctacagcattgaggatctccgccctgcaggcggcatcaagaagttctccgctgcttactcgaactgcgcgaggaagccatcctgatacctctctcgtcagccccatcctagtagcttagaaaccacctgcattttcattttgatcttcctaaaatctctctggctagttgctttccagtgaccaaaagatttcaagaaaccactccctgtcttcctcccccggctgtctgtcatcttgctctgaaacaatggctgtcctgcaagttgctgctgctgcccctccccctgtctcagcgattgggtttgagggatatgagaagcgccttgagatcagcttctctgaggcacctgtcttcgctgatcccaatggaaggggattgcgtgcgctctcacgtgaccagattgactctgttcttgaccttgcacggtgcaccattgtgtctgagctctcaaatgaggactttgactcttatgtcttatccgcgtcaagcctgtttgtctacccatataaaatggtgatcaagacctgtgggactacaaagcttctgctcgctattccgaggatccttgagcttgctaaagagctctcgttgccactttctgcagttaaatactcccgtgggacattcatattccctgatgcacagccttccccacacaagaactttgctgatgaggttgccttcctgaatcgcttctttggtggcctcaagtctggcggtaatgcttatgttattggtgattctgcaaagcctgggcagaagtggcacgtctactatgcctctgagcaccctgaggagcctgttgttactctcgagatgtgcatgactgggctggacaagaagaaagcttctgtcttcttcaagacatctgctgatggttacacatcgtgtgctaaggagatgaccaagctctctggtatctcggacattattccagagatggagatctgtgactttgatttcgagccctgtggctactccatgaatgctgttcatggccctgctttctcgaccattcatgtgaccccagaggatggcttcagctatgcaagctacgaggtcatgggcttcaacccaggctcttcttcttatggtgacctggttaagagggtgctgaggtgctttggcccagttgagttctctgttgccgtgactatcttcggtgagcgggacaatgcaaagacctgggggaagaaactggaagctgaggcctatgcctgcagcaacatggttgagcaggtgctgccgtctggtggcttgctcatatatcagagcttcactgctacgggtgcagccacccctgggtcgccgaggtcagtcctgcatgacttcgctggtgacattgtcaagcctggcgatagtggtgaggccgatggcccctgctgggaagctgatgctgtggatgagagcgaggaaagagaggtaaagaagatgaaatgctgatgctgtgatgagctatgctgaaggttgacaaatcagatttagagttgctgcccttggtcatcttgtgtagcagccaagccagattatttatgctgcataacctgtgctattgtggtgtggcacatgcttatatttgcaataaagagctctaggtggttagccttgtctgccacagtgagtagtgtacccatattgcgttttctgaactgtatgaatctaaataaagtcttgtgtttgatacaatttgaatttgaatgagtcttttcatgt

SEQ ID NO: 14796 - DNA, 1150 bp, Sorghum bicolor
  Clone ID: SORBI-28MAY03-CLUS1099_1
tgtgcggcgctgtggccggccgggccgggccgggaattccatttcgaattctagggttttgctgctccccgaccccgtgctccgaagcccgccgcatcgccgcaccaggcgcggccctcctttcgtgcgaccgagatggcgctcccgaatcaggggaccgtcgattaccccagcttcaagctcgtcatcgtcggcgatggcggaacgggtaaaactacgttcgtgaagaggcatctcactggagaatttgagaagaaatatgaaccaacaattggtgtcgaagtccacccattggatttcaccacgaactgtggtaagatcaggttctactgctgggacactgctgggcaagagaagttcggtggccttagggatggatactatatccatggccaatgtgctatcatcatgtttgatgtaacctcaaggctgacttacaagaatgttcctacatggcatagggacctgtgcagggtgtgtgaaaacatccccattgtcctctgcggtaacaaggttgatgtcaagaacaggcaggtgaaagccaagcaggtcaccttccacaggaagaagaatctgcagtactatgaaatttctgccaagagcaattacaattttgagaaacctttcctttaccttgcgaggaagttggcaggtgatccgaaccttcactttgttgaagctgttgctctgaagcccccggaagttaccatcgacatggctatgcagcagcagcatgaagctgagcttgctgcagcggctgcacaacctcttcccgatgacgatgatgatctgatcgagtagagaggatcatgagtctctgccttgagcaggagttgtgccttgcgttttaagttgttctagggtgaactctctcttgagttagcattgtctggagcatctttctctccttggacgtgttgcaacttttgagtgtggaaattgatggactcgtcggcatgaatttgctggctactttatacattgctttgtaactctgtttgatgttaaacgttcttgtggcaacgctcgttgtgctgccattttgttatctatttgtctgatgtaccatataaaatgcttttggtgtatttttcgcactttccaggtatttaggtttactgtatgtctggtgtcaggttatggttctcac

SEQ ID NO: 14797 - DNA, 500 bp, Sorghum bicolor
  Clone ID: LIB5052-001-A1-XP1-C4
gccggccgggctgcggaaattctgccagagcaattacaattttgagaaacctttcctttaccttgcgaggaagttggcaggtgatccgaaccttcactttgttgaagctgttgctctgaagcccccggaagttaccatcgacatggctatgcagcagcagcatgaagctgagcttgctgcagcggctgcacaacctcttcccgatgacgatgatgatctgatcgagtagagaggatcatgagtctctgccttgagcaggagttgtgccttgcgttttaagttgttctagggtgaactctctcttgagttagcattgtctggagcatctttctctccttggacgtgttgcaacttttgagtgtggaaattgatggactcgtcggcatgaatttgctggctactttatacattgctttgtaactctgtttgatgttaaacgttcttgtggcaacgctcgttgtgctgccattttggaaaaaaaaaaaaaaaaaaggccccta

SEQ ID NO: 14798 - DNA, 861 bp, Sorghum bicolor
  unsure (1)..(861): unsure at all n locations
  Clone ID: SORBI-28MAY03-CLUS17501_1
ggccgcttcgaggnnccggccgtctctttgccggccgggccgggatcagatcccacatcaagatcagagacactactactgcaccaaactaattaagcaagcaaagcagagccgtagagaggatcgtccaacagatcaggtgtagcatgaagatggtcattgttctcgccgtgtgcctggctctgtcagctgccagcgcctctgctctgcagatgcccgggatggggctgcaggacttgtatggcgccggcgccctgatgacgatgatgggcgccggcggcgggctgtacccctgcgccgagtacctgaggcagccgcagtgcagcccggtggcggcgcccttctacgcccttcgtgagcagacaatgtggcagccaaacttcatctgccagcctctccgacagcagtgctgccagcagatgaggatgatggacatgcagtcacggtgccaggccatgtgcggcgtggtgcagtccgtcgtgcagcagctgcagatgacgatgcagctccagggcgtcgccgccgccagcagcctgctgtaccagccagctctggtgcagcaatggcagcagctgctgccggcagctcaggccctcacccccttggccatggcggtggcgcaggttgcgcagaacatgccggccatgtgtggactctaccagctgcccagctactgcaccaccccctgtgccacctccgccgccattccgccctactactattgatgattctccctggcctgtttggaagatccgcttctctctactgcagtaataagacgtcacacattatcatgtgtggtgtgaccaataatatatatatatgcatgatcattgatcataataaaggtttggttctaac

SEQ ID NO: 14799 - DNA, 1488 bp, Sorghum bicolor
  Clone ID: SORBI-28MAY03-CLUS17324_1
gccggccgggccgggggaacgaaacttcattccaccgttcctcttcctcgttcagttcaccggcgagcagcggccatggctaaccaagcccctccggttccccgcgtcaagcttggcacccagggattcgaggtgtccaagctggggttcggctgcatggggctgacgggcgcgtacaactccccgctggacgacgaggccggcatcgccgtcatcacgcacgctttcagccgcgggatcaccttcttcgacacctccaatgtatacggccccctcaccaacgaaatcctcctcggcaaggcgctgaagcagctgccgcgggagcaggtgcaggtggccaccaagttcgggatactgcgtgacgagagcggcaaccggaccgtgtgcggacggccggagtacgttcgcgcctgctgcgaggccagcctgcgccgcctcgacatcgactgcatcgacctctactaccagcaccgcattgacaccacaattcccatcgaggagacgattggcgagctcaagaagttggtggaggaggggaaggtcaagtacatcggattgtcagaggcgagcccggacaccattaggcgtgcacacgctgtgcacccgatcaccgccgtgcagatggagtggtctctctggtctcgcgacattgagcctgaaattgtgccgctgtgcagagaattgggcattggaattgtaccatacagtcctcttggccgtgggtttttcggtggaagaggagtgaaagaacaagtgtccgctgaatctgttctgcatgggatcccaaggtttgctcctgaaaatttggagaagaacaagcaaatttatctgcgaatggaagaactggccaataagcaccagtgcagccctactcagctagctttagcatgggttctgcatcaaggaaatgatgtggttcctataccagggacaaccaaaatcaagaatctagattccaacattgactccttgaaggtgaaactgacagacgaagatctgaaagaaatgggcagccagatacgtgaagaagatgtggctggtgggagacaattcgcttcctttgaacatgccacctggaagtatgctgatacacccaagaagcagagctaaaaaatacgtcaaagcatcaatgctgatgcgattggcgtggcactctccctgcagatttcctcaggaacattgtcgatgtgtctttgttaatacctgttctaagtaatgtacagagaagaacaatgaagggcccagtgttgatggaagtacgagcaggaatttgattttgggtgtacttatgtgaagctaagactaatgagtgtagagtttgctcatggttatatgttgtcgcatgaattgtggttgtgtgaccctaccatatagttcgcaaaaaaaaaacagtgatgtgtgctagctcaatcagcatgtaggcaggaaacacatgccaccatctgttcgcttttaatccgcatttgggcctgagaacgagaaacaagc

SEQ ID NO: 14800 - DNA, 759 bp, Sorghum bicolor
  unsure (1)..(759): unsure at all n locations
  Clone ID: LIB5049-012-R1-XP1-E1
gccggccgggccggggttcctcttcctcgttcagttcaccggcgagcagcggccatggctaaccaagcccctccggttccccgcgtcaagcttggcacccagggattcgaggtgtccaagctggggttcggctgcatggggctgacgggcgcgtacaactccccgctggacgacgaggccggcatcgccgtcatcacgcacgctttcagccgcgggatcaccttcttcgacacctccaatgtgnntacggcccccctcaccaaacggaaattccctccttccgggaaaaggggggcttttaaaaaaaaaaattttctcccccgccgggagaaaaaaaaaaagggggtgggggggggcnccgcccccccccccaccccctggtttttttttttttttttggaagaaaaaaaccacccccggggggggggggggggggagaaaatttatcctgttttgggaggaaaaacacaccccccccccccccccnagggggagggttttttctaccccaccccgggggggggggggaacaacccttttccccgggggaaaaaagggggggggggtataaaaaaaaaggggggggggggggggggaggggagaaaaaatttttttttttttttttttgttaggggggggggggccccacccccccccctttnaaaggggggggtgggttttcccccccccccccccccccccccccaagggaggaggggggggggggggcgcccttctcctcctccccccctctctnt

SEQ ID NO: 14801 - DNA, 1864 bp, Sorghum bicolor
  Clone ID: SORBI-28MAY03-CLUS398_1
gcacgagggagagactcgctcgtctcgcactcccccgtcccgcaccacctccgcgcctcccacaccattcgcctatggcgtcggcggcgatgctccggtctgctgcccgctcgctccggctccggctccggcagcccctggagcagcagcggtgtcttcaggcaaggcaaatcctcagcagctccgcacctaccgaggcactaggcctccaaaggagttctacacatgccagaagctacagcagtcaactttctgctacttcccaatgctcaaatctgacaagaaaaagctgttacttacctaatccctatctataccaagtctggagtaggtcatttgcttcagacaacggagacaagtttgaggctgttgtgcccttcatgggtgaatctgtaactgatggaactcttgctaacttcctgaagaaacctggagacagagtcgaggccgatgaacccatagcacagattgaaactgataaggtcactatagatgttgcaagtcctgaggctggtgttattgaaaagctcattgctagtgaaggcgacacagttactcccggcactaaagttgcaatcatatccaagtctgctcaacctgctgaaacacatgttgctccatctgaggaagcaactccaaaagaatcatcaacgcctaaagttgaagagaaaccaaaggtagaggaaaaagccccaaaagttgaacctcccaagatgcaagcaccaaagccaactgcaccatcaaaaatgtccccttcagaaccacagctccctccaaaagaacgagagcgaagggtgccgatgccaaggctcagaaagcgtattgcaaaccggcttaaggattctcagaacacctttgcaatgctgactacatttaatgaagttgacatgaccaatttgatgaaacttcgttctgattataaagatgaatttgtcacaaagcatggtgtcaaattgggcctaatgtcttgctttgtcaaggctgctgtttcggcacttcaaaaccaaccgattgtcaatgctgtcattgatggtgacgatatcatatacagagactatgtggacgtcagtgttgctgttggcacatccaagggccttgtggttcctgttatccgggatgctgataccatgaactttgctgacattgagaaagggataaacaaccttgcaaagaaggcaactgagggggcactctcaattgatgacatggcaggaggaacatttaccatctccaatggtggtgtctatggaagcctcatcagcacacctatcatcaaccccccacagtcggcaattctggggatgcattccattgtgcaacgccctgtggttgtgaatggtgacatcctcgcgaggccaatgatgtacctcgcgctgacatacgaccacaggctgattgacggcagagaggctgtcttcttcctgcggcgcatcaaggatgtggtcgaggaccccaggaggttgctgcttgacatataaattcacgcacaagcgctcccctgccagactgtttttgtgcttatctggaaataataccatgcaaatttttgactgatgaaaaagaattacttcctcaggaagacaatctgagctgaggataccgtgagttttttctctatatataatcgtagaagagagcagcaaactcaactcaatgtgaggtcatgtttaattttcgggatgttccatttcgggatgcagttcccagtcatttttatttaccatgcaagagcaatagaggctgctgcatttttgtttgttggttcacaatttcgcctccagctggccagtctgcaactcatggagtctggttgtataacacgtgacgttaaaacagtgctccaatcgctcgctttgtggagggg

SEQ ID NO: 14802 - DNA, 1462 bp, Sorghum bicolor
  Clone ID: SORBI-28MAY03-CLUS56929_1
gcacgggggcccgaggcaagatagggcgtgcatataatcccaagctcctcatagaaatgaatacagattttcatatgactgaaggggaaggagaatggagctactccaaaaattctaggcgtcaagaaattttttttcttgagacgaggccaatgattgagaatgccataaaagaagtgtacacaactcttctccccaaaactatgatcattgctgacctaggatgctcttcagggccaaacacaatgctcttcatatctagtgtcataaacatcattgttgaaaaatgtaaatctactggagatgattgcatggaacttcaattcttcttgaatgaccttcccggtaatgactttaatgaactatttcggtcaattgagaagttcaaaaggccaaatacaacaggtgaaagggatcatctaccacctttatattatattatggggttaccagaatcctattacaaaaggctttttcctcgtgaaagtgtccatctattccactcttcatactgccttcactggcgctctcaggtacctattcggcaagtaccagcgaacaaaagaatttgaagaaatatctacatctacttctatatgaccacaacaagattcagggtcaaactaatccaataaagtgtctgtacatacaatatacactacagaccattggggcttgaatgtatgccatatatgaaagaatacgcacttgtattttttgggaggaagaatgaggatgtatataatggtgatctcaatcaactttttgcattggttgcaagatcgttacagtctcttgttttgaagggcattgtggagaaggaaaagctagaatctttcaatctaccaatctatgggccgtcggttggagaagtgaaggaactagtcatgcaaagtcatttattcaacatggatctaattaaacaatttgagatgaactgggacccttttgatgatttagaaggtgatgatgttgaggataatacccgcagtagcatgaatattgctaagttcatcatgtccgtactaaaatatttaattgttcaccattttggagaaaccatactcgatgcatggtttgccgagttcaagtgcctcgttggtgagcaccttgaaaaggagaagaccaagttcaccgtcatcgccatgtccttgaagaaagaataatatagatctatatgtgtgttgtttctcaattcttttactcaaatgccaaagaatattatgtatgtttgtatttgtgcatgtgtctctctgtgtctgtacatgcatgcatacatgtctactcctactttgtgtagtcactccaatgtgtatatcttatgataggtcgtatatggccaatgaagtatatttgtataaagtatatgatcatactagaccatttgggacagtatatatatattatatatataagtatacagagagtatatgattatacttaatatgatagtattatatgt

SEQ ID NO: 14803 - DNA, 1049 bp, Sorghum bicolor
  Clone ID: SORBI-28MAY03-CLUS18551_1
ccctggatgctcacagtcacagcacccacacactgcgcttcagaacttgcttgtgagcgaccgactgacagtacgtgcacaaccgtgcacggctagcaaataattaatcaacaaccatggcgtcgtctctggccaagtcatcgtcctccgttctcctcctcgccgccttcgtcgccctcttcgccgcctctgcgtcagtcgacgcggccaccttcaacgtgatcaaccgctgcaaggacacgctgtggccggcggcgctcccgggcggcggcgcgcgtctggacccggggaagacgtggaccgtgcaggtccccgcgggcacggcgcacgcgcggatgtgggcgcgcacggggtgccgcttcgacggcagcgggcgcgggacgtgccagacgggggactgcggcggcgcgctggcgtgcaccgtgtccgggaggaccccggcgacgctggccgagtacacgctcaacaacaacgggccggactacatcgacatctccctcgtcgacggcttcaacgtgcccatgtccttccggtgcggcggcaaggggccgagctgcaaggccgacgtcaacgccaagtgccccgccaagctcaaggtgcccggcggctgcgccagcgcgtgcgagaagctcggcggcgacacctactgctgccggggccaatacacggacaagtgcccgccgacggattactccaggttcttcaaggggctgtgcctggacgcctacagctacgccaaggacgaccagaccagcaccttcacctgcccaaagggctccaactacgagatcgtgctctgcccatgagtagtagtgccgtacgtggtggagtacaactatacacacgcgtataagcacgtggagtagttagtaaataaagtgcttattgcgtgtatgttaccccaggaataaggccttacttactggtggccatcatttgcaacatctgtttgtctatgaataaaggggggggaaatgcaaaacagcacaagatgttacttttattttttagatcccctatatataatgtcttgccactaatagaaactg

SEQ ID NO: 14804 - DNA, 613 bp, Sorghum bicolor
  Clone ID: LIB5047-007-R1-XP1-C2
gtgcggcgctcgaggcggcgggttggatgtcacagtcacagcacccacacactgcgcttcagaacttgcttgtgagcgaccgactgacagtacgtacgtgcactaccgtgcacggtgcacggctagcaaataatcaacaaaccatggcgtcgtctctggccaagtcatcgtcctccgttctcctcctcgccgccttcgtcgccctcttcgccgcctctgcgtcagtcgacgcggccaccttcaacgtgatcaaccgctgcaaggacacgctgtggccggcggcgctcccgggcggcggcgcgcggctggacccggggaagacgtggaccgtgcaggtccccgcgggcacggcgcacgcgcggatgtgggcgcgcacggggtgccgcttcgacggcagcgggcgcgggacgtgccagacgggggactgcggcggcgcgctggcgtgcaccgtgtccgggaggaccccggcgacgctggccgagtacacgctcaacaacaacgggcccggactacatcgacatctccctcgtcgacggcttcaacgtggccatgtccttccggtgcgggggcaaggggccgagctgcaaggccgacgtcaacgccaagtgccccg

SEQ ID NO: 14805 - DNA, 1821 bp, Sorghum bicolor
  Clone ID: SORBI-28MAY03-CLUS7170_1
cgggccctttcgctcctctcgccgctttgggttggggtttaagcgagtgcgagggaggccggaggcgacgacgacgggcgccggcgtcggagaagaagaagcagccaactctcgtatatgtcttcttgccccttttccgatctggtggtggtcgtagcgctcatcgtagccgtcgtcgccgtcctcctccgcgccctcgcctgctctagccgatctatgcgcaaggggctcaacggctggaacaaatcctcgtcgatgctcagggacgggttcggggtgaagtattccggattcctccacataaggccgtgcggcttctgtcgaggagactgacggattcgaccgatttgtgctcggctccgtcaaatttttgcactcagagaaagtttcttgtttttctttagtagttttcccccttagttttggcaattttggtgagagttctctccggctgaggagatagaagagagatggctccgttgaaccaccaccaggttctcatcaagaaggccctggcgaagaaacccaacagcaccaagaggatgactgggtttggccttaaaccctccgctgccctcctgaagtcccggccgcagcagcagccgccggcgccggtccagccaaggcgccgcgtccgcgtcctctttgaggaccccgacgccacggactcggactccgacgacgaggaggaggctgccggcgcccctactacgggccctgcaacaaggaccaagctcttctcttttgaggcgtacatcggcaaggccccagccaagccggtccttccggcggctactgtcgccgcgtgcaccagcggcggggcgccggagagctaccgcggcgtgaggctccgcaagtggggcaagtgggcggcggagatccgcaacccgttcaccggcaagaggcagtggcttggcaccttcgacaccgccggtgcggcctccgctgcctacctttccgcctcccggagcttcgccgacgagaagcggcgccgccgcgggcaggctgtgcccgcttccgcttcctcacctgctacttcggcaagcgctaccccgacggcgtcctcttcgtcgtccacctcgactgctccgttcgcgcacccgtcgccgtcgtccgtgctcgaatccaccaccaaggcagcagcgccgaaccccgagtctccagagccggtcgcgacaccaacacccgtcgtcctgccgccgtccactgaatctgctgcgcagctgccggacgacccagagttctaccaggaccttctgcgcggcctgcagctgcccgacatcgacccgatggacttccgcgccgggctggacgcgctggacgtctcggacgcggccttctgcctggacgacgaacaggacctcctgcttggggacttcggggatgaggagctggagattgacctcgacctcgacgacatcaacgacgtcttcccggagatgcctggctgcgacctgggccgcggcatggacgacttcctgcaaaccgtcgatttctgcgtgtgaattaaggagtgtgccttaatatgttagggttgttggtttgataaatcggggcctcgggagtgtgcttggaagggggatgatcttgggttttttccccgggcaattcaatctgctcgtgcccaagagatttcttcttctcgaacagcacattagcttgcggccggagagagtaattttggtagtaggttacattatgataagttatagtggctgtgctctgtttcctatgttatttggtaatgcttgtcaagacattatagtggacaagtcattgagctgttactattaagctatgaaagaaaaataagttcgtgat

SEQ ID NO: 14806 - DNA, 782 bp, Sorghum bicolor
  Clone ID: SORBI-28MAY03-CLUS5785_3
gccggccgggcttgctgacgtaatttcttctgtgtgctctcttgggtatgcatgtgcgcttgcctaaaaaaaacaggcagaaaaaaaaaacccacgcacgcagcctcactagggttttatcggcggcggcggcgagatggtgcagcgcctcacctaccggaagcgtcacagctacgcgaccaagtccaaccagacccgggtcgtcaagacccctggtgggaagcttgtgtaccagtacacgaagaagagggcgagcgggcccaagtgccccgtcaccgggaagaagatccaggggatcccccacttaaggcctgctgagtacaaaaggtccaggttgtctaggaaccgcaggactgtgaaccgtccatatggtggagtactctctggaattgctgttagggagagaatcatccgtgctttcttggttgaggaacagaagattgtcaagaaggtcctgaaaatacagaaaaccaaggacaagacagctgcaaaatagagctccaggaatggaagcctagcactgttttgtacactgcgaaaagtatttttggtggatggaaaatctagttgccttgtgttgagcatttagcatgtgagacatacctgttgaagtgttgagtttagagagtctggacactggaatatccctttcacctttgaattgttggaatattgggacatctgttccccaagttgctttgttatgaattcagaccatatctgggtaagatcagcttgtcgaataaattgaaaaaaaaaaaaaaaaaaaaaaaggcccctaa

SEQ ID NO: 14807 - DNA, 735 bp, Sorghum bicolor
  Clone ID: SORBI-28MAY03-CLUS5785_2
gccggccgggccgggcttccacgccgccacgccagagaggaagagcgcgcggagagccagagcccgggagaagcggcggccggcggcaagatggtgcagcggctcacctacaggaagcggcatagctacgccaccaaatccaaccagacccgcgtcgtcaagacccctggcgggaggcttgtgtaccagtacaccaagaagcgcgcgagcggaccgaagtgccccgtcaccgggaagaagatccaaggaattccacacctgagacctgctgagtacaagaggtccaggttgtcaaggaaccgcaggactgtgaaccgtccatatggtggtgttctgtctggtactgcagttagagagaggatcatccgtgcctttttggtcgaggagcagaagatcgtgaagaaggtgttgaagatccaaaagaccaaggacaaggcctccaagagctagacactattgcaatataggcatttaccacaatgtttaagtcaaattcgaatttgtttcggcaagaaattttctcgtgggtttggggaatcctggtacttatgctagtatgtgagatgggatgtggttgtttaaattttgagcgtaagttgcagatcctttttaagttttgtaactcaagttcggtggaatgttttttcacttggctatgtggatgtcagatattttgtgtaatgttgcttgcccagttgctccgtaaaaaaaaaaaaaaaaaagcccctagggccg

SEQ ID NO: 14808 - DNA, 832 bp, Sorghum bicolor
  Clone ID: SORBI-28MAY03-CLUS5785_1
gccggccgggccggggcttctcgttctcctagcctctctgctccagcctcccattagggtttatccaccggcggcgcgcgcgacggcggcaagatggtgcagcgtctgacctaccgcaagcggcacagctatgccacaaagtccaaccagacgcgggtcgtcaagacccctggtggtaagctcgtgtaccagtacaccaagaagagagccagcgggcccaagtgccccgtgaccgggaagaagatccaggggattccccatcttaggcctgctgagtacaaaaggtccaggttgtctaggaaccgcagaactgtgaaccgcccatatggtggagtgctctctggaactgcagttagagaaaggatcatccgtgctttcctggttgaagagcagaagattgtcaagaaggtgttgaaattacagaagaccaaagacaaaacttcctcaaagtaactctgaaacagaagtgaaccactcttctgtaaacaagggaagatatttttgtcgatggtgatgatcaatgaagtagtctcttctagctgtgttctagtatgtcttgagccgacaactgtttctagggtaccttgaaatctgtctaccattgtggtgtcaaagattatgagatgacatatgatccccatgttgcttttgttcacttcgctaaaactgcaagtctgagttcatatgagttgggcttcagttggtatttatatcctgcttgggtaaaatagctgttattccaatttgtctgtgggataagtttgcaatactatcgtccacctgtctcagacggtgatggctagtccttaaaaaaaaaaaaaaaaagggccct

SEQ ID NO: 14809 - DNA, 2077 bp, Sorghum bicolor
  Clone ID: SORBI-28MAY03-CLUS836_1
ctggtgacgcaaccgcggccgatatatacctcgcctccgcgctgcctccttggccaccgccgcatccaccacttccgccgccgtgctcgcctccaggctcctcctccgctgctcgccgcgcctgctgcgccgcctcagcgtgtcccgcgcgccgcacgcggcactcgcgtcgtcgtcgggccgcggcctcccgcccctcgtccgccactcgctcggtcaccgcgcccggatggggcacaccgccgccgctgcggccgtggccgccgaacccgctctcggcctcaccaagcccaacgccatcgagccgcctcaggtcaccttttccgctaaagacgtcgaattctccgagtggaagggcgatattctcgccgtcgcggtcacggagaaggatctgtccaaggatgccgactccaagttcgagaatgccgtcttgaagaagctggacggccagctcggcggcctcctgtcggaggctgcggcggaggaagatttcaccgggaagacggggcagtcggtggttctccgcctcgcggggcagggcttcaagagggtgggcctgatcggtcttggccagaacgccccgtccaccgctgccgctggccgaggtctcggcgagtcggtcgcgtcggttgccaaggccgcccaagctagcaccgctgcaattgttcttgcctcccccagtgggatccaggaagagttcaagctgactgctgcagctgcaattgcttccggaaccgtgctggggctgtatgaggacagcagatacaagtctgaatcaaaaaaggtgcacctgaagcaggttgatattattggactgggttctggtgctgatgtggatcagaaacttaagtatgctaatgacctttcgtcgggtgtgatattcggaagagagcttgtgaactctcctgcaaatgtccttacccctgctgtgcttgcggaggaggcgtcaaagatcgcttctacttacagtgatgtgttcacagccacaatactagatgtagagaaatgcaaagaattaaagatgggttcctacttgggagttgctgcagcttctgctaaccctccccacttcatccatttgtgttacaaaccgactgatgggaacgtcaagagaaagctggctattgttgggaagggtttaacttttgacagtggtggctacaacattaagaccggaccaggctgcagcatcgaactgatgaaatttgacatgggtggctctgcagctgtatttggtgcagctaaagctttgggacaaatcaagcctcctggagtagaggttcactttatagtcgctgcctgtgaaaatatgattagtggcacaggcatgagacccggtgacattgtaactgcttctaatgggaagacaattgaggtaaataacactgacgcggagggaaggctaacacttgctgatgctttggtctatgcttgcaaccaaggtgttgaaaagattattgatttggcaacactgactggcgcttgtgttatcgcacttgggcctagcattgccggggttttcacgccaagcgatgagctagccaaggaggttaccgctgcttctgaggtatcaggtgagaagttttggagactgccactggaggagagctactgggaatctatgaagtccggtgtggctgatatggtcaacactggcggtaggcagggaggttctattaccgctgccctgttcctgaaacagttcgttgacgagaaggtccagtggatgcacatcgacatggccgggccagtgtggaacgacaagaagcgggctgccaccggcttcggcgtttcgaccctggtggagtgggtcctcaagaactcctcgtcatgaacaaaaccccttcggcccttccccacatgttacatgcttttccaagctgccagcggtgaagaaaggtggagagggtttaccatggtttttttccccccttttgtgctaccattccattccacagttgcagccttgcaaactgcagacccgcctcttggcatgccaagtgggcgtgtgtgataccgttgtgatagaataatcatcataaagggtttggacttttagaacgcaaaaaaaaaaaaa

SEQ ID NO: 14810 - DNA, 883 bp, Sorghum bicolor
  Clone ID: SORBI-28MAY03-CLUS12137_1
gttttatacgccgtggcctgtgtcgcccactggagactcgaagaacacttcgttcaccaatccagcgctctcgtgcacacctactcacttgcctaggtccccgtagtgtgccatagcggcagcagccagcagccagcgagatgaacaagaagagcgtggttctgtacccgggcctcggcgtcggccacctgacgccgatgatcgagctggccaagctgttcacccagcacggcgtcgccgtcacggtcgcgctcgtcgagccgcccgccaagtcccctgacttctccacggcggtcgcccgcgccgcggcctccaatccgcgcgtcaccttccacgtcctgccgccgcctgaccccgccgattccagctcggatggtggcacgccgtcgcaccacgtcgaccagatgttcagctacctcaaggccatgaacgcgccgctgcgcgacctcctccgctcgctgccggccgtcgacgcgctcgtcgtcgacatgttctgccgcgacgcgctcggcgtcgctgccgagctcaacctgcccgtctactacttctacgcctcgggcgccagcgcgctggccgtcttcctcaacctgcctcgcatgacgaccacgggtttcctgcaggccgccgccggcgactccgtcctctcgttgcccggcgctcctccgttcagagcttcggaactgccagaactgatccggaacggcagcgcgacaggagagaccatcttccgcatgctccacgcgatcccagaggccaacgggatcctcgtcaacaccttcgagtcgctggagccgcgggccgtgcgcgctctcagggacgggctgtgcgtccccgaccgttccacgccgccggtgtactgcatcgggccgctggtttcgggagg

SEQ ID NO: 14811 - DNA, 1704 bp, Sorghum bicolor
  Clone ID: SORBI-28MAY03-CLUS308_1
gccggccgggttctacctcaacggactgatcagtgaccgctaaagctaaccacaccaaaccccccggccatggcgctcgcgtccacctccgccaccgcgcccgctgccgtgctcaagaccccgtcgttcctcggtgccaggcgcgcgctcgccaatgccgccgccgctgccaagcccgcgccgcgccgctcgctcgtcgtcgtcgccgcggtcgcccccaagaagtcgtggatccccgccttcaagagcgacgccgagttcatcaacccgccatggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcgggatcccgtggttcgaggccggcgccgacccgggcgccatcgcgcccttctccttcggctcgctgctgggcacgcagctgctgctcatggggtgggtggagtccaagcgctgggtggacttcttcaacccggactcgcagtccgtcgagtgggccacgccctggtcccgcaccgccgaaaacttcgccaacttcaccggcgagcaaggctaccccggcggcaagttcttcgacccgctcggcctcgccggcaccgtcaaggacggcgtctacatccccgacgtcgacaagctcgagcggctcaagctcgccgagatcaagcacgcccgcctcgccatgctcgccatgctcatcttctacttcgaggccggacagggcaagacgccgctcggcgcgctcggcctatgattttgcattgcatgctgccggtgccgacgacgaccgtgtcgtgtcatgctgtgtacttgtattcatcgatcgatcgaattcgaatcgaccgagttaaattctcgattgggcgcgtggcgtgggtgagggacgtatggcttcatcttcatcggatcagacgcattgaaatgcaaacaatggatcaagcttgccttgcttgcatgggattgattggatatttggattggagatcaaagaagagcgtagcagcaatgtactgtctgtgttcgtgacagcaaatggggacttcttctctgttttttcctcttccgtgtatgtaccatgtaatgtatagtttgtgaatgctagtcttagttttgttgagcacaatcggggatttaaccggagagttttcaatttcaattgaaaaatgttggcttaaaagccgtcaagcaagagctgcagatgccttaatgaagacagtgatggtgacagtgctctggacacaagcagtgatgtaagcaatgagagtgacaatgacaatgaaaggtctattggaacaacaacccagtgtttagcagaaaacatttgcaccgatcaagaaagtttgtccagtgatgactgtgagtccagcaaccagcaaccgtcccctgttttccaatatgtggagcatgatgcaccatatggaagacaacctttagcagatatgatttcagtatttgcatgtaagtttcctgatctaaatacatacaagagctgtgatcttctgccatccagttggatttctgtagcctggtatcccatataccggataccaacaggacccactctacaagatctagatgcttgctttttaacattccattcattgtcaacagcacctgacgg

SEQ ID NO: 14812 - DNA, 637 bp, Sorghum bicolor
  Clone ID: SORBI-28MAY03-CLUS245_2
gcccgcctctcgctccgaagcttctctcctctcgcgtctcgtaccaggaggaagggggacgggagagacccagggagcggaggcgtgcgaagctcgcttcgcgtgcgcgtgctgcggtctgcggggagcgggagattgggccctgagctagggtctgggactgggaggcggagatgtcgacgccggcgaggaagcgcctgatgcgggacttcaagcggctgcagcaggacccgcccgccggcatcagcggcgcgccgcacgacaacaacatcatgctctggaacgccgtcatattcgggccggatgacacgccgtgggatggaggcacgttcaagctgactctgcaatttacagaagattaccccaacaaacctccaactgttcggtttgtttcgaggatgtttcacccaaacatctacgcggatggaagcatctgtttggacatcctacaaaatcagtggagccctatatatgatgttgcggcaatactgacctctattcagtccctgctgtgtgacccaaacccaaattctcctgctaactctgaagcagccagaatgttcagtgagaacaagcgtgagtacaaccgcaaagttcgcgaggttgtggagcagagctggacagccgactaaaactt

SEQ ID NO: 14813 - DNA, 943 bp, Sorghum bicolor
  Clone ID: SORBI-28MAY03-CLUS245_1
gccgggcgcgccgctgtccctcgctcgctccgaggcttctgacgcaaccccgcggggtcaaggagccagccagagggggggaacgcaggcgcagcgagcgttctgccggagatcgaaaccctagctagggtttgagggcgccgggctgcggcggcggcggtcgagatgtcgacgccggcgaggaagcggctgatgcgggacttcaagcggctgcagcaggacccgcccgccgggatcagcggcgcgccccatgacaacaacatcatgctctggaacgccgtcatattcgggccagatgatacgccgtgggacggaggcacgttcaagcttactttgcagtttacagaagattacccgaacaaaccaccaactgttcggtttgtctctaggatgtttcacccaaatatatatgctgatggaagcatatgcttggatatcctacagaaccagtggagtcctatatatgatgttgctgcaattttgacttctattcagtctctgctgtgtgatccaaacccaaactcccctgcaaactcagaagccgcaagactgttcagtgagaacaagcgggagtacaaccgcaaagtccgtgagattgtggagcagagctggacagccgactagtgcagggggttgctcatcgtgctcgaaagggcacaataagaaatcatgaaaaaaaaaccctgcttgtgtttctggttcgccaggcttgtcgaaacattgaagaacccagtgattggttttctagtctgtcgttgtcgtggttttgccccaatcaagagccccggttgctcatggtggtggctgacctgtcgtaatgtagcggttgttgttgacctatatcttctcatgaattaaatggatcctgcctatgtacaaaaattatagcgtcggaatggttgtttgatggaccccagaaaaaaaaaaaaaaaaaaggccccta

SEQ ID NO: 14814 - DNA, 1886 bp, Sorghum bicolor
  Clone ID: SORBI-28MAY03-CLUS4207_1
gcaccagcgccgggaaccaggagagggggctcgtagatcaggaagcaagtgtactcatcagcaaagcatccagcattccagctagccagcagctagtactagaatctatatatcgtacacaagtagcggaggcatctatctgcagtccctttcttcttcctctcgattgataggtgcatcgccgctcgaagctcattggttttcttgggtggccattgtctctgtctgccggccagccgccaagctattaagtccatgcagggccaagcagcgcacagagatcggtcgacggcggggacaattcggagctagctagggaggatcggaggagaaggacaccaccaacgacgcctggccggctgctgccgtaggggaggacgatcgaggagtccgatcgacgacaccgatggacgatcatctccgtcatcagttgatggcgacaccggcagcagcaccagcaagcatgtgcggcagcgagggcaagaagcggcaggccggtgtaggaagtgagcatcgtagtagtaggggctgcggcggcgtcatcagtccgccggcggcgataatgaatggccgcgggacggcggaggaagcccccccgcgggtacggttggccgccttgttgggggagcgccgctgcgatttcttcacgacggcgtcgggtttgcccggggccgcgtcgaccccgtccctgcctgcctccacgtccaggtccagctgctctggctctccgagtccgagtccgagtccgagcagcggcggctgtggcggcacggccaccacgtcatcttctgccgtgaccgagtcagcgctgcggcaaagcagcggcggcgacaacgacgacgaggacgccgagctcgacgaggcgtccaccaccaccgccgcaaggcaacatcagtatcatcaccagcagcagcagcaggagtgctacgcctctgaccacttcttctggaacgacatcgcggcggcggaggcggcgagctacatgttcatcgacggcttggcaggagccggtcccggtggtcatcccgcaaccgcagaggtgggcgcggagccgccttcgtcgccgacgtgggagtactgctcggattactcgctctggaggatcgacgacaacgagtactacaagaagatgctcgactcctcctgatttcatcaggagccatctatatatgcatatcgatcattagcttatttgttttctgctgtttagtctagcagctatatgaattcaaacgttcgcctttaatatttcgttgcatctgttcgtatgttatatgtaataatatactaagtacatatatgtatttgcatctgcatactgtaactacatagtatatatctacacgtagtgacgtcctgcggcgccagcaggagtgctacgcctctgaccacttcttcgtcgccgacgtgggagtactgctcggattactcgctctggaggatcgacgacaacgagtactacaagaagatgctcgactcctcctgatttcatcaggagccatctatatatgcatatcgatcattagcttatttgttttctgctgtttagtctagcagctatatgaattcaaacgttcgcctttaatatttcgttgcatctgttcgtatgttatatgtaataatatactaagtacatatatgtatttgcatctgcatactgtaactacatagtatatatctacccgtagtgacgtactttgaagcatatatatgtgtgtacgaaactacggggcatgcatctgcatactgtatcatattgtacgaaacctggcattattattgtcttgtgatttttgaaaaaatcagttgaaactcgccaccaattgtagggtcatgctgcttctatatatgtatattcatgtaataagattataagtgattatgag

SEQ ID NO: 14815 - DNA, 1650 bp, Sorghum bicolor
  Clone ID: SORBI-28MAY03-CLUS3143_1
cagggccgggggaattggatcttgcgttgcgtagctgccgaccgcgggcaagcagagcagcaaagcatggaggttgaggccgacgccgaggtgcggcactggaccgcggatgtcaacggcatttcgctccacgtcgccgagcgcggccccgccgacgggccggcggtcctcctcatccacggcttccctgagctctggctctcctggcgccaccagatggccgcgctcgccgcccgcggcttccgcgcgctggcccccgacctccgtggttacggcgagttcgaggggaggaggtccgagtttatttcccgatacgaaaggagagcacgaatcaaggaccgagtttcaagttccaacatggaaaccgagttccaggatggtaagcaggaggttattgaagcatggtacatggacgatagtgaagaagaccagaggcttcctcatcaccgtgatcccaaagaattcattcctcttgataagctttcagaactgggaatcatcagctggcgcctgaatcctgacaactgggagaatgatgagaacctcaagaaaatccgtgaagccagagggtactcttacatggacatttgtgatgtatgcccagagaagctgccaaattatgagattaagataaagaatttctttgaagagcacctgcatactgatgaagaaatacgctattgccttgaagggagtggatactttgatgtgagggacgaaaatgaccagtggatccgtgtagcagtgaagaaaggaggcatgattgttcttcctgcagggatgtatcaccgcttcacattggacaatgagaactatatcaaggcaatgcgtctctttgttggcgagcctgtttggacgccgtacaaccgtccccatgatcatctgccagcgagaaaggagtatctggacaagctcctcaagccagaaggccaagctgttgaagctcgttgagacaatttgaaagctacctgttggcctctttccaccctgcgtcctgtgtcgtataacctgaataagatgttgtatgtccctaatctagtactagtgtcctggccaatttgaagtgaacactgtaactactgtctatcaggatcaggtgaggtcatctggcttaaatacctgcaatatatatactgtaaacatatatctaataaatagaaacgggtgcatctttctatgaagtattgaagtggatgaaggtgcgttttaccaaaacagtttgtaacctacttctactagtttactagccaggaggcatcatcttgatgttttgttgatgtacgatgggtctccatttctttctgaactgaaaaagtcttgaataaagtgtgagctaagcatttgctggcttgcgtgtatgaatatgaataaaaagagcatgtgacaaaaaaaaaaaaaaaaaactcgacgaggtccgagtttatttcccgatacgaaaggagagcacgaatcaaggaccgagtttcaagttccaacatggaaaccgagttccaggatggtaagcaggaggttattgaagcatggtacatggacgatagtgaagaagaccagaggcttcctcatcaccgtgatcccaaagaattcattcctcttgataagctttcagaactgggaatcatcagctggcgcctgaatcctgacaactgggag

SEQ ID NO: 14816 - DNA, 640 bp, Sorghum bicolor
  Clone ID: LIB5048-006-R1-XP1-E3
ccgggagaaatttgtatttatgcaagtcaccgtgagcaggtagcgcgtcaagcagagcagcaaagcatggaggttgaggccgacgccgaggtgcggcactggaccgcggatgtcaacggcatttcgctccacgtcgccgagcgcggccccgccgacgggccggcggtcctcctcatccacggcttccctgagctctggctctcctggcgccaccagatggccgcgctcgccgcccgcggcttccgcgcgctggcccccgacctccgtggttacggcgactcgtccgtgcccaccgaccccgccgcctactccatcctccacatcgtcggcgacttggttgcgctccttgaccacctccaactcacaaaggtgttcgtggttgggcatgactggggcgcgcaggtggcgtggcacctctgcctgttccggccggaccgggtgcgcgccgccgttgtcctggggattccctacttcccgcgcggctctcgcccgttgacggacagatttgtcccgctcggtgatggctattacatcaatcagttcctggagccagggagaaactgaagggcatttgctcgctatgatggtgctacagtcctaaagaaagtctacgccatggaaatcgatgagatacttgctc

SEQ ID NO: 14817 - DNA, 2098 bp, Sorghum bicolor
  Clone ID: SORBI-28MAY03-CLUS3194_1
gcgcgaccaacatctctttacccagcgagcccagggtagccgaggaggaccgcactccgccatttgccaccgccgcctccgcctccgcctccttttccttgcagcacaagaagaagagagggaagattcgccgcccgccggaggcgctgcaaggctcatttccaactaccgccccaacatgcctgccatctgtgttgtcactctccgtctgaagacaaaccaaagcaggtgcacgtcgacagctgcgtttgaggccaggcaatcactcaaagctagggccctcgtccccatgcctgctggcctccagcctcgagctgactctgcccgggttactaacgagtctgtgtaggaggttgctcacgaccaggcccaagcctcgctcgtcctcaactcccatgaccgtgtcgatgtttgccatgtcgtgcgcgattcctctgttctggagatgattgagctggatgattaggcaatcaccctatgcctgtatgctagggcatgtgtttgcctattttctcctcgccgtaaagttattggctatggataatcctctagcgcttgaaaaataagcagttattccctatggccccgtgaaagaatttgcttttgcagttacaacttgtcaggtagatcgaaatttgctcgacttaaagtgcctgtgtaactgttggaatgggaagatggaataatgcaataacaaatactgttcccccgtacttgttcaccggcagcgagactacttcagtttggttggaggtttctgaagttaaaggagacgatgtggtttgtataatcaagaacacagccaccttggctgggtcactcttcacactgcattgctcccagatccatattgacttgcccacgctgtctcatgaggataaggatgttatcaaaaaatggggtgctccaaataagattgacttcctttctttgtcttacacaagacatgcagaagatgtgcggcaggcacgcgagtacctctcgaaattgggtgatcttagccaaactcagatttttgccaaaattgagaatgttgagggcttgaaccatttacgtgaaatactggcagaggcagatggtatcattctgtcaagaggaaacctaggaattgaccttccacctgagaaggtctttctgtttcaaaagtctgcgcttcacaagtgcaacatggctggaaagcctgctgttgttactcgtgtcgtggacagcatgactgacaacctcaggcctactcgtgcggaggcaactgatgtggcaaatgcagttctcgatgggagtgatgccattctccttggtgctgagactctccgtggtttatatccagtcgagactatttcaacagtgggcagaatttgtgctgaggctgagaaggtattcaaccaagatttatacttcaagcgaactgtgaaatatgtgggagaacccatgacccacttggagtccattgcttcctcagcagtgcgagctgctatcaaagttaaggcttcagtgatcatttgcttcacctcttctggacgggctgcaaggctcatcgccaagtacaggcccagcatgcctgttctttctgttgtcattcctcgtctgaagacaaaccaactgaaatggagcttcactggtgcttttgaggcaagacaatcactgatagttagaggcctctttccgatgcttgctgatcctcggcatccagctgaatcaaccaactctacaaatgagtcagttctgaaggttgctctagaccatggcaaagcctctggtgtgatcaagtcccatgaccgtgtcgttgtttgccagaaagtgggagattcgtcagttgtgaagatcattgagctggatgactagatccttgtctactagggcatttgccgatttttgactaggccgaaaattgttggctatgtataatcctatagctttgccaaatgagcagtttttcctatggtgctatcataggacttgcttagcaatttaaaactcctgcgatgcagttgggagttgtcatattatatgccactcaaatgggcagatgggataatgaaatcatactgtaccctctatccgttgctattgtttttctgagcctgtttttggtttgtttttt

SEQ ID NO: 14818 - DNA, 1328 bp, Sorghum bicolor
  Clone ID: SORBI-28MAY03-CLUS107_3
cgtccgggtagtgttctttccgcgctgaagaaatcactagaccgtcttggcctatcgtcggttgagctctaccaactccactggccagggatgtgggggaacgaaggataccttgatggtctcgcagatgcttatgagcaaggcctagtaaaggctgttggagtctcaaactacaatgagaagcgccttcgggatgcgcatgctcgtctcaagaagaggggtgttccacttgctgcaaatcaggtgaattacagcctcatatacagaaccccggagctgaatggtgtgaaagcagcttgtgatgagctcggtatcaccaacattaggtctagatcgaggtggccgtcgcaacaaagttcgctgcccttccttggagatttggaaggggtagtgttctttccgcgctgaagaaatcactagaccgtcttggcctatcgtcagttgagctctaccaactccactggccagggatttgggggaacgaaggataccttgatggtctcgcagatgcttatgagcaaggcctagtaaaggctgttggagtctcaaactacaatgagaagcgccttcgggacgcgcatgctcgcctgaagaagaggggtgttccacttgctgcaaatcaggtgaattacagcctcatatacagaacccctgagctgaatggtgtgaaggcagcttgtgatgagctcggtatcacctggattgcttattcaccgatagcccaacgtccgtgttctgacaggtaagtacactccagaaaagccccctactggtcctcgagcaaatacatacacccctgagttcctcaccaaggttagtgttatgtaaactagagctcgctggttacactgacacagagcttcaatctctgcaattcaactttgttatctgaaaatgtcatacatgtacagctccaaccacttatgaacaggattaaagagattggagcaagctatggcaagagtccaacccaggtacggtggtttttttggggggaactggaggggccttggtccctgcagatgattttataaattaaaggacagagagtaatacaaaaaaaagtggttcacctacaaaagtttggaacatcaccagatcagaaacatttgagatcataacgagatgcatgaacacgattggtcttccttctcttccttcgtttcaggtgtctctgaactggctgacctgccaggggaatgtggtgccaatccccggagccaagaatgccagccaggccaaggagttcgctggtgcactcggttggagcctgacaggagacgaggtcgaagagctacgaactctggcacgcgagatcaagggcatca

SEQ ID NO: 14819 - DNA, 1789 bp, Sorghum bicolor
  Clone ID: SORBI-28MAY03-CLUS107_1
gcacgaggacgcgacgcgcgctccccctccggcctcagctcgccaccagacgcactcctcactgatggccacgccagcgatggtcccgctgcggcacctcttcctcgacggcgagtggcgcccgcccgcgcagggccgccgcgtccccgtcgtcaaccccacaacccaggcccccatcggcgagatgccggcgcgcaccgcggaggatgcggacgccgcgggggctgcggcgcggccggccccccggcggagccgcggccgggacggcgcccgcgctcctggagccggccgggcccagtgccagggtgcccgggtcacgcggggaattcagaggaatccggagctgcctaagctagaggcacttgattgtgggaagccttacgatgaagccgtatggtacatggatgatgttgctggatgctttgagtactttgcggatcgggcagaagccttggacaaaaggcaaaattccccagtttctcttccaatggaaacttttaaatgccacctccggagagagcctattggggtagttgggctgataactccttggaactatcctctcctgatggctacatggaaggtagctcctgctctggctgctggttgtacagcggttctaaagccatctgaattggtgacttggccgtcctgacagcttgctgatatctctatagaagtcggtcttccttccggtgtcttgaacattgtgacaggattaggtcctgatgctggtgctcctttgtcagggcacccagatgttgacaaggtcgcttttactgggagttttgaaactggaaagaagattatggcagctgcagctcctatggtcaagcctgttacactggaacttggtggaaaaagtcctatagtagtatttgatgatgttgacattgacaaagctgttgagtggactctgtttgggtgcttttggaccaatggtcagatttgcagcgcatcatctcgtcttcttatccatacaaaaattgctaaagaatttaatgagaggatggttgcatgggccaaaaatattaaggtttcggatccacttgaagagggttgcagacttgggccagttgttagtgaaggacagtatgagaagattaagaagttcatatctgccacgagaaggtggtgccattctccggagccaagaaggccagccacgccaagaagttcgctgggggttctttattgaaccaacaattattactgatatcaccacatcaatggaaatctggagggaggaagtctttggtccagtcctgtgtgttaaagaatttagcactgaagatgaagccattgaactggccaacgatacacagtatggtttggctggtgctgtaatttctggtgatcgtgagcgctgccagagattatctgaggagatcgatgctggatgtatctgggtaaactgctcacaaccctgcttctgccaagctccctggggtgggaacaagcgcagtggatttggacgtgagcttggagaagggggcattgataactacctgagcgtcaagcaagtcacggagtacatctctgatgagccgtggggttggtaccaatccccctccaagctgtaaacgagaaaatggcacgaaaacttgtctgtttcattagaataaataaatcttggatgccatacagaacgaacccgtgtatcaaatcgaacatgagacactgaaagaggcacatctgcggaataaagatcagaattgagtgttttgagagaattcttaagtatgccattggccgttataccggatccatgtattgccactgaaaataa

SEQ ID NO: 14820 - DNA, 562 bp, Sorghum bicolor
  unsure (1)..(562): unsure at all n locations
  Clone ID: LIB3481-011-Q6-K1-D11
cgtccgacttatgaacaggattaaagagattggagcaagctatggcaagagtccaacccaggtgtctctgaactggctgacctgccaggggaatgtggtgccaatccccggagccaagaatgccagccaggccaaggagttcgctggtgcactcggttggagcctgacaggagacgaggtcgaagagctacgaactctggcacgcgagatcaagggcatcaagatgcctatcgaggagtcgtagatacctccgtatttcaccaaccccatgcatggtatagcactgattagagattataaggttttaaagcgagaagaagaaaacacacggatctaaaaaggaaccaagatgtgtaagtactaagtagaaaatgcagctttcaacgaatctcatgcctatcagcctatgcactataactctgctgcctgttctccgctttacaaatacttagaatggaaagatagagactattgtgccgcanagcaacacaaaagaaactactcaaagtgaaagaaaagttacggtttgctttacagcgtttgtaaatttatgacatgacta

SEQ ID NO: 14821 - DNA, 343 bp, Sorghum bicolor
  Clone ID: LIB3481-013-P1-K1-H11
cgtccgcccacgcgtacgcccacgcgtccggagcaaggcctagtaaaggctgttggagtctcaaactacaatgagaagcgccttcgggatgcgcatgctcgtctcaagaagaggggagttccacttgctgcaaatcaagtgaattacagcctcatatacagaaccccggagctgaatggtgttaaggcagcttgtgatgagctcggtatcacctcgattgcttattcaccgatagcccaaggtgttctgacaggtaagtacactccagaaaagccccctactggttctcgagcaaatacatacacccctgagttcctcaccaagctccaaccacttatgaaca

SEQ ID NO: 14822 - DNA, 183 bp, Sorghum bicolor
  unsure (1)..(183): unsure at all n locations
  Clone ID: LIB3478-022-P1-K1-G7
caaacgcacgcacccnctcaggcctcagctcggcaccacacacacagaacgcgcgtgtgctcctgccttcccgatcgagcaacgagctaccttctacctagcttgaggacacgacacgatggccttgcaggtcaccggcggagtgggctgctgctgccctcgtcctctcccggcagtggcggc

SEQ ID NO: 14823 - DNA, 1881 bp, Sorghum bicolor
  Clone ID: SORBI-28MAY03-CLUS45820_1
gcccggggctcgcacagggctcgatctagccatggctgcggtacatgggggccttctccccggcattttcgccgtgctgatggtaatagccgtcgcaagcgctgcctccagtgaggcgtcctcggtggttatcggcctcgccaaatgcgccgattgcaccaggaagaacatgaaggccgaagcggcattcaagggtcttgaggtggcgatcaagtgcaggaacagcaaaggcgagtacgagagcaaggccataggcaagctagatgtctccggcgccttcagcatcccgctgagcacggacatgcacgccgctgactgcgttgcgcagctccacagcgccgcgggcaccccgtgccccggtcaggaaccttccaggattgtgccgcagtcgtccgatggcaacttcgtcgtggtccctggcaagacagactacccgtcggcagaatgcgcgtcggcaaccctatgcgggccgatcaagaagcacctgttggaccatttccacaagaagcctgtgccaccgaagccgaagccagagccaaagccaaagccagaacctaagccgcagccgaagtaccactcccctacgccaacatatcgatccccaactccaatctaccatcctccagcaaggcagttgttcgacaagaagcacatggttgatcacttccacaaggaccacgactatcaccacttcttggaccacttccacaagaagccatctccgctgaagccgaagccagaacccaaaccagaaccagaacctaagccacaccacttctttgaccacttccacaagaagccagttccaccaaagccgaagccagagcccaagccacagccagaataccaccctccgactccaacatacgggtcacccacaccgatctaccaccctccagctagacatttgtttgacaagaagcccttgctcgaccattttcataaggaccacgactaccaccacgtcttcgaccacttccacaagaagcccgtgccaccaaagccaaagccggagcccaagccgcagcctaagccgcagcctgagcctgatcactttcataaaggccatgactaccaccactttttttaccacttccacaagaagcctgtgccacccaagcccaagccagagcccaaacctcaacctgagcctgagtaccacccaccaacgccaacatatgggtcacctacaccaatctaccaccctcctgccaggcacttgttcgacaagaatcccttgcacgatgacttccacaaacaccatgactaccaccacatctttgaccacttccacaagaagcccgtgccaccaaagccaaagccgcagcctaagcctgagtaccaccccccgacacccacatacgggtctccgactccgatctaccaccctccggttgtgaaagaaatatcgtttgacaagaagcacttccttgatcacttccacaaggaccatgactatcacaagttctttgaccacttccacaagaaacctgtgccaccgaagcctaagcctgagcccaaaccaaagcctgagcctgagtaccaccccccagcgccaacgtacgcatcaccaactcccatctaccatcctccggccaaaaactgatcggttgaatcgagaacattggtcaatgatcaacgttgctagctatgagttgcatgtgtggtctagctagcgtggtttgcagtcctgttttgttttttttgtttctacagaataaagtacagcttcatttgggtgtgtatacttattttgtgtattgcgatagtgtcatatatatacatgtaagattccagtgagccttgtttttaatatgcattctatgatgtactttattcctttttaattattattatttatatatagaagttaaaaggttt

SEQ ID NO: 14824 - DNA, 1486 bp, Sorghum bicolor
  Clone ID: SORBI-28MAY03-CLUS4385_1
gccggcggcgcccgggcatcagaagctctctcactcgctggtcgcccacactggccccctcctcactctgatatttcgttttcgtccccccccccccttcccgtccgtcgccgaggtcctccgcggctccgccagccacatcagactcgtccctccaggaaccgcaaggtgaaccatgagcgccgtggcggtctcgtcgtcgtcgtcgctgaacccggacgcgccgctcttcatcccggcggcgctgctgcaggtggaggacttctcgccgcagtggtgggacctcatcaccaccaccgcctggttccgcgaccactggtcccgcgagcacgcccacctggacgagatggccgagcagctcgacgcggctggcctgctgcccgacgaagaggacctcttctacgacgaccagctcgagcaggcccccgccgccgtcgacccagcgcccgccgccgccgtcctcaagacagatgaggtgctcaaggcgctgaacctgacctccccgaagggcggcgacgccccgcgtgggttccgggagaagcccaggcactccgagaagccgaccaagtacgccggcagccccaagagcagcgccccccgcgtgatccaccagcctcgctaggttcgcatcgcatggggaactcagcaaggctgctgcccctcttccagcctctgctccctggctgctgccgttgcggtctgctctgctctttcaacaaagtttcaagtcaagtactggtggtgggttcgagtagtgatgagtagtagtacaactttagaagttccttctgtgtatagcaagcaagtaaaaaaaatgacaaaaaatataacaaaacgcagctggtctggtagttcactgctgctgctctctaagttgtgttcagtcctctggtgtgtctaggtctactagggaaaccccgcaaaaatggaagagggtgaaggtggagtcccagtgttaggatcaaggatgcaccttttgtaagtaaaatgtgtgatgttgtgcaatggcaggcagtctaatgttacgagttacccagcctctgctccctggctgctgccgttgcggtctgctctgctctttcaacaaagtttcaagtcaagtactggtggtgggttcgagtagtgatgagtagtagtacaactttagaagttccttctgtgtatagcaagcaagtaaaaaaaatgacaaaaaatataacaaaacgcagctggtctggtagttcactgctgctgctctctaagttgtgttcagtcctctggtgtgtctaggtctactagggaaaccccgcaaaaatggaagagggtgaaggtggagtcccagtgttaggatcaaggatgcaccttttgtaagtaaaatgtgtgatgtgtgcaatggcaggcagtctaatgtacggatctacctctctctctcgctccgattctagatttgccttgaaaacgaatcgcaatgagctcatgtgtgaacgttggtgtgtttttttttttc

SEQ ID NO: 14825 - DNA, 1805 bp, Sorghum bicolor
  Clone ID: SORBI-28MAY03-CLUS4845_1
aaaaaaaaaaaaaaaaaaaaaaaaaaaagagcagcacgagggctgcctccagctccaacccaccaccagacgagccgtctagccgagaggaggacgcggcaccgctcggtagcagccagggttgtcgcgctgagcacttgagcgcagtggccgcttgtctgttgtctccccgctgccactctcccacttccccgtctcgcgcccccccctcgcccgtccggctgtcccggcgtcccctgcagcttgtgctctgggtcggagggagctgagctgcgagggagcgcggaggggagggtttaggagatggagccagattcggcgaggaagaggctcgcattgctggctctgcttctcctcctggcggcgcccgcccggccggcctcggcggctccggtggaggatggcctgctcagcaatggcgactttgagacagcaccagccggtggttttgtaaaatctgcgtctgttgctgagggtgcatcgtcaatccctggttggacgatcaatggcacggttgagctcatttcagcaggccagcaccagggtggcatgatcctgattgttccacagggggaccatgctgtaaggctagggaatgatgctagtgttggtcaggtggtggacgttgagaagggctcggaatatgctatcacattcagcgctgcccggacatgtgcgcaactggagtcactgaatgtttctgtgctaggtggcatatcccagacagtagacttgcagacattgtacaacatagaaggctgggacgcgtatgcactggcttttcaggcgacggaagagcaggcacatcttcaattcatgaaccctggcatggaggatgatccaacttgtggtcctatcctagacaacgttgccgtcaagaagctcttcactccggacaaaccgaaggataacgtggtgctgaatggagactttgaggagggtccatggatgttcccgaacacgagctttggcgtgctgctcccaactaaccttgacgagcagacatctgccatacctggttggatgatcgagtcaaaccgcgctgtccgctacattgactctgatgagtacaaggttccccaggggaagcgtgccattgagcttctgtcaggcaaggagggtatcatctcccagatggttgagacgacccctcagaaggtttacagcctgacgttcacactgggcacggcaggggactcgtgccaaccaccaatggccatcatggcgttcgccggggatcaggcccagaacttccactactccccaataggcaacgccaccagccaggctgcgaatgtgacgttcactgcacgtgctgagagaacacgtgtggcattctacagcgtgtactacaacacgaggagtgacgaccacagctctctgtgtgggccggtgatcgacgatgtccgggtatggggcttgaacgcagcggctgggttgaaggcaagtattggactcgttcttggcattgttggtctcgctggcatggtgctcttctgaaatctgaatgcctcagtgcctgtggtcttgggaagtatggatgtataactattctgttagttggaggtggctgctagttttggtagtaagcttgaagtttgctgagtggtatgagcttaggctaaaaagctaccagaacctacatgttattgcttgtgttacttcatttgtgatttccgaagtaacttgcaattatatgggattgtatggtttgtttgccctagctatatgagatgtcagaattgttctaagttcatctcttcaatatattagaaaagagtaaagtacaacagccaattgttctt

SEQ ID NO: 14826 - DNA, 1961 bp, Sorghum bicolor
  Clone ID: SORBI-28MAY03-CLUS5493_1
gcacgaggctctttctctctctctgcacgaggccccctccctctttccagcgcggatctctttttcggggagggagaggaccaaggaagcgcccgcggagagagagagggagatggcgctcgctatcctggcgaggcggcgggcggcggaggccgtgctgcggcggccgcaggcggcggcggcgggggcggccgtgtccgcctggagggcgtacgcggcggcgggcgaggagagcgacgtggtcgtggtgggcggcgggcccggagggtacgtggcggcgatcaaggccgcgcagctcgggctcaagaccacctgcatcgagaagaggggcaccctcggcgggacctgcctcaacgtcggatgcatcccatccaaggctcttttgcattcatcacatatgtaccatgaagcaatgagttcttttgcacaccatggagttaagttttcaaatctggaagtggacctcccagccatgatggctcagaaagacaaagctgtggcagggctaacaaaaggaattgaagggctctttaaaaagaacaaggtgacttatgttaagggctttgggaaattgtcatccccctcagaagtgtcagtcgatttgattgatggtggtagcactgttgtcaaaggcaaaaacataataattgcaactgggtctgatgtaaaatcacttccaggaataacaattgatgagaagaaagtggtttcatctactggtgcactgtgcttgtcagagatcccgaagaaactggtggtaattggagcaggttatattggccttgagatgggttcagtctggaaccgccttggttcagaggtcactgttgttgaatttgcaccagatatagtaccatcaatggatggcgaggtcaggaggcagttccaacgcatgctagaaaaacagaagttcaagttcatgctcaagacaaaggttgttgggtgtgataccagtggagatggcgtaaagctgacacttgagcctgcagctggtggtgagcagaccatccttgaagcagatgttgtccttgtctctgctggcagaaccccatttacttctgggattgggcttgaaactcttggtgttgagacagacaacgctggcaggatccttgttgataagcgcttcatgaccaatgtgaagggagtctatgcaattggggatgccatccctggtcccatgcttgcccataaagctgaagaggatggtgtcgcatgcgtagagttcattgctggaaaggaaggccatgttgactatgacacagttcctggtgtggtctatacgcatccagaagttgcatctgttggcaagactgaggagcaggtgaaggatctaggaattgcctatcaagtgggcaagtttccacttttggctaacagccgtgcgaaggccattgatgacgctgaaggggtagttaaggtgatcgcagagaaggaaactgacaagattctgggtgtgcacataatggcacccaatgctggtgaaatcatccatgaagccgtcctcgccttgcagtatggagcatccagtgaggacgttgctcgaacatgccacgcacaccctacagtgagcgaagccctcaaggaggcttgcttgcaaaccttcgataaagcaatccacatatgatttctcattttctgtttctttaccatccgaactggtggctcaacaagatccaaagtttgtggtaattttgggtctgttggaacaaaaggcccctgattgccctttcgttttgttggcgatactgtgaattgaccctttgccaagttccccacatcttatagccgtttatgcttccttggcttggcttatccatccaaataatattctgaaccatatttgctgtttatgctcatgaaccattgatggatacatttctgacgttctagtaacctttgtgtcgcgatatttcattgtgactcgtactggatggccgtgtttgtgccttttctttttc

SEQ ID NO: 14827 - DNA, 2086 bp, Sorghum bicolor
  Clone ID: SORBI-28MAY03-CLUS8902_1
gcacgaggccccgagccagcacaccttcggcctcgctgcgccggccccccgatcgatcgaggcggcggcaaagcagaggaaaaccccagtcccttccccatcctcctcctcctcctcctcctcctcctcctcttcaactccagtcgccttcagcacttgaccacatctcttctcatcccaaccgccgcgtaggatcacaaggggatggcgagcggcggggcggtgagggaggtgcgttcgccggcggagctggaggcggcggtggccggggtgcgggcggcggccgtgcacttctgggcgtcctggtgcgaggcgtccaagcagatggacgaggtcttcgcgcacctcgccgtcgatttcccccacgcggccttcctccgggttgaagctgaagaacaacctgaaatatcagaggcacatggagtgtcagcggtgccatatgttgttttctacaaggaaggcaaaattgtcgatactttggagggagcaaacccagccagcctagccaataaggttgcaaaagtagctgggcctgctagtgttgctgagtctgctgtacctgctagcctcggagttgctgctgggcctgctgtacttgaaaacatccaaaagatggcacaacaaaatggttcttctgctgctgaaagcacaaactctggtagcaaggaagatgcattgaataagcgattggagcagcttgtcaattcccatcctgtgtttttatttatgaagggaaccccagaacaaccaaggtgtggcttcagccgtaaagtggttgacattttgaagcaggaaggagtcaaatttgggagttttgacattcttacagataatgatgttcgtgaaggtatgaagaagttctccaactggcccactttccctcaactctactgcaaaggtgagctgcttggtggatgtgatattgttatcgctatgcatgacagtggtgaattgaaggatgtttttgaggagcacaatattcccctcaaaccacagggaagcaaaaatgaagaagcaggtgaacctggatctgcaactgataagggtggtgcagttgctgaaccaatcaggcttactgatgcccagaaagctcgtttggaaagccttattaattccagcccagtgatggtattcatcaaaggtacacctgaggaaccgaagtgtgggtctagtgggaagttgcttcacatacttaagcaagagaacattcctttctccagttttgacattctctcagatgatgaggttagacaggggcttaaggtcttctcaaactggcccagttaccctcaactgtacataaaaggtgaactggttggcggctcagacatagtgatggagatgcataagagtggtgagctgaagaaggtcctgtctgagaaaggggttattccaaaagaaagtcttgaggacagattgaagtctctgatttcctctgcaccggtgatgcttttcatgaagggcactccagatgctcctcgttgcggcttcagttcaaaggttgtgaacgccttgaagaaggaaggggtcagctttgggtcctttgacatcttatctgacgaggaagttagacaaggtttgaagacatactccaactggccaaccttcccccagctctactacaaatcagagctgattgggggctgtgatataattcttgagatggagaagagcggagagctgaagtcaaccttgtcagagtagacacctagcattcttgcctcgctggtgtttctatcatattgcctgcctgcattggatcactctactatgacatttatgccaatgtattcatagatccacgtttggtacttgtctgcagtgccacattgctagaattgtgacacctgcagaaggaataacttgagacgcttgttcggtactgattgctcttatatcaccagttctatttagcggatggaagcttttttgttcgggtattgtcacgatttatagatggatgaattaaaatctttagagtatttattatctgtttacgtgtagttgtgtacttaagtcatgccattgtttttggaaagtcacatgtgaaaattgtttaaggttttgatttaaaattaattttgaa

SEQ ID NO: 14828 - DNA, 1179 bp, Sorghum bicolor
  Clone ID: SORBI-28MAY03-CLUS3255_1
agcctgactcgccgccacgcgtttgccttggccccaggcgaatccttccctgccttctctctcgccgcgtcgcgttgccggctccgtctcctcctcgggtatataaccgccagcaggggggaaggggatcggacaaaccagcaggcgtcgtcgtcgctctgcccacaggaacatcgccgccggaggatcggctacttctgctgtttctgggcgcgccggagctcgcgtcgtcgttcggtaacttggggagaccatgggaggagggaaggacaagcatgatgagagcgacaaggggctcttctcaaacatgatgcacggcgttgccggtggccatgggtaccctcaccagggataccctccgcagggctacccaccaccacaaggagcatacccacctcccccaggggcgtatcctcctcctccaccaggggcatacccacctccacctggggcatacccaccacaacatgggtaccctcagccaggtggctacccaccgcaaggtggatatcctcctgcaggctacccaggctcatctcaccagggttatgggagcagccatggcgggagccacatggggatggggacagttctagctggaggtgctgccgccgccgcagctgcttatggagcacacaagctttctcatggccatagcggacacggtggacatggtgtctttggaggaggctatggtcatggtggctacggccacggctacggcggccacggcaagttcaagcatggtcacggcggccacggcaagttcaagcacggtcacggcaagttcaagcatggcaagcacgggcacggcatgttcggcggcaagttcaagaagtggaagtgatgcgctctccatggttgatcataactgaacttgtatgcaagcttccagcacatctgttgcctggaacgcctttgcattgtatctagtagggtgatcacttactcatccttggtctatattgccgtgagcttgtggcgagtgacatgactgctaataagtgacataataaccatttactgtcttgctgaaaaaatgtgttgatgctgtggatgaagcgctctgaagattattcatgtgcattgattcggtcgtgccctgcgtttacggtgctcatgcaggcactgaatgtttcgactgtattatctgaccaatcattgaagttattttttctg

SEQ ID NO: 14829 - DNA, 896 bp, Sorghum bicolor
  unsure (1)..(896): unsure at all n locations
  Clone ID: SORBI-28MAY03-CLUS5050_3
ctgtgcggcgctcgagccggccgggccgggcttcacccgccgccgcctcctctcgtcatcttcgtccccttaggctaggttaggctagggtttcgacgagctcgcggaaatggtggccttcaggttccatcagtaccaggtggtggggcgcgcgctgccgacgcccggcgacgagcaccccaagatctaccgcatgaagctttgggccaccaacgaggtccgcgcaaagagcaagttctggtatttcctgaggaagttgaagaaggttaagaagagcaacggccaggtccttgccatcaacgagatctttgagcgcaacccaacgacgattaagaactacggcatctggctgcgctaccagagcagaaccggctaccacaacatgtacaaggagtaccgtgacacaaccctgaatggcgctgtggagcagatgtacaatgagatggcttctcgccaccgtgtgaggtccccctgcatccagatcatcaagaccgcgacagtgcacttcaagctgtgcaagagggacaacaccaagcagttccacaacagtgagatcaagttcccactcgtgtaccgcaaggtcaggccgccgacaaggaagctgaagaccacgttcaaggcttcgaggccgaacctgttcatgtgatttagctgtggtcagtgtatgtgatcgtaagagtcggaagtgttttgttttaagttttgacttgctaagacctcagtggtttgatgattcaactcgttttgaaacgtgcttggtgaaccatttgtgcatcaacgtattgcgagttgntcgcacttggcacactaggagtgataatggtgatctattttgcgagttgatttacaaaaannaaaaaaaaaaaaattaaaaaaaaaaaaaaagcccctagggc

SEQ ID NO: 14830 - DNA, 848 bp, Sorghum bicolor
  unsure (1)..(848): unsure at all n locations
  Clone ID: SORBI-28MAY03-CLUS5050_2
cccacgtgtgcccccgtatcacccccggcttaggtttaggtctcctcctctccgccgccgccagctgcggagagctcgccaaaatggttgcccacaggttccatcagtaccaggtggtgggtcgcgcgctgccaacccccgctgatgagcaccccaagatctaccggatgaagctgtgggctaccaacgaggtccgctccaaatccaagttctggtactttttgaggaagctcaagaaggttaagaagagcaacggtcaggttctcgctatcaacgagatatttgagcgtaaccctaccacaatcaagaactatggcatctggcttcgttaccagagcaggacaggttaccacaacatgtacaaggagtaccgtgataccaccctcaatggtgctgtggagcagatgtacaatgagatggcttcccgtcaccgtgtaaggtcaccctgcatccagatcatcaagacagcaacagttgacttcaagctctgcaagagggacaacaccaaacagttccacaattcaaagatcaagtttcctttggtttaccgcaaagtcaggccaccaaccaggaagctgaagaccaccttcaaggcttcaaggcccaacttgttcatgtgatccaactcaccctggcaccatccgaaaactgtgagcctggcagtctggagggtttctagttcaggttaattaaatctacatgcaaagtttctgaattgtagttgtaggtccatgcagtggcctttattagcttgatgaatatacccattttcctttctgtccttaccatctttctgccttataattatatagncatttcagatctcatctgcttttagctttattnag

SEQ ID NO: 14831 - DNA, 911 bp, Sorghum bicolor
  Clone ID: SORBI-28MAY03-CLUS5050_1
gccggccgggccgggagtcggccgccatctccccctgttaggttttaggagacctccgccgcccctccggcctcgcgagctcgccgaaatggtcgcccacaggttccatcagtaccaggtggtgggtcgcgcgctgccgaccccgaccgatgagcaccccaagatctaccggatgaagctctgggccaccaacgaggttcgcgccaagtcaaagttctggtacttccttaggaagctcaagaaggtgaagaagagcaatggccagatgctcgctatcaacgagatctttgagcgcaacccaaccactatcaagaactatggcatctggctgcgttaccagagcaggaccggttaccacaacatgtacaaggagtaccgtgacaccaccctgaacggtgccgtggagcagatgtacaacgagatggcctcccgccaccgtgtgaggtccccctgcatccagatcatcaagacggccacggtgcacttcaagctgtgcaagagggacaacaccaagcagttccacaactctaagatcaagttcccgctcgtgtaccgcaaggtgaggtcacccacaaggaagctcaagaccaccttcaaggcgtccaggcccaacctgttcatgtgatagttgtcgtcagattatcgtacctgtgtgctgtttcttagggtctgaagagtaggaaagtttgcttttttaagtttttgtgttccttggattgagcagtttgatgtttccaagttactggatttgaatgttgctatgcaaacccgctgactcttatcccaatatttacgcacatagtacactagaagtgataatgttgatctgctttgcgagtttgttctaggtccaaaacagtgtctacttttgcctgtgtggctgctggctgccccgttcttatttgtactgc

SEQ ID NO: 14832 - DNA, 2342 bp, Sorghum bicolor
  Clone ID: SORBI-28MAY03-CLUS3580_1
taaaccgcgctctttctctctgctcacgacgccgccgttgggagccctgccccgggagagcccccaacccttatcaaaccctaaatcaaaaactaccccaaaaaaatccgcaaaaaaccagaaaaatcccaaaaatcaccgcttgattggagatggcggcgcaagggcaggcggcggctggatccgcgtccgagtccggcggctcaccggctgcctcagctgcggcggcggccgcgttcccggcgacttcgctctacgtgggtgacctgcacgagagcgtgcaggacgcgcagctcttcgacgtcttcagccaggtcggcggcgttgtctccgtgcgcgtctgcagggacatcaactcccgcaagtcgctagggtacgcctacgtcaactacaacaatcccggcgacgctgcacgggcacttgaactgcttaacttcactcctatcaatggaaagcctatcaggatcatgtattctaaccgtgaccccagttcgcgtaaaagtggtgcaggaaatatatttattaagaatcttgataagtcaatagacaacaaagctttatatgacacgttctgtgcatttgggaatatcctttcatgtaaaattgcaacagacccctcaggagaatcaaggggctatggtttcgttcagtttgagagggatgaatctgctcagtctgctattgataaactcaatgggatgcttatcaatgacaagaaagtgtatgttggaccttttgttcgcaagcaggacagggagaatgtttcgagcaatttcaaattcagtaatgtatatgtgaagaatctgttagatactgttactgatgatgagttgaaggagatgtttggaaaatatgggtccatcactagtgctgttgttatgcgggatagtgatgggaaatccaggtgttttggatttgtcaattttgaaaatgctgatgatgctgctcaggctgttcaagagttgaatggcaagatattcaatgataaggaactgtatgttggaagagcacagaagaagtctgaaagagagatggagttgaaggagaaattcgaaaagaatattcaagaggtagctgagaagttccagaacactaacttgtatctgaagaacttagaagataacattgatgatgagaagttgcgtgaactctttgctgagtatggcaatattacttcttgcaaggttatgcgggattcgaatggtgtcagcagaggatctggatttgttgctttcaaatctgctgaagatgctaaccgagctcttacagagatgaatggcaaaatggttgggagcaagcccctttatgtagctcttgcgcagcgtaaagaagacagaaaggcaaagctacaggcacagttttcacaaatgcgtccagttgcgatggcgccttcagttggtcctcgcttgcccatgtttccacctggtgtccctggagttggtcaacagctgttttatggtcagccacctccagccttcataaaccctcaggctggatttgccttccagcaacctctgatgcctggtatgaggccgggtggtccaatgccgaactttatgatgcctatggttcagcagggacagcaaccacagcgtcctgctggtaggcgcgctggtgctagtggaatgcagcagcccatgccaatggctggtcagcaacagatgttccctagaggtggacgtgggtaccgctatcctactggccgtggaatgcctgatcctggcatgcatagtgttggtgctgtgatgccatctccatatgagatgggaggggtgccaatgagagatgctggtctctcgcagccgcagcctgttccaatcggggcactagccactgcgcttgctaatgccccaccagatcagcaaagactgatgcttggtgagaacctgtatcctcttgtagaacagctagagcgtgagcaggctgctaaggtcaccggcatgcttttggagatggaccaaacggaggttcttcacctgctggagtcaccagatgctctcaaggccaaggttgctgaagctatggaggtcctccgctctgcccagcatctccagcagagcaatgcctcccccgagcagcagctggctaatctatcactgaatgatggtgttgtttccagctgaatgtttctgatgatttggaaactgctctcaatttttgcttgataccatcctatctagagtgcaatgactttgtttacttggcttattggagatttagctgattagctgaaccagaggtgggtttagttttgttgctattttggttatttatggatatgttgttttgttggagctgttttgtgactgttactcgatttatcacagttgttttagagcgtc

SEQ ID NO: 14833 - DNA, 1865 bp, Sorghum bicolor
  Clone ID: SORBI-28MAY03-CLUS1236_1
ccccccccactgccacggccgcgatccatcccggcagcgacctagggagcgagggagagtctcggccggccggggcaagctagctcggccgccaccatggcgcgggaggagcaggcgctgctgtcgacggagatcatgaaccgcggcgtggagccgtcgggcccggacgccgggtcgccgaccttctcggtgcgcgtgcgccgccgcctgccggacttcctgcagtcggtgaacctcaagtacgtgcgcctagggtaccactacctcatcagccacggcgggtacctggcccccctccccgttctcgtgctcgtctgcggcgctcgaggtgggcagcctgatgcacgacgagctgtggcgcagggtctgggccgtggccgcctgcgacctcgccaacgggcttgcgtgcgtgggcgtcctgccgcccgcccaccctgtcgggccgtgggtcgaccccatgcaccgctacccggtggagctcgcggacatcgtcaaggacacatctgatgactcctaaagcatgcacgcgcgcagcccaactggcggttttcagcgcgatatatttgtacatacctggtatacgtatacatattcattcagttcgcgagagaagaaaagtatgcgtctagtcctcgcaaaaaaggaagagtatgcgtaaatatcggcggatatatgacatgtcgacgtctcagatagggcctcggccttctataatagctggatcatcgatgccattgattgtatgtagcccaaagcaaagggacttgatctgtttggggcctaaccttcgtacgacaacgcgtcaggcgccgttaggatggaaacagacaatattacgggggaacatcctgagctacaacctcggcggtatgggctgcagcgcgggcgtcatcgccgtcgacctagcccgggacatgctgcaggccagcgggaccgtccttgccgtggtgatcagcacggagaccatctccctcacgtggtactccgggaagcatcgctccatgctcatccccaacgccttcttccgcgccgggtgcgcggcgctgctgctgtccaaccggcgccgcgacttccaccgggccaagtaccagctggtgcacatggtgcgcacgcacaagggcgccgacgaccgcgccttccgctccgtgtaccaggaggaggacgaggagcggatagagggcctgtccatcagccgcgaccctcgcacgatggccggggacgcgctcaagaccaacatcacgacgctgggaccgctggtgctgccgctgtcggagcagctgctgttcatcgccacgctggtcgccaagaaggtgctcaagatgaagaaggtgaagccgtacatcccggacttcaagctggcgttcgagcacttctgcatccacgccggcgggcgcgccgtgctggacgagctggagagcaacctgtcgctcacggactggcacatggagccgtcgcggatgacgctgcaccggttcgggaacacctccagcagctcgctctggtacgagctggcctacagcgaggccaaggggaggatccggcggcgccaccgggtgtggcagatcgcgttcgggtcagggttcaagtgcaacagcgccgtgtggagggcgctccggtcggtgaacccggcggaggagaacaacccgtggatggacgagatcgacaggttccccgtggatgtccccaaggtctccaaggttaccagcgactgaaatgtgcacccctgatcgtggttagcgatagtgattattactattccttgggagtttgcaattgtttgggtaaaggatctggtgggaattttcttgagtttatatcactaggaaaagcgatgatttacttgtctgagatctgtatttcatagc

SEQ ID NO: 14834 - DNA, 1364 bp, Sorghum bicolor
  Clone ID: SORBI-28MAY03-CLUS1419_1
gcacgaggggtcagggtcgacgcgcgtccaagcaccccatcagtgtaggggctagctagcagcattggtgccgtgtcagtgtgacactggactgaaattctctagctataggtagtagcaagctaagagaaaaagcatgtcgaaggatgacgtgacggcggaggcggaggccgcggcgaaggcgccgtactgggatccgccgccggcgccgctgctggacacgagcgagctgaagaagtggtccctgtaccgcgcgctcatcgccgagttcatggccaccctcatcttcctctacgtgagcatcgccaccgtcatcgggtacaagaaccagtccaaggccgaatcgtgcaccggcgtcggcgccctcggcatcgcctggtccttcggcgccaccatcttcatcctcgtctactgcaccggcggcatctcaggcgggcacatcaacccggcggtgacgttcggtctgttcgtggggcggaagctgtcgctggtgcgcacgctgctgtacatcgtggcgcagtgcctgggcgccatctgcggcgtgggcatcgtcaaggggatcatgaaggtgccctacaactccctcggcggcggcgccaacgcggtggccacggccccctccgacggggtgctcacgggctactccgtcggcagcgccctggccgccgagatcgtcggcaccttcatcctcgtgtacaccgtcttctccgccaccgaccccaagcgcacggcgcgcgactccttcatccccgtgctcgtgccgctgccgattgggttcgcggtgttcgtggttcacctggcgaccattcccatcaccggcaccggcatcaacccggccaggagcctcggcgccgccgtcgtgcacgcagcatggaaagaccattggatcttctgggttgggccgctgatcggggcgacggtggcggcgttgtaccacaagctcgtgctgcgcggggaggccgtcaaggcgctcggctccttcaggagcaccagcgccacggtgtgagagtgagagcatctaattctgcttcctgcctgcagcgtataaacgtgcatatgaagcgcgaagctgttgatttgcctgaacaagattggcgccctccgtgtgtgtagttcctccaactgattcccaattcgttgtcgatcgtctccttcaatatatgcaatatgctacggggtgcttattacacgaacagtatgtatgcacgcttgtccgtgccatttcttttttttgtttgggaactacgaggtcgtccatgtatataaacctatgttctgcttgattagttatctatacacatgttgttaccaatacagtacgtatatatgcatagtagcagactgtggtcctccttatctaagaa

SEQ ID NO: 14835 - DNA, 504 bp, Sorghum bicolor
  Clone ID: LIB3478-020-P1-K1-B4
catcgtcaaggggatcatgaaggtgccctacaactccctcggcggcggcgccaacgcggtggccacgggcccctccgacggggtgctcgcgggctactccgtcggcagcgccctggccgccgagatcgtcggcaccttcatcctcgtgtacaccgtcttctccgccaccgaccccaagcgcacggcgcgcgactccttcatccccgtacggcgaccgcgcctctcgcgcgcgcgcggctcccctggaccgacctccacgcgcgcctgctttcccctgctacaactacaggtgcaaatgtgttaatcccggccccttgtcgtgcgtgcgtgcaggtgctcgtgccgctgccgattgggttcgcggtgttcgtggttcacctggcgaccattcccatcaccggcaccggcatcaacccggccaggagcctcggcgccgccgtcgtgcacgcagcatggaaagaccatgtaattgagataattaatctctataaccacactcttatt

SEQ ID NO: 14836 - DNA, 1697 bp, Sorghum bicolor
  Clone ID: SORBI-28MAY03-CLUS6090_1
gcacgtggcagggagcggccccccgcagagggccccgctccgccaccctccccccagcacacttctcaagcatcgccacagcaacacgatacccgtggcgggggttgtgcctcccgccggcgggagatgtgcgctatgacggccgagcagctgaaagatgaaggaaggcagtaggagctgagggggaggagaaggggaggtgccgggaccgatctagctgaaggtacgatctatttcgcctcgtacatagcggcacctggaccacacttgagctggggggaagaccgaccgggcgcaccagcgacggcgattgtccgccggctctagatcgagattgcgatagctttcgtgatattctggaggcagaagggatgtacaagatgcgggccccttgttcagcgagtggacagaaaagtagcagagggggaaacgtgcacgcaagctgttcatgtaccaaagtttcattgatgataattgtggatacggattggctcagcaaatgccccttagcaggtcagttgtggttttgagcttaatttcgtacaaaacactttccatttttctccgttggtatagctcttttaccatatgaggtctgctgttaagttggagtgtatgatgccatgtcacgcctgatattctgaaatatgtacaagcctttgtcacaaagttgaaatctggtaaacgttggaacaagcaatcctgcttcatatggttcgaccaattcacagaaacaaatgtcccttccagcaaaagctggacaaacttcctctgcgggtactatgaatgaagggtatggaactagaaatgcatacaatgcaaatggaaaccagtcagcaggataggcgcccgacactcagaacattcctgcaaacatcaccatgcaatatgacaggagtgcggggccgcctggaagccagtttagtggttcatcccttcagagtcaagcttcaagagggtccaatatgctagcactgggcccttcgcagcaacatcaaagttttgaattcccagcacttggccagtccttgcagccaacaggcctgaatccttttgaagaatggccacagcaacaggagaactgtggtggtattgatgactacctgacggaggagatcaggatgaggagccatgagattctggaaaacgaagaaatgcagcaaatgttgcggcttctgagcatgggtggtgcaggaaccaacctaactgaagatgccttcaatttcccctcatacatgcctgcaccttcaccaaacttgagctatgaggatgaccgcacccgtgcacctgggaaagctgttgtcgggtggctcaagatcaaggctgctatgcggtggggcatctttgtcaggaagaaggcagctgagagaagagctcagcttgttgagcttgacgactagaaagtaacagctggaagcatgtgcactcgagctgttcatgtaccaaagtttcattgatgatgtttgtggatccggatgggctcagctaatgtcccttaggaggacagttctggtcctgaccttaattatggacaaaactctctccatttttctccttctgtatagcccttttaccatttaaaatgtgttgtttgtttagtgtgatgctagccctgttatgaaccttaaaacaggtaaaaaaaaaaaaaaaaaaggcccctaccggcattaaatagctgtccacctcagacttcatcc

SEQ ID NO: 14837 - DNA, 361 bp, Sorghum bicolor
  unsure (1)..(361): unsure at all n locations
  Clone ID: LIB3478-017-P1-K1-F2
gtttggagattagaaaagattggcaaggatggtgcattccacaagaagttaaatgctaatgggatctatacagttgaagacttcctccggcttcttgttagggatcagcagagattacgtagtattctgggcagtggaatgtcaaataagatgtgggacagccttgttgagcatgcaaagacatgtgtcttaagtggaaagcattatgtatactatgctagagactcgagaaacgtgggtgcaatattcaataacatctatgagttcactggtttgatcgccgatgatcagttcatttcagctgaaaatctcacagacaatcagaaggtctatgctgatgcatnggtaaagaaagcatatg

SEQ ID NO: 14838 - DNA, 1682 bp, Sorghum bicolor
  Clone ID: SORBI-28MAY03-CLUS658_1
ctactggaaacagagcgcgagaatcgcacgcgccctctgccgtttgttcgttcctctcgctcgccaccaggcacctccacccacatcccaatctcgcgagcagcaggggcggcggcggcggcggcagcggcggtgcttcccattggcctccaggatggcgctccgcctcaacgacgtcgcgctctgcctctccccgccgctcgctgcccgacgccgccgccactgccgcagcggcggcggcagcaggttcgtcgccgtcgcctccatgacgtccgccgtctccaccaagctcgagaataagaagccatttgctcctccaagggaggtacatgtccaggttacacattcaatgccacctcagaagattgaaattttcaagtcgcttgatgattgggctagagataatatcttgacgcatctcaagccagttgagaagtgttggcagccacaggatttcctccctgacccatcatctgaaggatttcatgacgaagttaaggagctcagagaacgtgccaaggaaatccctgatgattattttgtttgtttggtgggagacatgattactgaggaagctcttccaacataccagactatgcttaacacccttgacggtgtcagagatgagacaggtgcaagccccactgcctgggctgtttggacgagggcatggactgctgaggagaacaggcatggtgatctgctcaacaagtatatgtacctcactgggagggtggatatgaggcaaattgagaagacaattcagtatcttattggctctggaatggatcctaggactgagaataatccttatcttggtttcatctacacctccttccaagagcgggcgaccttcatctcacacgggaacaccgctcgtcacgccaaggactttggcgacttaaagcttgcacagatctgtggcatcatcgcgtcagatgagaagcgacatgaaactgcgtacaccaagatcgtggagaaactgtttgagatcgaccctgatggtactgtggttgctctggctgacatgatgaagaagaagatcgcaatgcctgctcacctgatgtttgatgggcaggacgacaagctgtttgagcacttctccatggtcgcgcagaggcttggtgtttacactgccagggactacgccgacatccttgagttccttgtcgacaggtggaaggtggcggacctgactggtctgtctggtgaagggaacaaggcacaggactacctttgcacccttgcttcaaggatcaggaagctggacgagagggcccagagcagagccaagaaagcaggcacgctgcctttcagctgggtatatggtagggaagtccaactgtgaaatcggaaacccattgcgactgttgagttgcagcggaagtctatcatgcatcctgagacgcatcacgaagacaagacctggtgtgtcgcgttacatagttgttcaggttttgaccaaatggtctgggagcattctgtttgcctgtgtcgtctcatagagtgataggagaatgttcggctgttttttttctgctttgttgtacaacctgtggccgcatgaactgggcgtgaacatgctgtacgttgtctgtggcgttgtgtttcgctatggttatccagttcttcagatctgttaaaaaatttgtgagctatgaagttcagttctgttgctgttt

SEQ ID NO: 14839 - DNA, 1671 bp, Sorghum bicolor
  Clone ID: SORBI-28MAY03-CLUS1071_1
gagtactcgactacttccaccccgccgcttcctgcaagcaaagctaaccaaacccgtctttagccttcaaatcgagttcctccccgatcctcagtcgaaaccctaaccctcgcccttctcgatgtcggccgccccaaccggcccagcccctccggtggccactccgatggcgccccctccgtcctacccggcctcctccacgatctccgcctccgtcgccgcgtccgtcgaggaggaggacgacctctatggccgcctcaagtcgctccagcgccacatggagttcgtcgagatccaggaggagtacgttaaggacgagcagaagaacctcaagcgcgaactcctccgtgcgcaggaggaggtcaagcggatccagtccgtaccgctcgtcatcggccagtttatggagatggtcgacggcaacaacggcatcgtgggctctaccacgggcagcaactactacgtgcggatcctcagcaccatcaaccgcgagctgctcaagccgtcagcgtccgtcgcgttgcatcgtcactccaacgctctagtcgacgtgctgccacccgaggccgactccagcatctccttgctggggtcgtcggagaagcccaacgtcacctataacgatattggaggatgcgacatccaaaagcaagaaatacgggaggcggttgagttacccttgactcatcatgagctgtacaagcagattggtattgatcctccaagaggtgtgcttctgtatggtcctccaggtactggaaagaccatgcttgccaaagcagtcgcacatcacacgactgctgcttttatcagagtcgtgggttcagagtttgtacagaagtacttgggtgagggccctagaatggtgcgtgatgtgttccgcttggctaaggagaatgctccagcaatcattttcattgatgaggttgatgctatagccactgctcgtttcgatgctcagactggtgctgaccgagaagttcagcgtattcttatggagctactcaatcagatggatgggtttgatcaaacagtgaatgtgaaggttataatggcaactaatcgggcagacactctagatcctgctctgttgcgtcctggtagacttgacaggaaaattgagttccctctgccagaccggcgtcagaagaggcttgtttttcaagtttgcactgccaaaatgaacttgagcgatgaggttgatttggaagattatgtttccagaccggataagatcagtgctgctgatattgctgctatatgtcaagaagctggcatgcatgctgtccgtaagaaccgatatgtcatcctccccaaggactttgagaagggctaccgaaccaatgtgaagaagccggagacagatttcgatttctacaaatgagccaacatgagtgttaactggtttcttgtttatcaatcgaatatctttttcatcaagatgaagttttaggataactgccaatatcacgatgttcaagttgctcaatggtgatatgtgttctgtaatgagtttctggatagtttgcctctcgcaatttttatgttgatatgcttcatcagatttggagtccaaacaaatatttttacctggtgagcctgttcggttgagcttatctgcagttatttaacagtgtttttcactcacaataaatcagcttatctgcagtc

SEQ ID NO: 14840 - DNA, 1674 bp, Sorghum bicolor
  unsure (1)..(1674): unsure at all n locations
  Clone ID: SORBI-28MAY03-CLUS7205_1
gtcgccggggccggggcttcatctctctcccgatttcttccattcgagctcgcatcatggcgtcccctcagatctcccgcagagccctgggcctcctgctcgtcctcgccaccgctgccgccgcggtcgtctcgccggccgccgccgacgatgtggtggccctgacggaagccgacttcgagaaggaggtcggccaggaccgcggtgctctcgtcgagttctacgcgccatggtgcggccactgcaaaaagcttgcccccgagtatgaaaaacttggtgcaagcttcaagaaggctaaatctgtattaatcgcaaaggttgactgcgatgagcacaagggtttgtgcagcaagtatggagtttctgggtaccccacaattcaatggtttcccaaaggttccttggagccgaagaagtatgagggtcagcgttctgtggaagcccttgcagaatatgttaacagtgaagcaggtaccaatgtcaagatagttgccattccttcaagcgtcgtggttctgactccagagacttttgactctattgtccttgatgaaaccaaagatgtccttgttgagttctatgccccatggtgtggtcactgcaagcatcttgctccggtttatgagaagctggcttcagttttcaagcaggatgatggtgttgtgattgccaatcttgatgctgacaagcacactgacttggctgagtagtatggtgtttctggtttactgacattcctacacttccctaagggaaacnaggctggtgaagattatgatggtggcagggacttggatgattttgtcaagttcattaatgagaagtgtggcaccagccgggattcaaagggccaactgaattcagaggctgggcttgtggcaagcttgaatcctcttgtgaaggagtttctcaatgctgctgctgacaaacggaaggaagtcatctctaaaatagaagaggatgttgctaagctcagcggttctgctgccaagcacggaaagatatatgtgacagctgcaaagaagattatggacaagggctctgactacactaagaaggagactgagaggcttcaccgcttgctggagaagtcgatcagtccttccaaagctgatgaattcatcattaagaagaacattctttcgacattctcttcttgaagttgatgacccacagccacgtctgccagtgagtcagtgacttgagctgataatgcaaccacctgtgaggaaagttgagcagtagaaatcggatgatatgggagaaaggtggtagtggaagtccagtaatggcagagctagttcatgcacgtagatcccttttgtcttttctggttccagggattgacttcgtactcacagtttacttcacacagaagaaggttaatgtagccatcctgtgatacagcccatactttgtttttgatccaataaactggttattcagattttgcgagttatttttccctaatgtaatctggtgaaaggtgaaatcttgatgcatcttatttggattggtcactctgttagctggcaacatgggaattccctaaatttgttgtcggcgagagggtcactcatgtgcttgtgatgtcaattgcggttgttctaaaaaaacacaattagccaatgtgttgattcacagcacttaaggtcccatttgaatcacaagaat

SEQ ID NO: 14841 - DNA, 399 bp, Sorghum bicolor
  Clone ID: LIB3476-030-P1-K1-G12
cgccaaaacctccgggtgccttcccagagacccagccatggcgatctcccagatctcacgcggaaccctgtccatcctcctcctcctggccgccgccttcgctgctgccccggctgcgctcgcggacggcgacgacgtggtggccctcaccgagtccacgttcgagaaggaggtcggacaggaccgcggcgccctcgtcgagttctacgccccctggtgtggtcactgcaagaagcttgctcctgagtatgaaaggctgggtgcaagttttaagaaagctaaatctgtcttgattgctaagattgattgtgatgagcacaagagtttgtgcagtaagtatggagtttccgggtatccaacaatccaatggttcccaaaaggatccctggagcccaaaaa

SEQ ID NO: 14842 - DNA, 1839 bp, Sorghum bicolor
  Clone ID: SORBI-28MAY03-CLUS1486_1
acagaacgggccgggaaaccggaacgactgtgtcatcaaagagagggtagcacctgatctcatctttcaccttcagaaccagagcaatggcatctgctactctcctcaagtcatctttccttcccaagaaggctgaatggggtgccatgcgccaggctgccactcccaagccggtgactgtctccatggttgtccgtgctagcgcctatgctgatgagcttgtccaaaccgcgaaaaccatcgcgtcaccaggaaggggtatccttgccatggatgagtcgaacgctacctgcggcaagaggcttgactccattggccttgagaacactgaggccaaccgccaggcttacaggaccctccttgtcagtgccccaggcctaggacagtacatctctggtgctatcctcttcgaggagaccctctaccagtcaactgttgatggaaagaagattgttgacgtccttaatgagcagggaatcgtgcctggtatcaaggtcgacaagggtcttgtgccacttgctggctccaacaacgagtcgtggtgccaaggtcttgatggccttgcttcacgtgaagcagcctactaccaggctggtgcccgcttcgccaagtggcgcactgttgtcagcatccccaacggtccatctgaacttgccgtacggtcgtatacaatagggaaatcactttcgggcgacatttcttcttacgcgtgtctgggatcaattgtggagcccgaaatccttcttgatggtgagcatggcatcgagaggaccttcgaggtcgcacagaaggtgtgggcagagaccttctactacatggctgagaacaatgtgatgtttgagggcatcttgctcaagcccagcatggttacccctggtgctgagtgcgaggagaaggccactcctgagcaagtagccgagtacaccctcaagctcctccacagaaggatccctcctgccgttcccggcatcatgttcctgtctggtgggcagtctgaggttgaggcgacccagaacctgaacgccatgaaccagagccccaacccgtggcatgtgtcattctcctacgctagggcgctgcagaacacctgcctcaagacatggggaggcaggcctgagaacgtgaaggcagcacaggacgcgctgctgctgcgcgccaaggccaattccctggcacagctcggcaagtacaccggcgatggtgaggccgctgccgccaaggagggcatgttcgtcaagaactacagctactaagacgatgataccactgctgctagtacgttcctcgggggcactgtaggcagtctgccattacaggttcagctggaaaagtacactgcaatttcactactaccttgaggcctgattacatttcatttggaggaattggaatctacttagtggactaggctatttggcttggaatttgacattccacaactttcaaagttgacatataagcctatctcaaattcatagggtcgaagatataaattgattctatatagatcacagaaacttgtagcatgctcttcggctcgctcccctactatagaatgcagcacataggtatctgtatctcccccctatggccaacggtcgtatacaatagggaaatcactttcgtggcactttgtttctttcgctgtgtcttgtaaacattttgtcactattcagttttcgttattgagtagtgaaatcactttcatggcactttgtttctttcgctgtcatggagatcaattggtgccatgtgtggccaatttgctcttgtaaacattttgtcactgttcagctcttgttagtcaatagtgaaatgagtttcatagcactttgtttc

SEQ ID NO: 14843 - DNA, 316 bp, Sorghum bicolor
  Clone ID: LIB3478-012-P1-K1-B5
acgagccgtttaaataggtgtcaagtggaagtgcagtgatgtatgcagtctgaggttgaggcgacccagaacctgaacgccatgaaccagagccccaacccgtggcatgtgtcattctcctacgctagggcgctgcagaacacctgcctcaagacatggggaggcaggcctgagaacgtgaaagcagcacaggacgcgctgctgctgcgcgccaaggccaattccctggcacagctcggcaagtacaccggcgatggtgaggccgctgccgccaaggagggcatgttcgtcatcgggaccaaggccagcgacacct

SEQ ID NO: 14844 - DNA, 1434 bp, Sorghum bicolor
  Clone ID: SORBI-28MAY03-CLUS1750_1
gcacgcacgagccacactcgagagcccagcacgcacacgagcacgatggcgtccaccaccaccgccaccttcctcgccgtcttcctcctcgtggcggcgtcgtcctcggcgccggcgcggtcctgcgcaccgagcgacctgcacgcgctgctgagcgtgaagcaggcgctgggcaacccggcgacgctgtcgacgtggacggcgtcgtcgcccaactgctgcgcgtgggaccacctccggtgcaacgacgccgggcgcgtgaacaacgtcttcatcgacgccgcggacgacgtgcacgggcagatcccgtccgcggtgggcgggctgacggagctcatgtcgctgaccctgttcaagctgccggggctcacgggctccatcccggcgtgcctcaccgcgctgtccaagctggagttcctcaccatctcccacaccagcgtgtcgggcgccatcccggagtccctgacgcggctgcgcagcctcgactccgtggacctctccagcaaccagctgacgggcaccatcccggcgtcgttcgccgacctgcccaacctccggtcgcttgacctccggcacaaccagctgacgggcaccatcccggcggggctggtgcaggggcagttccggtcgctgatcctgtcctacaaccagctgacggggcccatcccgcgcgacgacgcccacgacgagatcaacaccgtggacctctcccacaacaagctcaccggcgacccctcccacctgttcgtcgccggccggcccatcggcaaggtggacctgtcgtggaactacctcgacttcgacctcagcaagctggtgttcccgccggagctgacgtacctggacctgtcccacaaccacatccggggcacggtgccgctgtcgctggagcgcctgtccacgctgcagaagctggacctcagctacaaccgcctgtgcgggccgctccccaagggccacggcgtcatcaagcacgggtgcaagccgtacgcgcacaaccagtgccgcaaggggaccccgctcgcgggatgccaggacctggagtgagccggccggtcgcccggaccccgccggagctgggatttctcttctctgctctccctctccctcgtcggcctctgctctctccctcgtcggcgtgcggcggcgcacgtgtgcttttcgcgtcccgatcgtggtggtgtgtgtgtaagcacgacggtgcctggtgtgtttagctatagacaaaagtacggccgcgtaagcacgcgcggttgatcttgagcagttaagcgtgtacgaaatgacagctgtgtacgtgtactgtgtctgatgaagtgtgggatgtagtactgtgtatttggtatggatctgatgtatgaaaaggatgtttacgtactataaatggcaaatcatcatatatttcctctaaaaaaaaaaaaaaaaaggccccta

SEQ ID NO: 14845 - DNA, 867 bp, Sorghum bicolor
  Clone ID: SORBI-28MAY03-CLUS25252_1
gcacgaggcctccagttcataagcacaccaagctgaagaacatggcgaacaagtgcttgcctttcgccctgttcatcgtccttctgggtctgtcgtccaatttggcagcagggcagatcctgttccagggcttcaactgggagtcctggaaggacgacggacgatggaacaacttcatgaagggcaaggtgcccgacatcgccgacacggtcatgcaggacgtcgcccacatcctcgcgtaccacgcgaacgcctccatcttctacgagcatttattcccctgggacctggacaaggagatctacgaccaggtgtccatgcgcgaccgccacgggatccagttcgacgacgaggtgctcaacatcaacgccgacgccgacatcaacctccctgcggcggagggcaaggtcatcggcaacatcggatgaagctacgattgcgaccaccccgtccccgaaggtctccaggtcgccgtgcacgaagatgagtaggccgtgtaggtgaaatcatgggacgacttcgtgcttcgtccgccccgaagagttctagcagatgtgaactgcatttttccactagctttttgagcctactaatatgggataactacaagcccgtatccaagattccggactttatcatccgtaaataagtgtggttgagcaggtctatttaagcctggaaaagaaatttaagagaggctaaataagtagcatacgattctatcaagcttctttcagcaaattattgaaagaaggttctaaagtttggatgtattattgtggtatgggaatttttgtaacctcttgaaatggggaaacaaagactattcttattaagctgaaaccccccgtgatgttagagctctcc

SEQ ID NO: 14846 - DNA, 1749 bp, Sorghum bicolor
  Clone ID: SORBI-28MAY03-CLUS196_1
gtgcggtcgtgcaaaaccaaatccgctgtgtaatccaccacctcctctcgggctttccccgtcttctccttctccgtcccctccacaacacgcgttccccaaattctcccacctagagatccccaaatccgcggcggcgacctttgaattcgatcccccttcccgaggcgactcaatctgatcgtcggagccggggcaccagcgaccatgtgggcggcgtcgtgcctggcgtcgtgctgcgcggcgtgcgcgtgcgaggcgtgccggacggcggtcggcagcatcggccgccgctccgcccgcatcgcctactgcggcctcttcgcgctctccctcttcgcatcctgggcgctccgcgaggtcgccgcgcccctcctccagtcgatcccatggattaaccactttcacaagactcccgaccgcgagtggttcgagaccgacgcggtgctcagggtcagcctcggcaatttcctcttcttcaccatcctcgccgtcatcatggccgggataaaggaccagaaggacccccgtgacaagatccaccacggcgggtggatggccaagatcttctgctgggccgtcatagtcttcctgatgttcttcgtgcccaacggagtcgtcagcttctatgaatctatatccaagttcggatctggcctgttccttctcgttcaggttgttctgctgttggattttgtgcatggatggaatgagaactgggtcgccaaggatgagcagttctggtacatggctctagttggttgcctcagctgtctgtagctgtgccaccgcctcgccctccggtcggctatttcactggttcactccatctggacatgactgcggactcaacatgtttttcattgtcttcacattgattcttgtttttgcatttgctattgttgccctgcacccaaagatcaatggaagcttgttgcctgcatcggttatcggtctgtactgcacatatctgtgctacagtggactctccagtgagccaagggattatgaatgcaatgggcttcacaatcagtcgaaagctgtgtcaactggtagccttacattgggactccttactacggtcctttctgtggtctactctgctgtccgtgctggctcctctgcaactgtgctctcgccaccagactcacctcgtggaaccgacaagccattgcttcccttcagcaaggcagatgaacaagaagataagaaggatgtaccaaggccggtgacatactcctactctttctttcacctcatcttctccctggccagcatgtactcggcaatgctcttgactggctggtcaacttccgttggtgagagcggaaagcttgttgatgttgggtggccatctgtctgggtcagaattgcaacccagtgggcgacggcaggtctgttcatatggtcgcttgttgcacccatcctcttccccgacagggaattctagatcaaccacggcaagcctggagcatcaatcgtttcactgcggtagctaatctatcctatcaagtgtattgtcttacacgtgctctgagcatggatgacaagaagtcagtgtttgtccactgctatcaagtttgtctacttaataacatgtgacattaggcattgtgccacactctgaacagtgaatgtgtgctgcttgtattgtgtatatatattggagtctggttgcctatcctggattggattttacgaatgccaccatgtgagcgtgttgcatatcgattggttggtcagaaattc

SEQ ID NO: 14847 - DNA, 1666 bp, Sorghum bicolor
  Clone ID: SORBI-28MAY03-CLUS71286_1
ctactggaaaaaaaaaaaaaaaaaaaaactactgacacgcctccgatccctccctctgcccacacctatagctagctagccaaggcctcatcaatcatggcggctactactacttctcgtcctgccgctgctgctctgccgctggcggtactggcagcagccatggtggtggccctggcggcggccggcgacgtcgtcgagcagcagctcgaggtcgttggcagcaggtacccgccgctggcgccgggcctgtcgttcgacttctacaagaagagctgcccgaaggcggagtcgatcgtgaaggagttcctgtcgtcggcggtgcggcagaacgtggggctcgccgccgcgctgatccgggtccacttccacgactgcttcgtgcagggctgcgacgcctccgtcctgctcgactccacgcccacccagcccagcgagcagctgtcgccgcccaaccttacgcttcggccggcggcgttcaaggccatcaacgacatccgcgcccgcctcgagcaggcctgcggccgcgtcgtctcctgcgccgacatcaccgccctcgccgcccgtgaatccgttgccctgggtggcggtccggcgtacaaggttccactaggccggcgagacggcctagcagcggcgtcgaacgccgccgtcctggcggcgctcccgtcgccgacgtcgacggtgccaacactgctctccttcctgtcgaagatcaacctggacgtgacggacctggtggcgctgtccggcggccacacggtgggcgtcgcgcactgcagctccttcagcaaccgtctgttcccgacgcaggacccgacgctgaacaagttcttcgcggggcagctgtacgggacgtgcccgaccgacaccacggtgaacacgacggtgaacgacatccggacgcccaacacgttcgacaacaagtactacgtggacctgctgaaccggcagggcctcttcacgtcggaccaggacctgctcaccaacgctacgaccaggcctatcgtcaccaagttcgctgttgaccagaacgccttcttcgagcagttcgtctactcgtacgtcaagatggggcagatcaatgtgctcacggggtcccagggacaggttcgcgccaactgctccgcgcgcaacgctggtgctgcaggtaacggtggcgaggaccagctgccgtggtccgacgtcgtcgagaccgtcgtcgacgccaccggcagcctcgtgctctagatcgtatcgtgaaacaacaaccgcaccaccggccgggagtgcgcgtatgtacgtgtgtagcagtttgttggcagcaagttgttagcaatttgaagcttgcttgttttttcttatataagtctcgatctctccatcgagtccatatatatgtgggggcatatgcatgcatgttgtaacaaaataagcaggcagctaagctagctagtgatccattggaaataaaaagctcgtgtgttcttgccttcttggggatcagatgatgtcatgacgacgatcattacaaacgacgacgtcgatggcattggcatgccctgcagggcagttcaggccgggcaccagcagatcgacgaactaattaagggggtgtttagttctcctttttttttcccaaaagaattttaggttttggtctatcatttgcaaaataaaactaatc

SEQ ID NO: 14848 - DNA, 849 bp, Sorghum bicolor
  unsure (1)..(849): unsure at all n locations
  Clone ID: SORBI-28MAY03-CLUS6164_3
cttcaatcagactgagtacatcacaatcacaaaccaccctaaacaggcaaccaacaacngactgggcagcagttgacatggaatgatanncaganncaggagcagaatagcgagcccttgagatttgtattaacaccagatgacaccacttcaaacaagaattgagatatccaaatcgttcacatcactcctcggctcacacttgaaaattgttctaatctcctagcaaggcccaagaaccaagcacaaaattaaactcaggtcttaaaggtagtgtagaacacaagttcccgatactgatgcactgtatctagtgcgatttgacgtactcctgcactatgttaaggccctcagattcttcgccatagtccttgacgacaacacaggagcagcctacgaccttcctcgccttgccctcagaatcaatcttgcaaagcccagcccattcgccaagagttttggcgctaggcaccgtaaccaggtgaacattgtgctcagagcagagagccttcaccagcttgacataatcaggctggtcacagtcctcggcaagcacacaaagctgagcagcatgcttctcaatggctttggcagcctcgcgaagacccttaacaaggccatcatgagcacctgacttcttcatgacaagctgcagagcagtcatcaagtcgatcggctccccaaggaccggggtaggtgcctcgactgcaactggggtctcctgatccgccatcttccgcgctcgagggcccgaccgatagcgagagtaatacctcgagggagtcggggagcagagggagtgccgagctgctagggtttccgccttcctgtccggccggcccggccggc

SEQ ID NO: 14849 - DNA, 748 bp, Sorghum bicolor
  Clone ID: SORBI-28MAY03-CLUS6164_2
taggggcgggtttttttttttttttgcttgcataaactcagctcttcttgatttgcattaaaaccagatgacagcaccataacaaaaatttcagatgtccaaattgctcatatcctcttcggcttttctagtaaaatgttctagtctcctagcaagccccagatgcaagcataattttaagcccaggtccaaagtactgaaacgtattacatctagtgtgacttgacatactcctgcactatgttaaggccctcagattcttcaccgtagtccttgacaacgacacaggagcagcctacaaccttccttgccttgccctcagagtcgatcttgcaaagcccagcccactcgccaagagtcttagcagcaggaacagtgaccaggtgaacattgtgctcagcacagagcgccttcaccagcttgacataatcaggctggtcacagtcctcagcaagcacacaaagctgagcagcgtgcttctcaatggccttggcagcctcacgaagacccttgacaagtccgtcatgagcacttgacttcttcatcacgagctgcagagcagtcatcaaatccatcggctctccaagaattggggtcggtgcctcaacagcgactggggcctcctgatcagccatgttcctcgctgtgaaggggtccctggccggcggctgcgaatagagatctgaagagagggcgggagcaccgaacggcggcggctagggttttggcgagagccggcggccggcgc

SEQ ID NO: 14850 - DNA, 830 bp, Sorghum bicolor
  Clone ID: SORBI-28MAY03-CLUS6164_1
caatcaaactgagtacatcacaattcacaaacaccctaaacaggcaaaccacaaacgactgggcagcagttgaggggccttttttttttattttttaagcagaatactggctcttgctgatttgtattaacagtagatgagagcacttcaaacaagagttgagatgtccaaatcgttcacatgaatccttggctcacttgaaaattgttctaatctcctagcaaagcccaagaaccaagcacaaatttaaactcaggtgcaaaatgtagtagaacacaagttccagatactggcacactatatagtgtgtatctagtgcgatttgacgtactcctgcactatgttaaggccttcagattcttcgccatagtccttgaccacaacacaggagcagcctacaaccttccttgccttgccctcggagtcaattttgcaaagcccagcccactcgccaagagttttagcgctaggcaccgtaaccaggtggacattgtgctcagcacagagagccttcaccagcttgacataatcaggctgatcacagtcctcagcaagcacgcaaagctgagcagcatgcttctcgatggctttggcagcctcacgaagacccttcacaaggccatcatgagcacctgacttcttcatgacgagctgcagggcagtcatcaggtccatcggctccccaagaaccggggtaggtgcctcaaccacagctggggtctcctgatccgccatctcccgcgctccgaggacccggccgacagcgtatgtaacacctgggttggaggagtgccgagctgctagggttttcgcctcccggccggcccggc

SEQ ID NO: 14851 - DNA, 618 bp, Sorghum bicolor
  Clone ID: SORBI-28MAY03-CLUS13982_2
gccggccgggctcaagagttctccctggccgttgagaaatgcaggtcgcgcagcaggaggccgagcgctccaagttcctcgtcgccaaggcggagcaggagaggcgggcggccatcgtgcgcgccgagggagagagcgagtccgcgcgcctcatctctgaggccacggcgatggctgggacagggctgatcgagctcaggaggatcgaggcggccaaggagattgccgcagagctggctcgctcgccaaatgtggcatacattccttctggggaaaacggaaagatgctgcttggtctcaatgctgcgggatttggtcggtgattcaccgttctgttttagttttgccttatgtgcttgggcatctgcctgcttgtgctatgccgatgcatgactaaaatggtggttcgaaggacagtggtatctgctacccttggttatgttaagtttcccttatcttggaactaaatgtgttttgtctcgtgctccaaataagtgtttggtcttgactctgggcaagtgggcatattttcaattggtagggttaatgtgacatattgtcttgagcgtgcattctaattcctcttgcatggaaaaaaaaaaaaaaaaaaggccccta

SEQ ID NO: 14852 - DNA, 1288 bp, Sorghum bicolor
  Clone ID: SORBI-28MAY03-CLUS13982_1
ccgcccagacccacctccaactacacagcccccaccacctcgccgtccacatagcgccccaccatccgccagccgccgacattcccctccttctccacggctttcccgccggagctgggcggcccgcaatgggcctgcgccgcggcgggctggctggcggtggcggggcggcgggggccgtgtgcgccgccactctggcggcggccgtgggggggttcgccgtctcggagatcctgggggggcacgacgaggtcgcggggggctgcaggcaggtcaacgaggcccgcgtcggcggggacgtccgcgccgacggcaccgtgtacgtgcccgccctcggcactggccacatggggcgcctcagcggcgccggcggctcgcgcggtcgcctctgtcccggcggcgagggcggccacggcggtgactaagtcaacgacaagaggcgcatccaacgctcccacgccgtcacggccttctccaccattttcacgagtgtcggctttgatgccggcgaagatgggcacgctggcattggccaccacggtggcaacgacgtcgtctcccacttcgaagacgacgcgggcggcggagagcgcgcccacgacggcgagcatgtccgcgacggtcgcatccgccgcgcccgcggccacggtagcggcctgcgccccgcttccagcacccgcttcgcctaaggtcctgcgtcctacggagctgttcaagaggaacacgtcaggccttaggcctgcgcctgctccgggtggcccatagaagaggaggaagaagaagcccgcccgccgctcggcagccgctgcgccttcggccgatcactccgcagatggcccgtctcccgacgactcatccgatgacgccgccgacaaggccgccgctgcgccggcgtccctgtttgcccggtgggtgacgatcgccgtggcgctggcgctggcgttggcagcctaagtaaggtgtgcgctcatgtgctatgtttttgttttgtttagcttattttggaccctatcttcttttctttgtccaattcgtgtcccttccttgttggtgcagaaaataagaagggctatttttaattttatatttatttattaccgcattccataaaaaaaagagagaaaaggtgagaggtgtgtgtgagtgatgtaactcttttgattttgttcattgggtttgtggtgatcattttgtaatgatagtggccaattggagagtgggttaagttttcacatatgagtcatcatatggagtttagaaaaccagcaagtgtttgttgcttgctttc

SEQ ID NO: 14853 - DNA, 704 bp, Sorghum bicolor
  Clone ID: SORBI-28MAY03-CLUS29621_1
gacaatcccccacccacacacacctcgtgtccttcacacagttcactcactcctgtgctagtgtagcttgtgatctgtcgacgatcgctggtcggggcggcggacatggggaagggtagcggcggcgtatgggcggcgttccacgaggtcgccggcgaccggcgccagaagcagtgccagcactacagcgactgggacaagaagcagcagtgcgtgcgcgactgccggcgcggccgtggcggctgggagacgacggtggccggcgccatcctcgaggtggtgtgaggacgcccggccggcggcgacgtgcatggcgtggcgcgcggctaataataaaaggggtgtacgtacgtacgtgtcaccgggcgtggcttctctgcaggggacccacatcgaccaagtactactgctcgttcgtactacgtacgtatatacgcccgtgtatacgtacgtatgtacatatgtgtgtatacgtctttgctgcacgtatgtagagagacgtgagaataaagagtggtagctacatgcacggcggccatggctctccgatgagagagctgctgctagctgtgtttgtgtgtgtgatcgtcatgttgcttggtgagggatctagcagaagtcaagtgcgctttgtactagttgagaggctatctctgtaagtgaaatgtggtataaataaaaagtaaagggttccttttcgggaa

SEQ ID NO: 14854 - DNA, 2100 bp, Sorghum bicolor
  Clone ID: SORBI-28MAY03-CLUS6775_1
gcacgagggcgacgtttaacggcggcgcagcgcgctaatcccgcccaaaacccgatatataacggcccgcgccttccgccgacgccaagaacagcctcagattactcgcacaaagatttagctggccgcggggtcgaactgaggctcttgatcgcgagcgcacacagggcgagcggacaagaaagcttgctttgtgttcaccggcggcacgggccccctgcgatggaagccgtcggcgtcgctcctgcgcccgtggcggcgccggagaagaagaagctgcttgacctgaaggatcccttccccgccgccgccaacggcagcgccaaggcgtccccggcggggaagtgggcgatgaagaagaagttggtgggcggcgatgccggctacgtgctcgaggacgtgccgcacctcacggattacatgccccacctcccgacatacccaaatcctctccaagacaatccggcgtattcagtcgtcaagcagtatttcgtcaacccggacgacaccgtcacgcaaaagattgttgttcataagaccagtgccaggggcacccacttccggcgtgccgggccacggcagcgggtgtatttccagtctgatgaggtgaacgccgccattgtcacctgcggaggtctctgccccgggttgaacacggtcatccgcgagcttgtttgcggattgtatgatatgtatggcgtcaccagcgttgttggcatagagggtggatacaagggtttctattctaaaaatactgttccgctgactccaaagtcggtgaacgacatccataagagaggtgggactgtccttggaacttcaagaggaggacatgacaccgccaaaattgttgattgtcttcaggaccgtggtattaatcaggtttatattattggaggtgatggtactcagaaaggtgcttctgtaatttatgaggaagtccgtagacggggcctcaaatgttctgttgttggtatcccaaagaccattgataatgacattgcggtgattgacaagtcgtttggatttgacactgctgtggaggaggcccagagggcgatcaatgctgctcatgtcgaggctgagagtgcagagaatggcattggtgttgtgaagctaatgggtcgcaacagtggttttattgcaatgtatgctactctagctagccgtgatgtggattgctgtttaatcccagagtcacccttctaccttgaagggaagggaggactccttgagttcattgagaaacggctcaaggacaatggtcatatggtcattgtggtggctgagggtgctggacaggatctcatcgcgaaaagtatgaatttcgtggacactcaagatgcttcaggaaataagctgcttctggatgttggcctttggttatcccagaagataaaggatcatttcaagaagaagcccagcttcccaataactctcaagtacatcgacccgacctacatgatccgtgccgtcaggtcaaatgcttctgacaatgtctactgcaccctgctagcccacagcgccctccatggtgccatggcggggtacaccggcttcaccgtcgctccagtcaatggcagacacgcttacatcccgttctataggatcaccgagaagcagaacaaggtggtgatcacggaccggatgtgggcgagggtgctgtgctcgacgaaccagccctgcttcctgagccacgaggacgtggagaacatgaagcacgacgacgacgagcaccacctgcacaacacgcagctcctggaaggcgagagctcgccggtgaaggacgcgtccaaatgcaatgggacagtgtgaagggcacaagaatacgcaaggatatatattagtattataagcatgtaactatagatggggtttttgtctttttctttttattttgctttttgggtgctggcgttgtagagagtagcgaccactactatagataggcttggataatgtgagcatttggtaataatatatgcttcgctgaagtaagctcagttttggttgtgaatgagctaatagcgctgctacgtgtattaaatttcgtcaggtgagggcaaaattagctcactacatgttatgcgggttacgaac

SEQ ID NO: 14855 - DNA, 885 bp, Sorghum bicolor
  Clone ID: SORBI-28MAY03-CLUS19367_1
tgtgcggcgcacgaggcagctcttagtagctcgctcactaagctatcatatcaatggcgtccacagccttagagtcttagtagctcgctcactaagctatcatatcaatggcgtccactacttccatgccctcggtcctcttcctcctcctcgccgccttcgcagccagcgcaagcgcagccaccttcaccataaagaacaactgtggttacacggtgtggccggctggcatccccgtcggcggcggcacgcagctgaactcaggccagacatggaccgtcaacgtgcccgccggcaccagcggccggttctggggccgcaccggctgttccttcagcggcgggagcggccactgcgacagcggtgactgcgccggtaagctctcctgcaccgtctccggccagacgccggcgacgctggccgagtacaccatcggcggcactggcaacccgcaggattactacgacatctcgtgtgttgatggctacaaccagcccatgtccttctcctgcagcaccggcgttgcgctgtcgtgcacgtacgccaaatgccctgatgcgtaccagtactcgactgatgacaccaagacccatgcttgcagtgccaacagcaactaccagatcaccttctgcccgtgaagaagcggcacagatggtgatcacgtcgatcacagagccacgcaacagacagttcattcctatattatgaataactagcactgtctagctaagattacagttcataatatataagatatgtaataaataataaatcgtccttgtgtgcatgtatacggatatatgacacactttgcgtgtttgtacttgactatgaagaacattcttaatatatacatgttttcgtcaaataatgatgggattttct

SEQ ID NO: 14856 - DNA, 865 bp, Sorghum bicolor
  unsure (1)..(865): unsure at all n locations
  Clone ID: LIB5052-009-A1-XP1-D8
gtgcggcgctcaggcggcgggttcgaagatgggaatatgcctgagcggtgcgaagccagaggaggcttcatatacagctcttagcagctcgctcactatcatatcaatggcgtccactacttccatgccctcagtcttcttcctcctcctcgccgccttcgcagccagcgcaagtgcagccaccttcaccataaagaacaactgtggttacacagtgtggccggcgggcatccccgtcggcggcggcacgcagctgaactcaggccagacatggaccgtcaacgtgcccgccggcaccagcggccggttctggggccgcaccggctgttccttcagcggcgggagcggccactgcgacagcggtggctgcgccggtaagctctcctgcaccgtctccggccagacgccggcgacgctggccgagtacaccatcggcggcactggcaacccgcaggattactacgacatctcgtgtgttgatggctacaaccagcccatgtccttctcctgcagcaccggcgttgcgctgtcgtgcacgtacgccaaatgccctgatgcgtaccagtactcgactgatgacaccaagacccatgcttgcagtgccaacagctactaccagatcaccttctgcccgtgaagaagcggcacagatggtgatcacgtcgatcacagagccacgcaacagacagttcattcctatattatgaataactagcactgtctagctaagattacagttcataatatataagatatgtaataaataataaatcgtccttgtgtgcatgtatacggatatatgacacacttttgcgtggttgtacttgactatgaagaacattcntaatatatacatggtttccct

SEQ ID NO: 14857 - DNA, 1680 bp, Sorghum bicolor
  Clone ID: SORBI-28MAY03-CLUS30_1
ctacgaaaagccattgaagcagctagcaatcgcctagctaggtagacccaccccttgatcacagtacccacctgcacgcggccatggtcgtcatgggcaaggaggaggagaagcaccaacaggcggaggaggaggaggtccaagaagaagaagcacgagtcgtcgtcctccagcaggacgtgacggaggacgaggcggcggtggcgcaggaggtctccgtcctgcccgccgccgtcgcgaaggtgccgtcgctgagccagccgccggcggtggacgcgctctttcccccccgcgtgagggcctgcatccggccccgcacgcgcgccgtggaccgcgtgcgcccggccctgcaggcgatgcgcgcggggcgcccccgcctccgcgccgacgccgaggcagtgctggaggcggacgcctccgacctgctggcgggcttcgacaacccgctggaccacctcccgctctccccctacttcagcaactacctgctgctgagcgagctggagcacggcctgctggcgcgccacgtcccgggaccgccgccggcgcgcgtcgccttcgtcggctccggcccgctcccgctcagctccctcgtgctcgcggcgcgccacctcccggccgcggccttcgacaactacgacatctgcggggacgccaacgaccgcgcgcgccgcctcgtgcgcgccgacgcggcgctcgccgcgcgcatggcgttccgcacctccgacgtggccgacgtttacatggacttggtcgggtacgaaggcttcttcctggcggcgctcgtgggcatggccgccgaggagaaggcccgcgtggtggagcacctcgggaggcacatggcgcccggcgccgcgctggtggtgcggagcgcgcacggcgcgcgcggcttcctgtaccccgtcgtggaccccgaggagatccgccgcggcggcttcgacgtgctcgccgtgcaccacccggaaggggaggtgatcaactccgtcatcatcgcgcgcaagcctgtcccgcccgtcgacgcgcacgccgtcgccgtcgccgccgccggggtggggcacgcgcacgcgcacgcgcacggcgccgtgctcagccggccctgcctctgctgcgagatggaggcccgggcgcaccagaagatggaggaggtggccgtggagcagctgccgtcctaggcactggcacaccacaagacaagatggattgccccggccggccacccattcagttgcatctacctgatcgatcgagtaaacagtaatcccctactactactatgtctacgtgtgtccacaccacatgcatggtcataatctgcaggttgaccttgctactggctggtgtattgttgccgtgattatactaaggtcccgtttaacaaggagtcggagctggtgaaaggaaaaatagtgaagagatttaaaaaaaaacagagtgcaccaagaagtcaaggcctgagatctagcaaacagagcctaatttgtccgttaatgttacatgtgtgtgtgagtgatgatgatcgagtggttaatttgaagtaactcccgtgcttaatttgtcagtttgggagtattattagcacgtaaatgcataaatacaggccattccggtccattggttgttttgacgcgatatatatgcatcatggtcatggcctcgaagtttgttcggagggacgaagcc

SEQ ID NO: 14858 - DNA, 1535 bp, Sorghum bicolor
  Clone ID: SORBI-28MAY03-CLUS3685_1
gcacgaggtgcgaatatacccctcggtctctccctccctccctccccccacgagggtccctcgtttccaacttccctcgcgcgccggcgcccgctcacgccccatttccaccctcccaaaaacccacacgggatcccggcaccctttccactcctccaggcaccagcggtcatggcggtggcctcagcctcgcccctcccctcggcgccgtcagccaagcccgccacggccccctcgcctctcgctccctcgtccgggttcctcgctctccgagcccgccgctgcggcgcaccgcgcctccgccccgccgccgccgcgtggaggaggcttcgcgtggaggcaatcaggacgcagcaggagaagcagcggacggaggtgcccgtcgaggagtccgccccagtcaggggcgccgccgcgcccctcgacggagtcggagcggacgaccccatggttgcttcctcggaggagagctgggtggtcaggctcgagcagtcgttcaacattttcgccacggaatcgatgattatgatactcgatggcgtgtaccgtgatcggaactacgccaggttttttgtgctcgagacgattgccagggtgccgtatttcgggttcatatcggtgcttcacctgtatgaaacctttggctggtggagacgagctgattatataaaggttcactttgcgcagagctggaacgagttccatcatctcttgatcatggaagaactgggtggcaacgctttatggattgatcgtttccttgcacggtttatggcgtttttttactacttcatgactgttgcaatgtacatgctgagcccacgaatggcatatcacttttctgaatgtgtggagagacatgcgtattccacctatgataagttcctcaagctccatgaagaggaattgaaaagactaccagctccagaggcagcattgaactattacctgaatgaggacctttacttatttgatgagtttcagacagcaggagttccatgttctaggaggcctaaaatagataacttatatgatgtattcgtcaatgtacgagatgacgaggcagagcactgcaagacaatgaaggcctgccaaacacatggaaatcttcgttctcctcactcaatgcttgactgcttagaagttgattccgaatgtgtgatacctgaacctgaagacgattgtgaaggttttgtggactctgtcaaaaagtcccttacaaagtaaatagtatgtaaagcgctctttcgtgtgttttcaggcatcatggtatacaaagtacaaaattttgatgatatcctctattttttctttgtaactttttttaagtaaaatccaggtcatatatcacagaagtcattgtagatacagttgtgcaacattaatcaaatatctaacactgcatagatgagaacattccaacttggcgtgccgtcctggcatatgagcctacctaagcatggatagaatagaggtgatgtatgtagcacagtacaacaacatttttttatgttcacatcttgcatactttggcc

SEQ ID NO: 14859 - DNA, 1630 bp, Sorghum bicolor
  Clone ID: SORBI-28MAY03-CLUS7119_1
ctactgggattcgctccccgccgccgccgcccgaaccctagccgccgccgccgccgccgccatggtcgccttcagccgccccctcgtgaccgtgaaggccctggagggcgacatggtgaccgacgctcccggcatcgccctaccgcccgtcttcggggcgccgatccgccccgacgtggtccgcttcgcccacaagctgctgtcctgcaacaagcgccagccctacgccgtctcccgccgcgccggccaccagacgtcggccgagtcctggggtacgggccgcgccgtgtcccgtatcccccgcgtcccgggaggcggcacccaccgcgccggccagggagccttcggcaacatgtgccgcggcggccgcatgttcgcgcccaccaagatctggcgcaagtggcaccaccgcgtcaacatcaacctccgccgcgtcgccgtcgcctccgcgctcgccgccaccgccgtcccggccctcgtccaggcgcgcggccaccgcatcgagaccgtcccagagatgcccctggtcatctccgactcggcggagtccatcgagaagacctcccaggcgctcaagatcctcaagcagatcggcgcctacgccgacgccgagaaggccaaggactccgtcgccatccgccccggcaaggggaagatgcgcaaccgccgctacatcaaccgcaagggcccgctcatcgtctatggcaccgagggctccaaggtcgtcaaggccttccgcaacctccccggtgtggatgtcgccaacgtcgagcgcctcaacctgctcgacctcgcccctggtggccacctcgggcgctttgtgatctggaccgagagcgcgttcaagaagctagaggaggtttatgggagctttgacgcgccctccctgaagaagaagggcttcgttctgccgaggcccaagatgaccaacgctgacctgggcaggatcatcaactctgacgaggtgcagtctgtggtgaagccactcaacaaggaggtgaagcgcagggagaagaggaagaaccctctcaagaacatggctgctgtgctcaagctcaacccctacctcggcactgcccggaagatggccacccttgctgaggctgcccgtgtcaaggcccggaaggagaagctcgactccaagaggaccaagcttagcccggaggaggctgccaaggtcaaggctgcgggcaaggcatggtacaagaccatgatctcagacagtgactacactgagtttgagaacttcacaaagtggctcggtgtgacgcagtgatctgcgtgagttctagttaagttttgagtagtagtgttgctgaacctgtcttgagaggaaagaggacctatcaatctgttttatcctgcatcatcgtaacaagttaccctgtgggattttgagacgtttcatatccgttttgtttgtgcatttccgtgagaacatagtatttgcatatttgaaccagttatctgaattatgcttgggatatgtgcacttgttgctttctggcaaccttccctgactccttcaatcactgtgctgtgttattgcgactgttctgttcatgatgcttatggtgcactgccgcttggctttgtaatatttggctatgggatctctcctggttggttg

SEQ ID NO: 14860 - DNA, 318 bp, Sorghum bicolor
  unsure (1)..(318): unsure at all n locations
  Clone ID: LIB3476-042-P1-K1-A2
acagccgccagccctacgcggtgtcgcgtcgagccggccaccagacctccgcggagtcctggggcacggggcgtgcggtgtcccgtatcccccgcgttcctggcggtggtacccaccgngccggccaggcagccttcggcaacatgtgccggggcggacgcatgttccgcccaccaagattgggccgtggaccgcggtaaatcactcgcggtgcatgctcgcttcgcacacgccgcctgctgccggcacggggcgcccagtcgtggttcattgcagttggaaccagctaactagctggccccattaagcagctctgtc

SEQ ID NO: 14861 - DNA, 867 bp, Sorghum bicolor
  Clone ID: SORBI-28MAY03-CLUS6384_2
gccgccggccgcggggccctctcgtccaaaccctagccctcgcgccgccgcagccgccgccgccccccagcgctcgagctcctcgcctcccgcgagctcgcgccgcaacgccaccatgaagttcaacatcgcgaacccgaccaccgggtgccagaagaagctggaaatcgatgacgaccagaagctgcgtgccttttatgaccgaaggatctcccaggaggtcagtggtgatgctctgggcgaggagttcaagggttatgtcttcaagatcatgggtggatgtgacaagcaaggcttcccaatgaagcaaggagttctgacttctggtcgtgttcgccttctgctccacaggggtactccctgcttccgtggttatgggaggcgtaatggtgagcgcaggaggaagtctgtccgtggttgtattgttagccaagacctttctgttatcaacttggtgattgttaagaagggtgagaatgatctgcctggtttgactgacactgagaagccaaggatgaggggtcccaagagggcctccaagatcaggaagctctttaacctttccaaggatgatgatgtacgcaagtatgtgaacacataccgcaggacattcactaccaagagcggcaagaaggtgagcaaggcacctaagatccagcggcttgtgacccccttgaccctccagaggaagcgcgctagaattgctgacaagaagaagaggatcgctaagaagaagtctgaggctgctgagtaccagaagcttcttgcccagaggctgaaggaacagagggatcgccgtagcgagagcttggccaagaggaggccaagctttcatctgccgccaaggctaccgctgcttccaccgct

SEQ ID NO: 14862 - DNA, 1103 bp, Sorghum bicolor
  Clone ID: SORBI-28MAY03-CLUS6384_1
ctctctcgccccaggcctagcccctcgcgccgccgccgccgccgccgccgccacaccaccaggctggagctcgccgctcggggctagaggtgctcgccgctcgcgaccatgaagttcaacatcgcgaacccgaccaccgggtgccagaagaagctcgagatcgatgacgatcagaagctgcgtgtcttttttgacaaaaggatctcccaggaggtcagtggtgatgcacttggtgaggaattcaagggctatgtctttaagatcatgggtgggtgtgacaagcaaggtttcccaatgaagcaaggagtgttgactcctggacgtgttcgccttctgcttcacaggggcactccgtgcttccgtgggtatggcaggcgcaatggtgagcgtaggaggaagtctgtccggggttgcattgtcagccaagacctgtctgtcattaacttggtcattgtcaagaagggtgagaatgaccttccaggtctgactgacactgagaagcccaggatgagggggcccaagagagcatccaagatcaggaagctcttcaacctttccaaggatgatgatgtacgcaagtatgtcaacacataccgcaggacattcacaaccaagagtggcaaaaaggtgagcaaggcccccaagatccagcgcctggtgaccccacaggtcctccagaggaagcgtgccaggatcgcagagaagaagaagaggattgcaaagaagcaggctgaggccgcagagtaccagaagctgctggcacagaggctcaaggagcaaagggaacgcaggagcgagagccttgccaagaggaggtcgaagctctctgccgctgccaaggcttcggctgccacatctgcctaaggaatggttgctttgagttgatttaagaaagcccccctacctacccaagacaatgttatagctgaagaaaagaaccccatgtgctatgtttgatatgttcggaacctctactttctagcttcatctgtgcaattttgcgtggacatgatgctggcttgtcgaaaattttttgagtacctgtgaattgttacgtttgtattaccttccctgacaatatatatcttaaaatctttatgcag

SEQ ID NO: 14863 - DNA, 794 bp, Sorghum bicolor
  unsure (1)..(794): unsure at all n locations
  Clone ID: LIB5121-008-A1-PF1-B8
gcgaattcggctttccgaaactcgtcgcgcgctggcactacgaaatcttgatgcgatctcatctgacgaggatataagaatcgactcgcgagtcgcgagactacgcccgcgcgccgccgtgtccttgccgcgtgtgcatttctgctgctgtctagaacgccggcggccatggcgatgtcgtcggcgctgccaacgtccgccctgagctccctggaggcgatgctccactctctgatgcgaggatcaggatcaggaggaggaggagcggggggctnacaancaaggtttcccaatgaagcaaggagtgttgactcctggacgtgttcgccttctgcttcacaggggcactccgtgcttccgtgggtatggcaggcgcaatggtgagcgtaggaggaagtctgtccggggttgcattgtcagccaagacctgtctgtcattaacttggtcattgtcaagaagggtgagaatgaccttccaggtctgactgacactgagaagcccaggatgagggggcccaagagagcatccaagatcaggaagctcttcaacctttccaaggatgatgatgtacgcaagtatgtcaacacataccgcaggacattcacaaccaagagtggcaaaaaggtgagcaaggcccccaagatccagcgcctggtgaccccacaggtcctccagaggaagcgtgccaggatcgcagagaagaagaagaggattgcaaagaagcaggctgacgccgcagagtaccagaagcttgctgcacagaggctcaaggagcaaaggaacgcaggagcga

SEQ ID NO: 14864 - DNA, 1061 bp, Sorghum bicolor
  unsure (1)..(1061): unsure at all n locations
  Clone ID: SORBI-28MAY03-CLUS123_2
gtccgcaggctttatgttcagggcaaggaagtcaatggtgctggcatcaactctagctttgctgtgcaccaggatgttgatggaagggcaactgatgttgctctagcatggtcagttgcacttggctccccctttacatttgctactactttagaacaggagtacaagagtgatatctttggagagcgaggcattttgctgggtgcggtccatggtatcgtggaggctctgtttaggagatacacagagcaaggaatggatgaagagtcagcctacaaaaacactgttgagggcataactgggatcatctcgaaaaccatctcaaagaaggggatgcttgaagtgtacaactcattgagtgaggaaggcaaaaaggagttcaacaaggcttacagtgcatcgttttacccgtgcatggatatactctacgaatgctatgaagatgtggcctctggaagtgaaatccggagtgtggtgttggctgggcggaggttttacgaaaaagagggcctcccagcttttccaatgggcaacattgaccaaactcgcatgtggaaggttggtgaaaaggtgcgcgcaacccgtccagaaggtgatcttggcccgctccatgccttcactgctggagtgtacattgccttgatgatggcgcagattgagatcttgaggaagaaggggcactcctactctgagatcatcaacgagagcgtgatcgagtcagtggactcgctgaacccgttcatgcacgcccgtggggtcgccttcatggtggacaactgctccacgacggctcgcctgggatccaggaagtgggcaccacgcttcgactacatcctgacgcagcaggccttcgtgacggtggacaaggacgcccccatcaaccaggacctcatcagcaacttcttgtcagaccctgtccatggcgccatcgaggtctgcgcggagctgaggcccaccgtcgacatcttcgtgactgccaacgccgactttgtgcgcccagagctccgacaatctttctagattgaggcagtgagcanagagagtgagagggagggagagga

SEQ ID NO: 14865 - DNA, 1173 bp, Sorghum bicolor
  Clone ID: SORBI-28MAY03-CLUS123_1
gcacgaggacgccggcgggccgcagcagagcccacccgcgcggtgtgcgagtgttcctaaggttgacaccacgacgtcgcttgagggccagcatcgtgcggggcagcagcagagccgatcccgtgcgtgtgcgagtgtgagtgagatcgacaccactagctaggtcgagaccatggctacagcttacgctcccatggcgagccaggtgatgaagagcagcctgcagctgcactccaagccgaggggcttgtccggcgctgccctcaccaccaccaggcgtccccggttcaccgtcaaggccatccagcccgagaaggcgacgtaccaggtggtgcagccgatcaacggcgacccgttcatcggcagcctggagacgccggtgacctcgagcccgctggtggcgtggtacctctccaacctgccggcgtaccgcacggccgtgagcccgctgctgcggggcatcgaggtggggctggcgcacggctacctcctcgtggggccgttcgcgctcacgggcccgctccgcaacacgcccgtgcacggacaggcgggcgcgctcggcgccgcggggctcgtcgccatcctcagcgtctgcctcaccatgtacggcgtcgcgtccttcaacgagggggaaccctccacggcgcccacgctcacgcttacggggaggaagaaggaggccgacaagctgcagaccgccgacggatggtctaagttcaccggagggttcttcttcggcggcatctccggcgtgctctgggcttacttcctcctctacgtgctcgacctcccctactacttcaagtagaagttgattaataaagatccatatatatatatatatagctccgatgctgcgatgcatgcgatcctcctctctgcgtcggcggcatgcgtggttatgtaggtgatggggtccttgtttcacttcagcagtgatgagcaccgtgtataaatgtaattcctctgcacatggatggattgggatgtaacttgaaactataaattttttttttaagggagaggaagagaggatttcgtgtccagagttagaacagagttgtatgttgtgcgactgctttgtaagtctgaactgaacctatgtgagcttctatcagaggacctgagaaagcttgggcatctgtttttggaataaaatgggcccttataggg

SEQ ID NO: 14866 - DNA, 512 bp, Sorghum bicolor
  Clone ID: LIB3478-013-P1-K1-G12
gaagatgtggcctctggaagtgaaatccggagtgtggtgttggctgggcggaggttttacgaaaaagagggcctcccagcttttccaatgggcaacattgaccaaactcgcatgtggaaggttggtgaaaaggtgcgcgcaacccgtccagaaggtgatcttggcccgctccatgccttcactgctggagtgtacattgccttgatgatggcgcagattgagatcttgaggaagaaggggcactcctactctgagatcatcaacgagagcgtgatcgagtcagtggactcgctgaacccgttcatgcacgctcacgcttacggggaggaagaaggaggccgacaagctgcagaccgccgacggatggtctaagttcaccggagggttcttcttcggcggcatctccggcgtgctctgggcttactttctcctctacgtgctcgaccttccctactacttcaagttgaaggtgattaataaagatccatatatatatatatatagctccgatg

SEQ ID NO: 14867 - DNA, 2020 bp, Sorghum bicolor
  Clone ID: SORBI-28MAY03-CLUS6625_1
agcacgagcctcccttcgacttcgagtcctgacgaaatctgaccaccccggttcacactgcgctgctccgcccgcccgcccgccatggcgatccgctcctccaaggcctgctggatctcgctgctgctcgcgctcgcgctctccgccgtcgcgcgggcggaggagcccgcggcggagggtgcggccgaggccgtgctcacactcgacgtcgacagcttcgacgaggccgtcgccaagcaccccttcatggtcgtcgagttctacgccccctggtgtggacactgcaagaagcttgctccagagtatgagactgcggccaaggaacttagcaagcacgacccaccgattgttctcgctaaggttgatgctaatgaggagaagaacaggccgcttgctaccaagtacgagatccaagggttcccaaccctcaagatcttcaggaaccaggggaagaacattcaggaatacaagggccccagggaggctgatggcattgtcgattacttgaagaagcaggttggccctgcgtccaaggagctcaagtcacaggaagatgttgcgacccattatgatgacaagaatatctacattgttggtgtcttcactgaattcagcggcactgaatttacaaacttcatggaggtcgctgagaagctgaggtctgactatgactttggccttcttttggatgccagtcaccgccgacacggtgatgcagaggtagaagcatcatcagttttcgacatgtgccgtaacatgaaggcccttgctgtccttttgcgtcgcggaggggctgctccgttgccgctgagtctcgcgcctgacgtccccgcagttgtcacttctgccctgaaccccgacagccgtctgtttcccctgtaaatcatcgttaattgtattcatctagctgttggaagcatgggccctaggccttgtatacaacatagtagtacatagtagtccctagctgaaatggaggaatacgagtacaaggaaaaacacttccttattggtgaccttgaatccagccagggtgccttacagtactttggtctgaatgagaacaaggcaccccttatcctcatccaggatggtgattccaagaagttcttgaaggatcaaattgaggctgaccagattgtctcttggttgaaggagtactttgatggcaaattgacgccgttcaagaagtctgagcctattcctgaggtcaacaatgagcctgttaaggtggttgtggctgacaacatccatgatttcgtcttcaagtctggcaaaaatgttcttattgaattctatgccccctggtgtggacactgcaagaagctggcgcccatcttggaagaggcagccaccactctccagagtgatgaggaagttgtgattgctaagatggacgcgacggccaatgatgtgcccagtgagttcgaggtccaaggctacccaaccatgtacttcgtgacccccagcgggaaggtcaccgcctacgacagcggcaggacagcagacgacatcgtcgacttcatcaagaagagcaaggagaccgccggcgccacccaggcgacgacgacgacatctgagaaggcagctgacgcagccgagaaagctgagcccgtcaaggacgagctgtaaacatccagtgcgtggatggcgctgtggctgtgtaagcatgggagaggaggggggagagaacacctggcgctaacatgcttgtcagcgccaagcctccaagtttagtttttgcgagaggggagagagggcaaagaggaagagaatgcgaggggatctgtgacgtgttttgctctgtggcgcggcatgtctgtgtatcccattgagattatgtacaatttacaaccagtcagcggtaccttttctttagttaaatatcagaagtgacagtagaaagaaactgattgtggtcgggttgaatggatgaataaatagcgagtccgccatcatggaaaaggcgtttttttttgtgatggtgaggttgaatgaatgaataaatggccgagtcatg

SEQ ID NO: 14868 - DNA, 315 bp, Sorghum bicolor
  unsure (1)..(315): unsure at all n locations
  Clone ID: LIB3480-033-P1-K1-A3
gtccanctgtccacgtttcactcctcgcacttgtccgcctcgtcgcctcgcttttttttgtggaacgtagaatggcagcttcctcgccgcccctcccgccgccgccgccggcagcgtcctccaccacgctggccggaaacctcacggcctcctcgctcctgtccatcccgcgcccgcgcccgcgcctcgccgcggcgcaccgccgggcggcgtggccgcgtccgtgtcgccacggccccggcccccgcagccgtcgtcggaggaggacggcgactagaacgaggcggagagggcaattgggatagacagctgatt

SEQ ID NO: 14869 - DNA, 3430 bp, Sorghum bicolor
  unsure (1)..(3430): unsure at all n locations
  Clone ID: SORBI-28MAY03-CLUS1091_1
accatccattgcaccacggttcaccccgtccatttgatttgcgttcgttcactgcgttgcgttgcgtttcttggagttgttgttctcctctcctctttggattggaggctccttcttcttctccctctcggaggaaggcttgaggacccaagaagagactagcaatgggggaagctgccggtgaccgtgttctgagccgcctccacagcgtcagggagcgcattggcgattcactctctgcccaccccaatgagcttgtcgccgtcttcaccaggctgaaaaaccttggaaagggtatgctgcagccccaccagatcattgccgagtacaacagtgctatccctgaggctgaacgtgagaagctgaaggatggtgcctttgaggatgtcctgagggcagctcaggaagcaattgttatccccccatgggttgcacttgccatccgccctaggcctggtgtctgggagtatgtgagggtcaacgtcagcgagctcgctgttgaggagctgagagtccctgagtacctgcagttcaaggaacagcttgtggaagaaggccccaacaacaactttgttcttgagctggactttgagccattcaatgcgtccttcccccgtccttctctgtcaaagtccattggcaatggtgtgcagttcctcaacaggcacctgtcatcaaagctcttccatgacaaggagagcatgtaccccttgctcaacttccttcgtgcccacaactacaaggggatgaccatgatgttgaacgacagaatccgcagtctcagtgctctgcaaggcgctctgaggaaggctgaggagcacctgtccaccctccaagctgataccccatactctgaatttcaccacaggttccaggaacttggtctggagaagggttggggtgactgcgctaagcgcgcacaggagactattcacctcctcttggaccttcttgaggccccagatccgtccaccctggagaagttccttggaacgatccccatggtgttcaatgttgttatcctctcccctcatggttactttgctcaagctaatgtcttgggttaccctgacaccggaggccaggttgtgtacattttggaccaagtccgtgctatggagaatgaaatgctgctgaggatcaagcagtgtggtcttgacatcacaccaaagatccttattgttaccaggttgcttcctgatgcaactggcaccacctgtggtcagcgtcttgagaaggtccttggcactgagcactgccatatccttcgtgtgccattcagaacagaaaatggaattgttcgcaagtggatctcgcgttttgaagtctggccttacctggagacttacactgatgatgtggcacatgagattgctggagagcttcaggccaatcctgacctgatcatcggaaactacagtgatggaaaccttgtcgcatgtttgctcgcgcacaagatgggtgttactcactgtaccattgcccacgcccttgagaaaactaagtaccctaactctgacctctactggaagaagtttgaggaccactaccacttctcgtgccagttcaccactgacttgattgctatgaaccatgctgacttcattatcaccagtaccttccaagagattgctggaaacaaggacaccgtcggtcagtacgagtcacacatggcattcacaatgcctggtctgtaccgcgttgtccacggtattgatgtgtttgaccctaagttcaacatcgtgtctcctggcgcggacttgtccatctacttcccatacaccgagtcacacaagaggttgacctccctccacccggagattgaggagctcctgtacagccaaaccgagaacaccgagcacaagtttgtgctgaacgacaggaacaagccaatcatcttctccatggctcgtcttgaccgcgtcaagaacttgactggtctggtggagctttatggccggaacaagcgcctgcaggagctggtgaacctcgtggttgtgtgcggtgaccacggcaacccgtccaaggacaaggaggagcaggccgagttcaagaagatgtttgacctcatcgagcagtacaacctgaacgggcacatccgctggatctccgcccagatgaaccgtgtccgcaacggtgagctgtaccgctacatttgcgacaccaagggtgccttcgtgcagcctgctttctacgaggcgttcgggctgacggtggttgaggccatgacctgtggcctgcccacgttcgccaccgcctatggtggtccggctgagatcatcgtgcacggcgtgtctggcttccacattgacccgtaccagggcgacaaggcgtcggcgctgctcgtggacttctttgagaagtgccagacggattcgagccactggaacaaaatctcccagggcgggctccagcgtatcgaggagaaatacacctggaagctgtactcggagaggctgatgaccctgacgggcgtgtatggtttctggaagtacgtgtccaacctggagaggcgcgagacccggcggtacctggagatgctgtacgcgctcaagtaccgcaccatggccagcaccgtgccgttggccgtggagggagagccctccagcaagtgagcgcgcggcggcggcggcggcgactagagatctcacctgatgagcgaaagggagcacttggagttgtgtcttttccctgggtttccttcccctgaccaggaggcgaaaaaagagtctgctttttcctaggcgacgggcgttcgttgctgctattcccttcaatcaagaattgttattgccttgtcatcaaggtcttgttccatcattgatccgggtgttggttttagtagtctgatctgaattgttagtagtttgtgttgagtcggttgagagggatgctgggatggtgggtggtgtgtgtgaagtcgggtgtggtgctcccttagtttcctggatgggatgttgctccttgaataatgatcattgtggccttggtgcccttttcctgaaataagagtagcatccttcctttccttgtggtccaaaaaaaaaaaaaaaaaaaaaaaaaaaaaactcggagaccgcggccttcgctggcccgcggatcgactggaaagagactccagaggcgcacgtgttcaaagcggacgtcccgctgaagaagatcaaggtggagtggactgcaacatccttcatcagccagcgcaacaaggaaaccacnagttacagtcccagagttgagcaacagcttcctgcaattataggttgatagaatgcttctacattccttctgcgtactgctcgatcatctgttgctcccaaactactgtgtagccagctcgctcacacatcatcagtgctctgttcaaggttctgttgcatggtatccaacttctcaattacatactccagcttcttacaacatatctcatcgc

SEQ ID NO: 14870 - DNA, 2151 bp, Sorghum bicolor
  Clone ID: SORBI-28MAY03-CLUS7340_1
gcacgaggattcagaacagatttaggcacatctgcagcagtgcgtgtggcatctcaactcaggatgcacacttcactttgaaaaagcgaatctgaattctgaacatgtatctatgttacataggccattgggcttgcacatgctgcgatcaatgcgatcccgaactcgctgtggcacataggaatatgttttggcatgaaagtgatgcgatcatgcacggcacatgccacctttgtgggagacgcctctcgtgccgtgatttgttttattttgcttcaggggggcgggaggctcctccctcctcccccctcccccccttgcaaatcctgagaacaccaccactcgttttcctgtccgggacaggagaaaaggggagagaggcgaggcgcggtgtccgcccgatctgctccgccccgacgcagctgttccgtcgttctcagtctcagcaaaatgggtgccggcggcaggatgaccgagaaggagcgggagaagcaggaacagctcgcccgtgctactggtggcgctgccatgcagcgatctccggtggagaagccaccgttcacggtgggtcagatcaagaaggccattccaccacactgcttcgagcgctcagtgttgaagtccttctcctacgtggtccatgacctcatcattgccgcggcgctcctgtactttgcgctggccatcataccggcgctcccaagcccgctccactacgcggcctggccgctctactggatcgcccaggggtgcgtgtgcactggcgtgtgggtcatcgcgcacgagtgcggccaccatgccttctccgactaccagctcctggatgacatcgttggcctggtgctgcactcgtcgctgatggtgccgtacttctcgtggaagtacagccaccggcgccaccactccaacaccggctccctggagcgagacgaggtgttcgtgccaaagaagaaggaagcgctggcgtggtacaccccgtacgtgtacaacaaccccgtcggccggctggtgcacatcgttgtgcagctcaccctcgggtggccgctgtacctggccaccaacgcgtcgggacgcccgtacccgcgcttcgcctgccacttcgacccctacggcccgatctacaacgaccgggagcgcgcacagatcttcatctcggatgctggcgtcatggccgtgtcgtttggtctgtacaagctggcggcaacgttcgggttctggtgggtggtgcgcgtctatgccgtgccactgctgatcgtgaacgcgtggcttgtgctcatcacctacctgcagcacacccacccggcgctcccccactacgattcgactgagtgggactggctgcgcggcgcgctggccaccatggaccgcgactacggcatcctcaaccgcgtgttccacaacatcacggacacgcacgtcgcgcaccacctcttctccaccatgccacactaccacgccatggaggccaccaaggcgatcaagcctatccttggcgagtactaccagttcgacccaactcctgttgccaaggcgacctggcgtgaagccagggagtgcatctacgtcgagcctgagaaccgcaagggcatcttctggtacaacaacaaattctagctgctggttgcagaggtgaggatggaggcgatcgcccatacttttaccctaggaatgggaggagcaatcaggaggagaagatggtaatgtcccaaagtctccatctacctatctctggttagtcatcaggctttagacaggaagagagcatttgggaacagagaaggcttattgcagtgccatcgctagagctgccatcaagtacaagtaggcaaattcgtcaacttagtgtgtcctctgcccatggctgagctttgggtagtcccaagttttttttttttctcgtttgcgtcctagtcgtcgctgttgtaggctttgccggcggcggtcgtcgtgtgattggcatccgtggccatgcctgtgcctgcgtggccgtgcttgtcgtgtgcgtctgtcatcgcgttggcgtcatctcttcgtgctccccgcgtgttgttgtaaaacaaaatatcctggtgtctttggcggaataacagatcgtcgaacgactacttttttgggcagttgtagtggttttccgagtcggatcacgccccc

SEQ ID NO: 14871 - DNA, 1270 bp, Sorghum bicolor
  Clone ID: SORBI-28MAY03-CLUS156_1
cttttctctctctccagaactctccccccgcagccatggcggaggacgcccccaacgccgccgccgagggcagccagcccgctccccccgagggatccgccgactccgcccccgccccggcggctaccgcgggcgccaaggccgcggaggcgctgctcccgtcgctcagcatctggccgccgtcgcagcgcacgcgcgacgccgtggtgcgccgtcttgtgcagacgctcgcggcgcccagcgtcctctgccagcgcaacaataataggcagccaccagcccaccatccccaccagcccagcgctagaaaatagcggcgagcaaaagcgggcggaaggggaaagccaggctcgccccgcgccaccagccgcaaaagcgcaaatccgatctctatctctatctctatctctcgttcggttctccgagcggcgaatctattccggccgccggcaccaccaccaccatggccgccgccgccgccgccgtagccgtctgtccttcgtcctccgcacgaggcacgaggccagccgagctccctcgtcgatctatcagcaaagcacccacaccagcgaaaaagcaagcagcgatggcggcctccatgatctcgccgtcagctctggtggcgccgccgtccagggcgcagggcctgccgtccctcggccgccgcgcctcctccttcgccgtcgtctgcggcaccggcaagaagatcaagaccgacaagcccttcgggattggaggtggcctgaccgtcgataaggatgcctccgggaggaaggtcaagggcaagggcgtgtaccagttcgtcgacaagtacggcgctaacgtcgacggatacagcccaatctacaacgagaatgagtggtctcccagcggcaacgtctacgtcggtggaacgactgggcttctgatctgggccatcaccctcgctgggctcctcggcggcggcgccctcctcgtctacaacaccagcgccctctccggctaaggatactcatttccaatcgtgatccatgcgcttcttcttgatgcggttcatcatgtaaaatcatgccagcagggtgtctgtctgtaatctagcctccttcgatgcccactgtaatgcaagcttcatcatgtaacaatgctactctctactactacgacgtactcttcatacttaattttgggacaacgactatcattatattattaattgatgctatatatttagaatattattaatatataactggtagtaaattcagcccaaaaaaaaaaaaaaaaaaaaaaa

SEQ ID NO: 14872 - DNA, 562 bp, Sorghum bicolor
  unsure (1)..(562): unsure at all n locations
  Clone ID: LIB3481-058-Q6-K1-H8
ggccgccctttttttttttttttacatggagaagcttgcattacagtgggcatcgaaggaggctagattacagacagacaccctgctggcatgattttacatgatgaaccgcatcaagaagaagcgcatggatcacgattggaaatgagtatccttagccggagagggcgctggtgttgtagacgaggagggcgccgccgccgaggagcccagcgagggtgatggcccagatcagaagcccagtcgttccaccgacgtagacgttgccgctgggagaccactcattctcgttgtagattgggctgtatccgtcgacgttagcgccgtacttgtcgacgaactggtacacgcccttgcccttgaccttcctcccggaggcatccttatcgacggtcaggccacctccaatcccgaagggcgactagttcttagatcgcgagcggccgctcncgatctagaactagtcttgctctgctgtctactgatgttcagtaatatgccataattggtgacgtgaacagattagattccatttcctttgttttgtcatggtgacataatg

SEQ ID NO: 14873 - DNA, 646 bp, Sorghum bicolor
  Clone ID: LIB5052-007-A1-XP1-E11
gccggccgggctcgatccatcgtcgatctatcagcaaagcacccacaccagcgaaaaagcaagcagcgatggcggcctccatgatctcgccgtcagctctggtggcgccgccgtccagggcgcagggcctgccgtccctcggccgccgcgcctcctccttcgccgtcgtctgcggcaccggcaagaagatcaagaccgacaagcccttcgggattggaggtggcctgaccgtcgataaggatgcctccgggaggaaggtcaagggcaagggcgtgtaccagttcgtcgacaagtacggcgctaacgtcgacggatacagcccaatctacaacgagaatgagtggtctcccagcggcaacgtctacgtcggtggaacgactgggcttctgatctgggccatcaccctcgctgggctcctcggcggcggcgccctcctcgtctacaacaccagcgccctctccggctaaggatactcatttccaatcgtgatccatgcgcttcttcttgatgcggttcatcatgtaaaatcatgccagcagggtgtctgtctgtaatctagcctccttcgatgcccactgtaatgcaagcttcatcatgtaacaatgctactctctactactaaaaaaaaaaaaaaaaaaggccccta

SEQ ID NO: 14874 - DNA, 519 bp, Sorghum bicolor
  unsure (1)..(519): unsure at all n locations
  Clone ID: LIB3478-056-Q6-K1-D7
cgagacgagccgtttaaataggtgtcaagtggaagtgcagtgatgtatgcagctgaggcatccacacgtccgcagtccgcacacaccccagagcaagcgcctgaccgtcgataaggatgcctccgggaggaaggtcaagggcaagggcgtgtaccagttcgtcgacaagtacggcgctaacgtcgacggatacagcccaatctacaacgagaatgagtggtctcccagcggcaacgtctacgtcggtggaacgactgggcttctgatctgggccatcaccctcgctgggctcctcggcggcggcgccctcctcgtctacaacaccagcgccctctccggctaaggatactcatttccaatcgtgatccatgcgcttcttcttgatgcggttcatcatgtaaaatcatgccagcagggtgtctgtctgtaatctagcctccttcgatgcccactgtaatgcaagcttcatcatgtaacaatgctactctctactactnaaaaaaaataaaaacagaanat

SEQ ID NO: 14875 - DNA, 222 bp, Sorghum bicolor
  unsure (1)..(222): unsure at all n locations
  Clone ID: LIB5051-002-A1-XP1-A9
gccggccggngtcagtatccggctaaggaactcatttcttccctgaccatgcgcttcttcttgatgcggttcatcatgtaaaatcatgccagcagggtgtctgtctgtaatctagcctccttcgatgcccactgtaatgcaagcttcatcatgtaacaatgctactctctactactacgacgtactcttcatacctaaaaaaaaaaataaaaaaggccccta

SEQ ID NO: 14876 - DNA, 1253 bp, Sorghum bicolor
  unsure (1)..(1253): unsure at all n locations
  Clone ID: SORBI-28MAY03-CLUS257_2
ggacattgttgcactttctggtggtcacaccctggttggtggaactggtcacctagcctgtgtatttttttgggtgtttggcaacttgaaaggtggtgcttatgcagaattgtctctcttgtagggaagatgccacaaggatagatctgggtttgagggagcctggacatccaaccctttaatctttgacaactcttacttcacgtacgtgatctgtttcttttgaagaaggcaactcttatttctactcataccatgttttgttggttaaactgaatagctgtgttacaatcctggagcatgaactctgacacgagtcttcattaagataagttgaataaactatgacagggagcttctgagtggagagaaggaaggccttctacagctaggaatcgacaaaactttttggttttcggggtgaactaaacaaggccacaattatagaattcctctaatattgctgaagcttctgccttgatgtaggcatgcttctgggtgcactgtgtgtgatccttctttgactatacaagaaatctactcagttagtgcataagaattcgtgaggaacatttgatctgagttcttggattgccttctttgtcgtgtcaaggataaagttagaatgtttctcaatggtacaaatgggataggtggacttactggtttggtctcttgtatcaggttctgatcacctcangcaggttttctccacacagatgggtttgagcgaccaggacattgttgcactttctggtggtcacaccctgggatgtcatttaatccttgcatagttctcatttgttggggagtcggcctttagcttgcaggtttatgatacctgtgatgattttgcctgatttgtaggatgaggacgctttctttgctgactacgccgaggcccacctgaagctttccgaattggggtaagtggtgctgatcggtctctccccgtgatcgaatgcctgtttactactagggcaacaaacactaaatctcttgcactgtgcagatttgctgaggcgtaaggtgaggtgctcataaagaaggggacaggcggngcagggctgggcaggtgcggatgaagattgttgcctagctgatttatcttgtcttgctggctatttggcatctaagaccaatgagaaccagaagagtatggtggtgtaataaacaatcgtcggccttgtgaggcagggcccatcttttgtggtttcccttgaatggttagagtaatgtgatttcctttccgg

SEQ ID NO: 14877 - DNA, 1721 bp, Sorghum bicolor
  unsure (1)..(1721): unsure at all n locations
  Clone ID: SORBI-28MAY03-CLUS257_1
gatatatggcattgtacagcaatttatagttgttgaattgatccgtaggcagttcaggatgtgaagaattctggtgagctgggcgaatatggatgctctttcaccagaatttagtcaggcaagaaggatggatgctaaaacgcatctggaaatgtaaattgtggcaccttgtttgattttagaactgaaataatgtaaataattgcttgtnaaaaaaaaaaaaaaaaaaaaaaaaaaaaaaaaaaaaaaaaaaaggggcgccgctcgcgatctagaactagggacatccaaccctttaatctttgacaactcttacttcacggagcttctgagtggagagaaggaaggccttctacagctatctcgtgaacatactggacaactcacctgatgccggcacggaagagattgtgcaggcgatggtcaatgcatcagcctcagttggctcaccatcagaggagaaggttcaggccaggatgcagatgatcaccagggtgttcctcaagagtctccagcctggtgacgtggtcttcaagaaggtctcccgcggccggtactgtcggggtccttcgctgcgccattctccgatcggaccaccgggccagtagcagagcgggtcgtgacgtcagcagccatggtgaaggcctaccccacggtgagtgaggactacctcaaggcggtcgacaaggccaagcgcaagctccgcggcctcatcgctgagaagaactgcgccccgctcatgctccgcctcgcctggcactccgcgggcaccttcgatgtggccaccaagaccggggggcccttcggcaccatgaagaaccccgccgagcaggcgcacggagccaacgccggactggaaattgccgtcaggctgctagagcctatcaaggagcagttccccatcctatcctatgctgacttctaccagcttgccggagtcgtggcagttgaggtaaccggcggacctgatgtccccttccaccctgggaggcaggacaagcctgagcctccgccagaaggccgccttcctgatgccacccaaggttctgatcacctcaggcaggttttctccacacagatgggtttgagcgaccaggacattgttgcactttctggtggtcacaccctgggaagatgccacaaggatagatctgggtttgagggagcctggacatccaaccctttaatctttgacaactcttacttcacggagcttctgagtggagagaaggaaggccttctacagctaccaagtgacaaagccctcctctctgatccatccttccgcccacttgttgacaaatatgcagcggatgaggacgctttctttgctgactacgccgaggcccacctgaagctttccgaattgggatttgctgaggcgtaaggtgaggtgctcataaagaaggggacaggcggggcagggctgggcaggtgcggatgaagattgttgcctagctgatttatcttgtcttgctggctatttggcatctaagaccaatgagaaccagaagagtatggtggatgtaataaacaatcgtcggccttgtgaggcaggcccatcttttgtgtgtttcccttgaatggttagagtaatgtgatttcctttccggcattgatgaactcagctgaagatgtagtgtgtaatgtcatggttcgtttttctatttattatttatctatatctatcaatatcgaagctccgataatgaatggagtct

SEQ ID NO: 14878 - DNA, 1633 bp, Sorghum bicolor
  Clone ID: SORBI-28MAY03-CLUS3480_1
cagacagcatcagtcatgcagagtgcagtacagcatcagtcacagtagtagtcatctggctatacctgttaagatactcttcacatacctgatcgatccttgcaagatggcgaggcagtgtatcgcttccatgcttgcactggcattgctcctcggagcatttgcagccattcctacaggagtgcaagccatcggggtgtgctacggcgtgaacggcgacaacctgccgtcggcgagcgacgtggtgaaactgtaccagtccaacggcatcaacctgatgcgcatctacttcgcggacaccaacgcgctcaacgcgctgagcggcagcaacatcggggtgatcatggacgtgcccaacacggacctctcctcgctggcctccgacccgagcgcggcggcgacgtgggtgaagagcaacgtgcaggcgttcccgggggtcaacttcaagtacatcgccgtcggcaacgaggtctccggcggggacaccaacaacatcctccccgccatgaagaacgtcaactcggcgctgtccaacgccgggctgggaaagatcaaggtgtccacggcggtgcagagcggcgtcacgcaggggtacccgccgtcgcagggcagcttctcgcagagctacatggcgcccatcgcgcagtacctgcagagcacgggggccccgctgctctgcaacgtctacccctacttctcctacacgggcaacgaggcccagatcgccctcagctacgcgctcttcacgtcgccggggaccgtcgtgcaggacggcagcaacgcgtaccagaacctcttcgacgcgctcgtcgacaccttcgtgtccgcgctcgagaacgccggcgccgggaacgtcggcgtcgtcgtgtccgagagcggctggccgtccgccggcggcgacgccgccacgccggggaacgcgcagacctacaaccagaacctcatcaaccatgtcgggaagggcacgcccaagcgccccggcgccatcgagacctacatcttcgccatgttcaacgaggacaagaagacgggagccgagacggagaggcacttcggactcttcaacccggacaaatcgccggcgtactccatcaatttctcctaaaaaccaaccaagtgggacgctcgcgcggcccggtccatatatacacgatcgaacaagacataaaatttaactatacgagataccatacagatacacatatataccttatatactacataccaaaacattgaataaactgcctgtaaaatgcaaagtgcatccatgtaaggcaagtgcttcgattattacataaaaatgaataacaagaagtacattcttgatttatttcttctttgcccatgtagttatatgctttctcctaatttcgtctcgacattatgtgcatcgatcattattaaatgggagtaatatctcattataatcaattaaaattcggttcaaaattagaacatatcatcttgcaaattgggagagtgttagtagtatgttcaaagattttgggcggcttggtaccaaatttgagagatttaaagaagtgtctgttagccttgtggagtaagttaagtagccatgttgtattgttgttgactataaatacaatactgctagcacgagtgcatgacttca

SEQ ID NO: 14879 - DNA, 1756 bp, Sorghum bicolor
  Clone ID: SORBI-28MAY03-CLUS1389_1
cgaggacgccctgaacccccctctccctccgcgccttccttctgcctcccagagaactcgtttgaaaagaaaagccccctcttggttcttcctttccctccctttcggcagcagggggggcagccatggcgaagcccatctccattgaggtgtggaaccccagcggcaagtaccgcgtggtgagcaccaagtccatgccgggcacgcgatggatccgcctgctcaccgacaacgactgccgccttgagatatgcaccgagcagaagaccatcctctcagtggacgacatcctggcgctcatcggcgatcgctgtgacggcgtgattggacagctcactgaggactggggggacgtgctcttctctgcgctcaagcgcgccggaggcacggccttcagcaacatggccgtcggctacaacaacgtcgacgtcgaggctgccaacaggaacggaatcgccgtcggcaacacgcctggtgttctgacggagacgacggctgagctcgcggcctccctcacgctgtcggcagccaggaggatcgtcgaggccgaccagttcatgagggctggtctctacgacggatggctcccacacctgttcgttggcaacctgctcaaggggcagactgttggagtcattggagctggtcgcattggctctgcctatgcacgcatgatgattgagggcttcaagatgaatctcatctactacgacctgtatcaggccacacggcttgagaagtttgtcacagcatatgggcagttcctgaaagcaaatggtgaggagcctgtcacctggaagagggccgccaccatggaggatgtcctcagggaggctgatgtgataagtctgcatccggttctggacaagaccacgtaccatctgataaaccctgaaaggctggccatcatgaagaaggaggctgttcttgtgaatgcaagccgagggcccgtgatcgatgaagtcgccctggtggagcacctcaaggctaaccccatgtttcgtgttggcctcgacgtctttgaggatgagccttacatgaaacctggtctcgctgacatgaagaatgccgtcgttgtgccgcacattgcatcagcctccaagtggacccgtgagggaatggcaacactgactgctctcaacgttcttggtaagatcaagggttaccctgtgtggggaaaccccaatcaggtggagcccttcttggacgagaattcgacgccaccgcgtgcctgcccaagcatcgttaatgccaaacagcttggcctgccatcggcaaagctttaggagccaacgctgacgctgccttggctagtatctactacacgtgtcgtcgtctccagcagcacatacactcatgcgtatggttggcattcatcttcagagcagctagctcatctagaatggatggtgtactgtgcagagggtgctccggactagagagctagaatggatgtactgtgcagtcaggcctcatatataatggattactacatatatagatagatgcagcttgggttccggtataacaataaaaacaatgcaagcacatacggctgtatgtgacttgatgcatgcgtgcatctggatccagcgtacgccgctgatgcatatattatgtgaattaatataatgttatgttacataagatatatacatctatcggatcccaaacatgtgcgtacgtatctggatttagttttgtacgatgaatagcatatatatatttggtatgtacaacgtatatatttgtgtac

SEQ ID NO: 14880 - DNA, 1109 bp, Sorghum bicolor
  Clone ID: SORBI-28MAY03-CLUS41537_1
gcacgagggctggaagcttcagctgagcagcagcagcatcatcatcatcaccaccgtcgtcagtagccaagtgtatttttcctagcgatttgcattgcgcgatctgttcctggccagtttaattagttgcagagcgagctgagcttcacgagcttttgagagacccctgctgcgtgccatggcttcccaccaggacaaggctagctaccaggccggcgagaccaaggctcgcaccgaggagaagactgggcaggcgatgggggcgaccaaggacacggcgcagcacgccaaggagaccaccaagcagaaggcgtccgactccgacaccggcagctaccttggccagaagaccgaggaggccaagcacaaggccggccagaccacggagtccaccaagcagaaggccggccagaccacggaggccgccaagcagaaggccgccgagaccacggaggcgaccaagcagaaggccggcgagacgacggaggcgaccaagcagaagaccgccgagacgacggaggccaccaagcagaaggccgccgaggccatggaagccaccaagcagaaggccgccgaggccgggcagtacgccaaggagaccgtcgtctccggcaaggacaagtccgccggcgtcatccagcaggccaccgagcaggtgaagagcgcggcggccggcgccaaggacgcggtgatgaacacgctggggatgggcggggacaacaacagcaagcagagcgacacaaacaccgacagcagcaaggactcctccaccatcaccagagatcactagacacatgcacacgcacttcgtcctgtaccatgatcccgtttgcttgttcaggagtccagtatgtatgcatgttttcagtgtcatgattttcgttctacggatttggtgctgtaagtttaattcgccgttgctgtggttcttgggtcatgaagagtgtctgtaaacgagtcgcgtggaagtgttctttgttataataaagttggtaaagccttaatatatagcatgtagcttgtggcctatatatgtgttttgtagtttacatcagtatgcactagatatgatcttcaagtttgccgctttttgcggtcgcaaagattgg

SEQ ID NO: 14881 - DNA, 1504 bp, Sorghum bicolor
  Clone ID: SORBI-28MAY03-CLUS6560_1
gccggccgccgcagtattactcctagtaaagtttctatcttgctccgcaaaccagcgcaaacccttccctgacagcggcggcgactccccagcggcggcgccatggtgctcgaggcgacgatgatctgcatagacaactcggagtggatgcggaacggcgactacgccccgtcgcggttccaggcgcaggccgatgccgtcaacctcatctgcggcgccaagacccagtcgaacccggagaacacggtaggcgtgatgacgatggccgggaagggcgtccgcgtgcttgtcactcccaccagcgacctcgggaagatcctcgcctgtatgcacgggttggaagttggtgccgaggcaaacttggctgcagcaatccaggttgctcagcttgcactaaagcatcgccagaacaagaggcagcagcagaggattatagctttcatcggaagtcctgtgaagtatgacaagaaagttttggagacaatcgggaagaagctgaaaaagaacaatgttgctcttgacattgttgactttggtgaatccgatgatgaaaaacctgagaaactggaagcattgattgctgctgttaacagcagtgatagcagtcacattgttcatgtccctcctggtgataatgccctctctgatgtcctcctaagcactcctatatttaccggtgaagaagggggaagcggttttgctgcttccgcagcagctgctgcagctactggagcatctggatttgaatttggtgtggacccaaatgtagatccagaattggcacttgccctgcggttgtctatggaagaagagcgggcaaggcaagaggctattgccaaaaaggctgcagaagatacttctaatactgaaaacaacaatgcctcaagctcaaacagcgattctgttatggctgaagcagaacctgcctcaaatgctgctgctggcgacaagaaagaacagccaaaggatgatgacgatctactacagcaggcacttgcaatgtcaatggagggtggtgcttcaggatctgcagctgtgactgactctgctatggcagaagctggtgcagttgaccctgacttggcattggctcttcaaatgtctgtccaggatgcaaacatgtccagtgacactgatatgagtaaggtgtttgaagacagaacgtttgtgtcatctatccttaattcgcttcctggtgttgatcccaatgatccatctgttaaagatttgctggcatcattgcacagccagggagagcaagagaagaaggaagacaagtccgacaaaacagaagatgagaagaactgatgtagccatgttcatgcttccatgcgcacaaagaaattgaagatcggtctccgttggctgcgtttactctcttggattcgtggaatttacttatcctcatgtaacaatgctttgattataacttaatgcggagggaatttgtattatgaccgcaacaatcttctctccatatatgttcaagtgattttcgtgttcc

SEQ ID NO: 14882 - DNA, 1109 bp, Sorghum bicolor
  Clone ID: SORBI-28MAY03-CLUS1465_1
gcccgggcccccccccagccccaccttccccggccgctccctgacctgcccaaaaaaaaaaaaaaaaaaaaatccggaaggttccccttccacctccatatcttcttcttggtcctcctccgcctccactttgccttccctgcgttgcgtcttgagagagaggagtgggagacctgtgcgagaggctgccgtgtagggaccgtagagttagcaactgcaaaggagggagaggggatggccgggatcgggccgatcaggcaggactgggagccggtggtggtgcggaagaaggcacccaccgcagccgccaagaaggatgagaaggccgtcaacgccgcgcgccgcgccggcgccgagatcgagaccatgaagaagtacaacgctggcacgaacaaggcggcgtccagcggcacatccctcaacaccaagcgcctcgacgacgacactgaaaacctcgcccatgagcgagttccaagtgacctgaagaaaaatctcatgcaagcaaggctcgataagaagatgacccaggcacagcttgctcagatgatcaatgagaagccacaggtgatccaggagtatgagtcgggcaaggcaatccccaaccagcagatcattggcaagctcgagagggccctgggaacgaagctgcgtggcaagaaatagctttcgtactagtcatgtgtcccggagcagcatagggaagacaaggcaaactgtctgcttattatcatctatgtttggtatctcaagtcatgcggactgtttctgtcggtacaagagtgaataactgtgttctcagacctgtaatgcttgctgcttgtcatatgagtatatgacctagctctaaaaaaatttgtgatgaagctgtcaactgatatgtgataacctcataaccagcgtggtcatgatgatgcccattcctgcagttgggcacttactctgtcaccggtaatatatattttgtctgtcacctatatattttagcctatttagcgacgtcagtaagcaaatcaatgttgacgagtgtcgcatactacgatcagtgtattgctctctgtaatcctatttgtatgttgcctttcactttgattcgaagaaattgaattacc

SEQ ID NO: 14883 - DNA, 505 bp, Sorghum bicolor
  Clone ID: LIB5049-003-R1-XP1-A2
gccggccgggccgggatccacgcggccccaacgccagccacagcacacgagtctctcgaagccatggactcgcgcgccgtaggcgacggcgcaggcgggggtcccgacgcctcctccccggccgatccgccgagccccgagcccgatccgtccgcgggctcgatggacgcgcgcctcccggcggacctgcttcgcgccgtgcttcagaggctgccgccgattgacctcgcgcggtccgcttgcgtctgccgcgcgtggcgcgcggtcgcctccgaccgcgccgtggtcgaggccgccttctgcgcgccctggggcgtgcggcgcgtcgtcggcgagtcggcgacgggggccttctggcggaccgcctgcctcgggagattcgcgctgtcgcacgccgtccgccgcggggataccgcccccggcgtcgctctcaagtactccgtgcaggtgacagatatcaaacgatttcacaacatgatgagtgatcatggcatctactcgaggg

SEQ ID NO: 14884 - DNA, 487 bp, Sorghum bicolor
  Clone ID: LIB3478-012-P1-K1-G5
ctcgcgcgccgtaggcgacggcacaggcgggggtcccgacgcctcctccccgtccgatccgccgagccccgagcccgatccgtccgcgggctcgatggacgcgcgcctcccggcggacctgcttcgcgccgtgcttgagaggctgacgccgattgacctcagcgcggtccgtttgcgtatgacgggcgtggcgcgcggtacattcctaaacaccaagcgtctagacgacgacactgaaaacctcgcccatgagcgagtttcaagtgacttgatgaaaaatcttatgcaagctaggctcagatagaagatgacccatgcacagcttgctcagatgatcaatgagaagccataggtgatccatgagtatgagtcgggcaaggcaatcctcaaccagcagatcattggcaagctcgagagggccctgtgaacgtatctgcttggcatgatattgtttttgtactagtcatgtgttctgtatcatgtatat

SEQ ID NO: 14885 - DNA, 1854 bp, Sorghum bicolor
  Clone ID: SORBI-28MAY03-CLUS810_1
ccgcccccgccggctcaccggacacactgcacggcgtacgtgtggttgccaccaccatgcacacggtggctatccagcggcggcgccatggcgccgtcacgctgcttctggtcgccgccgtagtgttcctggcggcagcggcggcggcgcaccgcccgcgcggctgcggggtgacgagcaagtacgtgcggaagcaccaggcgtcggaggacatgccgctggacgcggacgtgttcgcggtgccgccgggccggaacgcgccgcagcaggtgcacatcgggctggcgcaagcagacgggcacctccatgttcgtgtcctgggtcaccgtggaggccgagggcaacagcaccgtcctgtacggcgtcgccgccgacaagctcgacctcgcccccgagggcaccatcacgcgctacacctactactactacacgtccgggtacagccaccacgcgacgctgacgaacctgcagcacggcaccaggtacccctcctgggtccgggaccaggcgtagcagccgggtgtgcggtttttgatgcccggcgcggcgtgtccgaggctgtactcccggctccccgaggatgccggcggcggcctggtgagctcgtcggcgagcccctccacgttgccgccctcgccgacgacgacgtagaccggcgcgcggcggtcggcgatgcgcgtgcactcgccgtcggtcacgttgtacttgatgttggagtacctgtgggtgcgctcgtaggcgtggacgtggccggccaacacggcgtcgacgcgtgcgtcgacggccatcttctccaactgcgccctcatcggctcgccctccatgtagtggaagttgttgctgttgtaccacggcacgtgcgtgctgatgaagagccatggcgtcacctccctgtcgacgcgcttcagctccgcctccacccacttgtactgcggcgtgtacttgacgccgtcggtgtgggggtgggcgacacggtgcgcgcgttctggttcacgacgccgccggcgcccgggcacgacgtgccgctggcgtcctgaggcacgtacaacagcaaccacggccgctgcgcggaaggggaggcgctggccccagccaaaacaaaaaagaaggccgcggcggcggtccagctggctgcctacctctccagcccccctcccgcctactcgtcggcgccgggtggccgcctcgcccgcggcgaggcgatctgctcccgggtgaccagggcgggggcgcgggagagcgggcggggcgccgacgcccggcgcgcccgcccggtcgccggagcggcggaggccggcccgcgcgcgggcgggggcccccacggcttcccgccccctccggggtagccgtggccccgggccgcgcgccgccgcgccggccggctaggcgcgcacgcggggcccgggggggggggggcggcgcggcggccgcgcgaccggccccttcccctcccgccgggcgcccgggcccgtcggcgaccgcccgcccgccgagggggccaggcgcgccacccgatactgcccggccgggagcgggctgcgccgccgctccagccccctgcgcgcccaggccgggcccccggaccctggccgcccgggggggcgcgccgacggcgcggacctgcgcctccccgaccacgcccaccccccgccctgcctccacccccacacccgcccccaccccctcctccgcctcaccttccactcccacatgccccgcccccactaccgcgacaccatccacttcgccacaccccgcacgccgggcccccgtgcaccccgcccgcgccgtcgtgggtgacggcgagcgagctgggcaacagcaccgtcaagttcggggagaagccggacccgg

SEQ ID NO: 14886 - DNA, 348 bp, Sorghum bicolor
  unsure (1)..(348): unsure at all n locations
  Clone ID: LIB3478-030-P1-K1-A12
cccacgcgtccgcactgcacggcgtacgtgtggttgccaccaccatgcacacggtggctatccagcggcggcgccatggcgccgtcacgctgctgctggtcgccgccgccgtagtgctcctctcggcggcggcccagacagcggcggcgcaccgcccgcgcggctgcggggtgacgagcaagtacgtgcggaagcaccaggcgtcggaggacatgccgctggacgcggacgtgttcgcggtgccgccgggccggaacgcgccgcagcaggtgcacatcgggctggcggaccagacgggcacctncatgttcgtgtcctgggtcaccgtggaggccgagggcaacagca

SEQ ID NO: 14887 - DNA, 344 bp, Sorghum bicolor
  Clone ID: LIB3478-024-P1-K1-A9
cgccgacacatgtggttgcggtaccatgcgtagtaggcgtgcgtgcggttcttgatgtccagcacggcgtgtccgaagctgtgactcccggaacgccgagtatgccggctgcggccaggtgagctcatcggcgaccttggccagacggccgactccaacagcacgctggcgcactacgagtcccaccagggcgacgccgtgctgttcgtcggcgacctgtcgtacgccgacaagcacccgctgcacgacaacaaccggtgggacacgtggggccgcttcgccgagcgcaacgtcgcgtaccagccgtgggtgtggacgaccgtcaaccacgaggtggactatgc

SEQ ID NO: 14888 - DNA, 439 bp, Sorghum bicolor
  Clone ID: LIB3478-031-P1-K1-A12
cgacgccgtggaaggcgagccagtcgtcggagccgtactggtactcggtgaagctagggccggcgcacatcatcgtgctgtcgtcctactcggcgttcggcaagtacacgccgcagtacaagtgggtggaggcggagctgaagcgcgtcgacagggaggtgacgccatggctcttcatcagcacgcacgtgccgtggtacaacagcaacaacttccactacatggagggcgagccgatgagggcgcagttggagaagatggccgtcgacgcacgcgtcgacgccgtcttcgccggccacgtccacgcctacgagcgcacccacaggtactccaacatcaagtacaacgtcaccgacggcaagtgcacgcccatcgtcgaccggcgtgcgcccgtctacgttgttattggcgacggcggctacgtggaggggctcggcta

SEQ ID NO: 14889 - DNA, 1689 bp, Sorghum bicolor
  Clone ID: SORBI-28MAY03-CLUS5668_1
gccggccgggggccgggaaaaaaggtgggccatccggggtttggtcgagcccaacaactaaaacccccgccgcaccaatcaaccacttcatctcgcccaccacaccacaccacacgaactcgagccctcgccccgcccaaacacaagcctcagatctcagtcacctccgccgccgcttcgttcgtgtgcaggggagaagagaggaaatggcggcgaccgagggcgtgctcctggggatgggcaaccccctcctcgacatctccgccgtcgtcgacgacgccttcctggcaaagtatgacatcaagctgaacaatgccattctcgctgaggagaagcacttgcctatgtatgatgagttggctagcaagagcaatgttgaatatattgctggaggagccacccaaaactctatcagggttgcccaatggatgcttcaaactcctggtgcaacaagttacatgggatgcattggaaaggacaagtttggtgaggagatgaagaaaaatgctcaagctgcaggagttactgctcattactacgaggatgagactgctcctactggcacatgtgctgtatgtgttgttggtggtgaaaggtcattgattgcaaatctgtcggcggcaaactgttacaaatctgagcatctaaagaaaccagagaactgggcactagttgagaaggcaaaatacatctacattgctggatttttccttacggtgtcgcctgattctatccagctagttgctgagcatgctgcagcaaataacaaggtgttcctgatgaacctctctgctcccttcatctgtgagtttttccgtgatgcccaagagaaggtcctcccatatgctgactacatcttcggcaatgaaactgaggcaaagatcttcgccaaagtccgaggatgggagactgagaatattgaggagattgctttgaagatctctcaacttcctttggcttctggcaagcaaaagaggattgctgtgattactcaaggtgccgacccagtggttgttgctgaggacgggaaggtgaaaacattccctgtgatcctattgcccaaggagaagcttgttgacaccaatggcgcaggtgatgctttcgttggaggcttcctctcacagttggctcagggcaagagcattgaagattccgtgagggctggttgctatgccgcgaatgttatcatccagcgcccaggctgtacttacccggagaagcctgacttcaactagtgcgaaaactgaggcacgttatgagaggtggactgttataggcacacttattcttaaccactgcgtggttcggtgtgtacacaccctgtattctcccgaggcttttcttccgatccggccaatatttttgccgtgatatttgtcctgcaactatgaacgtcgtctttgacgctgtataaggcatgttttgccaccatagtctgttgcttcgctgatgcttgcaatgctcttgatcgcattttgcttttgtttctatcatatcaggctagcaaggacgcaccagccttggcctaagtagaagatctttgggtttctagcaggctaacaaggtaacaccagccttgcctaagtagaaggcccatctttgaatacgacttgcttggctgtttccctatgaattgttgtgttgcagtcatcgaacaatccatttaccaaacttagtgttttttttttc

SEQ ID NO: 14890 - DNA, 1118 bp, Sorghum bicolor
  Clone ID: SORBI-28MAY03-CLUS7103_1
gcccggcggcgtgggcggaaggtcgagagactccaggcgccctctaactactttctccccagtccatttcgaactctctagacgcctcctcggtcctctctgttcgccgccgccgacccgtcctccctcctcccccctctccacgccgcagaaatggcgctgccgaatcagcaggtcgtggattaccccagcttcaagctcgtcatcgttggcgacggtggaactggtaaaaccacatttgtgaaaaggcatcttactggcgagttcgagaagaaatatgagcccactattggtgtggaagttcaccctctggattttagcactaactgtggcaaaatccgcttctattgctgggacactgctgggcaagaaaagttcggtggcctcagggatggctactacattcatggtcagtgtgccatcattatgtttgatgttacttcgaggctgacatacaagaatgttccaacatggcacagggacctgtgcagggtgtgcgagaacattcccattgttctctgtggtaacaaggttgatgtaaagaacaggcaagtcaaagccaagcaagttacattccacaggaagaagaacttgcagtactatgagatttctgcaaagagcaattacaactttgagaagcccttcctttacctcgcaaggaaactggcaggggatcagaaccttcactttgtcgaagctgttgctctgaagccaccggaagtgcagattgatatggccatgcagcagcagcacgaagctgagcttgcagctgctgctgcgcaacccctccctgatgacgatgatgacctgatcgaatagatgttctcaatggccttgttgatgtgagaggggactttttataagaattcatggtggctcaaacctttttagagttaggctttactctcttgatgtatccatgttgagaatgaaacatatgtatcctgttattgacgagggtttttggtgaaccagatcgttgaggtaatacagcatacgtttcagcgcttgattgtgcctgtctgttttacccttaaaattggtattctcgattgattgaagtggggtttgtagtatgggaggaatttgcaggccatgttggcgcggttgaatattcc

SEQ ID NO: 14891 - DNA, 1457 bp, Sorghum bicolor
  Clone ID: SORBI-28MAY03-CLUS6532_1
tcccgactggatcgcagatagaacaggggacacacagagtgttctcctagcacgcagcagatcgggtgcgtggcgcagtcgcaatggcaatggcaatggccacggccaagctcgtcctcctgatggtcctcgtggccggcagctcctgcggcggcagcgcctggcgggggccactgagcctcctccggacgctgccgacgacgacggcggcgcagtccgtcgaggccgccgcggagcgcctgaaggaagacctgtcgtcggcggcgtcgtcggcgtcggcgtcgtcgtcgctgatccacgcgctgcggcccctgatgggttccgcgggggacctgggcctgcgcgccggcgtgccgtgcgacagctggcggctggccgtggaggcgtacaacaagcgcgactggacgacggtgccgggcagctgcgagggctacgtcggccactacatgctcggcgggcactaccgccgggactcccgcgtcgtcgtcgacgaggctatcgcgtacgccgaggggctcaagctcgccggcaacggcaaggaggtgtgggtgttcgatatcgacgagacgtccctctccaacctcccctactatgccacccatggcttcggcactaagccgtacaacgccacgagcttcaacgagtacgtgctggaggggagcgcgccggtgctgccggagtcgcagcggctcttcaagaagctcatctcgctcggcatcaagccggtgttcctgacggggcgcaccgaggaccagagggccatcaccgtcaccaacctccgccgccagggctactccggctggatggacctgctgctcaagcccgtcgggctcaaggccaccgccatcgcctacaagtccggcgagcggcagaagctgcaggacgccgggtacgtcatcgtcggcaacatcggcgaccagtggagcgacatcctgggcgcgccggagggtgctcgcaccttcaagctgcctgaccccctctactacattggctaattgagcgatgatgccacgttggcctccgtataattgttaatccatcgcagcggctctccatcagcccatcatcgatcgatccgtcgcccggttgcaatgcctgtgctgtttgtgatgaactgctctttgttgtttgttatatccttcccttcttattttacgaccgctgcatgttatcattaattcctaaaggttaatttcctgagctgagtggaaataaaagctgactatgtggagagctgtcgatttgtcaataaaggttatgacagctgcattttatttttcgtagcctgggatggtatttgtatttagtagatatgatggttgcgtaatttaacacgtatgttatacgtgtttcctgggaaaaaaaaaaaaaaaaaaaaataaaaaaaaaaaaaaaaaaaaaaaaaaaaaaatattaaaaaaaaaaataaaataaaaaaaaaaaaaaatattttataa

SEQ ID NO: 14892 - DNA, 895 bp, Sorghum bicolor
  Clone ID: SORBI-28MAY03-CLUS66910_1
ctgtccgcctgcgcgatgttccccagacgcagcagcacggcagtcctacgtttgtttcctcctcgcagcaccggttccgttctctcctcctcgatttccctccgtcgcgagatcgcctgatctctctagcgcacggcggccggagaagaggacgggcacgatctcattcatcggatcggcgtgcctgtgttgtctgttgatttgattttttttttcttccttacttttttttggttcattcatcaatcaataataagatttctgatttggggcgtggttcggcatgggattcggaatggggaataataacggggcgagctcctcgtcgtcgcggctggacccggcgccgctgctgccgcaccacggcagcgggagccgcgaggtcggcctgtcgtcgcagcccaagacgttcgccaacgtcttcatcgcggtggtgggcgccggcgtgctgggactgccgtacaccttctcgcacaccgggtgggcggcggggacgctgctgctcttctccgtcgccgcggtcaccttctactgcatgatgctgctcgtcgcgtgccgccgccgcctcgccgacgagcaccctaagatcgcctcgttcggggacctcggggacgccgtgttcggcgcgcacggccggttcgccgtcgacgtcatgctggtgctcagccaagtcagcttctgcgtcggctacctcatcttcatctctaacaccatggcgcacctctacccgattaccgcgccgtcctcctcggccctcctctcccccaaggcgctcgtcatctgggcgatgctgccgttccagctcgggctcaattccatcaagacgctcacgctgctcgcgccactcagcatcttcgccgacgtcgtcgacctcggcgccatgggcgtggtgctt

SEQ ID NO: 14893 - DNA, 1785 bp, Sorghum bicolor
  Clone ID: SORBI-28MAY03-CLUS11565_1
gcacgagggcccagtccaagagagcaggcccagctgagccctctagctcctgcctctccacacacccacagctgctgctgtcgcaggtcgatctcatcctccgaggagccggatcgaagtacctagctagcggccgatccatcgatcaacgtgcttgccgccactctggtacaacgtagagagaaagatccgatggagacgatggccggcgcgactgtgaccgtggaggaggtgcggaaggcgcagcgcgcggcgggcccggccaccgtgctgacgatcgcgacggcgaccccgggcaactgcgtgcaccaggccgactacccggactagaacttccggagcacaaagagcgagcacatgaccgaactctaggagaagttgaacagcatgtgggacaagtcgcagaggcgcaagcggtggacgcacctgacggaggggtagctcgcggacaaccccaacatctgggcgtacatggcgccggcgctggacgcccgccaggagatcgtggtggccgaggtgcgcaagctaggcgcgccggcggcgcagaaggcgatcacgcagtggaagcagccgaaatccaagatcactcacctcgtcttctccaccacctccggcgtcgacatgccctccgccgactaccagctaccacaggatccgccgtctgcgcctcacgtgctccagacacagtagggaggacaagggttgttctagggtcggcacgatgctgagtattgcttttgacagtgccaagggggacggagagtttcgccaccctcaaatttgtattaagtgcatttcggttgagaaccctagcccctcctagacccttctcgtacgccatggttggccaagcgctgttcggcgacggtgctgcggcggttattgtgggagctgaccctgacgagcgcgtggagcgcccgctgttccagctcgtgtcggcgtcgcagacaatcctgccggactccgagggcgccatcgacggccacctccgtgaggtcgggctcacgttccacctgctcaaggacgtgcccgggctcatctccaaaaacatagagcgctcgctggaggaggcgttcaagccgctggggatcaccgactacaactccatcttctgggtggcgcaccctggcgggccagcaatcctggaccaggtggaggccaaggtcgggctagagaaggagcggatgcgtgccacgcgccatgtcctgtccgagtacggcaacatgtctagtgcgtgcgtgctcttcatcctcgacgagatgcgcaaacgctccgccgaggacggccaggcaaccaccggcgaaggcttcgactggggcgtgctcttcggcttcggtcctgggctcaccgtcgagaccgtcgtgctccacagcgtccccatcaccaccggagcggccatcaccgcgtgagatgaagtaccacgccgcgcgcaccgcacctcgctcggtctccatgaatccctcctctccacaaccaccagtcgtcgatcgttcgtgattatttgcctcgtaacgcaaataatgtgctctgtattgtctgcataattgccgtgtatcgtagtagctgctattattttccatgtactgttgccagtcgcacaatgtgaacatgcatgtaagccctggtagtagaaccttaattttaagggcgagctagctcacggataaaagaccgttgttattaattgtcactagctactttagcatggatggtgaggtattgtatacctgtgtaagacaagcttggctggtttttaatattttaatttgtttattagtttgctca

SEQ ID NO: 14894 - DNA, 2122 bp, Sorghum bicolor
  Clone ID: SORBI-28MAY03-CLUS6149_1
ctactggaaaccagcacacgtcaaaagcgaaaaacctcagaaaaaccccaggaaaccgcattatattctcacccaccactgtcctccgatccgttgcaactccactcggccgccccctcgcacccacccaccttgatcctctggtccgttggtagcctgatcgatccatggacacccacgtcggatccgtgaacggatcggcggcggcgccggcgtcgaacgacacggtgggctgcccggcgtcggcgccggggtgcccgatggcgtccacgccggcgcagcccgcgtcgacgctgtcggcgggggaggcgtcgctggggcgccacctcgcgcggcgcctcgtgcaggtcggcgtcaacgacgtcttcgcggtccccggggacttcaacctcacgctgctcgaccacctgatcgccgagcccgggctgcgcctcgtcggctgctgcaacgagctcaacgccgggtacgccgccgacgggtacgcgcgcgcgcgcggcgtcggggcctgcgccgtcacgttcaccgtcgggggcctcagcgtgctcaacgccatcgcgggcgcctacagcgagaacctgcccgccacctgcaccgccgccgcgcccagctccaacgaatccggctccaagaccatccccagcagctccaccggcccctggccatggcactgagggagagcaagccggtgtacctcagcatcagctgcaacctccccgcgctgcctcaccctacctttagccgcgaccccgtgcccttcttcctcgcccccaggatgagcaacaagatggggctagaggctgcagtggaagcaactgtcgaattcctgaacaaggcggtgaagccagtgcttgttggcggccccaaactgcgtgtggcaaaggcaggaaaggcatttgtcgatctggtagatgccagtggctatgcctatgcagtgatgccatcggccaagggtcttgtgccagagacgcacccccacttcatcggcacctactggggcgccgtcagcactgccttctgtgctgagattgttgagtccgcagatgcctacctctttgcaggccccattttcaatgactacagctctgttggctactcattcctcctcaagaaggacaaggccatcatcgtccagcctgaacgtgtgataattggtaatgggccggcattcggatgtgtgatgatgaaggagtacttgtctgaattggctaagagggttaagaagaacaccactgcctatgagaactacaagaggatctttgtacctgaggggcagccgctggaaagccagccgaatgagccactgcgagtcaatgtgctcttcaagcacatccagaagatgttgaccggtgatagtgctgtgattgctgagactggtgactcctggttcaattgccagaagcttaagctgccagaaggctgtggatatgaattccaaatgcagtatggttcaattggatggtcagtgggtgcattgcttggctatgctcagggtgcaaaccaaaagcgtgtgattgcctgcattggtgatgggagcttccaggttacagcacaggatgtgtcaaccatgctgcgatgtgaacagaacagcataatcttcctgatcaacaatggtgggtacacaattgaggtggaaatccatgacggaccatacaacgtcatcaagaactggaactacactggctttgtggatgccatccacaatggagagggcaagtgctggacctccaaggtgaagtgcgaggaggagctgacggcagctattgagacggctctagcggagaagaaggactgcctgtgcttcatcgaggtgatcgcgcacaaggacgacaccagcaaagagctgctggaatggggttccagggtttctgctgccaactccaggccaccgaatcctcagtagagcagccttgcaagctccaagcctcagacgactggtgtcgggagtgatggtagcacgctggggctcaatcgaataacgtgaacgcattgcccgtttctgttacgttggttctttctctctctctcgtgtttctgtggtcctgtataaattttgttacgtgttccctgtttccccatgtgaatcgcacaagaattatgagaattttcaggttgctgatcgccc

SEQ ID NO: 14895 - DNA, 1950 bp, Sorghum bicolor
  Clone ID: SORBI-28MAY03-CLUS7763_1
cccccacgctcaccctgttgcccttgccttcgtagcctagacccacccccctcacaccccctcggtcctctttacccgtcacacgccacctcctccctacccagacccccgcgttaacttttagcccgtgcccgaggccatgatagtatgttgtaccgaacccttggtgacggtcgcgcagctcctccggtttgctgtttgtgtgtcctggatgggagttgggaattgtagctttttgaactttaaaagttttttttaatgagggggaaaaaatagtagatgcagttatgttgcttgtaaagatcagcgtgctgatatgatagaatagaaggttcctccctccctccccctcgctccaccaaaccaaaacccgcccggttctcagggtccactagagcactactgatccgctccacgcgagctcccctgtccccagctccccgcctccgcgtcgcgctcgcgcccaagcaagtgctagcaggctagcagcaaagcaagccttccctgatggctctggtgccctcaggctcgggtgccgaccaggtgatcgccgaggtggcgatgaacggcggcgccgacccgaacgcgaccaccgtgcgcgctaccgtcgtgcaggcgtccaccatcttccacgacacgcccgccactctcgataaagcagagagattgatagcagaggctgctgggtatggttcacagttagttgtctttccggaagcttttattggaggctatcctcgtggatccacatttggcttcgggatcagtattagtattattaatccaaaagacaagggaaaggaagcattccggaggtatcatgcagctgctatagatgtgcctggtccagaggttacacgattagctgctatggctggaaaatataaggttttcttggttatgggggtgattgaaagggaaggttataccctttattgttcagtgcttttctttgatcctcttggccgttacctgggtaagcaccgcaagctcatgccaacagcattagagagaattatatggggatttggggatggatcgactattcctgtttatgatactccacttggaaagattggggcgctcatttgctgggaaaataaaatgccacttttgaggacagcgctgtatggtaaaggtattgagatatactgtgcccccactgctgactccaggcctgtttggcaagcctccatgacacacattgctttggaggggggatgctttgtcttgtcagcaaaccaattctgccgcagaaaggactaccctcccccaccggagtatgagtttgctggtttaggtgaagagccatctgcagacactgttgtttgccctggaggcagcgttatcatttctccatctggagaagtcttagcaggtcccaactatgagggagaggcactgattacagccgaccttgacctgggagagattgttcgagccaagtttgatttcgacgtggtgggccactattctcgacctgaagtccttagcttggtagtgaatgaccagccacatctccctgtgtctttcacgtctgccggtgagaagactccagctgccaagagtgacagcgatgctaagtcttactgattgagtgtggccatgaaactatgttgtaccgaagccttggtgaaggtcgctcagctcctctggtttgctgtttgtgtgtcgtggatgggagttgggaattgtagcttttgaactctaaaagttctctttaatgaggcggaaaaaatagtagatgcagttatgttgcttgtaaagtcttgtattcggtgaataaaccctgccagaactatgaatcctattactatcgttgtagtttcgaatagtaccaaatgataatcgcccgttttgggctgcatatgtttattttgtcttgttttctaagaagaactatgaatcctgagttagctagaattggagaaccaaatctgaacatgatta

SEQ ID NO: 14896 - DNA, 1953 bp, Sorghum bicolor
  Clone ID: SORBI-28MAY03-CLUS72_1
cctgtgcacgaggcacacgccaacacttgccaagctctcgcgtcgctcagcgctagctcctagctagtatcttcttccaccgggcaccggccggccagccgtcgtcagctagctagctagccatggggtcgacggcggaggacgtggcggcggtggcggacgaggaggcgtgcatgtacgcgatgcagctggcgtcgtcgtcgatcctccccatgacgctgaagaacgcgctggagctgggcctgctggaggtgcttcagaaggacgccggcaaggcgctggcggcggaggaggtggtggcgcggctgcccgtggcgccgacgaaccccgccgcggcggacatggtggaccgcatgctccgcctcctcgcctcctacgacgtcgtgaagtgccagatggaggacaaggacggcaagtacgagcgtcggtactccgccgcacccacctgtaattggctcacccctttcatgcatggcgccatccaattctccgattaaaacatcattctctcctcggataacatacagaccaagaggaacctcaaagtcgtgttgctttacggcggcatcccgtcaagcaaggcgtacgggatgacggcgttagagtaccacggcacggacccgcgcttcaaccgcgtgttcaacgagggcatgaagaaccacagcgtgatcatcaccaagaagctcctcgagttctacacgggcttcgacgagtccgtctcgacgctcgtcgacgtgggcggcggcatcggcgccaccttacacgccatcacctcccaccactcccacatcaggggcgtcaacttcgacctcccccacgtgatctccgaggcgccgccgttccccggcgtgcagcacgtcggcggggacatgttcaagtcggtgccggccggcgacgccatcctcatgaagtggatcctccacgactggagcgacgcgcactgcgccacgctgctcaagaactgctacgacgcgctgccggagaagggcggcaaggtgatcgtcgtcgagtgcgtgctgccggtgaccaccgacgccgtccccaaggcgcagggcgtgttccatgtcgacatgatcatgctcgcgcataaccccggcggcagggagcggtacgagcgggagttccgtgacctcgccaaggccgctggcttctctgggttcaaggccacctacatctacgccaacgcctgggccatcgagttcatcaagtaaaaatgcagacagagtcctccgtacgtcgctcgctgcgatgagatggcacatgtcatggatggtcctcatcgccggccggctccatcgccgccgtcttcttcttctggttgctgctgctactgctgtcgcacatgcatctacttttgcttactttgctttcttcattcatcgatcctgcattataattaatggcctagcctgcctccgatgtccgatccatacatggtggccatatatatctttggttcgtcttgttgagctgttgcatgttcttggattctaaattgctgtcgaattgtctctgcgccatgtaccagtaataacaatcaaggttatacttactatatacaatgacatgcatgccggtttatttccctacaatcactcgttcacaagcaccctgaagaacaactttgcaaactgatcaaatgagcagagggtgccaagaagtttcgtccatctcttagcaggacaataagtttcttgtccaagaagccggcgagggaggtggagaggaggatgtcgtcgggcgcggaccaagacatcgcgcggatccccaatccggctccagaaaccggagctgatgcgccgcggctgggatcggagttgcttctacagcttgggaccaagctgcttagcggcccccccagggaaaaccactgctagggttcgcgtgggagtggagtgctctcgcgtgacggaagcagggaggagcagagttcggtgcttgcggacgcgtggg

SEQ ID NO: 14897 - DNA, 1329 bp, Sorghum bicolor
  Clone ID: SORBI-28MAY03-CLUS587_1
aacgccaacgccaacgccaacgccaacgccactccgccagtcagtcagccgagcggtgggcagagcggcacgcctctcgctcgactccgccccgctccgccgctccagatttcgcccacccaccacacgcccatggcgctcgccgcctcccaccacggcctcctgcccgtcgcccccgcccccaccgccacccttaccccgtcgcggggtcacctgcgcttccgcgccgcgcgacctctgcggcaccgacccgcccggagaatttgttgccaatctatcaactcagctaatgtgttgggagcttcttcaaagacatctgatgaggcagtcccagtcccagttgtccagatagatcaagattcagaccgtgatgcaaccattgtgcagctaagttttggagatcgtttgggggcactacttgacacgatgaaagcactcaaggaccttggccttgatgtcacaaaaggaagtgtgacaactgactcagctgtcacacaaacaaagttccacatcatgcgatctggacgcaaggttgaggaccctgacatgttagaaaggattcggctaaccatcatcaacaaccttctccagtatcatcctgaatcaagtgagaagttagcgatgggtgaattttttgggataaagcctcctgagaagaaggctgttgtcgatattgcaacacgtatagttattgaagatgatggaccaaaaagaagcatgctttacatagagacagccgatcggcctggcctacttcttgagataatcaagattattgcggacacaaatgttgatgtggaatcagctgagattgatactgaaggtttggttgcaaaggacaagttccatgtaagttacagaggtgcaaaactaaacagctccttatctcaggcgctgatcaattgtctgcgttattacctccgaaggcctgagacagatgaagacagttattgattgttgtgttgtcgaaccttcctagcagtacattaaaatcagaaacttcaaactttggcttgagttccttctctatgagccacttgtactattgcaagtggagtttccattgtagcatccatatatatgtacataggtggcattgaaatttggctcattaaaccattctgtagtcatatacagctgggagcaacagaattaggtttcaatcatcgttatcccatttgattcctgttataagggatcacattggaaggtcctcacatgattgatgttgtctgtaagttggtacaatccatttgcatgtaaaactcagctgtggactgtggtgttctctgatgaaataaataaaagagcattacaaaatccccgccc

SEQ ID NO: 14898 - DNA, 1946 bp, Sorghum bicolor
  Clone ID: SORBI-28MAY03-CLUS7361_1
gcacgaggggcacacgtgcccccctgacgcttaaaacacccgccgcggccgcgggcggcgtcggcgtcggcgtcggcgtcggcgtccgtcatcgcaaaactcttctcgcacgcgtcgccgcccgcaccgcacagatcaacaaccgctcgaaattttgggggaagcaagagagcagcagagcagcgcgcatcgcgaagcggagagatggaggcgccggctcgcctccccatctccctcctcgtcgtctccgccctcctcctcctcctctcggctcagggaccggcgggagcggcggcggcggccgtgccgccgcgaatccagccgctcgctaccgccgcgctgcgccgcctctacgacacctccaactacggcaggctgcagctcaacaacggcctcgcgctcactccgcagatggggtggaacagctggaatttcttcgcttgcaacatcaatgagacggtcatccgcgagacagctgacgcgctggtgtccacgggactggctgctctgggctacaacttcgtaaatattgatgattgctggtcatacgtgaaacgaggaaagcaggaccaattgctgcctgatccgaagactttcccttcaggcgtcaaagcccttgcagatgacgtgcggggaaaaggtctgaaacttggtatatactctgatgctgggaaatttacttgccaagttcgacctggatctctcgatcatgatagtgaagatgctgcggcctttgctccatggggggctgattaccggaagtaggacacctgtttggtctcctctacttgtcctcataaaagataacctcatatgcgagatgctcttgacgcaactggtcgcaaattcttctactatttgagtgtttggggccgggttgttccagccttatgggctgggaaagtgggccatagttggcgtacaactgatgacataacggatacatggcaaagcatgacagacattgctgataagaacaacaagtgggcgtcatatgctggacctggtggttggaatgacccagatatgttggaagtaggcaatggtggcatgacctcagcagagtatcgctcacattttagcatctgggctctcatgaaggcccctttattaattggctgtgatgtcagaaacatgacttctgaaacaatggaaatattgagcaacaaagaagtaattcaagtaaaccaagatcctcttggagttcaaggaagaaaaattttaggagaaggaaaatatggatgccgtgaggtgtgggctggtcccctgtctggaaatcggcttgttattgctctatggaaccgttgttctgagactgctaatattacaatgaaactgccagcggtaggccttgatggatcagctgcctattctgttagggatctgtggaagcatgaaacgctatcagaaaatgtggtaggaacttttggcgctcaagttgacgtgcatgacaccaagatgtacatcttttctcctgcaaccagtgtcgcttcaatttgatcggaactcgtgaatccaagatggcagcacgctatattcaaaggatatcacgacaaggaacttcatttttcctgctgcagtctgtcccactcaagtgcagaagcttacttcgtgcagaattgtctcattaatgtttgccatttctcacgaagtagttctctttatgtttcttcttttcatgtaagttgtactgccaatgaggtggctcatgtgttggctagactgagcgagctcgcatcttattcgcttgtacgatttgaaactgtctgaaccaatgagccaagtcaaggcgattccccaagtgggctcaaaaaaaaaactcgagactagttctctccttgctcacttgcattccaaagctagtacaagcaagtctcagacacccccagaacatcgacgacatggctcggcttgctgtggcgatcgccgtggtggcggcggcggcg

SEQ ID NO: 14899 - DNA, 457 bp, Sorghum bicolor
  unsure (1)..(457): unsure at all n locations
  Clone ID: LIB3476-032-P1-K1-H1
cgacaaacgcagagcgccatcgaatcgtctcgtctcgtctcgtcccctccctcccctcctcttcctcgcccaatcccagacaaatccaatccgaaatcatctcccccctcgcctcgcctcgccgaggaagagcagagagaagcgacgccgcgttccttcctcccgcgtcgagctcgatcttcccggagccaccgcgggaggcgcagacgttgggacagcctcgcgcgcgcgtnccacgccggtatgcagagccagatcgtgtgccatgcttgccggaccgttctactctacccgcgaggcgcgtccagcgtctgctgcgccgtttgccaggccatcaccaccgtgccgccaccaggactggagatggctcagcttatatgtggtgttgtcgaaccttgctgatgtatactcgcagtgcagacaccgtaaggtgttcatgttgcaacacagtcaatct

SEQ ID NO: 14900 - DNA, 247 bp, Sorghum bicolor
  Clone ID: LIB3478-050-P1-K1-F1
atccttggagatacaccatgaagtatttttattaggaccttgctgatgaaacaatggtcggacactgtgtattgattcttttgtgtgtataatatgggctctattagacttctgtaatcagatagttgagaggaattacagcatagtttcattatacgtgcgttgttacgcaatttatttgtttgttgaaaaaaaaaaatatttaaaaatattttaaaaatataatattaaatataaaaaatatttg

SEQ ID NO: 14901 - DNA, 1546 bp, Sorghum bicolor
  Clone ID: SORBI-28MAY03-CLUS8889_1
gcacgagggtcgcccccctccttcaacctccagatctggccactcccacacgcccagtctcctaaaccctacacatctcctctctcggccacggcaactgccatcgccatggccgggaggcgcccggcaccggcggccctcctcctcctcctcctagccgcatccttcgcccccatctcctccgccgtccgcccagtctccgacgcgcacagatccgctgccgcggagctcttcgccccctccgccgatggatccttcggcgatttggagagtacgtatgaggcggtgaggactttccagatactcgggttggagaactataagagtttgtctgggaaggcgtgcaagtttgctgcggagaacttggcttcccccggttccaccgcgaaagatctgttccacgcagtccggatcagtggcgcgctcgggtgcggtgttgatgccggcgtgtacgatggtgttgtggcaacgctcaaggcagtgattaaggataccaattccctgttggaattctattgttctgttgcaggtttgcgtaacatcaaggaacatggccatcatgttgttatgtctgattcggaacgtacatttcattccatgaaggcacttagcccaagtgacggaagttcgcgtcttgacactaacagtgcttaatctacctcttccgtgtcttggttggccctagaaccctatcctacctttgctccatggggacataacagaagtcggcataatttgacaatacaagcagagttctccatatcataaatttttgagatggtcattgcagatcattgtgtgacttttcgtttcaatgtgaccgaaccttatattttcgtaagctacatgcattttaagggttcactcgctttatttcagttgccttcgatgtatgctgattttagttaaagtagatccacactttcgtgtgttaaaataatgccccgccaacgtgtgttatgatgatgtgctgacaatttctgaatagaatggatgtttaatcatagaactcctctttcgttcccgtgcggcacgagggtctttgttcctttgatactgtcacttccttccaaagtattttcattgacttcgaaagatcagcttaaggttgaagttacaacagtttttggatctgcttcaccttcactcaaagtgaatcttgtgcaagtgttgggatctgactctaaagtcatcaccaatgagaacaaggaacttcaatatgaccttgacaacaatgtccattacttggacattgctccactgaaaatagatgttgggaaatactcaatagtttttgagatttcacttcaggaaccagagcatgagacagtttatgttactggagggagaaacaccgaaagtgtcattgtcacaggactgatcaaagtcaacaaggcagaaataggaatctctgacaatgatgctgggaccgtggagtctgtccaaaagttagatcttctgaaagatacaaaagtgtctctttctgcaaaccacctgcagaagctgcgtttatcctttcaactaaccacaccgctcgggcacacat

SEQ ID NO: 14902 - DNA, 443 bp, Sorghum bicolor
  Clone ID: LIB3480-043-P1-K1-E5
gcctcacttttccatgctggagtaggagcagtcctgctgctctacgttctcttctggctcaagttggagcttgtcacaactctgaagtaccttggcttcctcgtcatcttccttgtttttgtgggccataggaccctatcctacctttcctccgtgtcgacaaaacagaagacggcataattggacaatgcaaacagagttttcccgatcatcaatttttgaggtggccattgcaggccgttgagtgtcttttcgtggcactctgaccgcaccctagattttcattagctacatgcattttgagggaggactcggtttatttcagttgccttcgatgaatactgatactaggaaaagtaggacctcaccttcgtgtattatgatgatgcactgacaatttctgaatagaatggatgtttaatcatagaactcataatatgatc

SEQ ID NO: 14903 - DNA, 1613 bp, Sorghum bicolor
  unsure (1)..(1613): unsure at all n locations
  Clone ID: SORBI-28MAY03-CLUS7032_1
gccaggttgcgcgagcccgctacagaagcgaggagcacgacttcctcggattttcctcttgtgcgccagtgccacttcatagcgatctagtgctcctagccagttaagttgcagacacatggcgagcaacaccggcacggccaactgcaccaccgtgacccacccgcggccatcgaccgggaagctcatcacgattctcagcatcgatgccggcggcagccgcggcctcagcccggcgaccgtgatcacacaccccgaggccaagacgcagcaggtggccggcccagatgatctgaatgggcactacttcgccgtgctcggcgggactcgaaccggcgccctgcacgcgtcgatgctcgctgctcccgacgataacaaccgggcgcgacgataacaggcggccgctgtccccctccaaggcgcgaaccaccccaaaactttcccacagaaccagcctgtgtttctgacgaagggtagggtcgttgtgggcttggttcgacgtcccaggtacgacgacgtgttcctgcaacgcaggcgtgtgcctctaacccacgacgtcaagcctgcggaaacgggcaccgatagcatcctggcggcgttcgacgtcaagtacctgcagcccatcatcttctccacgtacgagcccctgccccacgcgctcaagaacgcgcacctctccgacatctgcatcagcacgtcggcggcgcccacctatttccccgcgcacttcttcaagacggaggccaccgacggcaggtcccgggagttccacctcgtcgacggcggcgtcgcggccaacaaccccaccatggtcgccatgtccatgctcaccaaggaggtgctccgccgcaaccccgacttcaacgccggcaggcccaccgagtacaccaactacctcatcatctctgttgggactgggtcggccaagcaggccgagaagtacaccgcgccgcagtgcgcgaaatggggactgattcagtggctctacaacggtggattcactccgatcatcgacatcttctcccatgccagttctgacatggttgacatccatgcggccgtgctctttgaggccctgcactgtgagaagaactaccttcggattcaggatgatactttgactggggacacatcgtcagtggacatcgcgaccaaggagaacatggagtctctgatcgggatcggccaggagctgctcaagaagccagtggcgagagtgaacatcgacactggggtgtacgagtcctgttccggtgagggcacaaatgcagaggcgctagcgcacttcgccaagaaactctctgacgagcgcaagctacgcaagagcaatctctgactcccactcgctatctctcagctacagcatggctggcgcttgccagcaaattcagccaagggatcggcagattgcattgatgggtggtcatgtacctagactagctagcaatgtgcctcagatagatgcatggtattggtagctagtcattaatcaagcaacatacatgtatatgcaccaataaagatgtaagttcaatcatttgtttgtctacgatctcaaaagaatcatctcgttttgatgcgcggttgtttagtctaataatnctgcgtgatgc

SEQ ID NO: 14904 - DNA, 850 bp, Sorghum bicolor
  Clone ID: SORBI-28MAY03-CLUS1112_2
gccggccgggccgggagaaggccggccgggcgtggactgtatagcctgtttgtttgtgggcgtggcgccttcttcattctccgcttccaccggagggagtgaagccagcagaatcaccaccgctgtgcctgctcgtcctgcttcaccgaatcgaatcagacctccgtccgaatccaagccaagctctttcatcaggaatggcaactggtagtgaagcctcgaagccagctgaggtgccagctgagactgtgcttgactggcataaacaggacaacaagaggatgctccacgcggtttaccgtgtcggggatctggaccgcacaatcaaatactacacggaatgctttgggatgaaactgctgaggaaaagggatattcctgaagagaagtacaccaacgccttccttggctttggaccagaggacaccaactttgcagttgaattgacttacaactatggcgttgacaagtatgacattggaacgggctttgggcattttgcaatcgctaatgaggatgtgtacaagttggctgagaatattaaatccaagggtggcaagatcacccgcgaacctggtcctgtcaagggaggatccactgttattgccttcgcacaggaccctgatggctacatgtttgagcttatccagagggctgagacacccgagcctctttgccaggtcatgcttcgtgttggtgaccttgagcgttctatcaagttttatgagaaggccctaggtttgaagctcctaaggaagaaggatgtacctgattacaagtataccattgccatgtttggctatgctgatgaggacaagacactgttctggagttgacatacaactatggg

SEQ ID NO: 14905 - DNA, 1859 bp, Sorghum bicolor
  Clone ID: SORBI-28MAY03-CLUS1112_1
gtcgtgacgatgatggcgctgctggcgcctaatccactgccgagcggcctccgcctcaagcgcaccaccgccgccgccgcaagatcccctaccgtccaccctctccccgacgagctccagctggtcgcggacatccgctccccttacaaccacatccgggtcgccgacgtctccccgcgggccacgggccacccgctcgccggcgctcgtctcctcctcctggacggcccgggcaacatccactccctctccttcccgcggcgcgccgaccagcccccgctcaccgccacctacctcgacgccttcgccacgctcccgcctctcctcccgcgcccgtcccttgcgggcctcggcttcggcgccggctccgccgcccgcgcgctgctccacttctacccggacctctccgtgcacggttggtagtgggacgcggcttccccggagggagtgaggccagcagaatcaccaccgctgtgcctgctcgtcctgcttcaccgaatcgaatcagacctccgtccgaatgcaagccaaggaatggcaactggtagcgccggagggagtgaagccagcagaatcaccaccgctgtgcctgctcgtcctgcttcaccgaatcgaatcagacctccgtccgaatccaagccaagctctttcatcaggaatggcaactggtagtgaagcctcgaagccagctgaggtgccagctgagactgtgcttgactggcataaacaggacaacaagaggatgctccacgcggtttaccgtgtcggggatctggaccgcacaatcaaatactacacggaatgctttgggatgaaactgctgaggaaaagggatattcctgaagagaagtacaccaacgccctagttggctttggataatagatcaccaactttgagatcacccgcactcctggtcctgtcaagggaggatccactgttattgccttcgcacaggaccctgatggctacatgtttgagcttatccagagggctgagacacccgagcctctttgccaggtcatgcttcgtgttggtgaccttgagcgttctatcaagttttatgagaaggccctaggtttgaagctcctaaggaagaaggatgtacctgattacaagtataccattgccatgttgggctatgctgatgaggacaagacaactgttctggagttgacatacaactatggggtcacagaatacagcaagggcaatgcatatgctcaggttgccattggcaccaacgatgtgtacaagagtgctgaggcggttgagctggcgaccaaagaactaggtggcaagattttgcggcagccagggccgctacctgggatcaacactaagatagcctcttttgttgatccagatggctggaaagtggttctggttgacaacaccgacttcctcagggaactccactgaagaccgggatacccagttgctgtcctaggatgtagtaatgcttgtctgtgaatgtaataagatgtgagtggtttgtttccgcctggatgaactgataataatggatgttgctacagaggttgtgcttctgccagtgaggtttgggatttgttatgtgactgtgcctgctactaaatgcaattgctccatgtagcaacatatcaaggggcttatttggcagggctaaggggtgctacaattctggcactgttcatacactgtaggagccagtgaagctcaaactgacgctacaggtgatgcaacctggaagcctgccaaagagggctccttctatgatgcctttttttttttttcttcgtgtcaccttatgcatccacattctataggagggccttgtttagttcattccaaaaaccaaaaacttttcaagatttccgtc

SEQ ID NO: 14906 - DNA, 790 bp, Sorghum bicolor
  Clone ID: LIB5049-010-R1-XP1-F3
gccggccgggccggagattctattctattctataaaggtcttgcacgatgatgtctggttgggctccggctgcctactatacgctcgtcctgctgctcctgcttgttctaggtgttgtcactgctcagagcagcaacggtggtgttggtcgtagccgcaggcaggaggagcaggcagtaagcgaggtgtcgtttgggaatcttgctcatgcatcatcccctatggagtccatcgctctttcatcaggaatggcaactggtagtgaagcctcgaagccagctgaggtgccagctgagactgtgcttgactggcataaacaggacaacaagaggatgctccacgcggtttaccgtgtcggggatctggaccgcacaatcaaatactacacggaatgctttgggatgaaactgctgaggaaaagggatattcctgaagagaagtacaccaacgccttccttggctttggaccagaggacaccaactttgcagttgaattgacttacaactatggcgttgacaagtatgacattggaacgggctttgggcattttgcaatcgctaatgaggatgtgtacaagttggctgagaatattaaatccaagggtggcaagatcacccgcgaacctggtcctgtcaagggaggatccactgttattgccttcgcacaggaccctgatggctacatgtttgagcttatccagagggctgagacacccgagcctctttgccaggtcatgcttcgtggtggtgaccttgagcgttctatcaggtttatgagaaagccctaggt

SEQ ID NO: 14907 - DNA, 917 bp, Sorghum bicolor
  Clone ID: SORBI-28MAY03-CLUS4451_1
ttcggcacgaggccgcgtgggcgccggccgggccgggattttcttccggcctcctcttcctcgcgcggcgacactcccccaccgatttgaagcgtgcggagcgagcgaagcagcggcgggacagatggctcgtaccaagcagactgctcgcaagtccacgggagggaaggctcccaggaagcagcttgcaaccaaggctgctcgtaagtcggcccccaccactggaggagtgaagaagcctcaccgctaccgccctggaactgttgccctccgtgagatccggaagtaccagaagagcactgagctgctgatcaggaagctgcccttccagaggcttgtcagggaaattgcacaggacttcaagactgatctgcgtttccagagccatgccgtgcttgccctccaggaggctgctgaggcataccttgttgggctgtttgaggacaccaacctgtgcgccatccatgctaagcgtgtgaccatcatgcccaaggacattcagctggcaaggaggatccgtggcgagagggcctaatccccccctcaaatcattgtgacaaaaatgaagtcttgtgtcgtagcaatgaatttaatctggtgccgttgtaaggacatatgagtagggtttgttttgtggatcataagtttctctactgccgcactatgtgttgctgctacctttgctggtgttattactagtgtcgaatgcttaaattgtctagtcatgtaatgcgctgacagtctgtgacgtgtatgcgatgtaggcactgactagtagtgttgtctgcgctgctggatcttgcgcctcattgctgtggctgatttgttcgttaatgtcaagaattgtgttacagtgagtgtaaaaaaaaaaaaaaaaaggcccctgtacgccgtaggccgaacctccggttcggtac

SEQ ID NO: 14908 - DNA, 1442 bp, Sorghum bicolor
  Clone ID: SORBI-28MAY03-CLUS13693_1
gccgcccgtcccggggcggtcccccctcgcactcgttctggccctgctcgcatctctccatcgccttgcgatcctcttccctgccgggaacttctacgacaccgcccgaggctccctcctcgcttctctccggaagagctctccggaatctaccgatcctcagccgcgccggggccctaggggccactcgccgtcggcccttcccgacccgacgccgccgctggttcccagctagcttgttccaccgaaagcaagcaggaaggagaggtacctcagctgagctgctaaggggtatggcgacggcggcggcacccgatgactccaccgtcagagagacgacgaaagcggaggaggtgctgcccccaaccctgggttctggttctcaaccaccaaacctcttcgatggcacaacaaggctctacatctcctacatatgcccatatgtgcagagagtttggatagctaggaacttcaaggggttacaagaaaagattcagctggttgccattgatttgcaagacaagcctgcttggttcctcgagaaagtttacccaccgggcaaggtccccgtcctggagcacaatggcaacatcatagcagagtccttggatctactcagctacctggacgccaactttgagggccccaaattgtttcctggtgatcaggaccctgcaaaacaagcttttgctgatgagttgattgccaacagcgattccatcatcatagccttgttcagggcaggccgtgcctatgccgaaggacaaggagatgatgatatcagtaagctacttgctcctgctcttgacaaggtggaggagtccctgggacgtttctctgatgggccattcctcctggggcagtccatgagcgcagtcgacatggtttatgcgccctttattgaacgcttcaaggatttcttcgctgcagtgaagcactacgatatgacacaagaaaggcctaaactcaaggagtggatagaggagctcaacaagatagatgcctacacagcgacctggggggatcgccgtctgcagcttgctgccttgatgaacaagtttgggatacaaagcccagtagcctgatctgatcttatcatccctaggggaggacatcttgtcaggcgtttcatgttgtatatgagttggaataagtctcaactgaataagatgtgtgtctgctataatgttacctatgttatggcccggccaggcctgtccgaagccagcccatgtccaggccacggccacattcgcattcgcattatccggcgccggtgacgagtttgaccgctgccgtatgtaagtgcaattgaataacctcgctgcaatctactaaacttgctactacgattctatactgcaaggatgtaatttaagaaacaggtgttctcatgtcgtattctatctctagacttttctcataaaaaaaaaaaaaaaaaa

SEQ ID NO: 14909 - DNA, 877 bp, Sorghum bicolor
  Clone ID: SORBI-28MAY03-CLUS471_2
gccggccgggtctggaagtgttgtggagcggaagctaacaggctcctctccgcacgctccaccttccctgcctcgccgccgccgtcgcacgcagccgcatccgccatgggtgcgtacaagtacgtatcggagctatggaggaggaagcagtccgacgtgatgcggttcgtgcagcgcgtgcgctgctgggagtacaggcagcagccggccatcgtccgcctcacaaggcccacccgccccgacaaggcccgccgcctcggctacaaggccaagcaggggtatgttgtttaccgtgtccgtgtcaggcgtggtggcaggaagaggcctgtgcctaagggtattgtctatggcaagcccaagcaccagggtatcacccagctcaagttccagaggaacaagagatctgttgctgaggagagagctggacgtaagcttggtggactcagggttctcaactcctactgggtgaatgaggatagcacctacaagtacttcgagatcatcctggttgatgttgcccacaccaccatccgtaatgacccaaggatcaactggttatgcaatcctgtgcacaagcaccgtgagctccgtggtctcacctctgcaggcaagaagttccgtggtctgcgtggcaagggccacactcaccacaagaacaggccgtcgaggagggccacctggaagcgcaaccagaccctctccctccgccgctaccgttgagcacatacatcttgatgctctgctactgtggaacccgccccatgcaggctctgatagtatttggtatttttgttgcattgttaaattttgctacatgtgttccgagctccttgaactctgttatcagtgtaccatggagcaagtgccgtgaactata

SEQ ID NO: 14910 - DNA, 1008 bp, Sorghum bicolor
  Clone ID: SORBI-28MAY03-CLUS471_1
aacacacccacacgccggccgggccgcggccttgtcgccgcgcactccatctccctccccgccgccgcctccgccgcacgcagccgcatccgccatgggggcgtacaagtacgtgtcggagctatggaggaggaagcagtcggacgtgatgcgtttcgtgcagcgcgtgcgctgctgggagtacaggcagcagccggccatcgtccgcctcaccaggcccacccgccccgacaaggcccgccgcctcggctacaaggccaagcagggttatgttgtctaccgtgtccgtgtgaggcgtggtggcaggaagaggcctgtgcctaagggtattgtctatggcaagcccaagcaccagggtatcacgcagctcaagttccagaggaacaagaggtccgttgctgaggagagagctggacgtaagcttggtggattgagggttcttaactcctactgggtgaatgaggatagtacctacaagtactttgagatcatccttgttgatgttgcccacacagccatcaaaaccgatccaaggatcaactggctatgcaaccctgtccacaagcaccgtgagcttcgtggcctcacctctgcaggcaagaagttccgtggcctgcgtggcaagggccacacccaccacaagaacaggccctccaggagagccacctggaagcgcaaccagaccctctcccttcgccgctaccgctgagcagcttgtcgggtgcttggatactgtcaccgtcaaacttgtcccaagcaaaacaaaaactttggctgtgtttggttgcattttcaaattttgctacttgtgttatcggcccttgctctaatgacagaagtcaattatggagcatatgtcatgaactatttccaattcgggggttattatctgtccaaaatcgatgaaaatgatggtttatgaatgctgggctgggctttcggtcgcgcggtttgcctttagtgttgcggccaacggttgattatttcctgtgttgatggtgcttctcg

SEQ ID NO: 14911 - DNA, 1598 bp, Sorghum bicolor
  Clone ID: SORBI-28MAY03-CLUS1411_1
gctcccgccctcgtgccgcagcgcgcgcggggccaccctcctcttctccctcccctgactggagagagagaacctgaaccttcccgagaggatagataggggggacggaaggcacccgcatcgaggaaaccaaaagagaggcaatctctagaaccctctcttccacctccctctctccctcccgcgccgatccattccattccattccatcactcaatcccccccacccagcccaaacaatggcgtcggacgggagcggcgtggtgacggtgtacgggaacaacggcgcagcccttctggaaccctcaaagcagcccaagtcggcgactttctccgtcaaggtcggcctcgcgcagatgctccgtggcggggtcatcatggacgtcgtcaccccggaacaagcccgcatcgcggaggaagccggcgcctgcgccgtcatggcgctggagcgcgtccccgccgacatccgctcgcagggcggcgtggcgcggatgtccgacccgggcctcatccgcgacatcaagcgcgccgtcaccatccccgtcatggccaaagcgcgcatcggccacttcgtcgaggcgcagatcctcgaggccgtcggcgtcgactacgtcgacgagagcgaggtcctcacacccgccgacgacgcgcaccacatcaacaagcacaacttccgtgtccccttcgtctgtggctgccgtgaccttggtgaggcgctccggagggtccgtgagggcgccgccatgatccgcaccaagggggaggccgggaccggcaacatcgtcgaggccgtcaggcatgtgcggtccgtcatgggcgatgtccgtgcgctccggaacatggatgatgatgaggtgttcgcgtatgctaagcgcatcgccgcgccgtatgatttggtgatgcagaccaagcagctgggccgcctccctgttgtgcagttcgcggccgggggtgtggccacgcctgctgatgccgcgctcatgatgcagcttgggtgcgacggcgtcttcgtcggctcgggaatcttcaagagtggcgaccctgctcgccgcgcgcgtgccatcgttcaggctgtcacccactacagcgaccctaccatcctcgccgacgtcagcgccggactcggggaggccatggtcggcatcaacctcaacgaccctaaggtcgagcgatacgccgccagatccgagtgaacaaccctatccgctccaccatcgtcatcttctctcatatatttgtatcacccatccatccatctgccttcgatatgcatctccactccgccggcttcatccttctcttcttaataatttttgcattacaaacagtagcttattttgtctcatgtctctccatcagtaataacgggactgaatcaatggtaagaaacaaagctatggtactatgcagaacctctttatttttgtgtcttcttattagctactgtattaagttagactaggctcccctggtttatcatgtactcaatcaaatgttgaacggtttgtatgtctgtcgctctgccagccctgcttatggcttatgaatgatgaatcaatgaatgaatcacatgtctttcaaaaaaaaaaaaaaaaaaa

SEQ ID NO: 14912 - DNA, 2742 bp, Sorghum bicolor
  Clone ID: SORBI-28MAY03-CLUS11141_1
gcacgaggccgtcttccaccttgcgcttctcgcccacggcccacctacctttatatttttcattcaagcagccaaatcgagcgaggcgacgaggacgagtagtagtagtagttgaggagttggagcaggcctgggcgcccgaggtctttccccgccggcggcatctcagagcttttggtctcgaccccgacagaggtcgccatggacgcagcggcggaggtggaccaccacgcggccgagagggccgccgtgcgcttcgacgtcgaggcgatgaaggttgcgtgggctggctcgcggcacgccgtcgaagtcggcgaccgcatggcccgactcgtcgcgtccgaccctgtcttccgcaaggataacaggaccatgctctctaggaaggacttgtttaaggacactctaagaaaggcagcccatgcatggaagcgtattgtcgaactacgtcttacagaggaggaagcaggtatgctgaggctatacgtagatcagcctggttatgttgatctgcattggggcatgtttgttcctgctataaaaggtcaaggtactgaggagcagcagaagaagtggttacctatggcttacaagttccaaataattgggtgctatgctcagactgaacttggtcacggctcaaacgttcagggccttgaaacaactgctacatttgatccaaagactgatgagtttgtcattcacagtccaactctgacctccagcaaatggtggcctggtggcttggggaaagcttccactcatgcagtggtgtatgctcggctgataactgaaggaaaggactatggtatacatggttttattgtgcaactgcgaagcttagaggatcactccccgcttcctggtgttaccctgggtgatattggtggaaaatttggtagcggtgcatataacagtatggacaatggtgttctgcgatttgaccatgtgcgcataccaagggatcaaatgttgatgaggctttcacaagttactagggaggggaaatatgttaattcagatgtcccaaagcagctgctttatgggactatggtttttgttcgtcagacaatagtcgcagatgcttctaaggctttgtcccgtgctgtttgcattgctgtacgatacagcgccatccgaaagcagtttggctctcaagatggtggccctgagactaaggtccttgattacaagactcaacaaagcagactctttccattgctggcttcagcatatgcatttagattcgtgggtgactggctcaagtggctatacatggatgtcactcagaaactggaagctaaagactactcaacactgcaagaaacccatgcctgtactgctggtttgaaggctgtgacaacatctgcaacagctgatgccattgaagaatgcagaaagctctgtggtggacatggttacttgaacagcagtgggcttcctgaattgtttgctgtctatgttcctgcttgcacttatgaaggagacaatattgttctgcttctgcaggttgcaaggattctaatgaagactgtatctcaattggcatctggaaaacaacctgttggtacaatggcttacatgggcaatgtacaatatctgatgcaatgcaaatgtgctgttaacacagccgaagattggcttaaccctgttgccatacaagaggcatttgaagccagggctctcaggatggcagtaaactgtgcccagaacataggccaagcagcaagccaagaagaaggtttctctgagcggtccccagatttgctagaggctgcagtagctcacatccagttgatcattgtaaccaagttcattgcaaaggtacagcaggacattcctggacatggagtgaaggaacagctccagaacctttgcaatgtttatgccctctacattcttcacaagcacctgggcgacttcctggcaactgggtgcatcacaccgaagcagggagcgttggcaaatgagcaacttggcaagctttacgcacaggtgcgtccaaatgctgttgctctggtggatgcgttcaactacacagaccactacctggggtcggtgctggggcggtatgacgggaatgtgtacccggcactgtatgaggaggcgtggaaggaccctttgaatgagacggtggtgcctgaggggtaccatgagtacctccggcccttgctcaagcagcagctcaagctctccaggctctgatctgtttggctacaccctgcaattctccatggcggttgcccttctcagagaatttgatacggtgaccccccattctgaatgaaagaatgaaataaactactaacgattcctgttaaagccaaggaagaggtggataaatataaatgtattctgtggtgaggatcatataagaagcacgttcaattaataaagaaagagcgagaggttgagcatctctctgctgttgctcaaatgttgtacgtagtgcaagcagtagaatgaatatgtacaagtgcatgtatggtgagttgaagtttcatttattagctaaaaatgtatcaggaaccaatggcttgatttgcctcatgcccaaaatgaaagccagattccaaacacataaaactaaaggaatttgtgcccgaaaattgaaaagaatgtttttcgtacaagatcacgaattgtggcggatgtagtgtgattgtaggatacattaaactgtagaccaaattggttttccctgtatgactgtagctgtgcttgtacaagcaagatccggtg

SEQ ID NO: 14913 - DNA, 959 bp, Sorghum bicolor
  Clone ID: SORBI-28MAY03-CLUS710_1
tgtgcggcgctcgggccggccgggccgggctcgctccgtcgctcgcctcgggccaaaccctagcagggagttgagtgaacggttgcagccatgagtaagttgcagtccgaggttctcaaggatgccatctctcagattgttggggatgccaaggagaagaataggaagttcaccgagactgttgagcttcagattggtctgaagaattatgatccacagaaggacaagcgtttcagtggctctgttaagttgccccacatccctcgtccaaagatgaaggtgtgcatgcttggtgatgcccagcacgttgaggaggctgagaagatgggacttgactacatggatgttgagtccctcaagaaaatgaacaagaacaagaagcttgttaagaagcttgccaagaagtaccatgcgtttttggcatcagaggccatcatcaagcagattccccgtctccttggtcctggtcttaacaaggcaggcaagttccctacgcttgttactcaccaggagtccctggaatccaaggtgaatgagacgaaggctactgtcaagtttcagctgaagaaggtcctctgcatgggtgtcgccgtcggtaacttgtccatggaggagaagcagatccagcagaacatccaaatgagtgtgaacttccttgtgtccctcctgaagaagaactggcagaatgtgagatgcctttacgtcaagagcaccatggggaaaccatacagggtgttctaagcctgctcgatctttgtgaagtctgctgtttatgaattatgatgctaggattttgaaccgaggttgtcttgaactaaaactcttgttagagtatgtttggttggcaggatattggagtggtactaaagcctttgtattctctctctatatatattgcttgaggctcaatataacatgcgtcttataactcatttcttttctaatttcatggtagcatg

SEQ ID NO: 14914 - DNA, 715 bp, Sorghum bicolor
  Clone ID: SORBI-28MAY03-CLUS118_1
tgttggccggggcacggaaaaaacaggcagcaaatcacgcctgaaacacccaccacacacaccactctgcacacacagaccgacgacgacgacggcacaggcgccatacgaaatggcctcccagctctccgccgccgtgccgcagttccacggcctccggggctacgcctcgcccaggtccgtggtggcgatgccgtccgtgcgggtcggcaggaagaggtcccagggcatccgctgcgactacatcggctccgccaccaacctgatcatggtgacgacgacgacgctgatgctgttcgcggggcggttcgggctggcgccgtcggcgaaccggaaggcgacggcggggctgaagctggaggcgcgcgactccgggctgcagacgggcgaccccgccgggttcaccctcgccgacacgctggcatgcggcgccgtcggccacatcctcggcgtcggcatcgtgctcgggctcaagaacaccggcgccctcgaccagatcatcggctagacgatccctacggttgttcttaagctctgatgaagctcacaatcctcgatcgcgccgccgccgccggtgcatatgcctatgtaacgtgcgtgcgtgtgtgtttgtgcgcgcatgccatgcgtacgtctcgttccaatggacatagctcttgttgctcctaaaaaaaaaaaaaaaggcccctacctcccaggcgtaggtctcgtcccc

SEQ ID NO: 14915 - DNA, 622 bp, Sorghum bicolor
  Clone ID: LIB5052-010-A1-XP1-B1
gccggccgggttgcggaaaccccaccaccacaccactctgtacacacagaccgacgacgacgacggcacaggcgccatacgaaatggcctcccagctctccgccgccgtgccgcagttccacggcctccggggctacgcctcgcccaggtccgtggtggcgatgccgtccgtgcgggtcggcaggaagaggtcccagggcatccgctgcgactacatcggctccgccaccaacctgatcatggtgacgacgacgacgctgatgctgttcgcggggcggttcgggctggcgccgtcggcgaaccggaaggcgacggcggggctgaagctggaggcgcgcgactccgggctgcagacgggcgaccccgccgggttcaccctcgccgacacgctggcatgcggcgccgtcggccacatcctcggcgtcggcatcgtgctcgggctcaagaacaccggcgccctcgaccagatcatcggctagacgatccctacggttgttcttaagctctgatgaagctcacaatcctcgatcgcgccgccgccgccggtgcatatgccatgcgtacgtctcgttccaatggacatagctcttgttgctcaaaaaaaaaaaaaaaaaggccccta

SEQ ID NO: 14916 - DNA, 406 bp, Sorghum bicolor
  unsure (1)..(406): unsure at all n locations
  Clone ID: LIB3481-003-Q6-K1-H11
cgtccgacacccaccacacacaccactctncaacgacanaccgacgacgacgacggcacaggcgccatacgaaatggcctcccagctctccgccgccgtgccgcagttccacggcctccggggctacgcctcgcccaggtccgtggtggcgatgccgtccgtgcgggtcggcaggaagaggggccgttggtccgctgcgactacatcggctccgccaccaacctggtatgtatatatatatatatatgtgtcaaatatatataacagttagaaccgtagtcggacacgacgactcgacgagtagtgaagctcgatgacgaccggccgatcactggtgggtggtatatgcagatcatggggacgacnacnacccttgtgctgtttggggggggggtcgggctggcgc

SEQ ID NO: 14917 - DNA, 2636 bp, Sorghum bicolor
  Clone ID: SORBI-28MAY03-CLUS78_1
gtgtgagcgaggcccacccggcccccgtttcccctccccccgcccgctcctacaacccccgccctgtgcctcccgcaccccctgcccctgctctggaagacccaagagagagagagagagaggcacccggcagccattactcgtcctcactcccacaccaacaacctccatccagtgcctgccgcagccgcttctgctgcagcggggacgcgtgcaagtacaggaggatatccgcttccattactgcgctgcgccgcggcggaaacagcagcagcagaggggttcttcgattcggggggttcggccggcgggcgcaataaattttgcccgggatggctcggagggccgcgtcctcgctcgtctcccgctgcctcttggccagggcctctgcccccgccgcgccacccgctgtcccctctgcgctgcgcaggccagatgggatgcgcggactgttgccaggcgtccttcagaggttcagcactgcagcagcagtagaggagcccatcacgccctcagtccaagtgaactatacaaagctcctcattaatggcaactttgttgatgctgcatccggcaagaccttcccaactctggaccctcgtacaggggaggtgattgctcatgtggctgagggtgatgcagaggacattaaccgtgcagtagctgctgcccgcaaggcttttgatgaagggccatggccgaagatgactgcctatgagaggtcccgtatcctactgcggtttgctgatttgattgagaagcacaatgatgagcttgctgctttggagacgtgggacaacggaaagccatatgagcaagcagcccatattgaagtaccaatggtggcccgtcttatgcgttactatgctggttgggctgataagatccatgggctcgttgtgccagctgatggcccacaccatgtacagatcttgcatgagccaatcggtgttgcaggtcagatcatcccatggaacttccctcttctgatgtttgcctggaaagttggccctgctttggcatgtggaaacactctcgtgctcaagactgctgagcaaactcctctatcggctttgtatatctccaagctgttgcatgaggctggactacctgagggtgttgtgaatgtcgtttctggttttggccctactgctggtgctgctcttgctagtcacatggatgttgataagcttgcatttacgggatctaccgataccggcaaagttgttcttgagttggctgcaaggagcaaccttaagacagtgacactggagttaggaggcaagtctccttttatcatcatggatgatgctgacattgaccatgctgttgagcttgcgcactttgccctgttctttaaccaggggcaatgctgttgtgctggatctcgcacatttgtacatgagcgtgtttatgatgagtttgtggagaaagccaaggctcgtgcattgaagcgcgtcgttggtgatccattcaggaaaggtgttgaacagggcccgcagattgacgacgagcaattcaacaagatcttgcgctacattaggtctggtgttgacagtggagctaaccttgtgacgggtggtgataggttgggtgagaaaggttactacatccagccaacgattttctcagatgtccaggatggcatgaagattgctcaggaggagatatttgggcctgttcagtcaatcctcaagttcaaggatctcaatgaggttattaagagggcaaatgcgagcccatatggattggccgctggtgtgttcaccaatagcttggacacagccaacaccctgacgcgtgcgctcagggctgggaccgtctggattaactgcttcgacatcttcgatgctgcaattccctttggtgggtacaagatgagcggcattgggagggagaagggcattgacagcctgaagaactacctgcaagtgaaggcagtcgtcacccctatcaagaacgccgcgtggttgtagatgctgcaagtatggccttctggataagaactacggatattcatttcctcatcacatcccgcacaataatatgaaggcgataatcagttagatgacgatgaagaacgaacagctataataagatttgccctttggttgtcagttatatctctaataagccttttggttggtgccatattgtgcaatttggctgcaccctttttcttttggataagactatattgtagcaacggattttgcagagttcattatgaaaaaacatttgttagaagagcagcactgcagcagtcacccaattgctctcatgtccccaattgtcatattggggttaaagttgttgcaaataagggtttgtttggttggtgccatagtttgccatatataactttttttgtaaatcatggccgctactatagaaagtgtgaatgaattcatgacacgtgggatagggtggtaagaaagtatgatagtcatagctgtgtcggtgaattaaataggtgtcgaaaaaaattgtggcatgactaacgtgttgtgtaataagttgttgtcatgaaccaaatagaccctgagagcagcaattacaaattgatctcccaatccccatgtccccaattgtcatattgggttaaagttgttgcaaataaaggtttggttggttgg

SEQ ID NO: 14918 - DNA, 1173 bp, Sorghum bicolor
  Clone ID: SORBI-28MAY03-CLUS1775_1
agcaccccccataaaacgcacgagcactagcaaaagcacaaacgatacaaggtactaacaattattggcagtatcgcagaacatattaggtaacaggtacgagacagtgtgaaattggcagacaaactatacattacgttgcactttgatcccaacctctaactagagtacaggaccacattaccaggggtatactgtgttcaaaacatcacgacgctctgacaaggttggcacagggtacatcttgtttgacccactagttatcggattgcatgctcctgagcatgtttaggatggaaaggaataggttcaggatgtcaaggtatagcccaactgatgcccagatgtactcatcataggtgtggcgcctgatcaggttctcggtgtcatacagaatgaagcctgcgaagaccaacgctcctagcccaccgaacaaaccaacagacactggtcccaatgggaagaaaatctgaagaaagctagttaggacaaggatagtaagcgcagaagacagaataggccccagatacccgaattccttgcccttctttgaggcccagaaagcataggcagtcaaagaaaccaccacaccagctgtcaatactaaagcctccagaacaattttcccttgagtgttagcacaagccacaccaatgctgaagctcaagcacaaagtgaacagacccaggaaaacgaaattgtgtgggtgcttgtgctgataatgatacaatgggatcatcaggatgaagggcaggacggcgagcacgagcgcgaggcccgcggagtcggagagcgtggcgttgagggtggggtggaggacggtgagggcggagacggcggtggtgaggagcagctgcgcggcgaggatgccgtagaccttgcggacgaagccccagcggagggcgctctccccgcgcgagatccccgggtacagcgtctccccggtcccggcctccaggtccacctccgacgcctccaccttctccttcatctccggcgaacggcggtaccccgctggcgcgaggggctgcatctccgccaccgacgccatctccctctccctctctctgtctcgcactccgacggggatgggattgggtgcggtgcggggaaagggaaatgcggattcttcgcacgagacgcgggttgcgcgtcgctccttgaccggccggc

SEQ ID NO: 14919 - DNA, 1960 bp, Sorghum bicolor
  Clone ID: SORBI-28MAY03-CLUS14568_1
agtgaagaagcttattgctgtttatttcatccaatattgcaatgatacacgtacgtgggaaatgaacacacagacacacggtacatatgcttgatttcctctcgcgctgcacagtccatccatacacagagatcgacacacgcagccacaacatccaaaagctagcaaaacctctcatcttcatccatcagacgacctcctcctccttgccggcgacgacgacgctgccgaggcggacggcgttgacgtagtccctagggctatgcgacgcgatgccgggcacgagcagtccagtggcacggtagagcaacgagacggcgccctccctgtaatccttgccctccttggtccacaggaacgcgcccttgaacagatccccccacgcattcccatacatggacagcaggtacctcgggttgaagtagttcgggttcggcgcgtcgccgccgttggcgatctcccgtcccttgtaccacccgtcgaagtagacgcatgtcccgccgtgcgcgaactcggcgacgggcggcgcgtcgaagggcacccggggcacgacgtcgtagcggtacaccacgcggagcggctccacgggcacgttcccgcgcacgtacgccgcgaacaccttgtcgccgacgcgaggctgcccgtaggtgaccacggacaggagcctgtccaggatgtcgcgctcgccgtggaacgccagcagcgccgggaagatcgccgccagcgcgccgcccaggctgtggcccgtgatcaccacgttggcgttcgggtgcttcttcagctgcgcgcggagctcctcgcggagcgtgtagtaggctaagggcttgccggcgacggcgttcggcgcggctttcgggaacgccttggcggcgtccttgccgtcttcctcctggaggccgagagccttgaggaagccgacgtggacgtggcccagaacgcccatgcctagccatgacaggttcacgtccgtggaccagtcacgcatgttgaagggctccgtgccacggaatgataccactatcacgctcgcgtcgttcgctttgtcggtgaacacaaacgcctgcgtcgtgtggtcccccacgaacttgttccagcagttgtagaaccccacgaagtggaacttccagacgttgttgacgacgttctcgatgtaggcggcgttctcataggcgatcttggcggccatcatgctcacctcgaacaccgagaaggtgcgcagccggatcagccgcccgttcacgtactgctgctgcaccagcggcaccgccgccgtgcccgtgctgctgccgccgccgccgccgctctccacgtcgacgtagtagtcgtcgctgccagcggcggagacgcccaccacctgcagccgccggtcttcagggccgccgccggccggcagcggcttcagctccgtcctgccgtcgatgagcccgatcatggaccggaagttgggcgcgtcacggtgtgggatcaccagcttacatctgaagatgttgagaaagatgccgagtatgccattgttgagggcgacgaagttgaggaggaactcgacgacggcgccgatgacgagcgccgggtagtaggcggcgtcgagcgccttctggatgagctgcgtgagcgcgacgagccagtcgcccggcgtgctgccgaagtcggcggcggtccggtcgccggcctccacgaacgcgtagctggtgatggggcggcgcaggaacagcatcgacaggacgtcgatgaacctcaccttctccgaccggatgatcagcttctcctcccccatcttggtgtggccggaggcggccgcgacggcctgcggcagctgcttcttcgccgccatggtgatcgccggacggcgaggtctagctagtagctctgagagctacactacacgcctacacccactgagtagctagctagctacgtgtaagtgtggtgggtagcaaagtggtgcctcgcgccctcctgc

SEQ ID NO: 14920 - DNA, 461 bp, Sorghum bicolor
  Clone ID: SORBI-28MAY03-CLUS666_2
aaatcacttatggatagaagtgcttattaactaaagattttgaagatgaagctgatgtctgctggaggtaggcttccttgaaatctaacgtctaaataacctttaagagcataacaacgtgcacgagtggtacatgctaacacgtcaaaaccttgtcatgaaagaattgtgtttctttctttcttccatttcctggcatttgatgctatgatgtgttcctcttgccagagaatggtgtggacaacgcggtaaatttggtgcagatggatgctgtgttcaaattgattggagttctctggatggatgcctatcgagtagtataattcctctctcagctcactgtccagataattagtgctatctgtgactgttgggtaatcagattgtcgagattttactggttggagctgtccggcattgctttcatcttttgtcaatatgcccggtcttcggcagcatgt

SEQ ID NO: 14921 - DNA, 3118 bp, Sorghum bicolor
  Clone ID: SORBI-28MAY03-CLUS666_1
ccacgcggcccggaggatggccgcgctccagacaccgcccgctcggccgctcccgccccgtccccccccccgctcgctgggaatcgcagtcactgctctgaagtccgaaccccttcatacccatcgtctcgtctccgatttccccaaattcaggccgcaggcgctacaggatccaggcaccacgcggtcggcggctgccgcctcgtcgtcccgcccgctcgattggggtcgcgtgtgcgataggaagttcgtcatacgcctcgcggtttttctagtctctgttttgatttctatgcgcccaatgttttgtccgattgatcgatcttcttaggtacgtgagatcgtgtcgattgctcgtgagtgcgcgtagatgatgatcgctcgataatgtctgattgtttagatctgtgactatttgcgcgacttgattgtgccgactgattgtttcatctatcgtgttagctgtattaaatgttgaatcccttaattgctttgaaaccactgcatgtgcttgattaatctgttttgtactgacagcttttggtgcctatttgtgaattgtgatgagattgaacattctgctgcttgtgtgtaatcttctatgcatggttaatggttgactagtacttctctggtgcgtggggatgatggttttcaagatgcctatcagctattggtggactagaatttaacatttccctgtgcggaagtagtcccctatgttgtgtcgaaagcagcacactctgtggtaaccaatattgctgcatatattttccgtccaaaaaaatatttgttgcatatgcatactttgctttttcatctctccttgtggcacaatactacatcgattgaagagaagtatcactcaattttagcactttatgggggaacctatcatcttctggatgaattccactatgtgccccagccatacacagatgagaatgggaactgggaaggagcagtttgtggactactggcaggctattgatttctgtattctttgggaaagaattgggaagggcatttttcttatacaggttgtgtaaccactggtgatatgagatgatctctattcgcttgggaagtagagataggttaaatttcaggtctgaatggtgaaaccttaaataaagtcttaggatgctgtgtgaaagaagcattgctggtttcctcgaaggtatgtctgatcaaagaatcgatggactgaaaatcacttatggatagaagtgcttattaactaaagattttgaagatgaagctgatgtctgctggagagaatggtgtggacaacgcggtaaatttggtgcagatggatgctgtgttcaaattgattggagttctctggatggatgcctatcgagtagtataattcctctctcagctcactgtccagataattagtgctatctgtgactgttgggtaatcagattgtcgagattttactggttggagctgtccggcattgctttcatcttttgtcaatatgcccggtcttcggcagcatgtggcgttccagaactgtgcgcagtggtttcctcgaatttaggacctccgactgcattctgtattgagaacaatcctgctaaatgcatgatatttgcaggtattgtgttgtgtttgcaacgtgatagcttgtaccgtaaaaaaagatcaagatgggcgccttggacctacaccttgagtttgcttctgctcaacatggacaagccaagctaaatgtggaggaatatgccaagggctctttgctgtctgatggaaactacaatacagagaagatcaatggttcaaatcctgatgagtatgagaaatttcagaaagggataatgcagtatgggtgtccacattatagaaggagatgccgcataagagctccttgctgcaatgaagtttttgattgccgacactgccacaatgaaactaagaattccattaaaattgataaaatgaagaggcatgaacttccacgccatgaagtgcagcaggttgtatgctcattgtgtggcactgaacaggaggtacaacaagtatgcatcaattgtggtgtttgcatggggaagtacttctgtggattgtgcaaactctttgacgatgatgtctctaaacagcagtatcactgcaacggatgtggaatatgcagaattggagggagggagaatttcttccactgttcaaaatgcggatgttgctattcaattgctctgaagaatagtcatgcatgtgttgaaggggcgatgcatcatgactgtccaatctgctttgagtacttgttcgagtcgacgaatgatgtttctgtcctgccttgtggtcataccattcatgtaaagtgcctcaaagaaatggaggagcactgccagtttgcatgccccctttgctccaagtcggtttgtgacatgtcgaaggcatgggagagactcgacatggagctggcaactctgtctgactcctgtgatgataaaatggtccgcatattatgcaacgactgcggggctatatcagatgtgcagttccatttgattgcgcacaagtgccagaattgcaagtcatacaacacccgccagatctgaagtaagaattgcaagtcacacgacaccgtgagatctgaagtaacaaagccttgtggggtttctgcattcttcaagaagcgtgatggctccttcccgtgagctggtgagcactgggatatctggcaagactccactgggtcctgcggaggcaaacagctcgagattatttgtctgctgctagctgccatccttcattatacatcttattagcctactaggtcctcttgccccttcactcctgtcgctttgtgattctagtgtgataatgttatatttcctgttgcttgaagattgtagcatcggagttcgtagatgagataattgttcaagctttgtagctggaattgattcatgaaggtgcctttgttgagcaaggaagagaggccttggttgcgggtagctactggctaggcaagctttgtagatgtgcacctgtggttggttgtacggcaaaccggatctcctatttcccgtgttttatagtgttcttgtgttattttactccctccggcccaataaagtccaaatatgaaggtgcaactagtttttg

SEQ ID NO: 14922 - DNA, 774 bp, Sorghum bicolor
  unsure (1)..(774): unsure at all n locations
  Clone ID: SORBI-28MAY03-CLUS253_1
gccggccggccggcccgggattgcagcagctgacagactcaaccgaccgacagacagacatggccgcctccaccgtctccggcctcgccggcgcctcctccctggccagccgcccggctttctccaccagcttcacgaggggcagccgggtgtcggcgaggaacccgctgatgacgaggaacctggagaggaacggcaggatcacctgcatgacgtttccccgggactggctgcggagggacctgagcatcatcgggtatgggctgatcggctggatgggcccgtccagcatcccggccatcaacggcaacagcctcacggggctcttcttctccagcatcggcgaggagctggcgcacttccccacgccgccgcccgtcacctcccagttctggctgtggctagtcacgtggcacctgggtctcttcatcgtgctcaccttcggccagatcggcttcaagggcaggacagaggactacttcgagaagtgatcagcgcgcggccacgatcgatcaagctccgatccatgcatcgtctctgatatgatgctgcgttgcgttccgctgcgtgcgtgccgcagcaaccagcaatcgatcgaacctttgctgtataatagtatatgatggttctgatttggttcaaaaatgtgtgatatgctacttttgagctcaaaaaatgtaaatctatgccgcgcgccccctgcacgctctggttcaatttgatgaatctatagcaagctagtcttctctcaaaaaaaaaaaaaaaagcccctan

SEQ ID NO: 14923 - DNA, 1245 bp, Sorghum bicolor
  Clone ID: SORBI-28MAY03-CLUS33549_1
gatccatctcgagcagagtgacacaagtaagctcagcaaagctagccaaaattcaggaaaagcaagagagcgagctagagagaggtgaaaggtatggcgcactacgagcagcaggggcggcggcagcaagtcgacgagtacgggaaccctatccctgggggccatgctattcagggtaggcaagccggcgggtacggcgccgtcgcgggcaccggcagctacgacgccggcggttacggcagccagcagcagcaggccgggtatggccccactggcaccggcatgcatgacgccgggggctacggcggcggccagcaggccgggtacggcgccactggcaccggcacgcatgacgccgggggctatggcggctctggtcatacgggttacggggctaccggaacaggcgtccacgacgccggcggcccaggagggtatggagccagagctcacggtacgcatggcgtgaccgggatccaggacggcgccggcggcgtcgggcacactggtggtctggctgccgcaacggcggtgtgtacccatggtaacgggaccggacacggtgcgcatggaggtgccaccggtggaagccatgacgccagggtaaccggaaagcataacaccgcaaggatggtaggcggcggacggcctggggagcatacggcggcacaggatacgccggaccgacgaccggtacgggcaccaccggcggcgggacgtacgtgccgacgaccggtggaggcacccacgagaagaagggcgtgatggagaagatcaaggagaagattccgggtggccacaaggactaccagcacacgaccgcgggaaccggcggcggctatggcggaaccaccggcacgtacggtacggcgacgacgacgacgactgaggggacgcacgagaagaagggcttcatggagaaaatcaaggagaagctccctggtcagcactaggcgcgcggctcctctgccaagttggaagtttgaagtttgtggcatgcgaagaagaataaaagtaacgaagaataaagcagcagcgctgtctgtgtttgtatatgtacatgtgtgtttaatttgcatgtaaccacacatatcctctgttcttgtgtgaatgaaaaggtaaaaaaaaaggaatccactccctagtatgtgtgcgctccctgtgcctgccctcgcttgattcactctctttggctggctgctttgtcaaatgttattgtggggtatatatatggcacctccttgg

SEQ ID NO: 14924 - DNA, 1629 bp, Sorghum bicolor
  Clone ID: SORBI-28MAY03-CLUS56075_1
gcacgaggaacaggcacagcgcgagccggagccgtcgtcgcctatatatatatatatatatatatacgtatgcaaagcacagccagaacaaggaagacgaagccgctgcccgatggcaatttcttggcgagtgtgcttgttcgcgctcgtcgtggctctagggtttctcttcttcttggacggtgcagcggcggcgagaagtgcagggacgtcgtcggcggcagcgcagcgccggcgagaggttcgaagcctcctcacgcggctcaacaagcctcctctcgcgaccattgagagcccagatggagatatcattgactgtgtccacatctcgaagcagccagcattcgatcatcctctcctcaagaatcatagtatccagatgatgccctcttgccacccagaaggactcaataacaattcaaatattgcaccaaatcctttcacccaaacatggcatcaaaatggcaagtgcccagagaataccataccgatccgaaggaccaaagaagaggatgtcctgagggtgagctccattgagagatatggcaagaagtcgccttggagcatcccaaaccgtttttccattgatgaccctgactcggtgaacgtattaagaggccaccagcatgccatagcatctgcgccggaggatgacaactactatggtacccaagcaaccttcaatttgtgggaaccaattgttgagatggacgaaggattcagtttgacccagttctggattagtagtgggtcctactcaaacaacgacctgaatactatagaagcaggatggcaggtttacccaggtctgtataaggatagacacacaagactcttcatctactggactcgggatgcatacaacaaaacaggatgctacaatctactatgctcagggtttatacagacaagcaaccagattgccatcggtgctagcaactcctacctgtcccctgtctccgtctatggtggctcacaatatgacttcactattttagtttggaaggacccaaaggatggcaattggtggttgcaagtgggaggccatgatctaggctactggccaacttcgatcttcactaggttggcaggtagtgctgcctctgtcgagtggggaggcgaggtggcatcgtcacctgatgctggccaaacatccacacagatgggtagtggacactttcctgaggaagggttcagcaaggccagttacgtcaagaacatccaattggtagattcgaccaacaatctcaaatcgcctagtgctgtgagcttggtagctaagtggcccaagtgctacaacgtgcagaatggtactagtgctgattggggtacttacatcttctatggaggacccgggaagaaccctaactgccaatagcaaaaagtgaactggttgcagcccaaacatctcattgacaaaagaacaatataattccccataagaaatgcaatatgcagtactcgacgccgagtaagtattattaggatgtatatcattgggtgtaatagtatgctttcccagttgtcgcattgcaagggtaaactgctacatatttgtctacgttgtagccataaacataaggaatggaagtttgaagcatatataaattcagagcatgttttacaata

SEQ ID NO: 14925 - DNA, 571 bp, Sorghum bicolor
  Clone ID: SORBI-28MAY03-CLUS329_2
attcatttgggccgcctgcaccaccccctggtttctggatgtccttcctacgagtgatgcatggtgttgtaaatttctgtgggagggttagctgccttattagccagaacactcaggcatttcacatgttcattactgcatttttgcagttatgtgatcgggctggaatgctttatggcgagcttgcaagatttgttctacgtttgctggggatcaaaacaaaaccgaagaagggtggtgttaagggcgcaggagctccatcatcagaaggacgaggccagcagtttgttgaggcaccgaaagctaactcctcatgggacagcgtctggactgaggatggcaaggggaagtaagggcctgtttgggtgcagtgaggctggttttgtgaaaggaggatgagtttgcttgtggaagagaaatctgccagtatgtgttcggatgcattttgcatttggatagaaggcaaaaacaagtaatcccttacgccctttgtatttgtcatgttcttccatagtgcacatatagatctggcacggtggtatagtaggtagtctgcaatgagaaatggggg

SEQ ID NO: 14926 - DNA, 1664 bp, Sorghum bicolor
  Clone ID: SORBI-28MAY03-CLUS329_1
atctttattacctggcactctgtctcgacctctgctcgccgtccctccttggaactgcagattgcacaaggctccaaggggcgagccccctcatctctaatacgggtatgactcgcgcctccaccacaccctccatccatttcttggtctccacacgctttgtccgttctgctgcaagtggatcgaagaagaagaagcgcaggtgttgatcgaggagcctgctgccgatcgacgacggacgacgccagcatgggggagatcaccaatgtcatggagtaccaggcgatcgcgaagcagaagcttccgaagatggcctacgactactacgcgtctggagctgaggacgagtggacgctaaaggagaacagggaggccttctccaggatcctgttccgaccacgcatactgatcgacgtgtccaagatcgacatgaccaccaccgtgctgggattcaagatctccatgcctatcatggttgcccccactgctatgcagaagatggctcacccagatggagagtacgccacagcacgcgccgcagctgcagcaggcactataatgacactgtcatcctgggcaacttcaagcgttgaggaggttgcctcaactggaccagggatccgattctttcagctctatgtctacaaggacaggaaagtggtggagcagcttgtgaggagagctgaaagggctgggttcaaggccatcgcgctcaccgtcgacaccccgcgcctcggccgcagggaggctgacatcaagaacagatttgttctgccaccacacctgacactgaagaacttcgaaggtctggacctcggcaaaatggaccaggcagctgattcagggctggcttcctacgtcgccggccaagtcgaccgcaccctgagctggaaagacgtcaagtggctgcagaccatcaccacgatgccgatcctcctcacaggagtgcgcaccgctgaagacacgaggcttgcggtggcgaacggcgcggcggggatcatcgtgtcgaaccacggcgcgcggcagctggactacgtgccggccaccatcagcgcgctggaggaggtcgtgaaggcggcccggggccagatccccgtcttcctcgacggcggagtccgccgcggcaccgacgtcttcaaggcgctcgccctcggcgccgccggcgtattcgtcgggaggccggtggttttctccctggcggcggcgggcgaggccggggtgtccaacgtcctgcggatgctgcgggacgagttcgagctcaccatggcgctcagcggctgcacctccctcgccgacatcacccgcaaccacatcatcaccgagtccgacaggctccgcgtcatgccgtcgcgcttgtagatgatcaataatcaatcacctgctacgctacgccgccggctgcccacctcgcgaggctcgctcgccgccggccggccgcgaacgaagacttatcaccccgatcggggatattcagtttcgtgcatgtatgcatggatgctcgatgacgatgatactattaattctggactgcatatatgttttgtttcataaaaagatccgatcactgtactgtaaaatcttactacagattacatgcatggtgtggtgcatcttcattaattaattgttaataatggcgcatgatgatcgctgtattgggccgg

SEQ ID NO: 14927 - DNA, 419 bp, Sorghum bicolor
  Clone ID: LIB3481-015-P1-K1-E5
cgtccgcgagcctgcttgtctgtcgcctcatccttccctagctagagactgcagagtatagcgtcgagggggctccggtggcagacaccatgggtgagatcaccaacgtgatggagtaccaggccatcgcgaagcagaagcttcccaagatggcctacgactactacgcctccggcgccgaggacgagtggacgctcaaagagaacagggaggccttctgcaggatcctgttccggcctcgcatcctgattgatgtctccaagattgacatgaccacaagtgttctgggtttcaagatctcaaatgcccattatggttgcccccactgccatgcagaagatggctcacccagattgggagtatgcaactgcacgggcagcatcagcaggagggactatcatgacactgtcatcatgggc

SEQ ID NO: 14928 - DNA, 1111 bp, Sorghum bicolor
  Clone ID: SORBI-28MAY03-CLUS1031_1
gcacgaggtcgcggcggagagaatccccaggcgaacaaacagggtagtggagaggagaggagaggaaggttgggttcggacggagagagccagaggccatggctccgatgaagctgtacggggcggtgatgtcgtggaacgtgacgcggtgcgcgacggcgctggaggaggccggctccgactacgagatcgtgcccatcaacttcgccaccgccgagcacaagagccccgagcacctcgcccgcaacccgtttggtcaggttccagctttgcaagatggtgacttgtacctcttcgaatcacgtgcaatctgcaagtatgctgctcgcaaaaacaaaccagagctgttgagggtaggaaaccttgaggagtcagcaatggtggatgtttggatggaggtggaggcaaaccagtacacctctgtattgaatcccatcctcttccaggttctcatcagtccgatgcttggaggaaccaccgaccagaaagttgtggatgagaaccttgagaagctgaagaaggtgctagaggtgtacgaggcacgtctgaccaagtgcaagtatcttgctggagacttcctgagccttgctgaccttaaccatgtatctgccactctctgcctgtttgctacgccctacgcatctgtgttcgacgcttacccgcatgtgaaggcctggtggtctagcctgatggagaggccatctgtccagaaggtcgctgccatgatgaagccatcagcttgaagcgggctgccctatcaatcggtgaatggaataagccaagtttgttctgggcatttgcttgttcagtgatgtgtcttcgatgttgaaagttcagtgcttatgtgtgagcatgcttgtaatcaggtcttgaattgttctgaaacgagcattcccgtgctcgttttgagaataaactttgcgttaggttcctctggatcttgatgagttctcatttgatggttgctgctgcagtgttcaggctggatgttatcattgcaaatgcatgtgcatagtccaatggacaacttgtctggataagagcatctccaaccattatacatttgaagttatgtattttaggcaaattgtaaaccccaaatgaaaatggc

SEQ ID NO: 14929 - DNA, 1722 bp, Sorghum bicolor
  Clone ID: SORBI-28MAY03-CLUS1922_1
caccccttgttgcagcgccagcgcgagtgcagcacagcaggcacagggaaggggacaaccacgagcgcctaagatcccgtcctccccgtcgagatctttgccgaggcggtgaccgtcgagggatcgccatggcgctgagggcgtcccccgtgtcgcatggcgccgcggcagcgccgctgccgccgttcgcgcggaggaggatggcccgtggggtggtggtggccatggcgtccaccatcaacagggtcaaaactgtcaaagaaccctatactcctccacgagaggtacatcgccaaattacccattcactaccacctcagaagcgggagatttttgattcacttcaaccttgggccaaggataacctattgaacctactgaagccagttgaaaagtcatggcagccacaggacttcctaccagagccttcttctgatggattttatgatgaagttaaagaactgagggagcgggcaaatgaaatacctgatgagtactttgtttgcttagttggtgatatggttaccgaggaagccttacctacctatcaaacaatgcttaacacccttgatggagtccgggatgaaactggtgcaagtccaaccacgtgggcggtttggacaagggcatggacagctgaagagaatagacatggtgacctccttaataagtatatgtaccttactggacgggttgacatgaaacaaattgagaagaccatacagtatctgattggttccggaatggatcctggaactgagaacaacccatacttgggtttcctttacacatcatttcaagaaagagcaacatttgtatcgcatgggaatactgcaaggcatgccaaggagtatggtgatctcaagctggcccagatatgtggtacaatagcagctgatgaaaagcgccatgaaacagcctacaccaagatagtcgagaagctctttgagattgatcctgattacacagtgcttgcatttgctgacatgatgaggaagaagatcacaatgcctgctcatctcatgtacgatggcaaggatgacaacctgtttgagcacttcagtgcagtggcgcagaggctgggcgtctacactgctaaagattatgctgacatccttgagttcttggtccagaggtggaaagttgcagatctcactgggctgtctggagaagggagaagggcacaggatttcgtctgtaccttggcacctagaatcaggcgattggacgaaagagctcaagcaagggcgaagcaagcaccagttattcctttcagttggatttatgaccgcaaggtgcagctttaatcgagaacactaggcaatgtgggcacttactatatcattttcagtcctggggttctctataagaaacagtctttaggttatttagcagggtaaaattcgactacttatggatctcacttgcgcaaagtatgctatctgttttcgtgcaagttgcaaagtttggattactatgtggtcctggtggagaagacttctgtggggtgcctgctgccagttacgaatggtgactccatcgcaactgagtgaacttgtgttgtattcaaatatgttacaggacttatagtttcaaagtaataactatatggagtttgtatatggacaagcttgctttgatgcatgatgagaatctaaagttagtatttttgtgttggttttcggaattggtctcaacttctgatagtgtgtgcttcattgc

SEQ ID NO: 14930 - DNA, 1484 bp, Sorghum bicolor
  Clone ID: SORBI-28MAY03-CLUS6350_1
tgctgaccgcatcacatcgcaatcgcgcaccacatcgcaatcgcctgagcacctcggctacttggctctctcgcgcgcgagttcgtgcagcagaagagcgatctctctcgtcgtcgtagcaagctaagccgatcccaagcccaagcccaatggcgcccctaggagacggcggagctgtgccggcggcggccaacaacctggtggtgtcgttcggcgagatgctgatcgacttcgtcccggacgtggcgggtctgtcgctagccgagtccggcggattcgtcaaggcacccggcggcgcccccgccaacgtcgcctgcgccatcgccaagctcggcggatcctccgccttcctcggcaagttcggcgacgacgagttcgggcacatgctggtgaacatcctgaagcaaaacaacgtcaactccgaaggctgcctcttcgaccagcacgcgcgcacagcgctcgctttcgtcaccctgaagcacaacggggagcgcgagttcatgttctaccggaacccgagcgcggacatgctgctcaccgaggccgagctgaacctggacctgatccggcgcgccaagatcttccactacggctccatctcgctcatcgccgaccccgtccggtcggcgcaccttgccgccatgcgcgccgccaaggctgccggcatcctctgctcctacgaccctaacgttcgtctcccgctctggccgtccccggatgctgcccgtgaggggatcctgagtatttggaaggaggcggatttcattaaggtcagtgatgatgaggtggcgtttttgaccaagggggatgcgaatgatgagaagaatgtgctgtcgctttggtttgaggggttgaagctcctcattgttaccgatggagataagggctgcagatacttcaccaaggacttcaagggcagcgtgcctggcttcaaggtcgacaccatcgacaccaccggtgctggtgatgccttcgttggatccctgctcgtcaacgtcgccaaggacgactccatcttccacaacgaggagaagctccgtgaggcgctcaagttctccaacgcctgcggcgccatctgcaccaccaagaagggtgccatcccggcgctgcccacggtcgccaccgcccaggagctcatcgccaaggccacctagacgctcacgcacgccgccactccacttcgccttcgccatcacccctcgacgtcctcaatttgaattcattagggagattgttgttagcgtccgtctctgctctaagctgagacgggtttgttgggttaattaatttagctttttctggttttgtggtgtgagtgtgagagagaagaacatggttttcgccccggggcattaataaaaatgttggcatgcgtggtggataatttttttagcttcaaatttccattgtgtcgtgtgaggaaggctgctgtaatctgatgccttcgatgcaaacttttcagagttttcaaggaacgtcttaag

SEQ ID NO: 14931 - DNA, 1953 bp, Sorghum bicolor
  Clone ID: SORBI-28MAY03-CLUS10178_1
gcacgaggcccgatcgattggagatagatatttaagccggggtggggagggagggaaggtggcgcacgagggggaggtaggtggacggtggtggtggcatcgccaattcaactccgcatctgatctgcatccgcatcggcaccagcgcgattcacaccgcccagcgaccaggcgggagaggaggcagcaccagagtgtaggagatggcgctcacaagaattggtcttgctggccttgcggtcatggggcagaaccttgccctcaacattgcagagaaaggcttccccatctctgtctacaacaggacaacctccaaggttgatgagaccgtgcagcgtgccaaggcagaaggaaaccttcctgtgtacggcttccatgaccctgcatcctttgtgaactccattcagaagccgcgtgttgtcatcatgcttgtcaaggctggtgcaccagttgaccagaccattgcgacgctcgcagctcacttggagcagggtgactgtatcattgatggagggaatgagtggtatgagaacactgagaggagggagaaggccatggaggagcgtggcctcctctatcttggaatgggcgtctctggaggagaggagggtgcccgcaacggaccatccttgatgcctggaggctcatttgaggcttacaagtacattgaagacattgttctcaaggtggctgctcaggtccctgacagtggcccatgtgtcacgtatattggcaaaggtggatcaggcaactttgtcaagatggttcacaatggtattgagtatggtgatatgcagctgatttcggaggcatatgatgtgctcaagtcagtcggtaagctcaccaacagtgagctgcaccaggtgttctccgaatggaacaagggtgagctccttagtttcttgattgagatcacggctgacatatttggcatcaaggacgagcagggtgagggctacttggttgacaaagtcctggacaagaccgggatgaaaggaacagggaaatggacagtgcagcaggctgctgagctatctgtggctgctcctacaattgaggcatccttggactccaggttcctgagcggactgaaggatgagcgggtcgaggcttccaaaatcttccaaggggactactccactggcctaccagtcgacaaggcacagctgatcgaagatgtgaggcaggccctctatgcctccaagatctgcagctacgcacagggcatgaacatcatcaaggctaagagctcagagaaaggatggggtctcaaccttggcgagctagccaggatctggaagggtgggtgcatcatccgcgccatcttcctcgaccgcatcaagaaggcctatgataggaactctaacctcgccaacctcctcgtggaccctgagtttgcacaggagatcatggacaggcaagcggcatggcgtagggtggtctgccttgccatcaacaatggcgtcagcaccccaggcatgtccgctagcctggcctacttcgactcgtaccggagggacaggctgcctgccaacctggtgcaggcccagagggactacttcggggctcacacctacgagagggttgacatgcctggcgctttccacaccgagtggttcaagattgcgcgcaacatctccaagaactgagctgctccagatgggcatgccatggcagcacattgacatggttctcctattttcgtcatcttttattgctgctcagtgttgagcaatcggtaatgtactactttgtagggggaggtactgtggttaaatttgatttttcgcgctcagtgcttaatttgggtcaggaagttgaatttgtctctgttcttcccttgtaagcggttggaatggagaacaatgatgtttcttggaacttctccatttgatctttgtaagttcgttatcagaataaataaaagcattctgacatgcttctgcttgccca

SEQ ID NO: 14932 - DNA, 2021 bp, Sorghum bicolor
  Clone ID: SORBI-28MAY03-CLUS8090_1
ccctctggactccatcgtctcgccgccgttccccgcaacctgtcgacccaatctcacccgacccggcgcgtcgtcaccctccagatctcccgcccgccacaggtagcagcaactgttctgctgcagtctgaccaagtggtgggcttaggagttcctgcttctttcatgtcggaacaatctttgcttcatttgggattgctgggagagtattctcgcgcgacgaggaaaaggcataaggttcagttctgctgcatgcatcaagagcccatctggtttccttgtccggaggtgtcaattgctggtgctcagagtgagcttggttttcttggaggatcagcagaaacttttgattctggactttgtcacatctgatagcatcaacttaatagatctttattaaagatggcgctgtaaaacattggtgcttcaaacagggatgattccttctatatgtacaagatgcccagaatgatttcctagatagttggtcgtggtgatggtatgaagcaaaatcttttgaatatggtgtgcttagcaaaagcacttgccggtccagcttcctacacaaccaagtactgtggatgtgagcttggtcaacagacgtattttgatgatgctacaattaaatatttgcttggaggggctcattatacttctaagctggctgtttggatgggagctttcatcacagtccaaatttgatgatatgacaggggtttccctggttatgggattctcatctcaaagacccagatgatatcactgaaatgtgcagcctgtgggttcgtctcagatgttgacatgagggacaagctcacaaccttcatcctgaaaaacccaccagaacagaagaagggaggaaaagacaagaaggccatgaggagagctgagaaggaacgcctgaaggaaggtgaggctgctgatgaggagatgaagaaactgaagaaggatgcaaagaagaagggtgcatccaaggagcccactgccaagggttcaaagaagaaggctactgctgctggctctgatgaggaccactcaacctctccaactcgcagccgtgatggtgaccatgcagctgcagatgaggaagaggatgatgatgatgttcagtggcagactgacacttctatcgaggctgcgaagcagcgcatgcaggagcagctgagtgcagcaactgctgaaatggtgatgctgtccactgaggagactgagaagaagaagaaacaggcaacccatgctaatggttcagcaaaagaaatccctgttgaaaaacctgccgtcactaagcctagtccatatgaagaactggttggagacatcaaggctagcctaggaagtgctcctacccctacccagctcaaggctgtgcttgcctcctcaacccttcctccccaggatgtgatgaatgctctcctcgaggctctatttgatggtgtgggcaaggggtttgcgaaggaggttgtcaagaacaagaagtaccttgcagttgctgtgccagatgaggctgcccaggtcctgctggttcaggccattgaggcttttggtggcaagtgcaaccctgaggcgctgaaggaggtcccagttgtcctgaaagccctgtatgatggagatatcctggaggaggaaaccatcgtggactggtacaatgctgctgttgcagctggaaaggactcccaggttgtcaagaacgccaagccctttgttgagtggctccagagcgccgagtctgaggaagaggacgatgagtgaaggggggcagctctgctctactgctgcacttaatagtattatatatttcaatttagtttcttttgcttgtctggtgtgatttcgtgtcagtgttcgtgtagtgtggatgtctaaaactgttaattgtggtgtggtgcagcataccctatgtggttggctgcgtgtggtgtcgtcagtttggtgtctgtgttggatgtcacagtttattatgttcctgtggattgctactatataatatttgcttgggttgtgttcttataccttccgggatg

SEQ ID NO: 14933 - DNA, 943 bp, Sorghum bicolor
  Clone ID: SORBI-28MAY03-CLUS76_4
ctctctccttgcgctctgccttgctttcctgctgctgctgctttggcgcgagcgaggaagtacggtcgatctggcggcggaggcggagggatcggccggggccggcggcggcagggcggcgacgaacatggggagggggcgggtcgagctcaagcggatcgagaacaagatcaaccgacaggtcaccttcgccaagcgccgcaacggcctgctcaagaaggcgtacgagctctccgtgctctgcgacgccgaggtcgcgctcatcatcttctccaaccgcggcaagctctacgagttctccagcacgcagagcatgccaaaaacacttgaaaagtaccaaaaatgcagtttcgcaggacctgaaacagccgtccagaatagagagaatgagcaattgaaaagcagccggaatgagtacctcaaactgaaggcacgcgtcgataatttacagcggactcagaggaacttgcttggtgaagatcttgagtcattaggcataaaagagctggagcacctcgagaagcaactcgattcatccttgaagcatataagatccacaaggacacaacacatggttgatcaactgacagaacttcagaaaagggaacaaatgttttgtgaagcaaataagtgtcttcgaagaagactggaagagagcaaccaggttatatggcagcatgcatgggagcaacaaggcgagcggcatcctgaagtgcagccgcagcagctacacggcaataacttcttccatcccctcgatgctgctggtgaacccaccttcagatagggtacccttcagaggcctgactagctcatgcatgaccaccttcctgcccccatggttgccatgagatcgaactactgtatgattctgaattaaataacaagcattgccgcagcttcctgcaatagctatatgttgtgcttcgagtgataaattcta

SEQ ID NO: 14934 - DNA, 883 bp, Sorghum bicolor
  Clone ID: SORBI-28MAY03-CLUS76_3
gccggccgggccgggaaagaacccaggactccggaaagagctttagagctagagagagagaagagggacgcaaaacaagctcgctaggaagatatgggtcgcggcaaggtggagctgaagcggatcgagaacaagatcagccggcaggtgacgttcgccaagcgccggaacgggctgctcaagaaggcgtacgagctgtcgctgctgtgcgacgccgaggtcgcgctcatcatcttctccggccgcggccgcctcttcgagttctccagctcgtcatgcatgtacaaaacactcgagagataccgcagctccaactacagctcacaggaagtaaaagttccactggacagtggaattaactaccaggattatctgaagttgaggacaagagttgaatttcttcaaactacacaaagaaatattcttggtgaggatctgggtccacttagcatgaaggaacttgagcagctggagaaccaaatagagacatccctgaagcagatcaggtcaagagagaatcaaatgttacttgatcagctctttgatctcaaaagcaaggaacaagaattgcaggatctcaataaagacctaaggaaaaagtgccagctgcaagaaacaagtccagagaatgtgctccatgtttccagctgggaggaaggtgggcacagtggcgcaagtggtaatgttcttgatccttatcagggactccttcagcacccagagagtgatccttccctgcagattgggtaccatcaacaagcctacatggaccagctgaaccaacgaggacatggcgggcccaaatgagcacggtcgatctggatggatatgaaatgctccgatgacgacccaaataaagttgatgcataacaagaatccaccc

SEQ ID NO: 14935 - DNA, 1060 bp, Sorghum bicolor
  Clone ID: SORBI-28MAY03-CLUS76_2
gctgagggtagctgcagctggggctagctggaagggttgggagccatggggagggggcgggttgagctgaagcggatcgagaacaagatcaaccgccaggtcaccttcgccaagcgccgcaacgggctgctcaagaaggcgtacgagctctccgtgctctgcgacgccgaggtcgcgctcatcatcttctccaaccgcggcaagctctacgagttctgcagcggacagagcatcacaaaaacacttgagaggtacgaaaaaagcaattatggaggccagatactgctgtacagaacaaggagaacgagttagtccagagcagtcggaatgagtaccttaaactgaaagcaagggtggataatttacaaaggactcagaggaatttgcttggtgaagatctggggtcacttggtatcaaagagcttgagcagctcgagaagcaacttgattcatccttaaggcacataagatccacaaggacacaacatatgcttgatcagctcactgatcttcagaggagggagcaaatgctgtgtgaagcaaataagtgccttagaagaaagctggaggagaccagcaaccaggtgcatagcaagtgtggagcacggtgccaacttactcggctacgagcggccactcccccccacagcaggccccatcacatattggcaatggattgttctttcatcccctggaagctgcagcagagccaaccctgcagatcgggttcgctcctgaacatatgaataacttcatgccgacatggctaccctgaagatggatctttgaggcaaaggaataaataaagatgcgatggccagcatcatctactactgcaagagtgacagtcatatatatatatatatatgacctagtttgtgtgtcgatgtgtcgaaacgcataaatttgtgatttgttatatgtaatgtataagcacaaacgaaacatgcaggactagttgcttgcttcgatgtatttgtgtgtatccgtgtaaagggccgtgcgcacagcatatgagtgatgagattttctctaataaggccgttatgccgccaatcgt

SEQ ID NO: 14936 - DNA, 1323 bp, Sorghum bicolor
  Clone ID: SORBI-28MAY03-CLUS76_1
gcacgaggcaccgccgttgcccccccttcccttcagccccctttccccccatccttccacctcctattctcttccaattcgcgcaatgggtgtctttctccaggccgagaggcactggcgcaccgctccgacgggcacggatgctcaagagcaggaccgagctgtgctgccggccgtcggaagtgacagagcagcgggcggaggagctggcccccggcgacaagcacgagaggggccagatcgcgatcacccgccgcggcaacgccccgcacgagcaggacaacggcggcaacgctcgcaacggcctcctcaagcaggtggacaacctctcgatcctgcgcgacgcccaggtcgcgctcatcggcttcttccgccacggccacctctacgagtccgcaaacaacagtgtgaagtacaccatttagaggttcaagaagcacaacagtggcgcctccaactctgacaccactgcagaagacagtacagagcactaccaggaggttgcctgctagatatcttgggtcattagtagtaagaaagatgcaaccactccagaagtaactcaattcatccataaagcatataagatccacaatgaccaaacacatggcaggtccaaggacagaacttcagaaaagggaacaaatgttttgtgaaggaaataagcgtctgcggagtagactggaagagagcaaccggatcagaaggcagcctacatggaaccaacaagatggatcgctgcgggaagtgcatccgcgccgccggcgatgaaattgatgctcccgccctcgacaagcgacttcgaacccatggcctcatttgacctgccaatccttggcactgagaacatcatgcaccaccctcagcccgtcccccaccaggcccaaccaacaaaccaccctctcaggttaagaaattaattaactgtagacgaatctggggcaaattatcaatgcatgcgggcatgcagttatatcttgtgtccaatcgagatcaaaaatctattctactgttgtataatttttattaataatcgtgattagtacaattgtcagcagtatgtgtgtgacaactctacatatatgttgtgtggctgtacggcgaggtcttttgcgacaacatttgcagcagcagcagcatttggtgttgttcatcgatcgatcgcaaaaattaagcttgccaccactgtgtgtgcatttgtacgtgttaattcagctgctgtatctgttaattgcaccctccattagaacgcacgcgtatgcatacttatacttatttatgtatatgagatttgtgtgtgttatatatattgcaatttgcgtt

SEQ ID NO: 14937 - DNA, 467 bp, Sorghum bicolor
  Clone ID: LIB3480-014-P1-K1-C8
cggacgcgtggggtagcttccgtccggaacggccgcggtgccgacacgcacccgctggcctgacccgctccggcacatgcggcgagacgctcatcatcttctccaacacgtgcaacctctactagttctgcatcgtacagagcatcacaaaaacactttagaggtacgaaaaaagcaattatggaggcccagatactgctgtacagaacaaggagaacgagttactccagagcattcgcaatgagtaccttaaactgaaagcaagtatcgataaattacaaacgactcatatgaattttattggtaaagatctcgctacacttgctatcaaactacttcagcagctcgagaagcaacttgattcatccttaaggcacataagatccacaaggacacaacatatgcttgatcagctcacttatctttaaaagaagtagcaaatgctgggtgaagcaaataagttcctt

SEQ ID NO: 14938 - DNA, 1941 bp, Sorghum bicolor
  Clone ID: SORBI-28MAY03-CLUS12363_1
gaccgcacgaggccaaaacccctccgtccttccttcccaaccgactcccaattccactcttcgcgtctcgccttcttcttccgtcctacgcaatggtggccgctcgcctccgcctcgcgctgctgctactcctccccgtgttcctctgctccgcgtgggcgcgcccacgcctcgagcccaccatccgcctgccgtccgaccgcgcggacgacgccgtcgggacacgctgggccgtgctcgtcgccggttccaatggctactacaactaccgccaccaggcggacatctgccatgcgtaccaaatcatgaagaagggaggactcaaggacgagaacatcattgtcttcatgtacgatgacatcgcacatagcccggagaatccgaggccaggtgtcctcattaaccatccccagggtggcgatgtctatgctggggttccaaaggattacactgggcgagaggtcagtgtcaacaatttcttcgctgttctgcttggcaacaaaactgctctgaaaggtgggagcggcaaggttgtggacagtggccccaatgatcatatctttgttttctacagtgaccatggaggtcctggtgtccttggaatgcctacgtatccgtatctctacggtgatgacctcgtagatgtcctgaagaagaagcatgctgctgggacctacaaaagcctggtcttttaccttgaagcatgcgaatctgggagcatctttgagggcctcctgccggatgacatcaatgtgtatgccaccaccgcgtcaaatgcagaggagagcagttgggggacgtactgccctggagaattcccaagccctccaccggagtatgacacatgcttgggagacctgtatagtgtttcttggatggaagacagtgatttccacaatctgcgaactgaatctctcaagcagcagtacaagttggtcaaggataggacagcagttcaggatacattcagctatggctcccatgtgatgcaatatggctcattggagttgaatgttcagaaattgttttcgtacattggcacaaaccctgctaacgatggcaacacatttgtagaagataactcattgccatcattttcaaaagctgttaatcagcgtgatgctgatcttgtctacttctggcagaagtaccggaaattggctgatgactcatctaagaaaaatgaagctcggaaggaattgcttgaagtgatggcccaccggtctcatgttgacaacagtgttgagctcattggaagccttctctttggctctgaggacggtccaagggttctgaaagccgtccgtgcagctggtgaacctctggttgatgattggagttgtctcaagtccatggttcgtacttttgaggcacaatgtgggtcattggcgcagtatgggatgaagcacatgcgatccttcgcaaacatctgcaatgctggcatccttcctgaagcagtgtcaaaggtcgccgctcaggcttgcaccagcattccttccaacccctggagctctatcgacaagggttttagcgcctaaaagccacaggtgaggcgaaatattacagcagctccaccacaccgaactccattacattacggtactcagggggtcttagttcttgaaacataggtgaagcagacttataccattattatagctgttccaccgtaccagattacgtagccatgcccaatttccggtgtacatacatatacatagtcggaaagttatttggcaattgtattggccgttggtgtatatattccctatagtttgttagcagatgtgtagtttgtaattccataaatgaagagcattgctgctatttctatatagccgattgatgttcatgtgaaactttacctcattcttgttgggaaatggactatccatggtggaattcttgcatggaatcaatcccctgagtgatcctttattc

SEQ ID NO: 14939 - DNA, 2726 bp, Sorghum bicolor
  Clone ID: SORBI-28MAY03-CLUS2549_1
gcacgaggcacatgagcaaccctactctccaatccgtgttcccccacctcctcctcctcctccacaccgcgcgcgcggcggtgttgacccacccacccgttcctccccccaccccatcagcgctggaggcggcggtgcgaaagtcccccggacccttcggcggcggcggcggcggcgcgcggttatgccgagaggctcccaggtttcatcaccgtgctctgctggagttatagcattttcagcaaggatatggagtacaccccctacacagcaagttcctctgtatcccacatctcgctgctcgaggaagttcttggctggaggttttgtctttacggagacttcttggtcatctcttttgtcaactgcacctgaggatcaccctgcacttagcaactgccttgcttggtcccatgccgtcagacattagagttgcctagtgattacagtgcagctgtagcacacttatttgagcatggtggatctgtttttctggcagcatttcggtaatctttgtcttggtgctaatcagccaacaaaagttaccatcaagacatctctggacacttgaatctaacgcttagagctttgccgtcacagataagctctaggttctggtttttgttctctgctagctttcttctaccctaccgctgtaagttttcagtctggtcagtccaaagttcggtgtgataagttacgctatctttcaccagccttcactttggatggcgtgacattagagcagaggtgttcaagattttgttgtgcaaagcatgggaatagcattcatagctttgagagcagtcttcagtgactttggtgttgtaacatccaaaggcgctcctgtgatacatatatgagtcttgtttgttactatacaactgttctggaataagggcagttctgtgcaccaccagcaaataaaatggagaggtataccatcatcaaggaagttggtgatggaacatttgggagtgtttggcgtgcaaccaataaggaaagtggtgaagtggttgcgatcaagaagatgaagaaaaaatattattcttgggaagagtgcataaacctccgcgaagtgaagtccctgcgaaggatgaaccatccaaacattgtgaagctcaaagaagtcataagagagaatgatatgctgttctttgtttttgagtacatggaatgtagtctttatcagctgatgaagagcagagggaagcccttctcagagaccgaaatcagaaattggtgctttcaaatatttcaagctctgagtcacatgcatcagcgtggatattttcaccgtgaccttaagcctgaaaatttgcttgttacaaaggagctcatcaagatagcggattttggacttgctcgtgaaatttcttctgagccaccatatacggaatatgtgtcgactcgttggtatcgtgcccctgaagttctcctacaggctactgtttacaatgcagcagttgacatgtgggctatgggtgccattatcgctgagcttttttcactgcggccactttttcctggctcaagtgaaccagatgaactctacaaaatctgtagcattcttggcactccgaatcagcgcacttggcctgaaggactgcagctagcagcatctataggttttcagttccctcagtgtgagagcgtacatctttcggaagtggttcccttagcaagcgaagatgcaatcagccttatttcgtggctttgctcatgggacccacgaagaaggccaacagcagtggaggttttgcagcatcccttctttcagcaatgcttctatgttcctccttcacttcgcttcaaatccaccggatatgcatcaacgccaccatcagctggggctaaaggagctgtggatcagaagaacattaggagatactccatggggactgtacccaatgcgaggccaacagttaattactcatacttgagcaataacgctccagcaagagcagctggtgtgcaaaggaaattggagttggatcatcagctcccagagactaataaccataaggtgacaaaggcgaacatgatgaatcagtcttggtccagaccagcagcagtaaggagcaatgggaattaccttgccaaggatcagaacccccgtgctcctgaccttgccgagaagctgtctcagctgtcaatgggccccaacagggtgtcgggtttgggttccgagaggtttgctacagacctgaagtatcgaacccatgggaacactgtcaagcgccccttgcccgtggggtctagggcgtggcatggtccagccgaccccttccgtcgcccatacgagatgccaggtgatagggctctccttccaaggaagctcgtaagctgaagctgaagctccaagaaacagatccaatgctcgccctctttgagtgtcaccgctacttttcctcggctacttacctcagaataaaccaccaatctcctttgcagcagcggatgttgcccagcattgtctattaccgtgtgcctgtgagaataagaggcgtcctggttcatgcacccgatcgccctggtccctgggtccaagggctccagggttagttgtgcgcatggccgaatgtgtctccatgtgacattgtgttttatgctttgcgatgcgtgactggtttcagtatggtttcttttgtttgatcagtgggtttgtatggaatgtgacatgctctgttaaacacaattctaaatataaatattgcttgttcctc

SEQ ID NO: 14940 - DNA, 1912 bp, Sorghum bicolor
  Clone ID: SORBI-28MAY03-CLUS2639_1
cctactcgctctctctctctctctctcctctcatcctccgctcctcagcctaggcgttcacgccgtcgctagcgcctgccgcggcgaagcttctgccctccccgtcgccggggtctggtcgtcgtcggccaggaagatggctggtggcttcagggtactgcatctggtcaggccctttctggctttcttgccagaggtgcagagcgcggataggaagataccattcagagaaaaagttatctacaccgttatttctctcttcattttcctggtgtgcagccagctcccactctatggcattcattcgactactggagctgatcctttctactggatgcgtgttatccttgcatcaaaccgtggcactgtgatggagttgggtattactccaattgtgacctctgggatggtaatgcaacttcttgttggatccaagatcattgaagttgacaacagtgtgagagaggatcgtgctctgctgaatggcgcgcaaaagttgcttggtatcctgatcgctatcggggaagctgtggcatatgtcctgtctggaatgtatggcagtgtaagccaacttggaacagggaatgctattctcattatacttcagcttttctttgctggtatcattgtcatctgtctggatgaacttctccagaaaggttatggtttgggatctggcatttctctgttcattgctaccaatatctgtgagaatatcatctggaaggcatttagccccacaaccatcaacagtggtcgtggtgctgaatttgaaggggctgtcattgcactgttccatctgttgattacgagaactgataaagtccgtgctcttcgtgaggctttctaccgccagaaccttccaaatgtgaccaatttgcttgccaccgtcttggtcttcctcatagttatctatttccaaggcttccgtgttgtgcttccagtgagatcaaagaatgctcgtggccagcaaggctcatatccaattaagctgttctacacttcaaacatgcccatcattctgcactctgcactgattaccaacctctatttcatatcccagcttctctacaggaagtacagtggaaacttccttgttaaccttcttgggaagtggaaggagtctgaatactctggccattctgttcctgttggtggtcttgcttactatgtaactgccccatcaagtttggctgatgtccttgcaaatccattccatgcactgttttatgtggtcttcatgctgtcagcttgcgctctgttctcaaagacgtggattgaagtttctggttcatcagcaaaggatgttgcgaagcagctaaaggaacaacaaatggtgatgccaggccatcgtgagtcaaacttgcagaaggaactgaaccgttacatccccactgctgctgcatttggtggagtatgcatcggcgcgttgactgtcctggctgatttcatgggtgcaattggttcaggaactggtatactgctcgctgtgacaatcatatatcaatacttcgaaaccttcgagaaggaaagggcgacggagcttggtttctttgggttttgattagtagctgtggaaccttgactttggctatagctgaattttcttgtaagtccgctgtagtgcttagccagttgtaacttaaaagagtttttatgtttaggttgccttcttgcggccacaatcatgtagcagaatctgcgtgtgtttcaggttagtgtgggggtatgtgcatctgtccaaagaggcgtgctcatgtatccacaatcagtcatccgcagtctacagttcataggttaccctggcaaccggatgttttgtgatcaatttcagttacttttgaactgagcatgttcttatttttcaaaaaaaatttcgatctgttattacgaaccttctgggcgctttaaa

SEQ ID NO: 14941 - DNA, 2517 bp, Sorghum bicolor
  Clone ID: SORBI-28MAY03-CLUS3018_1
ccaggagcgccgcctcaagtccccccccgggcccaggcccgggccccgccccagcctcccccacggactcccgtcctccctcaccccgccgcccgcgcagttcaccaagccgagcgctcactgcgtgcccccgaacaagaatggcattgggccatcggttgtgcatgcggaggggtcatctacctcttccagtggtgtgacacagacaccggcgccggcaccggcgccggtgccggccgaagcttaatatgagccctaagtgacgccaagtttgggtcttagggctgtgttcaaggaggctgcttctcctgttcctaatgctggagcttctcaagttcaacagccatcaatgtacccatctgttgaggagttgctgttcccccgtaattcagtagacaaacctgtctgcaaagggaagactgatgctcaaagtaagggaaagtctgttatgtcctcacttacccaacctgccccttactctctacctactcatgccccacctccgccgcctccatgcatttcagaatggtcccgaccacgaagaagtttacaacacccatggcaatatgaagacaatgcaaaagccactagtgattctagatggcgcattccaatgtacaaaatgccctatgcaccacctcctccagcagtgccacctccaggctatggaccttctccacattttccttatccaggccgcctcttgtcttcgggacatccatacggagatcttgctggtaacatggaaaactcagcacaacgtagtctgcatagatggattcagtgtgatggttgtggagtgcaaccaattgttggtccgcgttataaatctaatgtgaaggaagactatgatttatgtgattcctgtttccaacgcatgggaaatgaaatggagtacaccaaaatagacaaacctatttcaccccacaagtttctcagagatcctcatgcgacccgaaaggtgcaccacacacgggttctaatgaagtcaaaacgggagaaacttgaaagtcgcttcattttggatgtaactgtccttgatgggacactgatgacaccttctacctcgttcactaagatttggcgcatgcataacaatgggtctgttgtgtggccacttggcacacagcttatctgggttggtggagatcagtttgcattgcagtcatctgttccgttagagattcctgtggatggctttcctgtggacaaagagattgatgttgctgttgattttgtggcacctagaaggccagggagatacatatcatactggaggttggcttcaccttctggtcagaaatttggtcagcgagtttgggttcatatccaggtggaagacccttcttttgttaatgacaataacaggagtgctgctattaatctgaacctgcctccagagagcaatagtgcaaacacaaccaatttaattgatgtgaacattgagcctgttgactcagcccttactgccaaacgcacaaaagagttccatttctgttcaactgatgtttctgggcccaagaaatctctgcctgccacgttggttgctacctcttcgtctgcagcagctcctgcaaacccaaccggtgatgttcccatgtccagtgcacctgctgctgcttttgtgccctctgttaatgtgcctatgcctgaagttgtaactcatacaccatcacctgctatgcccgtgctgcctacaactatacctatgtcagctccagtatctgcgcctgcaattgcccctgtgtctgcatctggggctgtgcctgcgcctccacctgttagtgccgtggttcctgagctgtccgacctagatgttcacaatgaggagaagttgctgagggagctggaggaaatgggctttaggcagatcgatctcaacaaagaaatccttaggcagaacaattacaacctggagcagtctgttgatgacctatgtggcgtcaatgaatgggatccactccttgcagagttggaagagatgggatttgatgacacagaggtgaacaaggagctgcttgcgaagaacggaggaagcatcaagcgagctgtgatggacctgattgccagggagaaaaaggacaagtgaagatcgtgtgccagtgtgcgctgtgtgcacatagctatctagacctagtatatatgggtaaataatgagacggctgtgccattgtggtgcagccctagtgcgtctcagagcttgcttatggtgaactgttcgtgcttgcgtgtggtgtcgatgaactctagtatgtgcgcgtgtgcctcagcatttctttatgtgtctgtcgtgcgtgcggtgtcgatgaactctagtatgtgcgctcgtgcgcctcagtagtaaaccttggcatgccccaggtatactgcttctgcttgtatgatatgatgcgtggaccaatgtttgatgcttgtgctctcgcccttataatgtattcccttcattccaaattacaaccgttccaaattataggatattctaagagttttgaagagtcaaagatattaaataaatat

SEQ ID NO: 14942 - DNA, 362 bp, Sorghum bicolor
  Clone ID: LIB3481-017-P1-K1-B10
cgtccgcggtgattgaaggtaagtatcctcgagttttagggaggtgtcgttgaacttgtacccggtgcccagtacagaggactaattctggcgtgctaggctgagaaccaccttatgtgcctgacaatgttgcagtaaagctttagttcaaaaaagtgtttcttcttccagtcctgacatggagcattgggggatttttcgccccggttgaatgatcctgagtttgtaaaacaactggtgaggtgtaagcgtttgtccagaaacatgtttttttctcccatctcttctgccccttccatagctccatatgcttccatgtgtacattgaactaaaagaaaccggcatgttggaatcatgaaaa

SEQ ID NO: 14943 - DNA, 1208 bp, Sorghum bicolor
  Clone ID: SORBI-28MAY03-CLUS678_1
gtggcggccgctcgacgtgcgccggccggggccgggattcatcacaccaacaatccacacaagcagttgaacgcactgcgcacaggcactagaacaaacaccaagcatcaccattcaccaatggcctacttccaggaggtggactactgctcggaggaggtgaggtcggtggccccggccggcggcttcggccgctacggcggcggcgtccagcagcacgtcgtcaaggagaaattcgaggaggtcgacacggtgtcacgcgccggcggccaccaccacggccacggtcaccacggccacggcgtcgtggtgcgcgagaccagggtcgaggaggacttcaacacctgcaccggcgagttccacgagcgcaaggagagcttcctcgccagggctaactgagccgccggccgcacgaccgtaccatgcgcgcccccgttcgtgccttatgtatgtatgtgcgtataagattgtgcagggtcatcgtacttggctggcgtgcacgcactcagcttctgtaagaattacgacaataagctcgtgacctgaataaagcttctccgtaccacctaaaaaaaaaaaaaaaaaaaaaaaaaaaaaacctaccccttcatgacagcagaggatgcacaggctgcattggaggctttggatggagtggaactggaagggaggccacttcgacttagtctggcggaacagaatccaccacctggttccccgcctagtaatgcgcaggcacagcaggaagaaacagattcgggcgcatctgatgcagagacggaagcagtcagttcttcagaattatctgaagcagagttggacgagaacaacttgcagacagctgcaacttattaataagcaggagccacgggttatatattgacttctaagttctgccattcaagtccaaggtgtactgataggagcaaaaattttgacaagtgatgctgtagcaaggattcagcatttgagctatataatgtattagatattaggaactaccgtatttgtgtaatgagttctgcaaaatatgatctgaattataattgtgtagccttccgcttactgtaaactgatccttttcaaatgttctattttgttagtgcctggtcaactcataggttttatttgtttggccatttttcaaatgaactagagcaatacaagaggtataaactatttcaattgacgtttgaaagatgtaatca

SEQ ID NO: 14944 - DNA, 741 bp, Sorghum bicolor
  Clone ID: SORBI-28MAY03-CLUS33751_1
ggtcgtcgtcgcagcgccgggagcgggagcacggcaggagggagtggggcggcagagaggaagaggaggaggaaggtggccgcgggcacaagtcaagaagctacaggcaggtgaagtcccgcgtcagagagggctccgtcatcgtgatcccggcggggcacccgaccgcgctggtcgccggcgagaacagcaacctcgccgtcctctgcttcgaagtgaacgccaacttcgacgagaaggtgttcctggctggcaggaacagcgcgctgaagcagatggatgggccggcgaagctgctggcgttcggggcggacgaggaggaggtggtggaccgtgtcatcggagcgcagaaggatgccgtcttcctgcgcgggccccagagccgcagggtctcgtcggcgtaactgtatgcacgcgatgtagttagcggccgctcgtcggcgtcgacggtcgtggccaccccggtggtctggtgaggttagagtcgaataaagtagctggctcgccggcgtcgcctcgtgtatgtacgtctccagcggagggtgacgctcgggccctgtgtgcgcgcggcggcgcaggcatgtctgtacgggaagtcgggaatatgtaatcgtctatctacctacctatgctgctatgcaggtgaaataatgttgtttgagacatgctatctgctcttggaaaatgcagaggcactcgaggttcggaaaccctgcaaacaccccgcgaagaataggatta

SEQ ID NO: 14945 - DNA, 1956 bp, Sorghum bicolor
  Clone ID: SORBI-28MAY03-CLUS54_1
aaaaaaaaaaaaaaaaaaacacactcaacacagcagctcaaaactttagccagagctagcgcaagaaatggctccactactgcttcatgcttctgccataagtcacagtgcccatccagggcttagaagccatataggacccaacaatgagcatatctcacggcacctatcttcttcatcacaaaatactaagcgaaggtgcaacattagccttagatcacgagctcaaaggataagcagtcagcttggaggccagaagctcgagcactgggaaatccctaaaagggactggttccctcctagctttacctttggtgccgccacttcagcattccaaatcgaaggtggttggaatgaagatggaaagggtccaagcacttgggatcacttctgccacacttatccggattttatagccgacaagagcaatggggacgttgcagcggattcctaccatctctatgaagaggatgtaaaattgctcaaggaaatgggcatggacgcctataggttctcaatctcttggcccagaatattgccaaacgggacactcagtgacattaatgaaaaaggcatcgcctactacaataatctgatcaacttgttgatagacaacggcatagagccatatgtaacaattttccactgggacacgcctcaagcactggtagatgactacggcggcttcttagataagagaattataaaagattacacagacttcgctggactgtgctttgaacgattcggtgacagggtgaacaattggttaacctttaacgagccacatacatttacatgtttatcctacggaaccgggatccttgcccctggacggtgctcaccaggaatgaaatgtcccgacccaactggggactcaatcagagagccataccttgttggccacaatcttcttctagctcatgctgagactgttgatctttacaacaagtttcataggggtgagaaggggcgcatagggcttgcgcttaatgtaatggggactgtgccatatggaagtacgtttctcgatgaacaagcccatgaaaggtgtatggactacaacctaggatggtacttggagccagtggttcgtggtgactacccccattccatgagatcatcggtgagggataggctaccccacttcacagaaaaagagcaacagaagctagtgggttcctatgacatgatagggatcaactactactcctcaaggttcgccaagcacgttgacatcacagaaaatttctcgccagagctcaacacgcatgactgctgtgccactgaagaaattacagggcctaacgggaatactattggtcctgctactggaaatgcgtgggtctacctgtaccctaaaggcctaaaggatatccttatgatcatgaagaagagatacggaaatccaccggtctacatcactgaaaacgggattggggatattgacaatggcgatctatccatggaagctgcgttggacgaccacataaggctagattaccttcagcgccacatctcagtccttaaagattcaatagattccggagcgaacgtgcgtggtcacttcacatggtctctgttggacaacttcgagtggtctagtggctacaccgagcgtttcggcatcgtctacgtcgatcgtgagaatggctgcaagcgcaccctgaagcggtcagcaaggtggctgaaagagttcaacggagctgcaaaaaggcctggaaatctgattaagccaaatttcagcgaaataaataagatcaaagttgttacaccagcttagaacactggctgatgtttacccgtagtatttttcatctcaaactacaaaacaatttatgtctatgtaatcgatgttattattttaatttcatgtttatgaattttgtttggtactccaaataacctcgactgaaaaaaaaacctgcaaagttatagatttctttaagtactacc

SEQ ID NO: 14946 - DNA, 1970 bp, Sorghum bicolor
  Clone ID: SORBI-28MAY03-CLUS1753_1
tctcggcctaccaacagccaatccgcacctcgcgtcctcgcctcttgcgttgtcctcgccgcgcgcggcctcgtcgccctgatccggttccccccaatccttcttcgcctttgtcgtcgagcccaaattgagccaagcgaagccgtgatccggtccatgcgcggagcgtggtagccggattctctcgccgtcgtcgcctccccttcgccgccgccgccgccgtttctggtcgctgggatcagccgagttggatctcgaggcataaagcgttgcgggcgcccggcgaggatacgatgcctgcggtgctcgccgcattcgctaccctccgagcggccgctgccatcgcctccggggactccgccttcccctgttcccatcgcctcaagcatcgttttagtagtaattttagtagtagtagtagtagtaattgtctttgacctttccgttccctacgtcgcccacacctctttaccttcgcgtccgggtttcgatttggtttgctcgacccgaggcttcctttggccttgcggcttctctcggtgtcatagtttggtgtctggattcgatctgcaggatcggaaggaaggaaggtgttggacgtggtaattaccacctacaagataagagaaacttctctttgtaatttgggatcaagcttgtggatgggcgaaccctcggcggacttcagtgctgaaggtgttagcagcagctcaggtctctgccacagcacctgtttaaagcctggttgcgagcacggttgtgcttgctgggaagatgaatatgttgaagctgtaatatcttctgggcaagatgatttggcggttgaggaaattggaatggctcttactgaagtgatgcatgccaatgatgacgaagaagggccaggtctggatgaagattctgacaacgatgtcattgatgacccaattctttctctggaatctgattcaactgatgatttagtggacgtggactctgtatcacccgcctttcctagtggtgatggtgatgcaatggaatcatcaattgacaattcagttgctgggaattcttcaattaatggcactccaaggttagtttctgcaatgaaaggaacccgtgcgaagaagggaatcattgcaaagttgagtgtttcatgggcccctgatgtatatgaccctcctattacttctgactctcacactgtgagagggcaccataggagttcaatgaagagcaactacaaatacaagtcctccaagagcagtagccgcagtaccacgggaagcaaaaaggacaagaagcattctaggcacagtagcagcagtggtggcggcagcaaaagggacaggaagcattcttcccacagtaccagtagtgccagcagcagcagagctgttaccagtggttctcaatatcgtaacacatactgtggtgacgggatcagcagcagcagaactgtgacatgtgttcctgagtctgccaaggtatctccattggtgttagctgaaaatgccgcaccgcaagagccggttcctgtactcaagacactggaaccaatcaaatgtgctaccagctgcagcaaagagaagccatttgccttactgtcacgccagttttctcctgcaaggtacaaggggatgttttccttttggagccaaaaccaactggcttcttgataatctgctatacggaagctcacctggaagtcttcgttgctaattatgtcgtatcagtgattgtttggtatcattcccttcgttaccatgtttgtttcgcctgtgtctgaaacttcagaggtcacgttttccaaagttgcccggcaaagtgcctgtatatttgagtttccgttattattatttcctcactgaatcgtgtaattcttttatctgtttcatgtgtttggtactgttccatttgtgatcgtgttgtattatttgcacatttactcctacattgctgggactggttcagtcttctgtgttttggtt

SEQ ID NO: 14947 - DNA, 373 bp, Sorghum bicolor
  Clone ID: SORBI-28MAY03-CLUS727_7
gtcgctcgcagcaagccccgccccaacaaattcccccacgctgaccaggtaccctgggagctcggcctgaagctgcgccagaatgtgatgaaattattatagatacaaccatggatatgactcaggttctactagatgctcaatcttgagatgctaaccttcgaacagtagcagaaagcaacctcacacagttccaggagcagaagctttaagctacgctcaactgtctatgtgactcagatttgatgtactactttctcaacttgggtagcagcaacaataaggtctgaagctttctctacaagtacctgcacatgattttgctgtgatcttagtggcaaattgttgtgatcttcactgaacagaaatgaca

SEQ ID NO: 14948 - DNA, 1466 bp, Sorghum bicolor
  Clone ID: SORBI-28MAY03-CLUS727_1
gcacaaggcattcccaaactcttcacttcccgtctcctcccgatgccagacgccaggggcgacgagatggcgacggcgccgacgccggccgcgagcggctccccgcgggcgccctcctcctcctctgcctcttcatctgcctcctcctcctcctcttcccgtcctcctcctccgtcgttcctcatgtgctcctgtgctacaggaaaccctaggtgcttctgctcgaggaccccagctgcgcgtgccctcttcctttgcgccggtggttcagctccgcagctggatgtggcggttgctggcccctccacccagggttctgcagcagcggcggcgacgccgagtcatcccctcctcccttgtctatcagtgcgcacagcctcagtctcccggtgcaaacaggctcgatgcacgaatgtcagctgtttttgcctagctacactactgatcctagagtctattgcgatcccaaacaatgtgtctgctgagttattatcacagatatttcaatctaaaacattcattgaccaaagcccttcttatgcctcaacatcttggctaattctggcgaaaccgtcaatatatttaaggcattgtaattgaaaaaaaaaactgttcttcagaattttacatgaaaagaggtaactgaccccgatctactacaatacaaaggctaggggtatcagaaaatgaaccaatgcaaacgacatcatctgctcccggaccgccagggacacactgcagtcgctcataagctacgcaagtatgagctgagaagcatcaagtcatctgaatcttgcctgctttacattaattaatacaatattgtataatgttcaggttcgactataagctctatcttgcgtctctaaccgcctaacatttgtaggaagcaatcgcatgctgtcccagtattataatcttttctgtatgttgaactgtctcttaggatctgattttctgcagtcctttctcaacttgtgtctcaggtacaataagctgtgagccatttactacgagtacatgcataaagctttaatttgatcttaaacggaaagtgatgtgatctttactgcacagaaatgtcagctttgaagcttgtggttaacagtgaaccaagtatagtactgttttcgtgtatttgggtgaattaggagtcaagtactgatgttcccagtcatcctttccactgatgtacagctagtagtgagtcccggactgctgttttctgcgtttggcattaagtttcaccacaaagaggtgcaagtactgcttagtttacaataagattggagtgccctgcttttcgatgcttaaaaagatagaaacacgaatagagtgcaattattttcttttctttaccatgagtagaactattactttcaacatgtgtgatgacaaatcttatatccatgtaaccatcttttgaccatttacgatgccatttttttgaatcatgatgtgtagcc

SEQ ID NO: 14949 - DNA, 579 bp, Sorghum bicolor
  unsure (1)..(579): unsure at all n locations
  Clone ID: LIB3481-031-P1-K1-F2
cgtccgcgcacagatacattggttgatttagggcttgtttgaatgagtttcagattcttaaaaaccagttgttgcctctagtttctaaaatctagatcctgagcaaaaactggtggggtatttggatcccctagttgaatctggcttcatttattgctcacaaggtcacaagaaagtggcaaaagctgggtatcaacagcttcttgatttttaagaatctaacaaaaattgacacaagaaactgggcaaaaactagcctgtttgcatcctacccaattttcaaaaacccagattcttaaaaactggagggatccaaaccggaccttagctgtttagtgataatcttggattgttgatgaggctaagcaaatattatggatatatgtgctttaatatggatgaaaaatttgcatacagtgctttaagctacgctcaactgtctgtgtgactgacctttagtaatatgcactactgatgtatttatgtngctggtgattttctgtgattccttgctgactcaggttctactagatgctcaatctcgagatgctaaccttcgaacagtagcagaaagcaacc

SEQ ID NO: 14950 - DNA, 649 bp, Sorghum bicolor
  Clone ID: LIB3481-043-Q6-K1-H9
gcgtccggaaaaaatatgagattgtctttgttgctcagcacaaagttgtggtctattggattgcgattggtgttgtgctttgataatgatgccaatgcctttgtcatactaattttgtagttgtcagcaaataggatgcacgaagatcagctttttttgcctagctacactactgatccaagagtctattgcgttcccataccatgtgtctgatgagtcattatcagagccatgtcaatgtaaaagcttcattgatcagggcccttctcatggtacaacatggtggctgtttttggggtcacctttgaagccttacaggaatgcgtctatggatttatgccagtgcgaagtggggtcggcaaggtcttcaggatgggatatggattgttgtaaatgatccttatagcaacaaatatgatgatgtgaaattgcctgataagaaacctgctagttcactcttcctattcacgaagttgtatggcttcactctatgtccttattgcctgctagatgaacagtgtcgcaagatattgtcatctgcctgcgattccacaataatgcttctgtcactacccacagttccctgtttccactgatattaagtaggaaggcttctatatatctcaaactggaacagaatggaattgta

SEQ ID NO: 14951 - DNA, 436 bp, Sorghum bicolor
  Clone ID: LIB3476-011-P1-K1-C7
actaagagcgttgattactattctctttaaatcatttgttgttgttctatatacctactacatttgtatgctattcctgctactaattgtcaccaaatgggctcccttttgctatagcagttgtatggcttcactctatgtccttattgcctgctagatgaacaggtatttcattctacaatttaagtagtgcatctctgttacttgtcttcaatgtttaaatttcacggtctatgtgggtaacaggtcacaaggtaatggctgtattgtggttaatttacatgatttagtaggtgcactaaataacttcttctatgctattagtgtcgcaagatattgtcatctgcctgcgattccacaataatgcttctgtcactacccacagttccctgtttccactgatattaagtaggaaggcttctatatatctcaaact

SEQ ID NO: 14952 - DNA, 753 bp, Sorghum bicolor
  unsure (1)..(753): unsure at all n locations
  Clone ID: LIB5049-006-R1-XP1-G8
tcgaggccggccgggccgggacggtagggccacggcgccctctcctgcatcgcttagcgctcgtctctgcctaggcggcggcgaccagatcgacggccctgcgcaggcggtgcaccggcgtcctcctcctgcatctcctcctccacttcctccctctccctctccctctccctctccctctctgcggcctctcccggaacggcgcctcaacctggatgtccggcaaactctgcagcagcatcgccgacctagggttccgtcctctgtgtcaccgaccatcttggatcggctggaccctggcgcaagggcggcgctagccgccttggtgcaggtgacgcggacgacaaaggccaccaccgcgtcctcgcggctagtcacccagggttccgcggccgtagcggctgcacagggtcatccctcgttccccttctctcctactgcacaaagctcatccaccaggatacaaccatggatatgactcaggttctactagatgctcaatctcgagatgctaaccttcgaacagtagcagaaagcaacctcacacagttccaggagcagaagctttaagctacgctcaactgtctatgtgactcagatttgatgtactactttctcaacttgggtagcagcaacaataaggtctgaagctttctctacaagtacctgcacatgattttgctgtgatcttagtggcaaattgttgtgatcttcactgaacagaaatgacagtggtgntgctagtggttgcct

SEQ ID NO: 14953 - DNA, 420 bp, Sorghum bicolor
  Clone ID: LIB3480-006-P1-K1-G6
tgggatgaaagacaacaagctaggacaatagatgttgagttcttatcaaccactttgcttgcacaattcttcttcgaaacatgataacctgttgtcagcaaataggatgcacgaagatcagctttttttgcctagctacactactgatccaagagtctattgcgttcccataccatgtgtctgatgagtcattatcagagccatgtcaatgtaaaagcttcattgatcagggcccttctcatggtacaacatggtggctgtttttggggaatgcgtctatggatttatgccagtgcgaagtggggtcggcaaggtcttcaggatgggatatggattgttgtaaatgatccttatagcaacaaatatgatgatgtgaaattgcctgataagaaacctgctagttcactcttcctattcacg

SEQ ID NO: 14954 - DNA, 743 bp, Sorghum bicolor
  unsure (1)..(743): unsure at all n locations
  Clone ID: LIB5048-008-R1-XP1-D10
ccgggtaaaccacccaccctctgctcttcccaaccgccccgaaccctagcctcccttccgcgccgccgcaaccccgcgccgccggtccggatctcttgggctcgcgtgcggcggggatccgtccaggctcggattgatttctcctctgcgcggaggctccagacttcgatctactgcctcaaaaagagtagggagataagacaatgttgcagtgcaaacgactgcatcagctcctggaccgacaaaggcaaaatgcagccgctcattaaccaaaatactaacagagcagcatcaagccattagcagctaggcagttaatatagactaccaagtatataaagcacctggcagcgcatataatatatgtgcctatataccatcttgaatgtgtaatatacacattctgaatatatatgtgatacaaccatggatatcactcaggtactactttctcaacttgggtagtagcaacaataaggtctgaagctttctcttcaagtacctgcacatgattttgttgtgatcttagtggtagaaatgacagtgatgttgctggtggttgcctgtggccctagtttagtagtgttgttgtgaatttggttgagttgtgagtcaagtactgatgtccctagttatcatgctactgatgtncagttagttgtgagtcaagtactgatgtaagtgagttatgcaataacttatggtgccactttgtgggatcttttagtcattttcatggtatt

SEQ ID NO: 14955 - DNA, 543 bp, Sorghum bicolor
  Clone ID: LIB3478-038-P1-K1-D7
cccagatcttcctccctcaggttcaacgctggccaccgaccccaggtcttctacacctgatctgcacggtaggccacggcgccctctcctgcatcgcttggcgctcgtctctgcctaggcggtggcgaccagatcgacggccctgcgcaggcggtgcaccggcgtcctcctcctgcatctcctcctccacttcctccctctccctctccctctctgcggcctctcccgaaacggcacctcaacctggatgtacggcaaactctgcaacagcatcgccgacctagggttccgtcctccgtgtcaccggccatcttggatcggctggaccctggcacaagggcggcgctggccgctttggtgcaggtgacgcggacgacgaaggccaccaccgcgtcctcgcggctagtcacccagggttccgcggccgtagcggctgcacagggtcatccctcgttccccttctctcgtactgcacaaagctcatccaccagattatagtgttggttattcccctaaaaatataaatctcaaccttgttttaaa

SEQ ID NO: 14956 - DNA, 244 bp, Sorghum bicolor
  unsure (1)..(244): unsure at all n locations
  Clone ID: LIB3476-048-P1-K1-E2
caggtcttctacacctgatctacacggtagggccacggcgccctctcctgcatcgcttggcgctcgtctctgcctaggcggcggcgacgcagatcgacggccctgcgcaggcggtgcaccggcgtcctcctnctgcatctnctnctncacttnctccctctccctctccctctccctgtccctctctgcggcctttcccggaacggcgcctcaacctggatgtccggcaaactctgcagcagca

SEQ ID NO: 14957 - DNA, 2336 bp, Sorghum bicolor
  Clone ID: SORBI-28MAY03-CLUS3103_1
tctcgaggctctcgcctgcccagtgtgcgcactccctccctccctctctctcggtttctccctcttggcgacgactgggcggccgacaggccgtcgccgccgccctacgccaggttccgaggtcttcatcgggcccttctccggcgacgagcaccacagggtgacaaggatagctttctcaggtcagtgaaggaagacatcttcttgccgcggtagagctcctgacggttgctgggttgtgctacaagtatctaggggtggatttggactgggagatggtatactgaaggaaaactcaaaagtctcaagtgagcttgcttcaagatggatgaaggccagggagttaggtattggtgccacaggtgtgaggaggtgatagatcctatgcctgagatgaagtgcccaagctgtgacggtgggtttgttgaagagatgggctctgaagacttcgaggcagctacgaacgcaaggtctgatcgctccctctctctcttggctccactgctgtttggtatgttggggggtttcgtcccgcagatcaagacgctggagggacgccatggctgacgctagtgctgatgaggatgacgaagaggatgattcagaccatgagcttgaagcttcctccaaggatccagggacagagtgcagtgcgtcccagctgcggatgctccagactatccgtgaccgtgatgacgtaaggggctcggatgacactgacagtgatacagagagagacctggagagagcgagaagggagaggatcgagaggcggatggcgagggagaggattcaggagcggatggagaggcagagagagagggcaaggcaaattgagagagtgagtgctcgtggcagagagaggacagaaagcctaatactgatcaactccaacaatgaggctattattctgcaaggaacatttggatctgatgacaatcaagaggactcaagcaacacaagttctggtgtatcacttggggattactttcttggtcctgccctagatactctcttgcagcgtttggcggagagtgacctcaatcgttctggcacaccacctgccaagaaggaagcagtagctgcgctgccaactgtgaacatcgaggaagtgttgggctgttcagtctgtcttgaggattttgagatgggagcagaagcaaagcagatgccctgtcagcataagttccactcccattgcatacttccatggctggagctccacagttcttgcccaatctgtcgatttcagttgcctactgaggagacgaagaatccatgtgaatcagccagcactgcaggggccatgaacagagatggagacaatgctgctgcaagcagtagtgatacagaaagtagtaaccgcaatggagacaaccattctgatagtcctatcttctctgctctgagcacactcttctctgatccattctcatctgatgatgatgaaagtgttccacactcatctgagaactgaagacagcgttggatgcaagcttgcaatatggtgaaggtgttctgaaatatgaggctggcatctttatattgtagtttctgtacatatctctgaatggtcgcccccccagaagacaaactattatcttcgctttcctgaaaactatgtggcttgtaatctgctagtgcttgttatgtttacttgcctcaaataaatgttagcctccagcgtgcttaccatctccggaagacttagacatgcatgtggacgccaatttggttgacagtatggccaatgtaaggcaacccctccactagctgttatggcgtatgtatgcagtgactttgcgtcttatattttaactgtctatgagaactccttagaagatggctggaaaatttctgtgaaggcaaataccatccaatggtcctcattccacagtccgttgtatttttgagtggatgcaacgttgcaggtgctgcctcatgtggtcctgaatgtcacccctgaggttgaggatatctgccaggttcaagtgcattcgtgttggtattttgatccaaggagatcacgtaaacagcatttgccatcgtaccagttgggtgacagctgagatgttgtcatgcttatcagttccttggaactattgcccgagcaagaatcccgcttgctgtttattttgatggtgtgatcatgtggtaggtgcgggtttgatgtctggttctccactctctgttgttgttctgcttggttggtggtttggccctgtttggtaggcatcgaacttggagtgttttgatttgccacgccttgattatcaggcaggcatggctggattcgtaggtaaatgcaactttcgaattttgggaatttcatgctg

SEQ ID NO: 14958 - DNA, 522 bp, Sorghum bicolor
  Clone ID: LIB5050-005-R1-XP1-H1
ctgcggtcccgtatcgtttcctcctcctcctcctcctctcttttccccttcgcttcgggccccctgcctggcttggcgtctaccaggcgcgacgcggaccgaatcctcctcctaaggccgacggccgccgccgccgtcgtcggtgctcgctgcccgccccccgccgccggctcctgttggacacggtaaatctccttcctcttcgtccatgtcgccggggtcggggtcggggtccaaggggccgcgtggtgtcgccggcggcgccgatctgggcgtcgcctgcgttgaccccgcccgattcgccccgggctgatgctgggctccgctaccggcgcctccgtgaccgattactggggatttctactcgcctgtgggatcctcgagcggatcagctgagcacatcgacttcagcaccatgcttttgggcgggagaagcgaatcctagagctttcctggatttttcgagggctcttctcagatgtggagtcctctacctccagagtctacccacatactgtttga

SEQ ID NO: 14959 - DNA, 1875 bp, Sorghum bicolor
  Clone ID: SORBI-28MAY03-CLUS3120_1
gctgcggcgctcgcgccggccgggccgggaatcctcataccgcgacgcctcctctcgccctccgagcaactcgaaaccctaggagcgtgcggaccggcggcggcggcgaggtgttggcgatggacccggacgcggtggcgaaggccttcgtggatcactactaccagacgttcgacaccaaccgcccggcgctggtggggctgtaccaggagacctccatgctcaccttcgagggccataagttccagggccccgccgccattgccggcaagctcggatctctccccttccaggcctgccagcacaagatcgacaccgtcgactgccagccgtcgggaccccagggaggcgtgctcgtcttcgtctccggctccatccgcaccggccccgaggatcaccccctcaagttctcccaggcattccatttgctgccggcagctgggtcattcttcgtgcagaatgacatgttccgcctgaactatggctgaagacagccgaaaactcttgtgatgaatggattggttaagggtttcatgttgaaatgattaatacttaatgttgccgctactcttgtctcctttgtatctcctttgttggctgcttcactgtattacaagaaattgctagactttgtatgcctgcgttggactattgcagttgttttgaaccatgtactatggtcgcatgggcaccatttctttgtgcaatgtgaactgaaacggtccagatttgctggtgtgaaggatatctggtttgcccttccacggtgaggacaaaaatctcatagctacatcagagcagccattatgtgcttatcacctaggtgatcgaatctaccctgctgaacttccaattaaatatgctgggtactctacatgcttccggaaggaagctggttctcatggaagggacacagctggcatcttcagagttcaccaatttgaaaaaattgaacaattctgcattacaagcccaaatggcaatgattcctgggagatgcatgaagagatgttaaaaaattcagaagacttctataaagagattggactaccataccaagttgtttccattgtctctggtgctcttaatgatgctgctgctaagaaatatgatttggaagcttggttccccgcatcaaagaccttccgagagttggtgtcctgttcaaactgcactgactttcagtcaaggagacttggaattgggtatggccagaaaaagaatgatgagcagtccaagcagtttgttcatatgctgaactccaccttgactgccactgagaggacactctgctgtattctggagaatttccaaaaggaggatggtgtcgaggtgccgaaggcactgcaaccttatatgggtggaatagagttccttcctttcaagcaacctttggatgtcaaacaagctgctgactccaaatcaaacaagtccaaatcaaagggaaaggcaccttgagctggatgaggaacatactggaaacgcaaatgcacgtgatggtggaactgttggatattgtgcatccttatgttaatttttgggcctgtcagtactcatagcatgactgtggagttgcaggttttggttttacccattttggtttcttggttaccacattatctgatgtacttgccatacttatattgcataggatttcttgatatttgaccaccaccatccctacctgctgtgtttattatcgcgttaccacagaccactgcctgttcgtccccgaaaccaccaggttgtcttttgtagcacgattagtaccggtatgctggtgcattgacttttcttttttgaatgatgctggtggattgatgtacacttcctatcgattctcaaaaagcattttgtgttagcggcatattatgg

SEQ ID NO: 14960 - DNA, 1855 bp, Sorghum bicolor
  Clone ID: SORBI-28MAY03-CLUS56_1
cctactggatcgcctcttctggcagacggccaacaacaaacaaaacagagagagccacacaccccacctacccccaccccggcggccgggctccacgctcctccagcatggacctcgtgctcctggagaaggccctgctgggcctgttcgcggcggcggtgctcgctgtcgccgtggcgaagctaaccggcaagcgctaccgcctgccccctggccccgcgggcgcccccgtggtgggcaactggctgcaggtcggcgacgacctcaaccaccgcaacctgatgtccctcgccaagcggttcggcgacatcttcctcctccggatgggcgtccgcaacctggtggtggtctccaccccggagctcgccaaggaggtgctccacacgcagggcgtggagttcggctcccgcacccgcaacgtcgtcttcgacatcttcacggggaaaggccaggacatggtgttcaccgtgtacggcgaccactggcggaagatgcggcggatcatgacggtgcccttcttcaccaacaaggtggtggcgcagaaccgcgtcgggtgggaggaggaggcccgcctcgtggtggaggacgtgaggaaggacccgcgcgccgccgccgagggcgtcgtgatccggaggcggctgcagctcatgatgtacaacgacatgttccgcatcatgttcgacacaaggtttgagagcgagcaggatccgctcttcaacaagctcaaggcgctcaacgccgagaggagccgactgtcgcagagcttcgagtacaactacggtgacttcatccccgtcctccgcccgttcctccgtggctacctcaaccgctgccatgacctcaagacgcgccgcatgaaggtgtttgaggacaacttcgtccaggaacgcaagaaggtgatggctcagactggtgagatccggtgcgccatggaccacatcctcgaggccgagaggaaaggcgagatcaaccatgacaacgtcctctacatcgttgagaacatcaacgtcgcagcgatcgagacgacactgtggtcgatcgagtggggcatcgcggagctggtgaaccacccggccatccagtccaagctccgggaggagatggactcggtgctgggcgccggcgtgcctgtgacggagccggacctcgagcgcctcccctacctccaggccatcgtcaaggagacgctccgcctgcgcatggccatcccgctgctggtgccccacatgaacctcaacgacggcaagctcgccggctacgacatccccgccgagtccaagatcctcgtcaacgcctggttcctcgccaacgaccccaagaggtgggtgcggcccgacgagttccggcccgagcgcttcctggaggaggagaagaccgtggaggcacacggcaacgacttccgcttcgtgcccttcggcgtcggccgccggagctgccccgggatcatcctcgcgctgcctatcatcggcatcaccctgggcaggctggtgcagaacttccagctgctgccgccgccggggcaggacaagatcgacaccacggagaagcccggccagttcagcaaccagatcgctaagcatgccacaatcgtctgcaagcccctcgaggcctagatcaatgcgcacgcgccccgcagatccagcactctatgtattttgtctttttcttttgtgtttttatgtgtcggctctggagtctagagtgaagatgggggtacatgtggctgaggtatgatggcgtagattcacttaatggtgttctcgaaaacttatccatattttatagtgttgtaaacttgaatttagaggctgtttggtttcaggttttcagcatgtcatcgataaatgggctatgt

SEQ ID NO: 14961 - DNA, 1574 bp, Sorghum bicolor
  Clone ID: SORBI-28MAY03-CLUS14782_1
gcacgaggctcctctcccctcctctcaagttgcgctcgagctctgcttcttcggttccaaggagcggcggccattgctgctggtaaagccgacgccctccctcgtggcttttttccaaatcaggcttgttcttgacgcggttcgcgatccgattctttcggctccctttcactcgattcctttttccccaaaacacaacgtaataatcctccactgcggtcgctcctctcccctcctctcaagttgcgctcgagctctgcttcttcggttccaaggagcggcggccattgctgctgttttgccacgtaggcagattgatggcgatggagggacctgttctatgccgtcctgcaatgcaagccaaactgccggctgctgctgcgctggtcaacaactccctgaccaaatccgggcagctcgggactgcattgtttggtgctatttcgaagtacaggaacatttcaagattcatttctcccatctcccagccatctacgaagaacataggtccatgctgcagcttcagctcgtcttctgatggcaatggatacatggctggaaactttagcgagagtgatgaagattatgttaattctaccgtgctagaagcagttgaggtgagaagtggatcagaaggatatgtaataaagatgcgagatgggaaaaacttgcgatgtgtccataacaattctcaagggagaaatattccagagagtgcaccccaacctgctattgttttgaggattgaagatggaagtgaaactttacttccaatcattgttttggagatgccaagcgtacttctgatggcagctattcgtaatgtccacattgcacgaccgaccatatatcaagttgtcaaggaaatgattgataaaatgggctatgaggtaaaacttgttcgggtaaacaaaagaattcaagaagcctattgtgctgaactttatctaacaaagattgatgatcctacagacagcatcaccttcgatcttcggccttcagatgccataaacattgctgttcgttgcaaggttcctgtacaagtccatagaagtcttgcatacagtgatggcatcagaccagtcgagccagcaagaatggcagtagcagctggcctatcagatgggttgttatttacagagcttgacagacctgatggacagccatgtgtggaggctcaagagtttggattggtgaggaacatgctcattgcagccgtcgaagagagatacaaggatgctgcatcatggaaggacaaacttatgcggctgaggtctaagcggaagaactgggcctgacagtgttgcatgtctggatggtgtaaataaagatgatgccaagctgaattccagtatgcattccagataattgatactggttatggctctatgtaactagctgtacatattgtatggacctaagaatggtcttctgtaaattcagactaagctttgaagtgaaacactaatccttggaaaatttggtatcttagccgtgttcatttgtatgtcagtctgttactttgaagtgaaacactaatccttgggaaaatttggtttcttagccgtgttcat

SEQ ID NO: 14962 - DNA, 770 bp, Sorghum bicolor
  unsure (1)..(770): unsure at all n locations
  Clone ID: LIB5049-003-R1-XP1-C7
gccggccgggccgggaccaaacacaacgtaataatcctccactgcggtcgctcctctcccctcctctcaagttgcgctcgagctctgcttcttcggttccaaggagcggcggccattgctgctggtcacttggttatttctccgcaacattatccgggcacaccgtgacagatatttatttattggttccagttttggcacgtaggcagattgatggcgatggagggacctgttctatgccgtcctgcaatgcaagccaaactgccggctgctgctgcgctggtcaacaactccctgaccaaatccgggcagctcgggactgcattgtttggtgctatttcgaagtacaggaacatttcaagattcatttctcccatctcccagccatctacgaagaacataggtccatgctgcagcttcagctcgtcttctgatggcaatggatacatggctggaaactttagcgagagtgatgaagattatgttaattctaccgtgctagaagcagttgaggtgagaagtggatcagaaggatatgtaataaagatgcgagatgggaaaaacttgcgatgtgtccataacaattctcaagggagaaatattccagagagtgcaccccaacctgctattgttttgaggattgaagatggaagtgaaactttacttcaatcattgttttggagatgccaagcgtacttctgatggcagctattcgtaatgtccacattgcacgaccgaccatatatccagntgtcaaggaaatgattgat

SEQ ID NO: 14963 - DNA, 1936 bp, Sorghum bicolor
  Clone ID: SORBI-28MAY03-CLUS7290_1
acacgagggcgggcttctccggcaactgacatgtccgggccgtcaaggggcgccgctggtcacgcgcgagccgacaccgtcccttccgtcgtgtttcgtcccgttcccggcgactcccgtgaccctgagaggagaggcgactaggcgaggccatggcctccggcaccggcaccggctcccgccagctgcaacccccagcagcggcggcagatgctgacccgggagccggcggcgacaagctcgtcttcgaggcgccgccgcagcccgtgagggacgactacgtcgagaacgccgtcaagttcctctcccacccaaaggtcaggggttcccccgtcgtctacaggcgatctttcctcgagaagaagggcctcaccaccgaggagatcgacgaggccttccgaagagtccctgatcctcaacccagcactacggctaccacttctccacagcagcaggtcaacagccaaaatcattccgctggcgtgcaaacttacactccagcgcaacctgtgcacccagcaactgctggccctgttgcccttcgaacacaacccaggttcagctggtaccaagcattcctcgctgcagggctcttgcttggttttggtgctagcgctgctgtctttatcaagaaactgttccttcctaggctcaagtcttggatacgcaatgtcgtagcggaaggtgatggcactgaaggcaaccaacttaaggccacgatcgacgaggaaacagccgaggctgtaaaggcctctgcttcagctgtttctgctattgccaaaacaaaccaacatctgcttgcttcaaaggatgaaggaaaagaagatactagtgacgttaacacatgctctagattcccaagccaaggagttaaaatccttgaccgagtcaatcagtcataccaggggacccatcaacattactagggatgataggttttctcagtaccgcccactggaagaccacgcccctcctgttatgaggaatggggcaattaacagttcatggagggcttctcagcaaactaacatgtacggtgcgtcaaacggtgactttggttctgcgaggtcttcattcgcgccagcacctgttgaacctacagctggatcattttcaagatcctatgccgagcagacgatgtccactacacaacgaggggataggtcttctggcagtaagccatgggagatgcagcagtattcgcaacagaggcctggttatggatccaactcccagttgagtgatgatggatcatactctgatgcccaggacagctatgctccttcctatcaccagaatggaaaggcccctgattttcaagcagatgaacctaggcctttgacctacaacactggggttgaggaaagaccgccgcctcagcgccgctgggtgccccctcagcctccaggtgtcgtgatgccagaagcagctgctgccatacgtcaaccaaagacccctccaaagcaaccctccagcaatgcctctgaggcagctggtgaggtgcaggtgaatggtgcctcaagtgcatcagatgctgtgactgaggttcctgttaatggtgctacggcaagtgatgctggacacagcgagatcgaagaacaatgagtggccgtctaagtgaaaccaagaccagccaataactgggaagcaatctaagagagattctggatttctggtacatctggggattagtcatacatttctgaataacttctgtatcagaacagcgggacaacccgcaagatggatgccagtaataatgtaataagtagcagatagtttatgtatttaggttaatgctacacacaggagaacatatcagtaatatttctatggttgtttgatggtgcttaaaaagcgtgcttgtgaattattgtccttcgttcatgatcttgtaaagactagcaatctcaatggacaaaatcgagatggttat

SEQ ID NO: 14964 - DNA, 1581 bp, Sorghum bicolor
  Clone ID: SORBI-28MAY03-CLUS288_1
cctactgggttatctatccaatcctctcctgagtctctcctctgctttagctaggtagctacggccctttggtccccggctagcttcttcttcattcgaccccacgcagcagcaggacgccagcagcagccatggctgccgtgaccgcggcggccgtctctctgtcctcctcgtcgtccccagctgctgctgctgccaaggccaaggcggcggcgtccccgtcgtcgccatgcagccacctccagttcctatccttgtacccgcagcggcgcacccgcgcggtgcggatgcgggtgcaggtgtccagcaccgagaccgcggaggcggaggcggtgaagaaggagaaggtgtccaagaagcaggacgagggcgtcgtcaccaacaagtacaggcccaaggagccctacgtcgggaggtgcctgtccaacactaggattaccggcgacgacgcgccaggggagacgtggcacatggtcttcagcaccgaaggcgaggtcccctacagagaggggcagtccatcggcatcatcgctgacggcgaggacaagaacggcaagccgcacaagctgaggctctactccatcgccagtagcgccctcggagatttcggcgactccaaaacggtgtcgctgtgcgtgaagaggctagtctacaccaacgatcaaggggagatcgtcaaaggagtctgctcaaacttcctgtgtgacctgaagcccggctctgaggtgaagatcacagggccagtgggcaaggagatgctcatgcccaaagaccccaatgcaacaatcatcatgctcgcaacgggtactggtatcgctccgttccgctccttcttgtggaagatgttcttcgaggagcacgaggactacaagtacaccggccttgcgtggctgttcctgggagtcccgacgagcgacaccctgctgtacaaggaggagctggagaagatgaaggagatggcgcctgaaaatttccggctggacttcgcggtgagccgggagcagacgaacgcggcgggggagaagatgtacatccagacgcggatggcggagtacaaggaggagctgtgggagctgctcaagaaggacaacacctacgtctacatgtgcgggctcaagggcatggagaagggcatcgacgacatcatggtcgatctagcagcaaaggacgggatcgactggatggagtacaagaagcagctcaagaagggcgagcaatggaacgtcgaagtctactgatccatgcattgatccatgacgacgaccaatacgtttttttgttgttgttttggttctgttgtgcaagctccgctcgatctgctcaacgatgctctgccgctgggctatatagccactgctgatggagatgcacgcatgatgcatccttcattgatcagcatcagctcaaacaagctgatgacgagttagctctgcattgctaagatcaatgaaattgccgagtcagactcggtctatcgatgtacatataccttacgattggaagacacatatataatccatggtttctttctggaacacccccctaaagaacggttttgattttttttttctccaaacttct

SEQ ID NO: 14965 - DNA, 407 bp, Sorghum bicolor
  Clone ID: LIB3478-002-P1-K1-E7
atcctctcctgagtctctcctctgctttagctaggtagctacggccctttggtccccggctagcttcttcttcattcgaccccacgcagcagcaggacgccagcagcagccagcagccatggctgccgtgaccgcggcgtccccgtcgtcgccatgcagccacctccagttcctatccttgtacccgcagcggcgcacccgcgcggtgcggatgcgggtgcaggtgtccagcaccgagaccgcggaggcggaggcggtgaagaaggagaaggtgtccaagaagcaggacgagggcgtcgtcaccaacaagtacaggcccaaggagccctacggtcggaggtgcctgtccaacactaggattaccggcgacgacgcgccaaggggagcgtggcacatggtcttcagca

SEQ ID NO: 14966 - DNA, 2154 bp, Sorghum bicolor
  Clone ID: SORBI-28MAY03-CLUS849_1
tactggaagccgcgaagagaagagacgcacggcacagatagatccctctccccctgtttctccctttctctctcctcgaccctcccgacgcggcaaagcaaaacacacagggaggaggagaggagggagaaaggaaagaggaggaggccgaaatcccctccccctcccccaaatccttgcccaataatctctcaatcagggggggtcctagggctgatcaggtcggaggattcggcgggcgggcgcagccatgaacgagaaggcgtccgtttccaaggagctcaacgccaagcacaagaagatattggaaagtcttcttcggcttcctgagaatagagaatgtgcggactgcaagtcgaagggtcctcgatgggcaagtgtaaatctagggatctttatatgtatgacatgttctggaattcatagaagcctgggggtgcacatatctaaggtaagatctgcaaccctggatacatggctgccagagcaagttgcatttattcaatcaatgggaaacgaaaaagcaaatagctattgggaagcagagctgcctcctaactatgatagggttgggatagagaatttcatccgtgcaaaatatgaggacaagagatgggtaccgaggaatggaacatcacgacctacctccggtgttcgagatgagaagagccaagagtctctggctagtgctaataggagtggacatggtcatagatcttcatttgagcaaaaccgtgttacagctcttccgagcaaagttgcacctgtagcttcaaggataccctctcaggcatcacctcagcccccaaaggtagaaccaccagttcctaaggtggtttcacctcctcagccacagaaatctcctgccaaagttgaggcaacaccccctaaagttgagaagccatcagttgcgccgcctcctaaagtcgattatgctaccgatctctttaacatgttatcaatggatggaacaacagagaaagagtcagagtcatcttcaaatgatgataatgcctgggatggattccagtctgcacaaccagtacctagctcagagaaaaaagattctgccaaaccggcagaaagcaagacccagtcaacatccggaatagaagacctatttaaagactcaccagctctgtcaatatcctcagctccagctgtttcccaagtaaatgcgaagaatgatatcatgagtttgtttgagaagtccaatatggtatcgcctttcgctgcccatcaacagcagctggcgtttatgtctcagcagcaagctcttctaatggctgctcttaaagctggaaatgcaccacaaatgattccagggaatgccaatcagctaaatgctaatggttctaatccccctcttggaaccttgcctttccaaaactggacaaatcttggttatcaaaatcctgggttgactccagcagcagcacagaatggtgccaccaaggttgcgaacaacaatcaggacttttcttctggtacctttggttttggcacacctggggtgtacaacactagttcagctgtcccagcaaatggggccacggcagcaggtgctagcaacaacggcactgcatcaactgcatcttctaatctcccctcacaatctggcaaagattacgatttttcctcgttaactcaaggatttttcaccaaacgatgagtgcctaatgagcttggaaaccaaacagaccaccgggtcatgttggacgaggcatattgatttagggagcacaatggggcttgcatgcttattttgaggcagcttttcttatggtggatatatataatagttattacatgaccttgtagctgtcggacaataagagtggaaatatgccgcaaaatagctcatgttgtttctacaagtgaaggattccttgccggttatgtcaacggcttttactcgaggactacaccttgtcagttatacaagtctaatgcagccttttcattatcttggtcgtgacttagctgcgttgccgatactggttacagattgttttgtattgtactgtacaacgacgattggatttttatttgtttccacatttgtgtattgttgagactcaggcgacctcttcatggcattgaattaagcgtactcttccaacatttcatatatacttgccactattaaaacaa

SEQ ID NO: 14967 - DNA, 370 bp, Sorghum bicolor
  Clone ID: LIB3481-013-P1-K1-E1
cgtccggcaagctcttctaatggctgctcttaaagctggaaatgcaccacaaatgattccagggaatgccaatcagctaaatgctaatggttctaatccccctcttggaaccttgcctttccaaaactggacaaatcttggttatcaaaatcctgggttgactccagcagcagcacagaatggtgccaccaaggttgcgaacaacaatcaggacttttcttctggtacctttggttttggcacacctgggtaagctatactgtctgctagttgcagaatgcggtcgttggaatttcatgctgcaccaaatgggatttgtaaacaaaatttagatgtgtattgaactcagtagttgatcatatgtccattt

SEQ ID NO: 14968 - DNA, 2047 bp, Sorghum bicolor
  Clone ID: SORBI-28MAY03-CLUS41778_1
gctgctggtcctttgtctcctgcagcatttggcggaaccctccgcctcttcctctctctctctctctctcgctcgctccttggtcctctactcctatcctcccggcatttcgtccacttgtggcggcgtagctagcatattactgctgctgcctgcatggtgaagatggaggagcgcacgggctcactctacggccgcctcaacaggaccagcacgcgggggttcctcgcctacgtcgccgccggggccgcttgcgcggccgtcctcgcctgcttcgtcctctccgccgcggacccgccggcgactgcggcgcgcaacgatgttgcggcgcgactccgcctgtcctcgcgctcaccgcgcgtctggcccgacctcgcgttcaactggcgggtagtggtcgccaccgttgtcgggttcctcggttccgcgttcggcaccgtcggcggcgtcggtggaggcgggatcttcgtgcccatgctcaacctcgtcgtcggtttcgacaccaaatccgccgcggccctctccaaatgcatgatcatgggggcctcggcgtcgtcggtttggtacaacctccaggtgtcacacccgaccaaggaggcgcccgtcatcgactacaagctcgcgctgctcttccagcccatgcttatgctcggcataaccatcggcgtagagctcagcgtcatcttcccatactggctaatcactgtcctcattataatcctcttcgtaggcacctcgtcgagatcgttctacaaggggattctgatgtggagggaggagaccaggattctgatggagacacgcgagcgagaagagcaatccaagtctacctgcgctgcaggtgatgtgataattgatccgagttatgaggagcccctcctgactcagcctcagcccaagaagaagtctgcattggagactttcctgttcaatttgaggtggaagaatatccttgttttaatgtctgtctggtcatccttcttggtgctgcaagttctcaagaataatgcgaaatcatgcagcactttctactgggtggtcaacattctacaggttccagttgcggtgagtgtattcttgtgggaggccatgcagttatgtagggagagtcgtgcacggcgtatgaatgggaacctggaatgtgtgtgtgaggcctctattgagtggtcaccagcacaactgatcttctgtgccttctgtggccttctcggtgggactgttggtggccttcttggatctggtggtgggttcatcctcggcccacttcttctcgagcttgggtgcataccacaggtcgcaagtgcaacagcaacattcgtgatgatgttctcctcctccctctctgtggtggagttttacttcctgcacagattccccctcccttttgctggctacctcatcttcatttccatattggctggattctggggccagtgtttggttaggaagattgtgcatgtgctcaagagagcatcggttattgtcttcatcctctcctctgttatcttcgccagtgctcttacaatgggtgtcgttggaacccagaagagcatttcaatgataaaaaaccacgaatacatggggttcctcgacttctgcgagtaactcaatcacaccatcagactccgggagaatccaggccaatgcctaattgaccttatctccctcaaaatctagaacaataaagtcgccaagtgtgcgcacaggttagctcctcgctaacccgcgcgtatcttgtccgacagagtcgctttagtgaattcagctcgtgttagctcctcgctaaccgtcagatcatatggctttgctttgtggaagtgggtgagatttcgtcgtgtcatgcatgtgttagctcctggctaacctgcaaatgcatttgttggtgtgcaggtttttgtcacgtctgcgtcagctcctggctgaccagcaagtatttgtcgttcattcttgcgctagctcgcctgcaaaagtgcaaatatttgtcgcatggaacattgtaaatatcagtcaatttcaattctgtttgtggagacccaaaaaaaaaaag

SEQ ID NO: 14969 - DNA, 823 bp, Sorghum bicolor
  Clone ID: SORBI-28MAY03-CLUS7894_1
ccgcggcacgagccccgcacccgccgcagcttcgtcttcgtcgttccgtccaaggcaaggcaagccaagtcgccgcggagaggaaacccgccgagaagaggagatggcccgtacgaagcagaccgcccgcaagtccaccggaggcaaggccccgcgcaagcagctcgccaccaaggcggcgaggaagtcagcgccgacgacgggcggcgtgaagaagccgcacaggtataggcccggtacggtggcgctccgcgagatccgcaagtaccagaagagcacggagcttctgatccggaagctccccttccagcgcctggtccgcgaaatcgcccaggacttcaagacggacctccggttccagagccacgccgtgctggcgctccaggaggccgccgaggcctacctcgtgggtctcttcgaggacaccaacctctgcgccatccacgccaagcgcgtcaccatcatgcccaaggacatccagctcgcacgccgcatccgcggcgagcgcgcgtaggcgtgtccggtaccaccagcgtcgtcctgaaggaggcggcgaagagggcggagatcaatttggaaccctctggcttgttgatctccgccccgcgtttagtggatctgatgatgaagaacttagctcgctaaagtctgtattagcgtcgtcggttggtttggttagctgtgtaaaaatatatttacaagtctattttgtgccgtggttattttgtttgggtcgcttcgtcctgaagccatcctgttataaagactattagttggttattataattcgtgctgcaaatttttacaccgtttgaaaaaaaaa

SEQ ID NO: 14970 - DNA, 1158 bp, Sorghum bicolor
  Clone ID: SORBI-28MAY03-CLUS5475_1
gcgcgggggtcccgcctccgctgtgccccccgccccgccgccggccgggccggctctcctctccctcctccgcctcccccatttctcttcccctgcgatccgagcccgcacccgcagggaagagaagggatcacctgatcaccagggcgcggcctcgcgatctcgcggaggagcggagatggggctcacgttcacgaagctgttcagccggctcttcgccaagaaggagatgaggatcctcatggtcggtctggatgcagctggtaagaccaccatcctctacaagctcaagctcggcgagatcgtcaccaccatccccaccattggatttaacgttgaaactgtcgagtacaagaacattagtttcactgtttgggatgtcggtggtcaggacaagatccggcccctgtggaggcactacttccagaacacccagggcctcatttttgttgtagacagcaacgacagagagcgtgttgttgaggccagagatgagctccaccggatgctgaacgaagacgagctccgtgatgctgtgcttttggtgtttgcaaacaaacaagatctgcctaatgccatgaatgctgctgaaatcaccgataagcttggcctgcactcgctgcgccagcggcactggtacatccagagcacatgtgctacctctggtgagggtttgtacgaggggcttgactggctttcgaacaacattgccaacaaggcttgaagcatctaggcagggcttcaatcaatggaaacactctggatacttggggtacgaactgcctctaccattacagcgatgaactatagtcgtgtctgtcggatgtggggatgtttttgggaggataaaaggctctttggtcaaggagctaggtatcagatgttttcgtggtattgttaatttctgttttggtttgtgcaaggtataccatgtccgactgtgtgctgtgtactcgccactgttctataatgtgctgtatactctcgacccctgactgaggcgttgtactatatatctcgatctgtctagctgtctcttggcatagcaaaatggtggcctaatttgttagcacatcgttcctcctgcgtttgccgttgtactatctcgaactgtctggctgtccgtttggtggctgtattgctgcacgctgaattctc

SEQ ID NO: 14971 - DNA, 1048 bp, Sorghum bicolor
  Clone ID: SORBI-28MAY03-CLUS20876_1
gccggccgggttgggaccttaagaagcacgaggcttgcatgctcatcggcaactcccgtagttgaaaggatgggtatactggtgattacggtggacctagactgctgtcgctgtagagccaagatcaccaaagtcctcgactgtctcaaagaggaattctgcatcgagaaggtggagttcgaggacaagaaggagaagaaggtggtggtggtgcgcgggaaattcgacgccgagaagctctgcaagaaggtctggtgcaaggccgggagtaaggtcgtgaaggagatcatcatcgtggacgtctggccgattccacccaagccacccaagccatgcgatccttgcaatcccaagcctgagaaatgctgtgtctgtgaccactgcaagcccaagcctgagaaatgctgtgtctgtgatcactgcaagcccaagcctaagcaggagcaaaagcctaagcctgaggaaaagcctaaggcggcgacgcccaaaacggagtacaagttcgtgccgtacccgtacctggtgccgaaccctgggatgtgccagagctggccgtggcagtgccctcctcaccagcagtgccagtgctgccagaagcctccttcgccgccgccggcaccgccgcagcggccaccgtgcacctgttcgagccacggtagctgtggctgcggccagacactgccggtctggccaccgcagccgccggtctggcctccaccgtgggcaggctgcaatgttgtcgccgacgagaactcgtgctctgtcatgtgatccatggctacctgcttaacgtcacctgtcgctgttgctgtgctgtgatgggtactggacctccgatatctgaataatccgacactatgttctgtatagtgaagttactgtgcgtgtgcagatgtgtttgcgtcctgcagtgtgttatacgaacgtgttatgccagaatgcccttgttttatagtactggtgtactaccttccaaaactaaactgtaatttgcactttgtaatgtgatattcatgtctttgtacgagtatttcgtaattatgcctgc

SEQ ID NO: 14972 - DNA, 3331 bp, Sorghum bicolor
  Clone ID: SORBI-28MAY03-CLUS1517_1
agacccctctccccctactcagctgcgtcagcctccgtgcccgtcaacaacccgcgcctcgccgccgcatcctcctcctcctcctccgccgcccgcctcgcgctctagctgccattggccgcctgggtcggtcgcactagggggctccttcacgcccacctgcgagctggcacgctgcctccggtccaccgcgccccggcgccgccaggcgcccccgccgtgaacggcgggcgggcgatcgacctcctgccggccgcccgtcctcgtcgagagcgcgagaacgatcttgttgcgtgtagtagtacgcaaaaagcgcgacaatggcgaacgcaccagctaccaagcatgctttcaagagtatattggccagcctccctaagcctggtggtggtgaatacggcaagttcttcagccttcctgcactaaatgatccaaggattgataggcttccctactccatccgtgttctcctggaatcggctatccgccattgtgataacttccaagttacagagagtgatgtcgagaaaatcattgattgggagaacacatctccaaagctggctgagatacctttcaagccagcgagatgcattctaatggacaacactggagtcccagcagttgtagaccttgcagctatgcgtgatatgatgccaaagttgggttgtgatccctacaagatcaatccactgattcccgtggatgctgttattgaccatgcagtgcgagtggactttgcagggaggcatgatgcattggatagaaacgaggagctggagttccagcgcaacgtagtgagcaccacgtcaatcttgagtatcttggcagagttgttttcaacacagatggcattctctatcctgacagcgtagttggtactgactctcacaccactatgattgatggtttgggtgttgctggctggggggtcggtggtatagaagctgaggctacaatgcttggtcagccaatgagcatggttttgcctggtgtccgtggcttcaaattaactgggaagttacggagtggtgtcacggccactgatcttgttcttacagtgacacaaatgctaaggaaacatggtgttgtcggcaaatttgttgaattctacggtgaaggtatgggtaagctgtctttagctgacagggccacaattgcgaacatgtcaccggaatatggagctaccatgggcttctttcctgtggaccatgtgacattggattaccttaaactgacaggccggagtgatgaaacagtgtcaatgattgaagcatatctgagagccaacaaaatgtttgtggactacaatgagcctccaacagagagaatatactcatcttatcttgagctggaccttgatgaggtggagcctagcatgtctggaccaaagaggcctcatgatcgtgtccctttgaaggaaatgaaatcagattggcatgcttgcctggacaacaaagttgggttcaagggttttgcagtgccaaaggagcagcaggataaggttgtcaaatttgactttcacgggcagccggcagaaatgaagcatggtagtgttgttatagcagcaataactagctgcacaaacacctcaaatcctagtgttatgcttggtgctggtcttgtagctaagaaagcctgcgagttgggtcttgaggttaaaccatgggtgaagacaagccttgcccctggatcaggagttgtcacgaagtacttgcttcagagtggccttcaagaatacttgaaccagcaaggatttcatattgttggctatggctgtaccacttgcattggaaactctggtgatctcgatgaatctgtatcagctgccattacagaaaatgatgttgttgctgctgctgttttgtcgggtaaccgtaactttgagggtcgtgtgcaccctttaactcgggctaactatcttgcttcgccacctcttgttgttgcttatgcacttgctggaactgttgatattgattttgagaaagagcccattggacttggaaaggatggcaaggaagtctacttcagggatatatggccctcgacggaagaaattgcacaggttgtccaatccagtgtgctgcctgacatgttcaagggcacctatgaggctatcacaaaaggcaacccaatgtggaaccagttaactgtcccagaagcgtcactctattcatgggattccaaatccacttacattcatgaacccccgtactttaaggacatgaccatgtccccacccggtccctctgcagtgaaagatgcatactgcttgctgaacttcggggacagcattactacagatcacatttcacctgcaggaagcatacacaaagacagtcctgctgccaagtatttgatggagcgtggtgtggaccggaaggacttcaactcttatggtagccgtcgtggtaatgatgaaataatggcgaggggaacatttgcaaacattaggatcgtgaacaagtttttgaatggagaagttggacccaagaccattcatgtccctactggggagaagctttacgtttttgatgcggccatgagatacaaatctgagggccatgctactataattctcgctggcgctgagtatggaagcggcagttctcgtgattgggctgccaagggtccgatgctcctgggagttaaagctgtgattgccaagagcttcgagcgtatccacagaagcaacttggtggggatgggaatcattcctctctgcttcaaagctggtgaggatgctgattcgcttggcctcactggacatgagcggtacagcatcgatctccctgccaacctcagtgagatccgtcccggccaggatgtgactgttattaccgacaatgggaaatctttcacttgcacccttcgctttgacactgaggtggagctggcgtacttcaaccatggaggcatcctcccctatgtcatccgcaacttggctggtgcgcagaactaaggcagatcacactccattttgcctacaatgacagtggcaggctccatcttcccagggctagcggcctggttcaatgtagagactatgcgatgcctctcgagggcctttgtcgattcagccccataaataaagtgtgaaataaaaagtcataggaggaggcaggaaccgctgattgaggaacaggtttgcctgttgattggttacatgaaatttctgtttcacaggcgtgcagagcatggtgtaaatgctttctatgttactttcgttgtgacaaattgcttatgctgttatgctctcaagccctttaggttgcttcacattttggtgtcttatgaaacacattcttttttctaaaaaaaaaaaaaaaaa

SEQ ID NO: 14973 - DNA, 2000 bp, Sorghum bicolor
  Clone ID: SORBI-28MAY03-CLUS50_1
tgaattcgtgggcaactcaccacgcacgcggctcaaacctttagccactacacagcagctatagcaagaaatggctctacttcttgcttctgccatgaatcacactgcccatccagcaggccttagaagccatcccaataatgagagtttctcacggcaccacctatgttcttcaccacaaaacatcagtaagcgaaggtctaaccttagctttaggccacgagctcaaacgataagcagtgagtctgctggaatccacaggctgagcccctgggaaatccctaggagggactggttccctcctagctttctcttcggtgccgccacttcagcataccaaattgaaggtgcttggaatgaagatgggaaggggccaagcacatgggatcacttctgccacaattttccggaatggatagtggacaggagcaatggggatgttgcagcggattcgtaccatatgtacgctgaggatgtcaggttgctgaaggaaatgggcatggacgcctataggttctccatctcttggcccagaatactgccgaaggggacgctcgctggaggtattaacgagaaaggtgtcgagtactacaacaagttgatcgacttgttgttagagaacggcatagagccatatataacaattttccactgggacacgcctcaagcgctggtagacgcgtatggcggcttcttagatgagaggattataaaagattacacagacttcgctaaagtgtgctttgaaaagtttggtaagaaggtgaaaaactggttgacctttaatgagccggagacattctgttctgtttcctatggaactggagtccttgccccggggcggtgctcaccgggagtaagttgtgccgttccaactggaaactcactcagcgagccatacattgttgcccacaaccttctccgagctcatgctgagactgttgatatttacaacaagtatcacaagggtgcggacggccgtatagggcttgcgttaaatgtatttggccgtgtgccatacacaaatacgtttcttgatcaacaggcccaagaaaggtccatggacaaatgcctaggatggttcttggagccagtggttcgtggtgactaccccttctccatgagagtgtcagcgagggaccgggtgccctacttcaaagaaaaagagcaagagaagctagttggttcttacgatatgatcgggataaactactacacctcaacgttctccaagcacatcgacctctcaccaaacaactcgccagtgctcaacactgacgacgcctatgccagtcaagaaaccaaagggcctgacgggaatgctattggtcctcctactggaaatgcgtggatcaatatgtaccctaaaggcctacacgatatccttatgaccatgaagaacaagtatggaaacccaccaatgtacatcactgagaacgggatgggggacattgacaagggcgatctacccaaaccagttgcgttggaagaccacacaaggctagattacatccagcgccacctctcagttcttaaacaatcaatagacttgggagcagacgtgcgcggctacttcgcgtggtctctgctggacaacttcgaatggtccagcggctacaccgagcgtttcggcatcgtctacgtcgatcgcgagaatggctgcgagcgcaccatgaagcgatcagccaggtggttgcaggagttcaatggagctgccaagaaggttgaaaataacaagattcttacgccggccggccagcttaactaattaagtagaacacgtactgcttctggctgatgtatggtatggtggcactgtgtcttctgtgcatgcctgtgtggtctgaaacgacatattttactttgcacggctagaggtagtggaggcatattctccagcgccgcagctaataatgcaatgctctgttccagttcagtgttatctttttattatgcaataaaacgaagtgatcgatttgcaatatttgtaatgttgaatt

SEQ ID NO: 14974 - DNA, 413 bp, Sorghum bicolor
  Clone ID: LIB3476-055-P1-K1-D6
gcgcctcaagcgctggtagacacgtatggcggcttcttagatgagaggattataaaagattacacagacttcgctaaagtgtgctttgaaaagtttggtacactactacagaatgaggcattggtcgatgtccaaaatggccaaaaacctcggcctttttgcggcccggggttaaagacccctttagcaccggttcgtgtgacaaaccggtgctaaagggtcctgcccaacggctactgacatgtgctgtctgggcagggaccctttagcaccggtttttaacaagaaccggtgctaaaggggtccctttagcaccggccagagccacgggccgaggcaaaccctttagcaccggtttgtgttacaaaccggtgctaaaaggtaaccctttagcaccgccttttgctctgaac

SEQ ID NO: 14975 - DNA, 1410 bp, Sorghum bicolor
  Clone ID: SORBI-28MAY03-CLUS21230_1
tacacatcggcatcgatcggcactgcaggcaggcacaactcgtatcgtatcgtagcaggttgctgttgcagcgtacgtacaaatcgtacacaaaaagcatatatagcccccatcatcggccatcgacctcaagtgatagcactcgatcggcagtttgtagaaggagctggaaaaagcagagcactcctcgctctgttagctagctgcttgccatctcctccctgctagctgctggcctctggtagtttgtagtagaagcagctatagctagtagcttgccatctccatcgatccaccagagggagagagcagagagagaggatggtgagcagcacgacgatggcggcggcgagctgcggcggcggcggcggcgttggcgttggcgttagggcggcgggcgtgctgccgctggcgtcgctgaaccacatcagcatcgtgtgtcgctccgtggaggcgtcgctgcgcttctacaccgacgtgctcggattcgtccccatccgccgccccggctccttcgacttcgacggcgcctggctgttcaactacgggatcggcatccacctgctgcagtcggaggaccccggcagcctcccggagaagggcgagatcaaccccaaggacaaccatatctccttccagtgcgagagcatggtggcggtggagcgtcgtctgaaggagatgggcatcccgtacgtgcagcgctgcgtggccacgaccccgacggcttcatgatcgagatctgcaactgcgacaacctccccgtcatcccgctcgccggcgccgtccagctcgggtcatgcaagcgcgccgcggcggcggtcgtcgtcggcaagcagcagcagcagcaacgcggcggcggtcgccgccggcctcctccttcccctccggtcaccgcgacggcggccgcgcatcatcaggctatccgcgtcgccgaggagtcgtcgtcgtcgcacatttcgtgcgccggcggcggcggccgcgcgtcagcagccttcccgcggcgccgtgccggcgccgccgtcgcgcatttcgtgcgcgtgatttgatgactacacgagaggatccatcggtcagtgtcgtgccggatcgtcgatgatgcatgccgtcgtcgtcacagcgagacggtgacgcattggatcatggcacgatggatttatcgatggagtcgtcacggccaagcgtagtctctctgtacatgcgcgtgcgtgcgttcgtgtgtagctggatgtgcaagcaaactgcccgtttttagtaaagaataaacgaaccaattaaggtggctccatcgatctatactaatagctactaagtggtgtcttctggtttccctttttttctcgcagttctgtttctgcacttccgggcatacgtcttttttttcaggaagtaccccattatctatataaaaag

SEQ ID NO: 14976 - DNA, 1263 bp, Sorghum bicolor
  Clone ID: SORBI-28MAY03-CLUS3837_1
cgcaatataaacccctggggagcgtggcgcgcacgcgccgccagcagctctttgtgatcctacctcagccgcgtcgcgtcccattcccatcgcattctgcgattcgaagctctctgttcgcagccatggcgaagagctacccgaccgtgagcgccgagtacagcgaggccgtcgagaaggccaggcaaaagctccgcgccctcatcgccgagaagagctgcgccccactcatgctccgcctcgcgtggcactccgccgggacgttcgacgtgtcgtcgaggaccggcggtcccttcggcacgatgaagaacccggcggaactggcgcatggcgccaacgcggggctggacatcgcggtgcggctgctcgagcccatcaaggaggagttccccatcctctcttacgccgatttctaccagctcgcgggagttgtggccgtggaggtcactggtgggcctcagatccccttccaccccggtagggaggacaagcctcagcccccacccgagggccgtcttcctgatgccactaagggttctgaccacctgaggcaagtctttggcaagcagatgggtctgagcgaccaggacattgttgccctttctggtggccacaccttgggaaggtgccacaaagagcggtctggttttgagggggcctggacttcaaaccctttggtcttcgacaactcttacttcaaggaacttctgagtggtgacaaggagggccttcttcagctcccaagtgacaaagccctgctgagcgaccctgccttccgccctcttgtggataaatatgctgcggatgagaaggcattctttgaagactacaaagaagcccacctcaagctctccgaactggggttcgctgatgcttaaatggcccctatcctggagtgatccaaactgctgcctgtatggaatcatgtgcatctggagttagagtgaaccagcagattgtctcgtgtcttctatgtaataaatttgtcgctgttgagccctcaggctgttcttggaactttggctatggttgaacgggggggaccctttgcctatactctgatgctgtatgcaactgaaactagtagatctatgatcttatggctgcagtatgttcttgttactttgcttaaatggtttcccttagttcggttcacagcttgtggtttaaaaaggcggtgcttgcgctgcatctgcatgatctgattctttctgcgtggtgtgactggtcgagcaattttagtcggagctaatacgctttgct

SEQ ID NO: 14977 - DNA, 2800 bp, Sorghum bicolor
  Clone ID: SORBI-28MAY03-CLUS41897_1
gcacgaggcggcacgaggctcttggtcttggggtcctgggacactactagcgcgcacagcaaagggaggcggcttcctgggcgtctcgctctcgccatggccaccaggccgggccctttgactgaatggccatggcagaggcttggcaacttcaagtacttggtgatgggtcccgtggtggtggacggggcgcggcgggtggtggcgcggggctggggcgacatcgacctggcgttcgcgctcatcctgccgtcgctgctgctgcggatggcgcacaaccagatctggatcagcgcggcgcgctaccagacggcgcggagcaagcaccggatcgtggaccggggcatcgagttcgagcaggtggacagggagcggggctgggacgaccagatcatcctcaacgggctgctcttctacgcgggctacctggccatcccgagcgcgaggcacctgccggcgtggaggacggacggcgccgccgtgatggcgctgctccacgcggggcccgtcgagttcctctactactggttccacagggcgctgcaccaccacttcctctactcgcgctaccactcgcaccaccactcctccatcgtcaccgagcccatcacctcggtgatccatccctttgctgaacacatggtctactacgtcctgtttgcgatccccatgctgtcgactgtttacattgggaatgcctctgttctgggtattgtggtctacatcgcctacatcgacttcatgaacaacatggggcactgcaatttcgagctggtgcctaagtggatgttccaagtcttccctcctctcaagtacctcatgtacacgccatcgtttcattctctgcaccacacgcagttccgcacaaactactcgctgttcatgccgttctacgactacatatacaacaccatggacaagtcatctgaccagctgtatgagagctcactcaggggaacagaggaaacacctgaccttgttcacctcacgcacatgaccgatctgcaatcggcctatcatctacggattggattcgcctccatagcgtccagaccgtctgacagctccatgtggtatatgtgggtgctatggcctgtggcgtggctgtcaatggtgcttgcatgggtttatgggtcctctacgtttgtggttgagagaatcaaactagggaagctgaagatgcagacatgggcagtaccaagatacaacttccaatatggcctgagctgggagagagaatcgatcaacgacttaatcgaaaaggcgatattagatgctgatgcaagaggtgttaaagtgctcagtctaggactattaaaccaggcgaaacaactaaatggtggtggtgaactatttaggcagaagtatccaaaattaacagttcgccttgtcgatggaagtggcttagcgactgcggtggtgcttaaaagcattcctcatgacgcaaagcaagtttttcttcatgcaggcccttctaagatagcgtgtgccacagctttcgcattatgtgagaggggcgtccaggtgatcatgaatccaaagaaggaatatgatatgcttaagtcacagattgcagatagcaaagcaagctatttgaaacactccagcaaccacacgcctcagatttggctagtagacaacattgacgataaagaacagaagatggcaccacaaggagctatattcgttcctatctcacagttccccatcaagaaaattcgcaaggattgcacttacttgagcactccagcaatgaagatccctgaaacaatgcagaatatccatgcctgcgagaactggctgccaagaagggtgatgagcgcttggcgcatcggaggaatacttcacgccctggaagggtggaccatgcacgagtgtggggatgccatgatgcatactgagaaagcatggtcagctgctattaggcacggattcattcctctgactaaagcttgagattgagagctttcgaaacccggatttgtggagctaggagatgtatgcactgcaactctagatgggcattcgacaatgctggcaaactatgtttcagcgtgattctgcccggtataaaagccaactatggtcttgatgagtcgtcagggacggggaggcacatcatgaacgcctaccttgattccaaaagcttagtaattatacatatgctgtatcattgtatgatgcaagtgtgagaaactacttttatggctgtgtgggtgacgtatacaattattataataaaatgacggtttgggttgcccctttggaatttgaacccgccgaagaatggctgaaaaacaggtaaggaatttttgatacgcaatcttaatctcggcggtaagagctgacttctatttcagcctttcagggattcaggaaatggtacacacgcagtcatccatccatagtccaaaagagcatactggtatgttcctgcttcagaacctgtatatccaggcacgatgcaatctagatagattgtcgttgatccgacgaaagagatgcagtgcgagaaccgagagatgcagttgagcgaggaaacctgcaacggatttggtatacgttggtgcaaagatcgtagctcgctgaagatcatcgagttcgagtccagagtttcctttgactgcggagatcggcgcaggggcgaagacaaagagaggcaggggcacagtcttcacaagtacttctcattatagttatcactaatcactagtcaactaattctagatttttttttctaaaatgcatatcttgatcggttaatgttaagcgcttaaataaagtaaatataatatttttt

SEQ ID NO: 14978 - DNA, 1686 bp, Sorghum bicolor
  Clone ID: SORBI-28MAY03-CLUS11_1
gcacctgggctgcatccggttggcgatggaccccctgggtccccctggcctgctcgtcttgctgcttgctccctgccccttctcggtctctccccttctgggccggttccccgccggcgggtcgtgtggtactccctggggcctctcgtgctgccggcccccgtgccctcctcgctgtcgtggtccccggccctctgttcgcccctgtcccataaaaaaaaaacaggccggacaagcttccccgtttccacaagcttcctggcgctgcattcattttgcaatagagcccctgggtcgcccttgccatcttttcttgcagataagtccctgccccttctctttttctcacattcaggtccttttccccttctgcgagtcgtgtagtactccctgaaggaactcttgcatccagcccccttgccttcctcgaattcttgttccccggtccttcctttgatcctgtcccgtgtagatccgttccatatccatatccatccggggagcagagcagagcagagcaccggccgccgtcccccatgtttacccaccagtttctctaacggccgccgtcctccgatgaagctgagcgtgctccgtatccgccgttcccactccttctccgtcgccttcctctactggttctacgtcttctcatgaacgcctcgcccccctctcccaacaactccacctgctgatcccttgtttcttcctttctgagttggttagacagatagatctctcttagtttcttcttgaatctttcggccttttcttttccccctttcttccaaaaaaaaacgttccttttttgagctgagcctgtccaacaagaacaagaaggaggaatcatccgacgagaccatgtcgtcgtcacgccggagctcgagccccgacagcaacaacaacacggacgtgagcggcggcggcggaggcgggttcgccgcggacgagcggaagcggaagcggatgctgtcgaacagggagtcggcgcgtcggtcccgcgcgaagaagcagcagcggctggaggagctggtggcggaggtggcccgtctgcaggcggagaacgcggcggcgcagtcccgcatcgcggcgttcgagcgcgagttcgccaaggtggacggcgacaacgccgtgctgcgcgcccgccacggggagctgtccagccggctcgagtcgctcggcggcgtcctggaggtgcttcagatggccggcgccgccgtcgacatcccggagatggtcactgaagaccccatgctccgcccctggcagccgtcgttccccccgatgcagcccatcgggttctgagcctgcgccggagccaagtcaagacattggccgtggtttatacagtgtcgccatggtcagtggtcacctaccgctgctatctactactcctacatgcccccaagtgctagttttgtgtcgtcgtgtgtctgcactctgcagcagccttggctgcttatcatggtttgcttcttgttagtgttaatctagactgttatcaagaatgatcaatttgtcgtgtggttatgaacttgtgaatgtagcgatgtgctctggcggtgagacattatcaagaatgtataagtgtgccggagaacatcatcgttctgtggttgtaatatctttgcctgtgaaattaaatggacctatatatatgtgtttattatgggaatgctctgcatc

SEQ ID NO: 14979 - DNA, 1497 bp, Sorghum bicolor
  Clone ID: SORBI-28MAY03-CLUS1434_1
ttccagaaaactttttaaaactcacaagaagggaaaaggatattggctatcatattttggcactaaaccaaatacatgccttcattttttgccctcattttggtcagtcttattttggcttaccatgaattcagcttgacatggtttttgctaggcaggtttggaaccagaatccaaccaaacaaagctcttcatttggtcagtctcggtcaatcctgggctacacaccaacagccaagcaaatacaaattggccattgggtactcaaattgtagaaacacaacgaaccaagtacacccccaatgtaagagccagatctaaaaacagatgacaaagcagaaacatcaacattgatatataattctaatagatacccattaatttacacatcattatccatagaacaaagataaacttgtgtaggctcattgcaagttgtaacaagcagcaatgccaccacactaaaccacgcatgagagctccagttcaccataggaaacataaagacattacacagtaatacttgctacaccacatctgagttcatacttgatataattgattatgtagtttccattccattccattccatcttctactgggaggggataggctgcatctctggtgctggggcaacatcagccatggggtacgggaacacccgggcgagccgctcagtgggcacaagcgggagataggtggccacagtgttcccgcgcttggcaccatcacgcaccgctgaattgtacctggctgagagctgcgcggctgtggggaggacagccctggtgactgaaggcaccagcggaaggcggttcagggccacccaggcttccgcagcacggcgctctgccacgggctcatagcgggtgtagagctccctggcctttggctccgcgcgggcaatggctgacttggcaaggcctgtggccgtacccacaaggccggcctcacgaacctcctttgcagccgagcgggcaagggttggggcttccttcaccactggaggaacgcggcggtctatctcctcaacggactcaccaaccttgcgatcgatgaacttgaggaggtcaagcgggacggcatggaagcggtcatacaccggcccgacgacagccttgacggtgccctcgacatggtcaacgccggggcggagcggccccgcgccctgcttggcgtacgcgtaggccgcggccgccagcaccagcgcctgcgccgccgcctgctgcacgaactcgaggtaccgcagcctctcctcctcctcctccgccgccgccgccgccctctccaccgtcacctcctcctccgtggtgggctggctgttgacgaccggggcgtcgttggtggtggaatcggccatggctcgctggatcgaggagggattttgggagatttcgcttcgtcgggggattctgggttttcttcttctctcgtgtcggggggattttgattttggttgatttcgaggacgcgtttgtttgttgtggatttttccag

SEQ ID NO: 14980 - DNA, 1812 bp, Sorghum bicolor
  Clone ID: SORBI-28MAY03-CLUS5075_1
tgcgcacgaggaccaacacgaccccgggtggccggccggcacggagatcggatcggaagcttggacaaggtttccacctggatggcgatccgcaggggcccttcgtacgccgtcgcggcactcctcgcgctcgcctctgtcgccgccgtcgccggcgaggtcttcttccaggagaagttcgaagatggctgggaaagtcggtgggtcaagtctgagtggaagaaggacgagaacatggccggtgaatggaaccacacctctgggaaatggaatggagatgccgaggacaaaggtattcagacctctgaggactacaggttctatgctatttcagctgagtaccctgagttcagcagcaaggataagaccctggtgctgcaattctctgtgaagcacgagcagaagcttgactgcggtggtggttatgtcaagttgctgggtggtgatgtagaccagaagaaatttggtggggacacaccttacagcattatgtttggaccagatatctgtgggtacagcaccaagaaggttcacactatcctgaccaaggatggcaagaaccacttgatcaagaaggatgtgccttgtgagactgatcagttgactcatgtttacactttgattatccgccctgatgcaacatacagcattctcattgataacgaagagaagcaaactggcagcatctacgagcactgggatattctgccccctaagcaaatcaaggacccagaggctaagaagcctgaggactgggatgacaaggagtacattcctgaccctgaggacaagaagcctgagggctatgatgatattcccaaggaaattcctgaccctgatgctaagaagcctgaggactgggatgatgaggaagatggtgaatggactgcccctaccattccaaacccagaatacaagggaccatggaagcaaaagaaaatcaagaacccgaactaccagggtaaatggaaggcacctatgattgacaatccagatttcaaggatgatccatacatctatgcatttgacagcctgaagtacattggcattgagctgtggcaggttaaatcaggcactttgtttgacaacttcatcatcactgatgaccctgcgttggccaagactttcgcagaggagacctggggcaagcacaaggaggcagagaaggctgctttcgatgcggctgagaaaaagaaggaagaagaggaagccgccaagggtggtgatgatgaggatgacgacctagaggatgaggaagacgatgagaaggcagacgaggacaaggctgactctgatgccgaggatagcaaggacgactctgatgatgagaagcacgacgagctctagatggtgaggatgatgatgttgtggccaccgaacttggagccgctggcctggatttatcaactctcccactatgaacttctcttttttctgtgatcatcgacaagttactgcatagagcattgctaataagccgagggatagtttgggttgctgtagcgttttttttttcccattattagaactgatagcactggacaaggaagatgtttgctcacaactgatatctcccattcttacgttaaatgtgatcctgcgaaagcataggtttcgtgacgcacgtggactgcagcgtcgttttgccgttttcgtttagagaacattcgtgcctgtttactgttctaggtatcgctagggtcttgtttcgggcaaatagctgctccgtctcgtgtctggcaaactctgctttcctatccgtttcctgccagcgccactgcttttgcctggtatgagatttgtttaaagaga

SEQ ID NO: 14981 - DNA, 3569 bp, Sorghum bicolor
  Clone ID: SORBI-28MAY03-CLUS3052_1
gtgctcgcacgaggcgcagttgctgtcctcagtgctcagttgacgccgcagctaggccgggaggtccgaaggtattaaagacgctggctgattccgagcactagagctcaccgccgcctgcagcgatggccgacttctcttggctcacggtgcttggcttcctcttcctcaccttcaactccggcatggcgatttatcgctccaacggcgacgctggctccgtcaccttcgtcgtggtatcttacctcgacctgctggccctcttcgcctgcctgcgctactacgagcagttggatcgccactcccccaagcgcgcgacggtcaaggctggggtttggagcctcacgacgctccttacggtcatgttcagctacaaagtcgctgagattatgcccctgcccgtcaaaattcttgtctggtcgatggcagcggctacctcctgtggcggcttctacgctttcttcgtccacgacgagaagcctgtcctgccagcggcggcgccaccggccgccgcggtcaaggaagcagacgccaactaagttcgtttgccaccacatggcgcataccgttgtttcggcaccgcgcgttagatcccagggccatctaggttgttctctaattgctaatttcttggctttttctcttcccctttccaccatttttgctgtcacttcggttgttttagcttgccggcgtggacagactgccagatctggagctcggtgtgaccagatccgctgctgctgtgcccgatggcaggggaaatctctcaggtttgctctgctgcgggtcaaagagaagatgatgacgacaactgagcttatggggttgccgcaaattggactttctggtgttctaattgtgcgtgttctcaccaagagaagaaattttcggtctcatctagtaataagtatgctggatagttctccagcacgggagttaattgcatcaggaaaaggggagaccaggggcagagtagcagaggtattgatacagaggatatctgtgtatatggaatatatggagactacatgtgaacaaggaggtttatttgtgaacctcaaatcatggcgatcgagagcagatcaaaaggaggctgggagtagcaaggaagcagacgaagagaggaggaagactgaagatctgaagaacctaaggagtacaactacagaagaatggaagaagcaaagatgcaagggcgaagggcggacagtactagaattcatttctgtaccaagatctaaacttccatcagtgattccggtatgcatggcactgcttctctcaagatgtggtctacatctcgtctgagtttgaggtactggttgaatcattacctattatagatatgttccaaagaatgagtttgttcatatttcttgaagaaagcttcatgaatcattcaagaaacatgctggaatccaaatatcttcatgaaaagaaaatgggtttatatcatattggtagtcatgcatgcttccatatggtgtttcgttcttgggattcagagcagaacagaggaggaaagctgaagaagatgacaaattagtggaaggaacaaagaagcaacacacagcagtttatgatattgatcattatttcatgatcgtatgatatcaaccttgcaagttcatcaattagcagctgcaacactgatattcaaaacaaataattttgttcgacgtatgaccaatatctccaatgaatccaagaaatttgaagcattaggcaacacattgctatgcttgaaggcatgagcttccttatttcttcaagaagatttcagcattgtcacaaatgtcatcctggtactctgcctcgattcaacatgttgaacatcaagtatgcttgagaagttgagagcatgagcgtccttgtttcttcgaaaatatttcagcactataaaagagcttcactgttactctgcctggatgtaacaaggtagaaatactagtcactgaactgtattcagttattgaagaagggttcatgaatcattcattatgcttggtgggagtagatatattccatgactacgagctagcagatttatttggtggtattcactcctcttgaacaaattattttgccaatcacaccatgaagaaaacatgcatctgaagaatgaaggacatttgtagcagagaatagaatggagatccgaaccaagagaattattcatggaggtttcatgaacaatctgcatgcttccacatgagtatcgttttaggagtttgaagtttatatggtggtcaatctctctgcgagtttaaggctatagcgcaatcattgtcattcatctgctaatatatcaactggtgggttctattaacttcaaggaagctttgtgaaacaatcagaatacttgctggaacacagatatcttccatgcataaaaagtagatttatttggtggtcatgcatgttccatattttcccatcttgaacatatctactctgcccaaggaagtaccgaagcggacatgtattgaacaatgaaggtggtttgtataggtaaaatggagtggaatgctgaacaacgagggaatgaggacggcagaaagtgacatcctgtttgagtttattaggatacagataactgtactcagtgggcaatttctggagaataacatcattgttttctgtcatgcataaaagctgtcgatgcatagctattggaataatgaattgatggggtggaagtttcgtggaaatccagcatctattgataatggacagaacaccaggtagaataaagggagacaactgcacagcagcggatttgcagaggaccagcgaatacacgacaacgatgaagctattattgatgctagccggcaagctgacagcaaaggtgaaagcttttcaaaactattttgagtggaagagaaaaggccaagatacattttgaatatgacaggatattttaaaatctagctggcccaggtctaacgtgtggtcgctgtagcctaaggtaagtgctgcgtggtggcaaacgtcaattaaggattttacgtatgtggtttaggctcaagttatgtttgcattatgggatatctatgtacctacaaactctatgtagtatgtgctttatgtggcttgcttggtcggtctccgcgatggtcaggtacttctctttgctgttgcaaatttcactcttgctgttttcgaattccacatgagtccagataaataaagttgtaagatatgcaggggactgctatttgttaaacaatgagtcttttgtgttgtgcctatgctgtaattcagtgcatttatttcttgttgctcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaggggggggcccttttaagagaaaaaaactttaaccccagggaagttaaaataaaaatttttttttgggggaacccaaaacaaataccccccccccttttttaaaaaccttttgtggg

SEQ ID NO: 14982 - DNA, 1412 bp, Sorghum bicolor
  Clone ID: SORBI-28MAY03-CLUS25247_1
gcgccggagccacccaccccacccaaggcccgcaccgaagcacgccgacacaccgagagctatactgcacacacaggtgccacggcaccaggatggtgagcgccaggatcgtcctcctcctccgcgccaccctcctctgcgccggcgcggcggtcgcgtcgtcgtgggaggaccacgacgggcacaggtgcgcgcggcggtgcgaggaccggccctggcaccagcgggcccggggcgtggagcagtgcagggaggaggaggcgcgcgagagccagcagcaggaggagcggggccggggcgaccggcacgagcacgaccggcgcggcgagggctcgtcgtcgggtgacgagcgcgagcaggagcaggggcggtggcggcggccagtacgtgttcgaccggcgcagcttccgtcgcgtggtccggagcgagcaggggtccgtgagggcgctccggccgttccacgaggcgtccaagctgctccgcggcatccggaactaccgcgtggccgacctggaggccaacccgcgctacttcgtcgtgcccagccacacagacgcgcactgcaccggctacgtcgtgcaaggcgagggagtggtgacgctgatatggtgtaaccaactgaggccatgcgagaccgggcaatgccaattcatcgtagagtaggacggggccatcacctacctagccaacaccgacggccggaagaaactggtcatcgccaagatcctccacaccatctccgtgcctggcgagttccagttcttcttcggccccggcgggagcgacccggagtcgttcctgtcgagcttcggcgagagcggccagagcggcggccggcagcgcgtggaggaggcggctggaggacgccacggcggccgtggggagagggagaaggaggagcaggagcaggaggaacgcgagggacgccacggcggccgtgggcagaggaagcaggaggaggaggaacgcgagggacgccacggcggacgcgggcgccgcgaggaggcggcggagacgctcctgaggatggtgaccgccaggatgtgaggccgccgcgcgcgcgctgatcgacgaccgaacgaggaggatgacgcgcctgggcgcgacgtgcgtacgtgtagtatgcaggagcctgagtggagacgttcaacgtgtatgtatgttacgtacagtatgtaagtatgtatgttatgtacagtatgtaagtatgtatgtatgtatgtaagcggcaggcagtgcaataagcgtggctccgtatgtacgtctatgatgctgtaagctactgaggcgaggcgaggcagggcaatgtcaataaataaaataataacacgtgttctccgcaccatccccgcgcgcctgtcgcaaggcacggtgttcgtggtgcccgtcggccacccgttcgtcgcggtggc

SEQ ID NO: 14983 - DNA, 964 bp, Sorghum bicolor
  Clone ID: SORBI-28MAY03-CLUS44332_1
gcacggcacgggggccagctgggagcagagcacgtacgggttccatagcgcacgcatccgatcgatccatatccatcactcgcatcgcatctgatcatcatcatcacgagagcaccatgggcggagggcacgacatgcacggccacaacggcggcgtgaagggctacgtgtccaacctcgtccacggcggcggtggcggcggccatggccacggctatggcggcggccatggcggctacggcggccatgggcatggatacggcggccatgggcagggctacggccacgcgtaccctcctccggccgccgccggcgcgtaccctcctccgcacggcggctacccgcccgccgccgcctaccccgcgcactcggcgcactacgggaacatgggatcgtaccacagcagccacagccatggcggcggccaccacggcggctacggcggcaagcacaagggcggcatgttcggcggcggcaagttcaggaagtggaagtgaagctgaaagccatcgatcgaaacaacacgacacctacctctacggctctacgtacgtatctgccagccggcagccgcgtacgtacgtacgtacgtatcctgccagccgtagctaagcatgcactgcacacagttcctataaataaattaaataaagtagtgcaagcaggcaggacgcgtcctacgtgtacgtacgttcaatacgagtgccagtagtcgttatttgtatacggaataaagtgagacgtgtgtttctggtcatgttcatgtaacgtgctcggcgtatgtaccaccatgcatgcagtgttgtataccagtcgtatatacagtacaagccgagtataatacagtactgctatgtgcatcattaccttgaaattgctacagtaagtgcaagagcctgaagtgagtgctttggcaaaccaaaaaaaaaaaaaaaaaactcagcagtagtcatatgcttgtctc

SEQ ID NO: 14984 - DNA, 740 bp, Sorghum bicolor
  unsure (1)..(740): unsure at all n locations
  Clone ID: SORBI-28MAY03-CLUS287_3
agctgatgagagcactcgagccttttatccgggatgcctcctctgctcctcacggatccagtccgctcctccacccccaccaccagcctctcagtccctcgtcgccgttctccttccaccacgccgccgcctacggcgggtacccgttcgccgccgccgcggccgagggggcgggccagctcagcccagcccagatgcagtacatccaggcccgcctccacctgcagcgccagtcgcagcagtcctccgtgctgggcccgcgggcccagcccatgaaggcgtccgcgtcggcggcggccccgaccccgccgcgtccgcagaagctgtaccgcggcgtgcggcagcggcactggggcaagtgggtcgccgagatccgcctnccgcggaaccgcacccgcctgtggctcggcaccttcgacaccgccgaggacgcggcgctcgcctacgacaaggccgccttccgcctccgcggcgacatggcgcgcctcaacttcccggccctccgccgcgaccccgcgcgtccggccggcccgctccacgcctccgtggacgccaagctcaccgccatctgccagtccctgacgggttccaagaacggcggctcctccggcgacgagtcggccgggtccccgccggactcccccaagtgctcggcgtcggcgtcgacggagggggaggaggagtcggtctccgacggtttcccaactatcactgagctgtcgaccaccgtgtctatgaca

SEQ ID NO: 14985 - DNA, 770 bp, Sorghum bicolor
  Clone ID: SORBI-28MAY03-CLUS287_2
ttcaaatacgcgacaacgccgcctcccgctgcccgctccacgcctccgtcgacgccaagctccagacgctctgccagaacatcgccgcgtccaagaagggcgccaagaagcacgcctccgcctccgccgcagctgctgccgccacgtcgtcgtccgcccccaccagcaactgctcctcctcgccgtcctccgacgacgcgtcctcgtcctgctgcctcgagtccgccgccgagtcctcgtgcccgtccccgtccccgtccgcctcccccgagtcgtcgacggtgccggagatgcagcagctggacttcagcgaggcgccgtgggacgaggccgccggcttcgcgctcaccgagtacccgtcgtacgagatcgactgggactccctcctcgccgccaattaaccaccgaccgacattgttctttccttcttggctccttccgactgctactactactgcaggctgcagcagagggttaaggttaacggccgtcgcgcagaatggtattttagacatcctgcgcgggcactagtggattattagtgctaatcccgttcgttcgttttgtgtagatgttcaattcgtttttgttgctgtcacttgtcaagtcaggttgtagatctcttatgttatttagggtttggttcccggaggagagaaccacaaccgacgggaagccggcgtttttgtgtccggcgtctccggtggtcggtcggtcactggtcagtgaccccggctgttcaggtgtccattgttctggtagctgtttct

SEQ ID NO: 14986 - DNA, 2614 bp, Sorghum bicolor
  Clone ID: SORBI-28MAY03-CLUS287_1
aaagcactcgagcctggagtaacagtgcttcctcctcctctggctaccatcgctactcgtcttctccatccatgtcccaagattcttacatgcctacaccctcctacaccagcttcgccacctcgcctcttcccacccccgccgccacctcctcctcctcctcgcctttctcgcagcttccgccactctactcgtcgccttacgcggcgccgagcatggttgggcagatgggcctgaaccagctcggcccggcccagatccagcagatccaggcccagttcatgttccagcagcagcagcagcagcagaggggtctgcacgcggcgttcctgggcccgcgggcgcagccgatgaagcagtccggatcgccgccgctggcgccggcgcagtcgaagctgtaccgcggcgtccgccagcgccactggggcgagtgggtggcagagatccgctccccaagaaccgcacccggctgggctcggcaccttcgacaccgcgaggacgcgggctcgctacgacaaggcgcttccgcttccgcggcgacatggcgcgcctcaacttcccggccctccgccgcgactgcgcgcacctcgccggcccgctccacgcctccgtggacgccaagctcaccgccatctgccagtccctgacgggttccaagaacggcggctcctccggcgacgagtcgcacggagagagacgcctcaaccccaccaccccacctccacaagaacaccacgccacacatcccatccagctccacggtgaggtttgagcgatccgagcaaaaatcatcagcaacgcagcgcaggtttgttctctgaactctctgattcttcttttagcagcagggacgcccggcccttcgcctccactccccgccgccgccgcaccgccgcgccgcgagccgattcaatggcgccgtcgtctaagctgtcgcagggcatcaagaaggcctcgcggtcccacgcgtaccaccgccgcggtctgtgggcgatcaaggctaagcacggcggcgccttccccaaggccgagaagcccgccgcggtcgccgagcccaagttttaccccgccgatgacgtgaagccgcgcaagcccagcacccggaagccgaagcccaccaagcttaggtcctcaatcactcccggcaccgtgctgattctgctcgccgggaggttcatggggaagagagtcgttttcctcaagcagctcaaatctggcctgctccttgttactggacctttcaagatcaatggagtcccaatccgccgtgtgaatcagacctacaccattgcaacgtccacaaaggttgatatctctggtgttaacgtagagaagtttgatgacaagtactttgcaagggagaagaagaagaaggcaaccaagactgagggtgaactttttgagacagagaaggagtcaaccaaggacctgcctcagttcaagaaggatgaccagaaggcggtggacaccgagttgatcaaagctattgatgctgtgccagatctgaaaacctacctcggtgcgcggttctctctcagggatggcgacaagcctcatgagatggttttctagattagttggtgctaggtgtgaagctcaatagtctgtttgcctgatctacctgagggcgctcttgaattttgtatctgaccagtcaacctttggtttccacttgaatcactgtcaaatctttaatgaagtcatacatctgcctggtagagttagggttgacggccgcaagcgcacaatggtagtttggacatcccgcgcgggcactagtggattattagtgctaatcccgttcgttcgttttgtgtagatgttcaattcgtttttgttgctgtcactggtcaagtcaggttgtagatctcttatgttatttagggtttggttcccggaggagagaaccacaaccgacgggaagccggcgtttttgtgtccggcgtctccggtggtcggtcggtcactggtcagtgaccccggctgttcaggtgtccattgttctggtagctgttgccggccgggtccccgccggactcccccaagtgctcggcgtcggcgtcgacggagggggaggaggagtcgggctccgccggctcccctccttccccgacgctggcgccgcccgtgccggagatggcgaagctggacttcaccgaggcgccgtgggacgagacggagaccttccacctgcgcaagtacccgtcctgggagatcgactgggattccatcctctcgtgaacgatcaactacaactgctatagtagtagcagcagcaagattcagtcagtgtcagctcaatggtagctctgtgtaattttcgatttggggtttgcagtggcggtggctcgatggcattttagacatcggccatggcggctgcgagtagcaatgagtaaactagtagctagtacatcgtcgtccagtgttgtgatgcagcagtaagtatgtgctaatctcctggttgagctgccggttgttttttctcacggcacggccagtcgagaaagtcattgtaatcctgtgttattaagtgttatgatctatcagttgcttcttaagtaattcctctggcttatgtatgtaaccatgtgtatatctatccatcttgaat

SEQ ID NO: 14987 - DNA, 485 bp, Sorghum bicolor
  unsure (1)..(485): unsure at all n locations
  Clone ID: LIB3478-052-P1-K1-F3
ctcaaccccacccaccccacctccacaagaacaccacgccacacatcccatccagctccacggtgaggtttgagcgatccgagcaaaaatcatcagcaacgcagcgcaggtttgttctctgaactctctgattcttcttttagcagcagggacgcacagcacanagaaaggtccggttcaagaggctctcttcttttgggtttattagaatcctcaaaagaagcgtgttcttgggttaggatttttttctcaacttcatcacacctctcctagctagggggaacagagatccagagaaccttttttctcttctggattcttgccgacttttgtttggccttcgatcgaaagggttgttttgcaatacccttgtcagctcaccacccctttttctttgcataaacacccacctcgtttctctacttttattgaggaacaggtctgatttccaaactttttcctattttgattttgcataacaaaaa

SEQ ID NO: 14988 - DNA, 1353 bp, Sorghum bicolor
  Clone ID: SORBI-28MAY03-CLUS544_1
cgctcgaggccggcccggccgggaaggcaaccaagggccatctccacatcaaatatatgctagctctagagatgcatcgattggcaataatcctccaccttgttgtggttgtagccggcgccatcagggtgcttggccaccccggcgatgcaggcggcgttacacccttggtgcatttttgggagaaggccctcccgggtacacctgtgccagaggtcatcgccgacctcgtccataaaggcattgatcattcgccgcttgccgagcactaccctgtaactgactacggcgcaagagatgtattttttgacacaaactacgccgtcgcaggagatgatattaagcgtaagaaaggttggcagcgatgccgccgctgtgcagaagacgcaaaagcaggcttctacttccgcgagacacaactgcgtgtgggcagcaccatgaccttctccttccgtccggcaatggttgctcccatcctcccacacgccgtcgctgagaaagtcccgttcggtgacctgccggacttgctcgcgacgttcgacattgcgcccagctctgccgaggcggcgacggtggcggacaccctgagccaatgccaggcgttaccaatcgacggcgagcacaaggcctgcgccacgtccctggagagtaccgtgcagagcgccatgcgcatgcttggcaccgccggcacagacgacgacgacagcgcgacgacgctgtgggccgccgcgtcggcgctcccgagcaccggcttgccactccagccctacgtgatccaggcggtcaccacgctggacggcgaccgccatgtgggctgccatatcatgccgtatccgtacgccgtctacttctgccacatgacgccggcgatgccaacaaaggtgtatctggtctcgctccgcagcagcatcagcggcggcggtccggcggtcaccatggcggcgatctgccacctcgacacctccaactggcagaaggctcacccagccttcgagatggtgcacacccagcccggtggcgtgccggtgtgccacttcatgtcttatggtaatctgctgtttggggagaaggcagtggcggccactcgctaagaatgtatcaacggtgcttgtcagtattgtatgtaagtgagcacaagataaataagcacacacggtgcggtgatgatgtgtgagtaatggcacacgatgtgtctactactatgctcatgtggtctggtaaagcaaatgttatatgtgtgagtgccgcggcgtagtaacgccgatcatatcgattgtatactttgttgtgaatctatgcaatggtgttgctgtataaaaaaaaaaaaaaaaaaggcccctatataacagtaat

SEQ ID NO: 14989 - DNA, 1847 bp, Sorghum bicolor
  Clone ID: SORBI-28MAY03-CLUS9317_1
gcacgacgctgcgctctgcttcttcttctcttctcttctccctcggcttcgagggggagggttatttttatttatttctttctttcctttttttttcttttctattttctttcttttttttttctttttgggttttttttccttcgtcctcccgttggggttttgcgccccgacgaaccctaataatcgccggggaccgaccggcggccgatcgccgcgcctcgcccgcctcgcccgcccgcccgccggcatgcacccgcagcggatgaagcaggccgcggcgcagcagcagctgatgcagcaggccctgctcctgcagcagcagcagcagcagcagcaggcgcagcagccgcccttgttcccggggcaccaccacccgcaccccggcctcctcgccgcgccacagatggagccaatagttagtggaaacctgcctcctgggtttgattcgagtacatgccgcagcgtgtatgttggcaatatcagtcttcaagtgacggacacagtactgcaggaagtcttccaaagtattggtccagtagaagggtgcaaactcatcaggaaagaaaagtcatcctttggtttcattgactactatgaccgcagatatgctgcactagcaattttatctctcaatggcagaccactgtatggtcagccaataaaagttaattgggcatatacaagtactcagagggaggatacatcaggtcattttaatatttttgttggggatctttgcccagaagtcactgatgctactttgtttgcatttttctctggatactctacctgctcagatgctagggttatgtgggaccagaaaacaggacgatccagagggtttggttttgtttctttcaggaaccagcaggatgctcaaagtgcgataaatgacttgaatgggaagtggcttggcaaccgtcaaattcgttgcaattgggcaacgaaaggtgccaatgctggtgaagagaaacagattctggactccaaggttgacctgacaaatggcacatcagaatctggaaaagagaatccaaatgaagatggtcctgaaagtaaccctcagtttactactgtctatgttggcaatcttcctcacgaggctaccaacaatgatgtgcacctgtttttccattcacttggggctggctcaattgaggaagtccgtgtaactcgtgataaaggctttggttttgtaaggtacagcacccatgaggaggctgcgcaggcaattcagatggctaatggccaacttattggcgggaggcagataaagtgttcctggggaagcaaaccgactccaccagggacagcatcctcgcctctgcctcctccagcaccggcactgttctccactggagtgtcgccgacagacttcctggcataccagcgcatggccctgaacaagatggccacgaacccatccctaatgggtcagcacgccttgaatcaggtcgcactggggatgggtggccgagccagccagtccatctatgatggcggcttccagggcatcagtactgccgccgccacaacctccgcccagcaacaacagcagcagcagcagcagctcatgtactactagagtactactactccatgaggcaccagctacctatctcttaaagaggaaggcgaggatgaatggatgatgccccttgctacacccttatacatatagtagatgatgtactaccaggaccttttttataatcttttaagacccatctaagtaacatgtcctctctatgctagctatatatatctatatacaccctataacgtatgtatttctggatacatgaacaccccaaggttcttagtataatcttctgtgttggccc

SEQ ID NO: 14990 - DNA, 2929 bp, Sorghum bicolor
  Clone ID: SORBI-28MAY03-CLUS26_1
cgtccggttgcggcttatattcttgaccatcccgttagtgatagtaaatctggtcacagtgtagggttttctggtgtgcctcccaccacattggtccgaaccttacatagggggaagagcttcaagattggttcactgcagatgttcatggagaacaatggaagcactgaagatatgggtcctcgaccttttcctgtcaaggaggttcacaaaatagcagtactagatattaggttagctaatgctgatctcctccccctcgtggcccacgtctctctctctctctctctcttcttccttgctgtgcactgcaaaccaaccataactctctcttgttctcttccctgcgtgaaccgcggagcaagaaggaagggggacgttggggacttttggggttgggaagcctacatatcatttcactaattccggcgtggtttgggctgggagggaaggaatccgtggaactgcagccccatacgggaggagggcttgaaggaaccggcatgctggggagattctagtgtgaaaggagggaaggcttggcaacggttgcctctttccaatctatcgcggttattgcttggctgagaggtttgaagttcgtccattagcggggctctgttagccttatgcccgtcagttattcaattatgaaacctctgaatatattaaattacttgatgctgaagaggacatcaagtcggtttaggtttaggggggggagctgcctccacgttctgcttcttttctgcgcatcagaacagcgcttttgaagaaaggtgcatcgcgtggctgtagaccaaataacataaggctcatactatggagggaaactgtgaatagggactctgagattgaggtcctcactcctgaatcacagcatgctgttctcccagggtccagtgataacattcttgtagaaaatgtctgtaaaaccatagtccatcaccatgacaaggagtgggtttagaaattcagaatgactgacctggttgttccagctgtatccggtttgttgtaagtattgttgacaaggcactggtcaagggactaaagatttcatttgtttgtatcctcaaattcgatttcacttggttgtaattggtcagaggtacttagcttatgcaaattttgtgaattattggttggttcagattcatcgacacaaagacaggtcttcagaggcctattgcttggattgatgaaaatggaaagcgctacttcccggaatcatttatgcaagatcagaaattatttatcaagaaagagaatggcaacggaaatcctgagtacactagggcgcaatgttatggtactcaagaacaagcttgcagcataggaggatgaggatattggtaatcttgaggatcacaaacttgaatatgatggtgaggagcttgaggaccaagatctagggctggatagaattccatcataaaaaaatactgtgatatgggagaagctattggagaaaatgagccatgtgctttgttgcctacagcctgtaacctactgccacaccaagctaatctgggtgaggtatcacgtgctcagcgcactattgaagccgtggagaagctgttgctgcaggggacctgctcctgttgaaccaatagttaaccgaaaggaatcttcaggactccattattggatgaccacagacaagtccgttaccatattcaccaaaagcaagtacaggttaccggatgtcatcgtggaaatgcaaatgtccgttatgcatggcttccttgctccaaaagcactgtgcatgaaatgatgctgaatggtgttttacaagttcataagccgcccattaattttgcagcctatggagagggcatcctccttacaccagcaaatcgttctgatgcctgtgtgaaatactctgatgttgatgaaaatggcattgtccatatgatgttgtgccgtgttataatggggaacgtagaaatagttcaccctggatctaatcagcaccgacctagtagtgaccatgttgatagtggagtagatgaccttaaaaacccacaacattacattgtgtgggatatgaatatgaataggcacatctattctgagtttgtagtcatcgtcaaattgccttctaaaaccaaagattccttcgtgtctcaagaagagtgtcagaattcatctgatctgtcactggtgttgaattctagttcacctgactgtatttcagaggagatgaacctggaggcacctccagcattgggaggtggatgtgcagcccccatgctaggagattcgatggaaaaggctccaagctcaccttggatgcctttctccatgttgtttgcagcgatctctactaaagtgtctcctgagaatatggacatggttattagttgctatgaagagtttaagagtaagaaaataagccgaggtgaactagtaaagaagctgagacatgtagttggtgatagagtgctaatatcgacgataatgcgtctccaagataagttacctccagtggagaggcgtgaggcaccggacgcatcagcggccaagatggtggcgaaaccgtgaggtgggtgtcatcgtgggcgaggaatgcagaagggaggaaccagcggacttgacataaaaccctgtgggaagcagcaactatgaaagcctcttgcagtcttgcggcatcagtctttatatatggcggctgctgtttgttctctctgtgtcataggagtttatgttggcgaggaaattgtatctggtgttttttcatttcaaagtaaactatgcacgcagctgccgtgctttttgaaccattggaatggttcatcagtcgaaaaggttccttttaccttccagtttgcctttctaagataacagagttgagcattgttgattaatgttggtcttacatatatatagaataatatgtgaatatactatgtttttgagtctgtct

SEQ ID NO: 14991 - DNA, 592 bp, Sorghum bicolor
  unsure (1)..(592): unsure at all n locations
  Clone ID: LIB3476-034-P1-K1-D11
gaagcactgaagatatgggtcctcgaccttttcctgtcaaggaggttcacaaaatagcagtactagatattaggttagctaatgctgatcgtcatgctgggaatattctagtgtgcaaggagggagaacttggcaactacaagctgattccaattgatcatggttattgcttgccagagaagtttgaagattgtacatttgagtggctctactggccccaagcccgtgagccattcaatgatgaaaccattgaatacatcaaatcacttgatgctgaagaagacatcaagcttctcaagttccatgggtgggagctgcctccacgatgtgctcgtgtcctgcgcatcagcacaatgcttttgaagaaaggtgcagctcgtggcctcacaccacatgacatagggcgcatactatgcagggaaactgtgaataggggctctgagattgaggatatcattcaggaagcagaggatgctgttctcccagggtccagtgaaaacatgtttgtagaaactgtatctgaaatcatagaccatcaccttgacaaggagtgagtttagaaattcagaataactgatctangtgtccagct

SEQ ID NO: 14992 - DNA, 594 bp, Sorghum bicolor
  Clone ID: LIB3481-057-Q6-K1-C10
ccccgcgtccgggctagttctaggagcgcgggcgggcgctcgcgatctagaaccccacgcgtccgcccacgcgtccgggtggttaaagcaccacttaacaacttccttttatatgcataaaacaggagatgaacctggaggcacctccagcattgggaggtggatgtgcagcccccatgctaggagattcgatgggaaaaggctccaagctcaccttggatgcctttctccatgttgtttgcagcgatctctactaaagtgtctcctgagaatatggacatggttattagttgctatgaagagtttaagagtaagaaaataagccgaggtgaactagtaaagaagctgagacatgtagttggtgatagagtgctaatatcgacgataatgcgtgtccaagataagttacctccagtggagaggcgtgaggcaccggacgcatcagcggccaagatggtggcgaaaccgtgaggtgggtgtcatcgtgggcgaggaatgcagaagggaggaaccagcggacttgacataaaaccctgtgggaagcagcaactatgaaagcctcttgcagtgttgcggcatcagtctttatatatg

SEQ ID NO: 14993 - DNA, 408 bp, Sorghum bicolor
  Clone ID: LIB3481-009-Q6-K1-D8
cgtccggaaatagttcaccctggatctaatcagcaccgacctagtagtgaccatgttgatagtggagtagatgaccttaaaaacccacaacattacattgtgtgggatatgaatatgaataggcacatctattctgagtttgtagtcatcgtcaaattgccttctaaaaccaaagattccttcgtgtctcaagaagagtgtcagaattcatctgatctgtcactggtgttgaattctagttcacctgactgtatttcagaggtaagatgctttacatggggtattaacaagatagtactgtaacactagagtcaactcctgttgctaacttgatatacagacgagttccactgttggagcagcaagagtgcagtaattcagattgtgtgatttgactcaataattgac

SEQ ID NO: 14994 - DNA, 1003 bp, Sorghum bicolor
  Clone ID: SORBI-28MAY03-CLUS33496_1
ggcctctctgcatcgaacgcacgcccgcactcgcacaccacaatgccacacacgggcgccatgaagacgaaggtcctggtgctcctgctcctgctctccgtgtgctcctcgctggcgctcgaatggcaaacggacacgggctccggctccggctccggctccggccggccgtaccacttcggcgaggagagcttccggcactggacgcggtcgcggcaggggcggttccgggtgctggagcagttcacccacgagctgctggaggacgccgtgggcaactaccgcgtcgccgagctggaggccgcgccgcgcgcgttcctgcagcccagccactacgacgccgacgaggtgatgttcgtcaaggaaggcgagggcgtcgtcgtgctgctccgcggcgagaggaaggagtcgttctgcgtcagggagggcgacgtcttggtcatccccgccggcgccgtcgtgtactcggccaacacgcaccactccgagtggttccgcgtcgtcatgctcctcagccccgtctccacatctggacacttcgaggagttctaccccatcggaggcgagagcccggagtcgttcctcagcgtcttcagcgacgacgttatccaggcgtcgttcaacactcgccgggaagagtgggagaaagtgttcgagaagcagagcaagggcgagatcacgacggcgtccgaggagcagatccgggagctgagcaggtcgtgctcacgcggcggaggccgcagcagccgcgaggagggtggcgacacgggttctcgttcttcttccaagtgggagatcaagccgtccagcctcacgggcaagaggccgacccactccaacagccacggcaagcactacgagatcaccggcgacgagtgcccgcacctccgtgtgctcgacatgaaagttggcctggcaaacatctcccgtgggtctatgatggcgctgagctacagcacccgtgcccacaagatagccatcgtcgtggacggcggcaaaggct

SEQ ID NO: 14995 - DNA, 765 bp, Sorghum bicolor
  Clone ID: SORBI-28MAY03-CLUS1058_2
gccggccgggccgggattagtgctgtgctggtggttcatctcctagctctcgctactagcttattgctggcagtaacaacaatgaaggcaacaactgggtcatcatcagtagctcgcgttcttgttttgcttgcgacgacggcatgcctcctgtggaaagaagccgcgtgcttctcggcgtccggcatgaacaaggcgttcgccactttctacggcggtagcgacgcttcaggaacgatgggtggagcttgtgggtatgggaacctgtactcgacggggtacggcacgaacacggcggcgctgagcacggcgctgttcaacgacggcgcctcgtgcgggcagtgctaccggatctcgtgcgactaccaggcggacccgcggttctgcatccgcggcacgtcggtgaccatcacggccaccaacctttgccctcccaactacgcgctgcccaacgacgacggcggctggtgcaacccgccccggcagcacttcgacatggccgagcccgcttggctcaagatcggcatctaccgcggcggcattgttcccgtcaactaccaaagggtgccatgtgtgaagcaaggaggggtgaggttcaccatcaacgggcgcgactacttcgagctggtgctcatctccaacgtcggcggctgcggctccatccagtcggcgtcgatcaaaggatcgaggaccgggtggatggccatgtcgaggaactggggagtcaactggcagtctaacgcgtacctcgacgggcagagcctg

SEQ ID NO: 14996 - DNA, 1454 bp, Sorghum bicolor
  Clone ID: SORBI-28MAY03-CLUS1058_1
gcacgccgggcaagtcgacgcccctcgatcctcgccactccctgtgccgccgctgctggagcctctccccctccttgtgcgctgcactaacgcagccagcactcagggagagcgctggcggctatgcccgcgctcctgcttctgctcgtggcggcggcgctgctgctctccccagcggccgcccgcattcccggcgtgtacggcggcggcggctggcagagcgcgcacgccacgttctacggcggcagtgacgccgcgggcaccgtgggcggcgcctgcggctgtggcaacctgtacagccaggggtccggcgtgaacaacggggcgctgagcacggcgctgttcaacgagggtctgagctgcggcgcgtgcttccagctcaagtgcgagaagcacgccccgggctgggcggctggcgccgccccgcgaccccctccatactggtgacggccaccaccttctgcccggcaaactacgcgctccccgccgacgatcgtgcctggcgcaccccgccgcgcccgcacctcgcccgtgccatgcccatgtccccccacatcgctgaggaccgcgccggcatcgtccccgtctcctaacgccgttctccatcccggggctctggcggcgcgccctggcgcatgagacgctcgcggcgcttccagctggcgctcatcccgcacgtggccggcgctggcgcccgggtgggcacgccatggcgcgggactggggccagaactcgcacagcgacgcggacctgggggcacagccggcgtcgttccagctcacccccagcgccggcccccccctcccgcgtcacaggccggcctcgccgcaccggcagatccgggaaagccgccccgcccaccaggcagttcggctagaccttcgaggtcaggtccttcagggtctgatgaggtcatgtcaaattccaccgcgagtgagaaagaagaagccaagaaggtcttcttcttatacataattattactactaagtatacctagtgattaagagcgtgttagggtgggaatgtccgtgaatgcccctttaaggccaccacgtcttctcgccttaattcgatgtccaagctaagtcctctgaaaaaaaggagtttttgcttctgaacatggggggcaaaagggtcggttagggtatattgctgtctagctggtcccttagtactcgactactccattagtgtgtggttatggatcatgttttggcttgggcctttggggaggtgatggacttctgtcgaaactaaagagtggctgaagtggctgccaagctgcagctcaaaattggggggcggtgagcgtagcccgcagctgctcgtcttgtccttccgtcccgtgtctttctccatgaagtggctagcctttgttatctcattattatcatggacctgattttcattgccagtaagtaaggtgattgaacgtgtaagaaagtttctttt

SEQ ID NO: 14997 - DNA, 2155 bp, Sorghum bicolor
  Clone ID: SORBI-28MAY03-CLUS183_1
tgcacgaggcccattgctcgccaagagttcttcttgttaggcaaggcaaaagcagaagcaaaaaggtctcgttggcgatggcgagctcgggagtttcgtggacgctgccagaccacccgaagctccccaaggggaagccggtggccgtcgtcgtgctggacggatggggtgaggccagccccgaccagtacaactgcatccatgtcgctcagactcctgtcatggactcgctaaagaatggtgctcctgagaaatggacactagtgaaggctcatggaacagctgtgggtctcccatctgatgatgacatgggcaacagtgaagttggccacaatgcacttggtgctggtcggatttttgcccaaggtgctaagcttgtcgatagtgctcttgcctctggaaagatttatagtggagatgggttcaactacatcaaagaatcttttgaaagtggtactcttcaccttattgggttgttgagtgatggtggtgtccactctcgtcttgaccaactgcagttacttctgaaaggtgccagtgagaggggagcaaaaaaaatccgtgtgcacatccttaccgatgggcgtgatgttttggatggcagcagtgttggtttcgtggagaccctagagaatgatctttcggagcttcgagggaagggtattgatgcacaaattgcatctggtggtggaaggatgtatgttaccatggaccgttatgagaatgactgggatgtggttaaacgtggctgggatgcccaggtgcttggagaagcaccctacaaattcaaaagtgcacttgaggctgtgaaaacactgagagcacagcccaatgctaatgatcagtacttgcccccatttgtgattgttgacgacagtggcaaagctgttgggcctgtattagatggtgatgcagttgtcactctcaacttccgagctgatcgcatggttatgcttgccaaagcactagaatacgcagattttgacaaatttgaccgtgttcgtgtccccaaaatccgatatgctgggatgcttcagtatgatggtgagttgaagcttccaagccgttaccttgtttccccaccagagatagatagaacatctggggagtacttggtgaagaatggcgtccgcacctttgcttgcagtgagacagtgaaattcggccatgtcacatttttctggaacggcaaccgttcaggatactttgatgaaactaaggaagagtatgtagaagttcctagtgacagtggtattacattcaatgttgcacccaagatgaaggcgcttgaaattgctgagaaagccagggatgctctcctaagtggaaagtttgaccaggtacgtgtcaacctgccaaatggtgacatggttggtcacactggtgatattgaggccaccgttgttgcttgcaaggcagctgatgaagctgttaagattattttggatgctgtcgagcaagttggtggtatttaccttgttactgccgatcatggcaatgcagaggatatggtgaaaaggaacaaagctggcaagccattgctcgacaagaatggtggtatccagattctaacctcgcatacccttcagccagtcccggttgccattggaggccctggtcttcactccggagtgaaattccggaaggacattgaaacccctgggctcgccaacgtcgcggcgactgtgatgaacctccatggatttgtggcccctgctgactacgagcaaaccctgattgaagtggctgacaactaaagactggccagctatgcccaattttggttctatagtttgagaatggatatggccatgtcatttaataatttatgtttgcaagcacgttgctcaaactcagcaaaacattgagagatgccttttgacttgcatttagatgctctatttataccgatgacagttgtatgctgtgctggcttttggcagtttgatagctatctttatttagctatgtatactgtatctgaggccgcaaactttgtctcagtctaaaattgctcgaggttatatactgtttgtgtgagtcatcactagtgattgccttttgcctcacgccttgacgaacgagttcgttaacctgctgagaatggactcatggtaatacggtaatagcttttgtgggaaggtgcagtaatagt

SEQ ID NO: 14998 - DNA, 849 bp, Sorghum bicolor
  Clone ID: SORBI-28MAY03-CLUS875_3
cccaaccagaccaggggcggcgctggctgacgaggaggcggagtagagcggccggactaactcgataccgccacagccaccatgggtatctcgcgtgactcgatgcacaagcgccgggccaccggtggaaagcagaaggcatggcgcaagaagcgaaagtatgagcttggccgccagcctgcaaacaccaaactgtctagcaataagacagtgaggagggtccgtgtccgtggaggcaatgtgaagtggagggctctccgcttggatacaggtaactactcatggggaagtgaggctcttacccgcaagacccgcatcctcgatgtggtctataatgcatcaaacaatgagcttgtgaggactcagactcttgtgaagagtgccattgtacaagttgatgctgctccattcaagcagtggtacctcactcactatggagtggacatcggtaggaagaaggtgcctgttgccaagaaggatgcagctgagggacaagagggtgaggctatagctgaggaaacaaagaagagcaaccacgtacaaaggaagcttgagaagcgccagcaggggcgtgcacttgacactcatattgaagagcaatttggcagtggaagattgttggcttgcatttcttcccgccctggacagtgtggccgagctgatggctacatccttgagggtaaagagctagagttctacatgaagaagctccagaggaagaaaggcaagggtgctgcatcttagagcattcatttagctagaacagcagaatatcttgttttttcatataatttgtgcacctgatgaacactataagtgaatcaactcgctttcgaagaaataacgatt

SEQ ID NO: 14999 - DNA, 2284 bp, Sorghum bicolor
  Clone ID: SORBI-28MAY03-CLUS875_1
gcagtaattacaaggaaaaaaaactgcaccaccgtgttcaatgtgcctcggaacttctgatcaatgtgctttgaaggaaacacaattgcagcaataggtttgtctgcataaccaccaccttcatcgattatgaatcggaggccgtcgatgtggagcttcccgtggtggccacttacaatgatagtttgcttgccagtcagatccttgggtgtgttccaaacatcttgcctcccactaagcatttgaacctttggcacccttgtgtctctggttctcaaaactctaagttgctcattcaaatctatggtcctctctaggccagcatggacggcaatcgaatccggccgggtcggccttgtgatacccaaccagaagtgcggcggcgcaggcggaccaggaggaggcggaggagaagcagcggagccaagccaccgccgccaccatgggtatctcgcgtgactcgatgcacaagcgcagggccaccggtggaaagcagaaggcctggaggaagaagcgaaagtatgagctcgggcgccagccggccaacaccaagctgtcaagcaacaagacagtgaggagggttcgtgttcgtggaggtaatgtgaagtggagggctcttcgcctggatactggtaactactcatggggaagtgaagctgttacccgcaagacccgtatccttgatgttgtctacaatgcatcaaacaacgagcttgtgaggactcaaacccttgtgaagagtgccattgtgcaagttgatgctgccccattcaagcagtggtacctcactcactatggagttgacatcggtaggaagaaaaaggctcctgctgcaaagaaggaagctgctgagggacaagagggtgaggcagcagctgaggaagcaaagaagagcaaccatgtgaagaggaagcttgagaagcgtcaggagggacgcgagcttgatgcgcacattgaagagcaatttggcagtggaaggttgctggcgtgcatttcctcccgccctggacagtgtggccgagctgatgggtacattcttgagggtaaagagcttgagttctacatgaagaagcttcagcgcaagaagggcaagggcgccgcagcttagagcattctcatggatggtcttacgccgaaatgtgtggcctattaaatattactcttgcttttttgttagtcgtctcaagttcagagcgtctatgtcatgttttgcagacctgagaacactattttctgaaaatgaatcaactctatctagctcttaagaattgagattttccggttgtatttttgtaactatgggtgtgactgtttaatcgctccgatatttcccttcatcccctagcaattcttgtgcaaagatgaattctccaagaataaattgccgtggacatacttgtactcgctcccggcggcgggcggcctgcgcgctgcggctcagcgcgtgcggcggccccgtcctccccgagttctgcccgctgcgcgtcagcgccgctccccgcgcccgccacggctggcgcggccccctccgcgccgacgacttctggccgccgcacgccgccgacttcgacgacttcgccgccgccgccgccgcctccttccatcccgaccaaggtactgtaatactcattgttcatttgcacgcttgctacctgcagtgacacggccagcaggccggacacacgctccaccgcctgaacctgacacccgtagcgtgcatggtgcagagccgccggccaggaagcgggagcgcaagaccatgtaccgccgcgcaggggatgctcgccatgtcctgcgccggcggcggcggtggcagggaccacctcgtcgactacgacgtcgacgtcatgggcatgggcatggggacgacgttcttccagcaccacccgcagccgtcgtacgtgtccgacgccgtcaccgtggcgcagcaggagcaggtgcccacggtcgcgtacgtgcaccaccaccagctgccgccgccgcaggacgacgccgcggggatggacatgtggacgttcgacggcatcaacacagccgtgcccatgtgatgccatgtgatagaccacgcatctgcttccttaccgttactgctagcttatcaacatgttgttgctgctgcttttcaaatattagtagtaggtttttatacatacactgttaggagtaatttatctgcccatgtaactaggggtggaactctagcatctcacagttgttccccttcttcccctagcaattcttgtgcaaagataattctccaagaataaattgccgtggacatact

SEQ ID NO: 15000 - DNA, 783 bp, Sorghum bicolor
  unsure (1)..(783): unsure at all n locations
  Clone ID: LIB5052-012-A1-XP1-G3
gccggccgggctgcggatcgaatccacatcgaatccaatcaagcacctttgcctccttcctcgacctcgacttgctcctcctcaccaccgcaccgcagtttgtagacgcagacgcagcagcaggctacctacgcaaatcggaacaacatgtgtggcggcgccatcatctccgagttcatcccgcagcgcgacagcgccgctgcccgcgccggccacggcaagcgcggcctcgtctgcgccgacgacttctggccgccgcacgccgccgacttcggcggtggcagggaccacctcgtcgactacgacgtcgacgtcatgggcatgggcatggggacgacgttcttccagcaccacccgcagccgtcgtacgtgtccgacgccgtcaccgtggcgcagcaggagcaggtgcccacggtcgcgtacgtgcaccaccaccagctgccgccgccgcaggacgacgccgcggggatggacatgtggacgttcgacggcatcaacacagccgtgcccatgtgatgccatgtgatagaccacgcatctgcttccttaccgttactgctagcttatcaacatgttgttgctgctgcttttcaaatattagtagtaggtttttatacatacactgttaggagtaatttatctgcccatgtaactaggggtggaactctagcatctcacagttgttccccttcttcccctagcaattcttgtgncaagatgaatttctccagaaataaatgccgtggacatactttgtattaaaaaaaaaaaaaaaaagcccct

SEQ ID NO: 15001 - DNA, 423 bp, Sorghum bicolor
  Clone ID: SORBI-28MAY03-CLUS14457_4
gccggccgggccgggcaccaataaaaccaaacagccatcacaaaaaaaaaaaaacaagcttcaaagatggtgtccaagaagatggtcgtcgtcgtggcggcgctgctgctcgtggcgctcgcactggaggctgcccctccggcggccgccatggactgcaaggctgggtgcgccgaggtctcaggcccactcggcatgagcacggaggagtgcatgaagaattgcgatgcgatcgccgccgggcgcaatggacaacccagggacccttacaaggatgacaagcttgacatcccaaaataaatggctgtaactggtgatatctgcctatatatccatgcatggtcgacagatcatgcatctatatatgtactatgcatatatatatgcctgtccacgcaaaaaaaaaaaaaaaaaaggccccta

SEQ ID NO: 15002 - DNA, 535 bp, Sorghum bicolor
  Clone ID: SORBI-28MAY03-CLUS14457_3
gccggccgggccgggaaaaccaaacagccatcacaaaaaaaaaaacaagcttcaaagatggtgtccaagaagatggtcgtcgtcgtggcggcgctgctgctcgtggcgctcgcactggaggctgcccctccggcggccgccatggactgcaaggctgggtgcgccgaggtctcaggcccactcggcatgagcacggaggagtgcatgaagaattgcgatgcgatcgccgccgggcgcaatggacaacccagggacccttacaaggatgacaagcttgacatcccataataaatggctgtaactggtgatatctgcctatatatccatgcatggtcgacagatcatgcatctatatatgtactatgcatatatatatgcctgtccatgaaatttggtttcccctttctatatttttggcgtccgacaaagttcgacaagctataagtcacccatgttcctccatggatccatcggatctgtagtaatgtaatcggtccattcaagggataaaaaaaaaaaaaaaaaaaggccccta

SEQ ID NO: 15003 - DNA, 607 bp, Sorghum bicolor
  Clone ID: SORBI-28MAY03-CLUS14457_2
tcgaggcgccggccgggccggggaccaacaacatctgtcaccaataaaaccaagagacatccaccacaaaaaaagagaagcaaaatggcgtccaagaagatggtcgtcgtcgtggcggcgctgctgctcgtggcgctgatgacgctggaggctgcccctccggcggccgccgcggactgcaaggccgagtgcgtcaagttcgcgagctcactcggcgttagcccggaggattgcgtgaagaagtgcgatgcgttcgccgcccagaaccaaggtggtcaacccgattacatgaacaagaagttggacatcccataaatatatatatatatgctcgatcgtacctggtgatatatctgcctatccatgaaatttggttttcccttcccttcctatactatttggatccgacaaagttcgacaatctaattaagtcgcccgtggtttctccatggatggatatgatccaccgatcgatggatctgtaataatgtaatcggtccactcaagagaccaatgcttgttattttatttgtattccacgcatcatatataagaaatacaaaggcatgcaattgagccaaaaaaaaaaaaaaaaaaggcccctaag

SEQ ID NO: 15004 - DNA, 759 bp, Sorghum bicolor
  Clone ID: SORBI-28MAY03-CLUS14457_1
gccggcccgggtttgccgggccgtaggtgacggtgagtcgagctcgccggccgggccgggtaaaaccaaacagccatcacaaaaaaaaaaaaacaagcttcaaagatggtgtccaagaagatggtcgtcgtcgtggcggcgctgctgctcgtggcgctcgcactggaggctgcccctccggcggccgccatggactgcaaggctgggtgcgccgaggtctcaggcccactcggcatgagcacggaggagtgcatgaagaattgcgatgcgatcgccgccgggcgcaatggacaacccagggacccttacaaggatgacaagcttgacatcccaaaataaatggctgtaactggtgatatctgcctatatatccatgcatggtcgacagatcatgcatctatatatgtactatgcatatatatatgcctgtccatgaaatttggtttcccctttctatatttttggcgtccgacaaagttcgacaagctataagtcacccatgttcctccatggatccatcggatctgtagtaatgtaatcggtccattcaagggatcagtgcttgttattctatttgtattccacattataagaaatacaaaggcatgcaattgagcaaaaaaaaaaaaaaaaaaggcccctaaaaaaaaaaaaactataagccgcggcgctcgcgatctagaactagtgcgctggggggtcgcctggacaacgccttaagaactatggctactattcactcatgtcttgcaaactgag

SEQ ID NO: 15005 - DNA, 813 bp, Sorghum bicolor
  Clone ID: SORBI-28MAY03-CLUS28_13
caaaaccaccatgactggaagtgtcaccttccttcagctacagattgtttcattaatacatggtaacaaaaataaactagacaagggcatagaatttcaattctctctgaatagcataataaacagtgcggtaatcgcagaatggtagtgcacttaatccgcccgggattgaccagcacgggatgaaaggataattccaacgatgagaccatagagagcaagcgcttctgcgaaagtgaggatgaggatcatgcccacgaaaagcttcggctgttgtgcatttgccctgactccagcatcaccaacaatgccgatggccatgccagccgcaagcccagcaaggccacaagcaatagtatgctggggttgatccccgtgctgatgatgacggcgatgatgagcccgtagataccgagcacaccagccatgacgacgggcacgatggacttcatgacgagctccggccgcatcacacccatcgacgccacgcccacgccgctcttcgccgtcccgtacgccgcgcccatgcatgagaagacgagggcggcggcggcgccgaggaagccgaagaagggggccgtctcatcgccgctgaacaccgacgacatcttgttcgcctccggcttcctgctcctcctcctctccttgcctctgtgtggtggcttgctttgctcggtctccggtgtgccgcgtcgctggggcgaggagggagggacggagggaggaaagggaaggtgggttgggcaggcaagcagatgcgatctctctcgagccgagtttggtttctttcggacgcgtgggcggacgcgtggg

SEQ ID NO: 15006 - DNA, 937 bp, Sorghum bicolor
  Clone ID: SORBI-28MAY03-CLUS28_12
caaatttgtcagccactacaacatcagtgggaagcaggagtgagaccccctttgacttggctttctcaataagtgaagttgccagttcaagcttgtcttcctcaacaggagatttgcctacagcatatccctgggccttataaaatgtgaatatcataccaccaccaaggattaggatgtcaaccttagccaatagagactcaatcacccctatttttgtggacacctttgatccaccaacaattgcagcgaatggcttctttgggttggcaacagcgccaacaagatagtcaagttccttctgcataaggaagccggccacagcaggtttcaaatacttggtaactccctcggttgaagcatgagctctgtgtgccgtaccaaaggcatcgtttacatagagatcagcaacagatgccagcttcttggcaaattcagggtcattcttctcttcctccttgtagaacctaacattttctaaaagcagaacacctccatctggtaaagaagcagccaacttctgaacttcctcaccaatgcaatcattggccataacaacattaactccaaggagctcagacaagcgcgggacaagaggcttcaagctgtacttgggagtgacaccttttggacgtcccagatggctggccaggatgaccttggcgcccttctccatcaagaacttgatggtggggacggacgcgcggatgcgggtgtcgtcggtgatcttctggctgtcgcccagcgggacgttgaggtcggcgcggaggaacaccttcttccccttcagatccgcctccgtcagggtgcccacgctcttcttggtcgccattcctcccctaaactaaacccagtaccagggaacaggctggtcggattcttgggggctgatttgggtccgaggtgggaagaacaggagcagctttggatacaccgg

SEQ ID NO: 15007 - DNA, 886 bp, Sorghum bicolor
  Clone ID: SORBI-28MAY03-CLUS28_9
ccttggctacacaagttttcttgtttctcgactcaacagaagaacgaacctagacagcataaaaaaataagcctctaaaaagtgctccagcttcttgtctcatggatatagaacatgacccagctacgaccaggtaacggtaacagtccgcacggcgttgacatctgaaatgtgtgcctaatctgcacgggattggccagcacgggatgaaaggatgatgccgacaatgagaccgtagagggcaagcgcttcggcgaaaataaggatgaggatcatgcccacaaacaactttggctgctgagcattcgccctgacaccagcatcaccaacgatgccaatggccatgcctgcagcaagcccagcaagaccacaggcaaggccagacgacaggtgggcgtagccgtcaaagaggtagtacggcttggccttggggttgattccagtgctgataatgacagcgatgatgaggccatagataccgagcacaccagccatgaccacgggcacgatggacttcatgacgagctcggggcgcatgacacccatggacgccacgccgacgccactcttggccgtcccgtacgccgcccccatgcatgagaagacgagcgcggcggcggcgccaaggaagccgaagaagggggcagtctcatcgccgctgaacgccgacgacatcttccccttactgttgctgctgcgacgagagcgggaaccctggggcgctctcgtgccgctgcctcctcttcgtcgtgtggtcgccggcgcgagcgctcgaggtttcggtcctctgctcgggattggccttgccgatctgatctgagggagcgccgggccggccgtggggaagaagacgagagggccacggcgctgccccggcccggccggc

SEQ ID NO: 15008 - DNA, 1390 bp, Sorghum bicolor
  Clone ID: SORBI-28MAY03-CLUS28_8
atgctcagcagccaaagttgtttgtgggcatgatcctcatcctgattttcgctgaagcgcttgccctctacggtctcatcgtcggcatcatcctttcatcccgtgctggccaatcccgtgcagattaggcacatatttcagatgtgaatgctgtgcggactgttaccgttacctggttgtagctgggtcatgttctatatccatgagacaagaagctggagcactttttagaggcttattttttatgctgtctagttttcgttccgttgagttgagaaaacaagaaaacttgtgtaaccatgggtggacttttcccttgtggtgtcattcttttccccgtcgtggtggtgggctgtggttgatgcttctttctgcacagtttttgctggggctgtaatctggtgaataagcgagtgcatgcaacgcaatgggagctgaagactcttgttcaatcctcttgtttagtcgttttctgtgatctaagaaaaaaaaaaaaaaaaagcctctaaaaagtgctccagcttcttgtctcatggatatagaacatgacccagctacaaccaggtaacggtaacagtccgcacagcattcacatctgaaatatgtgcctaatctgcacgggattggccagcacgggatgaaaggatgatgccgacgatgagaccgtacagatatgtggattgcaaatataggtgattcaagagctcctccatgttcatggcctacagcccggatgcttccatgaagaaagcatcctctctctcggcgagggccttggcgtcctcggtcgggacggccctgaggtggcgcagatccgccttgttgccgacaagcatgatcacgatgttggcgtccgtgtggtctttgagctccctcatccacctctccacgttctcgaaggtgacatgccgtgtaacgtcatagacgacgagtgctcctactgctccacggtaataggcacttgtgatagcacggtacctttcctggccggcggtgtcccagatctgggccttgacgaccttgtcgtcgacgtggatgctgcgggtggcgaactcgacgccgatggtggacttggactcgaggctgaactcgttgcgcgtgaagcgcgggagcaggttcgacttgccgacgccggagtccccgatgagcaccaccttgaagaggtagtcgtagtcgtcgtccgcccggtacgccatcgccaccaccacgggcacacacgcacacaaaggctggccggctggctagcgggccttgggccggcggcggcgggacgggcggtggatgaggaggggagcgcggatgggagggggcggcgagagagagagagagagagcacccggacgcgggtgcgggttttttctcagttcctcctctccccggcccggccggc

SEQ ID NO: 15009 - DNA, 939 bp, Sorghum bicolor
  unsure (1)..(939): unsure at all n locations
  Clone ID: SORBI-28MAY03-CLUS28_7
taggggcctttttttnttttttttntatcttaaaatctgcaacgacagctataataacaatataaagcaccaggacctcaagagccatggcgctggtacagatgacatatccaattacacaggccatgctgctgatacgagaggatagcagggcccagacacgaaccgaatgggaccatgtcgaattattgctgcatacacaggaggctctgaaaagctctagttttcctgggcaccttcatcagatggggcttccttctcctttaccgcctgcgcagatacctcccttggcttctcttcggttgtctgtgccttctcagcctcagtggtggcctcactggcttcaggggccgtgcttgcggtgctgccgtcttcaacagggacggtcttcttgacagtaccaaccttcacatacttgctcatgaacttgtattcccaatcctgcagggcgtcaagctcaaatgggcctaggccagagatgtcgccagtaagatcctgtggctcaaaggacatctttgctagggctctgctggcatctttaccagcaaatagggcataaggtccgccaggtccatagaacaccctgcccggcctgacgtcgtagatctggcccttgatggccatgaggagcggcttcttagtgtcggagccgtcgtactggcggagctcctcctcggagacctcccccaactgcacggggggcgggagcggctccgcctcgggctcctcccgcgggcgcggcggcggcggcgacggggccgcgaagagccccgacacgacgtggtacagagcggccgccaccgcgacggccgtgaagaaggccgccggcgacaggcccgtgtacgcaacgatcgcctgcttcagcgtctcccacagctccgccaccgccatcgctggttgtggtggtctggctccgccggtgggtagaggtgcgatgac

SEQ ID NO: 15010 - DNA, 460 bp, Sorghum bicolor
  Clone ID: SORBI-28MAY03-CLUS28_5
caagagctcctctcatgttttaagaagatatctctgctacgtatactggtaccacatacgacatgacaccgacaccaaatccttcaagcaatcttcccatatacagaaacgaagtgtcttttgctaaggagattgcaagccagcccatgatgttcggaatcgctgcaatcatcagtgaccctctgcggccaatgtacttggccatctggccgctggcaatcgccccgaccatggcgcctacattgggcagcgagccgaacaccgagaactcggatatggagaggttgaggtcccggacgacgccgtcctgcgtcggcgaggagtacccgttggtgaagcccaactggagggggccgagcgcgacgatgaacgtgcacagcaaggcggggacgtgggactcgcgcaggacggcaatggaggtgccggcgccgttgaggcaggactggcgcgaccccatccc

SEQ ID NO: 15011 - DNA, 839 bp, Sorghum bicolor
  Clone ID: SORBI-28MAY03-CLUS28_4
catcagaaaataaaaaagttaaaaagaaaaggacatgcatatactacacatgcatgcacaagcagattatgtgtaataacctaacccatgcatgcatgcagattatgcagagcaacaacgaacgacgacatacatagtatgagcgatcaaattagagcaaatcataatgctcatgcattttaataaaattaagcggggcaggtgaagtccgcagggcagatcttgccgcagtggttgaggaggagggtcaggtcgacgggcacgttgaggttgatgcccaggatgttggccttgatggcggtgcagaggcagacggcggcgtctaggtccaccaggccttccagcagcggacagcactggtcgttcttcggggggatgctgagcttcagtaggttcagcacgttggcacacacctccagcttcagcgcgttcatcgggcacgacccgccgccaccgccagaaggcggcgatggtggcggcaccaccggcggagtaggacagtacggcgtgcagccatgcaccagggccaggacagtggagaggatggtcagggccaggaacagggaaataagcttggatgccattgctaccgatcagagagctagctagtagctatagctcttcaatcaaagggattaagtgtctcttctgatcgagctaggtgtgtacgtccggccggcactaccatgctgctcctgcgcacgtccatgtgttatcattcactggtgtactagatcgctttgttttttttgcaacatgaaaatgttatggaggatatggggaacctaaatggatgctagcaaggctagtgaagctgaagaaggaggaaagcataaacg

SEQ ID NO: 15012 - DNA, 2445 bp, Sorghum bicolor
  Clone ID: SORBI-28MAY03-CLUS28_3
ctatctcatcatagtagtcgcctttgtcatacccataaggatccggacgcgtgggtacagactgtctcattaatacatggtagcaaacatacactagacaggggcatagagtttcaattctctctgaatagcataataaacagcgcggcgatcgcagactggtagtgaacttaaccaaactaaaccacgttgaagggatgaaaaatgtcgaacaaaacatatcatacaaatccatgggagtttgttagttccaaatttccgaattccagtcacttcactcacagcagcgaggaagtaaaagcttattcacgactcatctaccaaaaactcgatggcaagcctatctcaagttcatataagccataactttgcagtgttacaccaaggtccggaacaaaatgacacgcaagctggcagaccgagtagcttaggcgtcatcgagggcaaggacacctggtagagtcttgccttccaagagctccaagcttgcaccaccgccggtcgaaatgtggctcatcttgtcggccagcccagccttctcaacagcaggcaacagaatcaccaccgccgatgatggtggtgacaccctttgtggttgtacgctccgccagcttcttggcaatcgcctcagtgccagctgcaaacttcgggtactcaacaactcccatgggacccgttccaaataatagtatgggcggggtccaaagagtcattgaatgttagggttgcatcagggcctacactccaaacctaggcaatcagcaggaatagcagtgggaggattcatctcggtctgagcacgagctgcaagcccgtctgctacaagaggatcagctgcatggtatagggcaacccggtctggcggagcgcctccgacgatacgaccgtaaagggcaagcgctgcggcgagcgtgaggtcatcgatcatgcccacaagcaactttggcggcggaggagtagccccgacaaccgcatctccgaaggataccaatgggctcgcctccaggaaggccatcaagacgacaggcaacgacaggcgccagatcggcaaaaccgcctgccagggcgtattgcctggccctgagcccgacaacagcacagtcaagtccggtcgtcatgagggcatatacaccaacgaggtcgaaatgcttggccagtccgtcggtcctcgtgcggactctgtgtgccgtggcaaaggcatcatttacataaaggccaccaccagatgctagcttcttagcaaactcgggctcgttcttctcttcctccttgtagaatctaacattctctaggagaagaactccaccttctggcaaagcagcaaccaacttctcaacttcctcaccaatgcaatcattggccatcacaacttcaactccaaggagctcagacaagcgtggaacaagaggcttcaagctgtactttggggtgacaccttttggacgacccaggtggctagcgaggatgaccttggcgcccttctcgaggaggaacttgatggtggggacggaggcgcggatgcgggtgtcatcggtgatcttctgggcgtcgtcgagcgggacgttgaggtcggcgcgcacgaacaccttcttccccttcagatccgcctccccaagggtaccgacgctcctcttggtcgccatatcactccccgcggggttggaagaaccggatcggatcggcggacgacgacgacgacgagatcggtggacggtggtggtggtgggatgcgaatggcgatgaggcgagtttgacgtcccagatggctggccaggatgaccttggcgcccttctccatcaagaacttgatggtggggacggacgcgcggatgcgggtgtcgtcggtgatcttctggctgtcgcccagcgggacgttgaggtcggcgcggaggaacaccttcttccccttcagatccgcctccgtcagggtgcccacgctcttcttggtcgccattcctcccctaaactaaacccagtaccagggaacaggctggtcggattcttgggggctgatttgggtccgaggtgggaagaacaggagcagctttggatacgaggcagtttttggggttgatccccgtgctgataatgacagcgatgatgaggccatagataccgagcacaccagccatgaccacggggacgatggacttcatgacgagctcggggcgcatgacacccatggacgccacgccgacgccactcttggccgtcccgtacgccgcccccatgcatgagaagacgagcgcggcggcggcgccgaggaagccgaagaagggggcagtctcatcgccgctgaacgccgacgacatcttccccttactgttgctgctgcgacgagagcgggaaccctggggcgctctcgtgccgctgcctcctcttcgtcgtgtggtcgccggcgcgagcgctcgaggtttcggtcctctgctcgggattggccgagcc

SEQ ID NO: 15013 - DNA, 1039 bp, Sorghum bicolor
  Clone ID: SORBI-28MAY03-CLUS28_1
cccacgcgtccgcccacgcgtccgggagcagctcctgagcagctacccagcgggccaccgagttaatttagcttactccatatacacactgctactaagattgctactagctagcatggcggcaagttcatggtcgtcgtcttcatcctgcacatcgtcgttcgggtccctcgacgacgatgtcgtctgcgtcatcaagtcggattccgtggctgccgcagccgttgcggagggaagcgtcaagttcctgtgcagctacggtggtaggatcctgccccgccacaccgatggcacgctgcgctacgtcggcggcgacaatcgagttctctccgtcgaccgacccctccggttttacgacttgcagcggaagatgagggaattgtgcggctgggaagcgtacctgcggtgccagctaccgacggaggacctggacgcgctcatctccgtgacgtgcgacgacgacctcgccaacctgctccaggagtacgacgaggccagcaaggaccgtctccagtcgctcaaaatccgggcgttcctgttcccgaggacgccggcgcctgcgtcctccataccgcgtagtagcccgccgtcgtccccgtcgtcgcattccagaccgtcaccgagtgctcacctccacaggcgaaacacttcccgggcgcccgcagccggcgtctcgctgacgtgcgcgccgcggtggtgggcagcgccccgggcctctcgccaggcacaagcgcaccagtcgcagaactacgacctgcgtagccttgacgaggagcggtcgcacccgcaccggtaccttgtccaaaatggcaggcacttgcaataacgtgacatgagcagctcctccggaccatgggatgagcagatcggagtgtaatacagtgtacagtgcgcgcgcgtgatgcctgatgcgtgcgcaccgtgcacgcaacgtctgacatgtactaccatgctgatcctgtgcacgtccatgtgttatcatccactggtgtactagatcgctttgttttttttgcaacatgaaaatgttatggaggat

SEQ ID NO: 15014 - DNA, 1062 bp, Sorghum bicolor
  Clone ID: LIB3478-015-B5_FLI
ggagcagctcctgagcagctacccagcgggccaccgagttaatttagcttactccatatacacactgctactaagattgctactagctagcatggcggcaagttcatggtcgtcgtcttcatcctgcacatcgtcgttcgggtccctcgacgacgatgtcgtctgcgtcatcaagtcggattccgtggctgccgcagccgttgcggagggaagcgtcaagttcctgtgcagctacggtggtaggatcctgccccgccacaccgatggcacgctgcgctacgtcggcggcgacaatcgagttctctccgtcgaccgacccctccggttttacggtgcataatatttctgccgaccaatctatacacaagtccatcccctgaattcaatcctttaatttctctgacttcatttgggttacctgatcgtgtctgtcggcagacttgcagcggaagatgagggaattgtgcggctgggaagcgtacctgcggtgccagctaccgacggaggacctggacgcgctcatctccgtgacgtgcgacgacgacctcgccaacctgctccaggagtacgacgaggccagcaaggaccgtctccagtcgctcaaaatccgggcgttcctgttcccgaggacgccggcgcctgcgtcctccataccgcgtagtagcccgccgtcgtccccgtcgtcgcattccagaccgtcaccgagtgctcacctccacaggcgaaacacttcccgggcgcccgcagccggcgtctcgctgacgtgcgcgccgcggtggtgggcagcgccccgggcctctcgccaggcacaagcgcaccagtcgcagaactacgacctgcgtagccttgacgaggagcggtcgcacccgcaccggtaccttgtccaaaatggcaggcacttgcaataacgtgacatgagcagctcctccggaccatgggatgagcagatcggagtgtaatacagtgtacagtgcgcgcgcgtgatgcctgatgcgtgcgcaccgtgcacgcaacgtctgacatgtactaccatgctgatcctgtgcacgtccatgtgttatc

SEQ ID NO: 15015 - DNA, 618 bp, Sorghum bicolor
  Clone ID: LIB5051-006-A1-XP1-B8
gccggccgggctgcgacaacccagccgcacgcaacgcagttagacaccgcgccgccacccccacgcacgacgtcggctgttcggcacctcgcacatcgacaccctcgtccggtgactgccctttccccaaccccgctccggtcctcccaagatttatcagggctcatccctgctcgtggattcaagatgtatctccagtactacatcaacgagaagggagacaaggtttacaccaccaagaaggagtcgcctcttggggtaccaacgcagtctgctcacccggctcgcttctcaccagatgacaagtactctcgccagaggtacctgttgaagaaaagatttgcacttctgccaacccagaagccagcaccgaagtactgaagcctcaagccctcaactgtccaaccacggatgttcaggagaaaaacatctgttactctgcttgttggttggaatgtactgtagagtagctatctgagaagaaattaaacactgccgatgcactactatgatatttcagcagcacattcagacacaatatgtaatgctatgtgattggcagatggtgcttcctaagtgtgtctcgtttgggcaaaaaaaaaaaaaaaaaggccccta

SEQ ID NO: 15016 - DNA, 494 bp, Sorghum bicolor
  Clone ID: LIB3476-030-P1-K1-A2
gtaccgatccgcagtgtcgagcccacgcgtacggtgctgaagctaaactcctgatccgtcttccaagctctggtatcatccctgcacactgattcaagatgtatctccagtactacatcaacgagaagggggacaaggtctacaccaccaagaaggagtcgcctcttggggtgccgacacagtctgctcacccagctcgcttctcaccagatgacaagtactctcgccagcggtacctattgaagaagagatttgcacttttgccaactcagcagccagcaccaaagtactgaagctccaactgtccaaccatgcatgttcagtttgtgtcacggtttgttggttggaatgtagaaagttattctgagaacaaaaatcaaacattgctaggcactactatggcatctctccagcacattcaagctctatatgtaatgctatgtgattgacatgttgtgtccttaatatgtacttgtgcgtggaccaatacgcta

SEQ ID NO: 15017 - DNA, 521 bp, Sorghum bicolor
  unsure (1)..(521): unsure at all n locations
  Clone ID: LIB3476-028-P1-K1-H11
cgacccacgcgtacgctcttntgacggacatcggaggaagaagaagaagaagagggagagcgagcaggggcgggcgtggttcgggaaggaatggctggtcggcgcgcggaggaggagtacgactacctgttcaaggtggtgctgatcggggactcgggcgtcggcaagtccaacctcctctcccgattcacccgcaacgagttctgcctcgagtccaagtccaccatcggcgtcgagttcgccacacgaacactccatgttgagggcaagatcatcaaggcgcagatttgggacacggcaggccaggagcggtacagggcaatcacaagcgcctactaccgcggtgcgctgggcgcggtcctggtctatgacgtgagcaagcctaccaccttcgagaacatcagccggtggctcaaggagctgcgtgaccacgccgactccaacatcagaatcatgctcgttggcaacaagactgactngaggcacctncgagctgtcgccaccgatgatgcgcagagctt

SEQ ID NO: 15018 - DNA, 446 bp, Sorghum bicolor
  unsure (1)..(446): unsure at all n locations
  Clone ID: LIB3480-016-P1-K1-F3
cttgactatcttgttggcgctgttgccaacccaaagaagccattcgctgcaattgttggtggatcaaaggtgtccacaaaaataggggtgattgagtctctattggctagagcagaaactgaagatgcccaggtggaggaaactactggtatttcaaccaatggtgataatgatgatccattgagccgtttccttcctccacctgtgactacaaaatgctctgcagcattacagcaaaaaattaacaggttccttgcatacaaaagggctggaaagagctttaatgctgaagtgcgcaacaggaaggactacagaaatccagactttttgcagcatgctgtgcggtnaccaagaaatgatcagatagggacctgttttggtaaagatgtttttgatccttatgggtatgacaaaggcgactactatgatgagatagaagcttgaat

SEQ ID NO: 15019 - DNA, 382 bp, Sorghum bicolor
  unsure (1)..(382): unsure at all n locations
  Clone ID: LIB3478-002-P1-K1-D9
catctctccgaatctttcggcatcggcaccggcaccggcgagagaagagaaggggcgacccaggcgggccaacgcgcaccctagcactttatcatcatcaaggggtagacggccctcgaagcgcacccgtccggaccgaccccatcctcctttcccgaacaaccggagcgcggcggcgcggcgcgagacccttccccgccccagtccgccgactactcgcccagagggacttgcgatcgatcgcgtgcccgcggggagtgatatggcgaccaagaggagcgtcggtacccttggggaggcggatctgaaggggaaagaggtgttcgtgcgcgccgacctcaacgtcccgctcgacgacgccncaaaagatcaccgatgacac

SEQ ID NO: 15020 - DNA, 450 bp, Sorghum bicolor
  Clone ID: LIB3476-044-P1-K1-F8
cccgattcacccgtaacgagttctgcctcgagtccaagtccaccatcggcgtcgagttcgccacccgcaccctccagattgaagggaaaaccatcaaagctcagatatgggatactgctgggcaagagaggtaccgtgcaatcacaagtgcttactacagaggagctgtgggtgcacttttagtctatgacatcacgaagaagcagacatttgaaaacatacagaggtggctccgtgaactccgtgaccatgcagactccaacattgtgattatgatggttggtaacaagtctgaccttaaccacctgaggtcggttgcagaggaagatggccaggcattagcagagaaggaaggcctatccttcctcgagacatccgcgcttgaagctcttaatgttgagaaggcgtttcagaccgttctctctgatattcatcaaattataagcaaga

SEQ ID NO: 15021 - DNA, 514 bp, Sorghum bicolor
  Clone ID: LIB5051-012-A1-XP1-E11
gccggccgggtccggaaacgccacttgttctctagcttcctctccctcctctcatcggaagcaggcaggcaggcagccagcaatggccatggcgtcgtcgagcgggctgaggagctgcagcgccgtgggcgtgcccagcctcctggcgccgtcgtcccggtggtccagccgcctgccgttctgcgccaacgccaccacctccggccgcgtcaccatgtccgccgagtggatgcccggccagccccgccctgcccacctcgacggctcctcgcccggggacttcggcttcgaccctcttggtctggcgacggtgccggagaacttcgagcggttcaaggagtcggaggtgtaccactgccggtgggcgatgctggcggtgccggggatcctggtgccggaggctctagggctaggcaactgcgccggaaaaccccttgtaatgtaaagcttatattattaagtagcggctactcttgtagtcttgtatcaaaaaaaaaaaaaaaaaaggccccta

SEQ ID NO: 15022 - DNA, 758 bp, Sorghum bicolor
  Clone ID: LIB5121-003-A1-PF1-G5
acctctacaggctacagcagccaagcagcagcagcagtccgcagactcctcctccgttccctcccctcctctcttcgtcatcctccagaaacccagcagcagctcgatctcttcctctccgaccgcgtgtaaggacatggcggacgccgtcgagcgcttgaagaccgggttcgagcagttcaaggccgatgtctacgacaagaagccggagctgttcgagccactcaaggcgcaccagtcacccaagtacatggtgttcgcctgctccgactcccgcgtgtgcccgtcggtgaccctgggcctgcaccccggcgaggccttcgccgtccgcaacatcgccagcatggtgccaccctacgacaagaccaagtacgccggcgtcgggtccgccatcgagtacgccgtgtgcgccctcaaggtggaggtcatcgtcgtcatcggccacagccgctgcggcgggatcaaggcgctcctctccctcgaggacggcgcgcccgacaagttccacttcgtggaggagtgggtcaggatcggcggtccggccaagactaaggtgaaggccgaccacgcctcggtgccgttcgaagaccaatgctccatcctcgagaaggaggccgtgaacgtgtcccttgagaacctcaagacgtacccgttcgtgaaggaaggggtggagaaagggaccctcaagctggtcggcggccactacgacttcgtcaatggaaagttcgagacatgggagccctaagccgcgcgcggcc

SEQ ID NO: 15023 - DNA, 366 bp, Sorghum bicolor
  Clone ID: LIB3481-015-P1-K1-C8
cgtccgctcggcgcgctcggctgcgtgttcccggagctgctcgcccgcaacgacctcgccgacgaccccgaggccttcgccgagctcaaggtgaaggagctcaagaacggccgccttgccatgttctccatgttcggattcttcgtccaggccatcgtcaccggcaagggcccgctcgagaacctcgccgaccacctcgccgaccccgtcaacaacaacgcctgggcctacgccaccaacttcgtgccccggcaagtgaggaggtgtccggatgcatgtgagcgcgcgcgcgcactggtttcggcttgtaccatgatgtaaattactgtaccagggttcaatcaagaaggaataactgtgttcatt

SEQ ID NO: 15024 - DNA, 621 bp, Sorghum bicolor
  unsure (1)..(621): unsure at all n locations
  Clone ID: 9848842
ccaatcctgacacggggaggtagtgacaataaataccaataccgggcgcgttagtgtctggtaattggaatgagtacaatctaaatcccttaacgaggatccattggagggcaagtctggaccgccaacatggagaggatcatgaaggcccaggcgctcagggactccagcatgtctgggtacatgtcctccaagaagacgatggagatcaacccggagaacgccatcatggaggagctgcgcaagcgcgcggaggctgacaagaacgacaagtctgtcaaggaccttgtcatgctgctgttcgagacggcgctgctcacctccggcttcagcctcgacgaccccaacaccttcggcagccgcatccaccgcatgctcaagctgggcctgagcattgacgaggacgaggccccggaggctgacactgacatgccccctctggaggacgacgccggcgagagcaagatggaggaggtcgactaagcctggggtaccctgtgtcccggctgaagagcgtgtctgaacatctcggtttattttgtgtggtttacttttgctagcctgcaatgtaatggggctggggctggatgcgtgtgttatcgaacntaagtacgttaatgt

SEQ ID NO: 15025 - DNA, 503 bp, Sorghum bicolor
  Clone ID: 30964281
acctccaccgcatcgattccatccgccattgatcactgcacgagcgcacgcgaggaacaagtcatggccggtgagaagaagcagggcctgcagctgctggacttctgggtgagcccgttcgggcagcgctgccggatcgcgctggacgagaagggcctctcctacgagtacctcgagcaggacctcgcgaacaagagcgagctcctgctccgcgccaacccggtccacaagaagatccccgtgctgctccacgacggccgccccgtctgcgagtccctcatcatcgtgcagtacctggacgaggcgttcccggcgacgccgtcgctgctccccgccgccgccggcgacgcgtacgcgcgcgcgcaggcccggttctgggcggactacgtggacaagaagctctacgactgcggcacccggctgtggaagctcaagggggacggccacgcgcaggcgcggacggagatggtcgagatcctccgcacgctggagggcgcgctcgg

SEQ ID NO: 15026 - DNA, 445 bp, Sorghum bicolor
  unsure (1)..(445): unsure at all n locations
  Clone ID: 7551911
aaaaaaaaaaaaaaaaaaaaananctcaagaccgaggtctatgacaagaagccggagctgttcgagcctctcaaggccggccagtcccccaagtacatggtgtttgcgtgctccgactcccgtgtgtgcccgtcggtgaccctgggtctgcagcccggtgaggccttcaccgtccgcaacatcgccgccatggtcccagcctacaacttcgtgtcaggggagttcgacacatgggaaattaagagctaagctgcccggccggccgcttaacaactcctaccatcatcataaatatatatactacatacctaccgatatgcacccgatcgatgtgaatgcgtggagtattactcatgttttctgcatgcagcgacatatatatatatataccggatcgcccaatgtgaatgtaataagtaatagcattttctaccgcttttattct

SEQ ID NO: 15027 - DNA, 284 bp, Sorghum bicolor
  Clone ID: LIB3478-006-P1-K1-A1
aacacagagcaagctatcatctgatcgacatggccggcgccaccatggctctcacctcccgcgcgctcgtcggcaagccggcgaccaccagcaccagggacgtcttcggcgagggccgcatcaccatgcgcaagactgctgccaagcccaagccagcggcgtccggcagcccctggtacggtgccgaccgcgtcctgtacctgggtccgttctccggcgccgtcgaggggtaccgcgtcgccggtggcccgctcggagaggtggtcgatcctctgtaccctggc

SEQ ID NO: 15028 - DNA, 478 bp, Sorghum bicolor
  Clone ID: 7553080
gaagcgagggaggggaggtacggcggggaacaagttccgcatgtcactgggtctgcggcgccaagaacctctacatcatctccgtcaagggcatcaagggccgcctcaaccgcctcccgtccgcctgcgtcggcgacatggtcatggccaccgtcaagaagggaaagcctgacctcaggaagaaggtgatgcccgccgtcatcgtccgccagctacatgtacttcgaagataatgctggagtgattgtgaatcccaagggtgagatgaaaggttctgctatcactggacctatcggcaaggagtgtgctgacctttggcctaggattgctagcgcagcaaatgccatcgttttctgtatgatcatctcagtttctgtcgcaactgttgctaagagtgctattggacttaatggctcttttatgtttggtcactcaattttgtagtgaacagaaatttgtctaccatgtggatctatat

SEQ ID NO: 15029 - DNA, 599 bp, Sorghum bicolor
  Clone ID: 7660757
gcacgaggcatcctgatcgatcgtttgattattggcgagcttcattccattccatcagttcctttggcggaggatgtcgtgctgcggaggcaactgcgggtgcggctccggctgcaagtgcggcagcggctgcggagggtgcaagatgtacccggacatggctgagcagcaggtgaccaccaccgccaagactctcgtcatgggtgtcgcaccatcgtccaaggggcacgccgagggcgggttcgaggcggcggccggcgccggagctgagaacgacgggtgcaagtgcggccccaactgcagctgcaacccctgcacctgcaagtgcggcagtgtcgtcactgtgtgtgtgtttgagtcagccagtcagtcgagtgccatggcaccatatgctagtggttctggtactgatgggaaccaataataattgtactgggatgttggcgtcgtgtcgtccttcccgtgctcctccgggggctcatctactagcagtcggtgttgtgttgtgtgtttgtgggtgcagtgcagcacagcagcaggccatgccccctgctctgtgggcacgtcgatcgtgtgcgactttgtttgtgctctgtcac

SEQ ID NO: 15030 - DNA, 433 bp, Sorghum bicolor
  Clone ID: 7553217
aagactctcgtcatgggtgtcgcaccatcgtccaaggggcacgccgagggcgggttcgaggcggcggccggcgccggagctgagaacgacgggtgcaagtgcggccccaactgcagctgcaaccccctgcactgcactgcagcccggaggaaggacggattcccttagctgtagtatagcagtgtcgtcactgtgtgtgtgtttgagtcagccagtcagtcgagtgccatggcaccatatgctagtggttctggtactgatgggggcgtcgtgtcgtccttcccgtgctcctccgggggctcatctactagcagtcggtgttgtgttgtgtgtttgtgggtgcagtgcagcacagcagcaggccatgccccctgctctgtgggcacgtcgatcgtgatccatctattacctataatatcccccgtctttgtgt

SEQ ID NO: 15031 - DNA, 594 bp, Sorghum bicolor
  Clone ID: 30950760
ttaaataggtaggacggcacggctgctccggtgagccgtgccatggaatcgggagctccaagtgggccatttttggtaagcagaactggcgatgcgggatgaaccggaagccgggttacggtgccaaactgcgcgctatctacggtgttggccgcttgatgctccctcttccttcacctaagcgaatgtggattggagccagactgatttctggtgcatgtggcatcatcctccctatcattaaagctgaaggcgtgagacagatgttcttccctgctactgtacctgcatattaccgggccgcacctatgggagaataagcatgaacagagcaccgattccatgctgctgatccgaccatgatatatggtggcaactgatgtttcacggatggcatttttcctgtattagttggttggttgttcgttgtgttagctggttgtatgtcccgtcattggaatgaggaacctgtatagtgtgtgccctggctactggtaagttagaaaatgtgttgggtttgttctgtatgcatgccgattattgccaagctgtacatgactctgttgaactagtaaaacgtccccttcttccatg

SEQ ID NO: 15032 - DNA, 460 bp, Sorghum bicolor
  Clone ID: LIB3480-033-P1-K1-D10
ccctcgtctcgtgcacttctcctctgccctcaagccgccgccgccgccgccgcctgctcgccgcgctctcctagcgtccgggaaggtcgtctcgccagccatggcctcggagacggagacgttcgccttccaggcggagatcaaccagctgctggtggggctagcgtgctccagcccggaaccggcgctgcgccccgggatgcgcggcgtggtccaggtgctgggcggcgagtccgacccgccgttcgtgccggcggccaggccgtccatgagcctcggcggcagcgccaacaaccagcagctgctgctgagcctgcaggacagcgtgtcggactacaacgccctgctggggctcgccggcctgtcggacgactcgttgtcgtccgccgactcgctcaactcgtcgtccctcaccagcacgctccgcaggggcggccatgatatcgggttcagcagcacc

SEQ ID NO: 15033 - DNA, 445 bp, Sorghum bicolor
  Clone ID: LIB3478-036-P1-K1-D9
gccgcatacacataacctcgcccgcgccgcctgcccaaggagactcgatacctctcgcttacggcaacgccttcacgctctcgcttacggtgacgacgcccgccactccctcgtcgacgagatgacgaagcgcaccaagaaggcaggaatcgttggcaaatatggtaccaggtatggtgccagtttgcgtaaacagatcaagaagatggaggtctcccagcactccaagtacttctgtgagttctgtggcaagtttgctgtgaagaggaaagcagttggtatctggggatgcaaggactgtgggaaggttaaggctggtggtgcctacaccatgaacactgccagtgcggtcactgtcagaagcacaatctcgggcctgcgggagcagaccgaagcatgagtatggacagtttgaaaagggaatacctggattttgtagttcagc

SEQ ID NO: 15034 - DNA, 487 bp, Sorghum bicolor
  Clone ID: 7553236
aggggttgacgcgaggaggtggaggtggcagccgccgatatgccagtgcctggacacgtcgacgagcggctgcaacccggggtgcaaggcgtgcgtcaagtccatcagcgacggcctctacgagtgcaaggacaggatcgtcaacttctgcaagcgccgctgcacccgtcctcctgctgctgctgctgccgatcccagagccggcaaatgagctttgccaataaataatttccgttcggacttcggagttccctttttgcatctttctcaagatgcagacagggtttgaataaggtgatgcttgctgttttctgaaataaagagcatgcatgggaggtagagaaaatgtaataatcgctttgtttatgtgcatctttagatgccatagaccgaggcatgactagctaataagcgcatggctacttgcatctctttgatgcaaaggccgtgatatggaaaatatcacaaacattttatgaatagtgtc

SEQ ID NO: 15035 - DNA, 549 bp, Sorghum bicolor
  Clone ID: 7661050
cgtgaccccatctcttcctttcccgtctcctctccacataacgcggccagcaatgcaactgctggtaaggaacccggccagcagtggcggctgcgcgtttctgccggctgctgctgctacactgcggccaccgtcgtcggccacgctctcatggaggaggccgggctgcagttggaggagcaagcggtgcctcagtctccccccgcgcgcaaacaccgacggttcagggtctggtgctgctgcggctgaggcgtctaccgtgggagacaccttggaacgggaggagggcggcggcgtaaatgcaggtgcttcggctgagtcatcatccaaccggaagcagccgccccctgtcgatcccaagatcgagaaggagctcaagaaggcagttcagaagactgcagcaacctttgcaccgagggcgtccacgaaaacaaagaaccctgctgtccctggaactgccctgtacagtatctttgaagtccagggatatgtctccatgctgttgggtggagctctttccttcaatctcatattcccatcgaatgaacc

SEQ ID NO: 15036 - DNA, 801 bp, Sorghum bicolor
  Clone ID: SORBI-28MAY03-CLUS104_17
gcacgaggcttggaatttctccatctgaaggtggcctcatattccattgcccttggtagcggcgttgctgcattgaaactttgggactggccatgaggcagatagttctacatttactttaaattctttgcatttacatttgtttttgttgcttgttaattgtaccagctaggtttacccgagttatcttttatcacatatgccacatgtttttgtaattgcatctatttgattgttcttgttaggtgtgtggtaactttggaataccaacacacttactgacggaagggctccgaggttcttcagccttttttggagcaaacattacatgtttgtatattccaaagcaaacgtcagaaattaagtttttatctgtagaggtttgctggcgaagattttcatctttgagagctttcctccatttgaaaatggtctcatattccattgccttgggtagcggcatcgctgcattgaaactttgggactggccatgagacatatattttgttcatttcttacattaatgttctttgttaagttttggttctgtggaaagattgtttctgtatatgttctagtgttttcaactgtttactctctggctgtgttgttatttgttgttgaactgatctgggttgatgcattttatttccagataatgctggagtgattgtgaatcccaagggtgagatgaaaggttctgctatcactggacctatcggcaaggagtgtgctgacctttggcctaggattgctagcgcagcaaatgccatcgtttgagaacttgttggaatgtgttta

SEQ ID NO: 15037 - DNA, 779 bp, Sorghum bicolor
  Clone ID: SORBI-28MAY03-CLUS104_18
acgagctcctgctgcgcgccaacccggtccacaaaaagatccccgtgctgctccacgacggccgccccgtctgcgagtccctcatcatcgtgcagtacctggacgaggcgttcccggcgacgccgtcgctgctccccgccgccgccggcgacgcgtacgcgcgcgcgcaggcccggttctgggcggactacgtggacaagaagctctacgactgcggcacccggctgtggaagctcaagggggacggccacgcgcaggcgcggacggagatggtcgagatcctccgcacgctggagggcgcgctcggcgacggcgagttcttcggcggcgaggcgttcgggttcgtcgacgtcgcgctcgtgccgtttacgtcgtggttcctcgcctacgagcggttcggggacctcagcgtcgagaaggagtgccccaggctcgccgcgtgggccaagcgctgcgcggagcggcctagcgtcgccaagaacctgtacccgggcgagaaggtctacgagttcatctgcgggttgaagaagaggttcggcatcgagtaggatttggattgattgccgtcgtcaacagtgtttcatggttccgttggtaggtgatgagcagagcagtcgtgaggtcgtcgttgttgtgttgtgttggttgcattgggtggagttgtttttgtgccgttccttgtatcgatgtgtgtgtgtcgtctggcgtccgtgcagcggaagcgccgtgttgcctcgtgcacgttctggagctgaaataaaatgggttgtatggaattt

SEQ ID NO: 15038 - DNA, 568 bp, Sorghum bicolor
  Clone ID: SORBI-28MAY03-CLUS104_19
cggatcgcggcgacgaaggcggttcgccgcccccgacgtcgcgagaagtccattgaaccttatcatttagaggaaggaaatgagcttcttagtgctttcaaggttgcaaacttttccagtggcgaagatgatgcaacattctggagtaggctgatacagccagatcctgcagatatgattcaggaaacattggcacctcgtgctgcacgaaataaaaagagctatgttgaagatccccagctcgacaaaagtaataacaggaaaagacgagcagttgaagcacaagaaaagccaaggaggcgttctggcagaactgtggaaacagttaattcattaccattggttgatggagcagtagctcaagtacgagagtggtcttttggtaatgttccaaagaaggacgcttctcgttttgtacgagcggtcaaaaaatttgggaatgcaacccagattggattaatcgtggatgatgttggtggtgtacttgcgaaggcatcacatgaagcgcaaatagagctatttgatttgctaattgatggttgtcaggaagcagttaaagagaatacgg

SEQ ID NO: 15039 - DNA, 587 bp, Sorghum bicolor
  Clone ID: SORBI-28MAY03-CLUS104_20
acggataatagcagcactattataccaacattaacgtacttagttcgataacacacgcatccagccccattacattgcaggctagcaaaagtaaaccacacaaaataaaccgagacgttcagacacgataaccagaatagctacgctaacaactcgctcttcagccgggacacagggtaccccccaggcttagtcgacctcctccatcttgctctcgccggcgtcgtcctccagagggggcatgtcagtgtcagcctccggggcctcgtcctcgtcaatgctcaggcccagcttgagcatgcggtggatgcggctgccgaaggtgttggggtcgtcgaggctgaagccggaggtgagcagcgccgtctcgaacagcagcatgacaaggtccttgagctggccaatagcgtactcatcaatggcatccaccatgtacaggacttcatagcccttcttcttcagcttctcaaggaagggagagttctccacagccttcttgctctcgccagtgatgtagtagatgtcattctggccctccttcatcctggtcacatagtccttcaagctggtcagctcatctccgctct

SEQ ID NO: 15040 - DNA, 731 bp, Sorghum bicolor
  Clone ID: SORBI-28MAY03-CLUS104_21
gcacgaggggcaacggatatctcggctctcgcatcgatgaagaacgtagcaaaatgcgatacctggtgtgaattgcagaatcccgcgaaccatcgagtttttgaacgcaagtgaaataccactacttttaacgttattttacttattccgtgggtcggaagcggggcatcgcccctccttttggctctaaggcccggccttgccgggccgatccgggcggaagacattgtcaggtggggagtttggctggggcggcacatctgttaaaagataacgcaggtgtcctaaacgtctgccgggacattgttcaaccaatgcacttccagaaatcaaccaactgccaagagctggaggaggcgtttcttcagatcatctccaccttgcctgtcccagaagcccaggagctgctgcagcagtgcctggggttctccacccgcaatgttgacgactgcccacatctggtcgccgcgttcaagacgtggttccggcgcgctggccgggctcctatgggcggggaatactgagacatgagcggatgtctgtatcgcccgtggcgctgtgtattctcacatgtactactagtcagctgtaggcctacctacatcctctggatttggtatagtgcttgcgtctcttttttttttctcagagattgtctgtatatattgtctgtcgtttgtgtccgtactcgttttagctaataaccaaggtaaaggtatgcagcgtatgct

SEQ ID NO: 15041 - DNA, 594 bp, Sorghum bicolor
  Clone ID: SORBI-28MAY03-CLUS104_22
gcctcagcaatcacatgattttattgacttattatgtttatcaacattcatagtatggtataaagttgacaacaatttattttcactccgaccccagtacgtatacttgcatgtattcaattcatgcatacggcacactactacgtctagtatgggctctggccgacgtagttgcccggcgggttgtagctgcagatgatgaagacgccggcgttgttgtcgcagacgacgcgggcgcagccgatggccgtggagtcacgccacaccacctgcgtgtagtgcccgcacaccttgccgtccgcgcagctgttggtgtcgtggttgtagtactgcttctcggaaacccacgacgccacggcgtcggacgccgaccagtcggcgccggcggagccccagaagatgttctcgccgtagggaccgccggagtggatcagcttgcagtcgccctgccgctgcgccgcgtagctctgcgcgtagtcctgcggcgagttctgcgccgcgcacggcgcgacgacggtggcagccagcgccagagctgcggcgacgaggcacgctagcagcttcgtcggtgacgaggaggacgacgcctcgtgc

SEQ ID NO: 15042 - DNA, 342 bp, Sorghum bicolor
  Clone ID: SORBI-28MAY03-CLUS104_23
ctaagctgcccggccggccgcttaacaactcctaccatcatcataatatatatactacatacctaccgatatgcacccgatcgatgtgaatgcgtggagtattactcatgttttctgcatgcagcgacatatatatatatataccggatcgccccaatgtgaatgtaataagcaatagcattttcaaccgctttcatttctaacgccgagcttttatgtactatatatataatatgatgcataattgaccggcttgtggtcaaaagacatcaactataatccttttttcataatattgttatgaagagtttacctcaaaaaaaaaataaaaaaaaaactaaa

SEQ ID NO: 15043 - DNA, 684 bp, Sorghum bicolor
  Clone ID: SORBI-28MAY03-CLUS104_24
gcacgaggccgcgccggcgtccggcgatcgccggcatcggagcgatggatcacccatccacgtgatggatccgccagcgccttctccgaggccccctgtgggcgatggggcacagccatcggagcgtaaccggcagcgaccaaggtctgcactccgtggcgccctcggggtggccttccccatcgcggtatcgttcctcttctccttcctcgtcgggctcgctgggctcgcgcttggtggcctctcatccaccgcatcggtctccatgccctccacctgccgcgtcctctccaccggtgttgaccttaggtcatcaaaggtttgcgagcttggattattgaactatagagctaagcatatcttctacccgtcgagtaagagaagattccgctgccatgatgactactactgggcttcagttttacaggttgaatacacagaatatttttctggccaagtatcttatgcagtggcagaggccccaaaagaggctcttcctcataattgtcgacctgattttggtgctgcatggtcaacaacattaaagttcaaggtcaatgaatcatacagttgcagatatatgctaggtagtaacaaggctgatattcactcggacaaactattcaattgtactgctgaggaaccttcaactacggagctgctcaaaaggatacttatactgtt

SEQ ID NO: 15044 - DNA, 853 bp, Sorghum bicolor
  Clone ID: SORBI-28MAY03-CLUS104_25
ttctcactgaccactgtgccgcgccgtgctcacacacagaacgacgatggccgcgtcggcgcttcaccagaccaccagcttcctcgggcaggccctggtctcccgccccgccgccgccgccgccgatgccggcggccgcatcaccatgcgccgcaccgtcaagttcggcgaggcggtgtggttcaaggccggcgcgcagatcttctcggagggcgggctggactacctgggcaacccgaacctggtgcacgcgcagagcatcctggccatctgggcgtgccaggtcgtgctcatgggcttcgtcgagggctaccgcgtcggcggcggcccgctcggggaagggctcgacaaggtctaccccggcggcgcgttcgacccgctcgggctcgccgatgaccccgactacgggtgggacacggcggggctgtcggcggacccggagacgttcgcgcggaaccgcgagctggaggtgatccactcgcggtgggcgatgctgggcgcgctggggtgcgtgttcccggagatcctcgccatgttctccatgtttgggttcttcgtccaggccatcgtcaccggcaagggacccatcgagaacctcttcgaccatgtcgctgaccccgtcgccaacaacgcctgggcttacgccaccaacttcgtccccggcaactaaagctgatcgagcgagcgagctgaagctgagcagagcatccatgcgtgcatgtcgagcgaggtctcttgtactctacttgttgttttcaatcgtaggcgtgtagtagttgcacgagatcgatgtaaactaagcacagatcgcatgtaacatcagtgtggatgaatcaatctatatcgatggccc

SEQ ID NO: 15045 - DNA, 639 bp, Sorghum bicolor
  Clone ID: SORBI-28MAY03-CLUS104_26
gcacgaggggaccacccgctgagtttaagcatataaataagcggaggagaagaaacttacaaggattcccctagtaacggcgagcgaaccgggaccagcccagcttgagaatcgggtggcttcgtcacctgaattgtagtctggagaggcgtcctcagcgacggaccgggcccaagttccctggaaagggacgcctgggagggtgagagccccgtccggcccggaccctgccgcaccacgaggcgccgtcaacgagtcgggttgtttgggaatgcagcccaaatcgggcggtaaactccgtccaaggctgtcaagtgcgacgtcgccagcgagcggctcggcctgatgctgtgacgcggcctggcgaaccgtaaccgctctggctcgggggttagttgttccctcagtggccataaccttaacctgccaaacgtttttaagtttggaacatgtttatccttttttcatgtaaggaaggaaaacctgcataaccttgatcgtgcctgtggcatgtacggtgtttagcgtaaactgtaaacttagtgtagtgatgtgtttctttactttactgaacaagtagtgttgtatgtaaatatcaacttgtagaagatgtacaagcttcaatgaagtacattatgt

SEQ ID NO: 15046 - DNA, 250 bp, Sorghum bicolor
  Clone ID: SORBI-28MAY03-CLUS104_27
ggaccacctggccgaccccgtcaacaacaacgcttgggcctatgcccccaattttgtccccggcaagtgaccggcaggccccaggagtcccccatggatgtccccccgagagcattccagggcatggtagggtttacattcccataaggagggtccgtggcaagtgaatttaacttttgtataaaacagtgtgttaagcgttcgattatttgggattatacatacgaatgaggtatttggcggtatcctc

SEQ ID NO: 15047 - DNA, 827 bp, Sorghum bicolor
  Clone ID: SORBI-28MAY03-CLUS104_28
gagctgctcgcccgcaacggcgtcaagttcggcgaggccgtctggttcaaggccggctcccagatcttcagcgagggcggcctggactacctgggcaaccccagcctgatccacgcgcagagcatgcctcagtgccgttcgatgaccagtgctccatcctggagaaggaggccgtgaacgtgtccctcgccaacctcaagacttaccccttcgtcaaggaacggctggccaaagggaccctcaagctggtcggcgcccactacgacttcgtgtccgggaagttcctcacatgggagcctgtgatggacgccgttgaccgcttgaagagcgggttcgagcagttcaagatcgaggtctatgacaagaagccagagctttttgagcctctcaaatctggccaggcccccaggtacatggtgttcgcctgcgctgactcccgtgtgtgcccgtcggtgaccctgggcctgatgcccggcgaggccttcaccgtccgcaacatcgccgccctggtcccaggctacgacaagaccaagtacaccggcatcgggtccgccatcgagtacgccgtgtgcgccctcaaggtgcaggtgctcgtcgtcattggccatagctgctgcggtggcatcagggcgctcctctccctccaggacggtgcacctgacaacttgtaagacgccaccgtaaaatatacaaagtttcattaagataaaacaaaaattcttttgtacctctatgatgattttgatcccagcgcatttttatctgttgttttttttgtggtgtatccagccactttgttgaggactgggtcaagattggcttccctg

SEQ ID NO: 15048 - DNA, 922 bp, Sorghum bicolor
  Clone ID: SORBI-28MAY03-CLUS104_29
ccgggcacacgactctcggcaacggatatctcggctctcgcatcgatgaagaacgtagcaaaatgcgatacctggtgtgaattgcagaatcccgcgaaccatcgagtttttgaacgcaagttgcgcccgaggccttccggccgagggcacgtctgcctgggcgtcacgccaacagaaaataaaaaaaaaaaagaaagaaaaaaaaaatacacgactctcggcaacggatatctcggctctcgcatcgatgaagaacgtagcaaaatgcgatacctggtgtgaattgcagaatcccgcgaaccatcgagtttttgaacgcaagttgcgcccgaggccttccggccgagggcacgtctgcctgggcgtcacgccaacagaaaaaaaaaaaataaaaaaaaaaaaaaaaataaactgcaagaagagggggaaggggcgacaggagagtcattaaataaatccacttgtcgattcagggtagggaatgatgtctgagagtgaagagcatggctcgctcctagagaagatcaacgagaagatccacgagtacaagcactcatcatcgtcctcctcttcggactcagatgatgacaagaagccaaagaagactaagaagaagaagaagctattcgggaggaaacattcattgcatcacgttctcggaggaggcaaagccgccgatcttgtgctgtggaggaacaaacaggcatccgggagcatcttggcaggagtcactgtgatctggctactatttgagggcatcggctaccacctccttaccttcctctgccatgcactaattgtgtttctcaccgtctggttcgtctggtccaatgctgcatcctttgtcaacaggtctcctccaaagttcccagaggtcattctatctgaagtccaatgcctgaaggtagctcatattgcaagg

SEQ ID NO: 15049 - DNA, 793 bp, Sorghum bicolor
  Clone ID: SORBI-28MAY03-CLUS104_30
gcacgaggcaagcagcagcagcagtccgcagactcctcctccgttccctcccctcctctcttcgtcatcctccagaaacccagcagcagctcgatctcttcctctccgaccgcgtgtaaggatcgaacaagaaaagccaaaaattcgaacgatccctcacaagaaacccgctgctgatgcatcgaagattcaagacatggcggacgccgtcgagcgcttgaagaccgggttcgagcagttcaaggccgatgtctacgacaagaagccggagctgttcgagccactcaaggcgcaccagtcacccaagtacatggtgttcgcctgctccgactcccgcgtgtgcccgtcggtgaccctgggcctgcaccccggcgaggccttcgccgtccgcaacatcgccagcatggtgccaccctacgacaagaccaagtacgccggcgtcgggtccgccatcgagtacgccgtgtgcgccctcaaggtggaggtcatcgtcgtcatcggccacagccgctgcggcgggatcaaggcgctcctctccctcgaggacggcgcgcccgacaagttccacttcgtggaggaatgggtcaggatcggcggtccggccaagactaaggtgaagaccgaccacgcctcggtgccgttcgaagaccaatgctccatcctcgagaaggtacggtatatacacacgctacacatgcacatacgtacggtttctctttgaccacaccacacattgtacgtacacacacgtacgcttattggcgtctctttgaccgcgacatgcatttcgata

SEQ ID NO: 15050 - DNA, 937 bp, Sorghum bicolor
  unsure (1)..(937): unsure at all n locations
  Clone ID: SORBI-28MAY03-CLUS104_31
cgtgtagtgcccgcacaccttgccgtccgcgcagctgttggtgtcgtggttgtagtactgcttctcggaaacccacgacgccacggcgtcggacgccgaccagtcggcgccggcggagccccagaagatgttctcgccgtagggaccgccggagtggatcagcttgcagtcgccctggattctccaaggaccccgccaagttcgaggagtacaagctcaaggagatcaagaacggccgcctcgccatgctcgcgttcgtcggcttctgcgtgcagcagtcggcgtaccccggcaccggcccgctggagaacctcgcgacccacctcgccgacccgtggcacaacaacatcggcgacatcatcatccccagatcaatctccccttgagctcagatcaaatgcatgttttgtacgtgtgtcattgccttgccattactaggcattgcctgctgcctgcctgcgtgcaggagctgtacaacgacgacggcgacttcctgcgccggaaaaccccttgtaatgtaaagcttatattattaagtagcggctactcttgtagtcttgtatccaaaaaaaaaaaaaaaaaaaaaaaaaaaaaaaaaaaaaccccccgactctcggcaacggatatctcggctctcgcatcgatgaagaacgtagcaaaatgcgatacctggtgtgaattgcagaatcccgcgaaccatcgagtttttgaacgcaagttgcgcccgaggccttccggccgagggcacgtctgcctgggcgtcacgccagatgcatgttttgtacgtgtgtcattgccttgccattactaggcattgcctgctgcctgcctgcgtgcaggagctgtacaacgacgacggcgacttcctgcgccggaaaaccccttgtaatgtaaagcttatattattaagtagncgctactcttgtagtcttgtatc

SEQ ID NO: 15051 - DNA, 790 bp, Sorghum bicolor
  unsure (1)..(790): unsure at all n locations
  Clone ID: SORBI-28MAY03-CLUS104_32
gcacgaggctttaacacagctaagaactctactggaaaacaatgtcgtacaataaaatactgcaacccgatcttcagaatagaacatgtattcatgtgtactggtgctttcagcggtgctggtattatctcatattaacctctggaaggaaattctgttacacaagtctacaacgttcctggaatgcttaaacaaagtttctcatatattcttgctatatagtacaatatcagtcacgcatctttgctattcacttcaggtgcgccagcaatgacctcgaggggtctagtggagaaggactttgagcagattggagagttcctccaccaggcggtgaccatctgcctgaacattcagaaggagtacggcaagctcctcaaggacttcaacaagggcctgttgaacaacaaggacattgagaacctcaagacccaggtggagaagttcgccgactctttcgacatgcctgggttcacgcttgagagcatgaagtacaaggagtagatgtctcccgtgtataacaaggccctcttgtaccaatgtttttcttggccatggcggagggtgccatggcactgcactgccacacttaaggtgatgatggcttatggattttgtctacaacgtcagcagtataggctcacaagtgccccctgccctctggtttggtcgccttcggtttatcaggttttcctttggtacttgttcgcagggagtcatgaaaatgtcaatcaggtgtttgccaataataattncctggtttcagccagcagcttttttataaattagt

SEQ ID NO: 15052 - DNA, 755 bp, Sorghum bicolor
  Clone ID: SORBI-28MAY03-CLUS104_33
gccggccgggccgggaagattgcatctccatcctgatcgatcgtttgattattggcgagcttcattccattccatcagttcctttggcggaggatgtcgtgctgcggaggcaactgcgggtgcggctccggctgcaagtgcggcagcggctgcggagggtgcaagatgtacccggacatggctgagcagcaggtgaccaccaccgccaagactctcgtcatgggtgtcgcaccatcgtccaaggggcacgccgagggcgggttcgaggcggcggccggcgccggagctgagaacgaagggtgcaagtgcggccccaactgcagctgcaacccctgcacctgcaagtgagctgtataataaccccctgcactgcactgcagcccggaggaaggacggactcccctagctagtatagcagtgtcgtcactgcagtgtgtgtgtttgagtcagccagtcagtcgagtgccatggcaccatatgctagtggttctggtactgatgggaaccaataataattgtactgggatgttggcgtcgtgtcgtccttcccgtgctcctccgggggctcatctactagcagtcggtgttgtgttgtgtgtttgtgggtgcagtgcagcacagcagcaggccatgccccctgctctgtgggcacgtcgatcgtgtgcgactttgtttgtgctctgtcaccatccatctattacctataatatcccccgtctttgtgtgcaaaaaaaaaaaaaaaaaagccccctagg

SEQ ID NO: 15053 - DNA, 643 bp, Sorghum bicolor
  Clone ID: SORBI-28MAY03-CLUS104_34
aagatcgctctccatcctgatcgatcgtttgattattggcgagcttcattccattccatcagttcctttggcggaggatgtcgtgctgcggaggcaactgcgggtgcggctccggctgcaagtgcggcagcggctgcggagggtgcaagatgtacccggacatggctgagcagcaggtgaccaccaccgccaagactctcgccatgggtgtcgcaccatcgtccaaggggcacgccgagggcgggttcgaggcggcggccggcgccggagctgagaacgacgggtgcaagtgcggccccaactgcagctgcaacccctgcacctgcaagtgagctgtataataaccccctgcactgcactgcagcccggaggaaggacggattcccttagctgtagtatagcagtgtcgtcactgtgtgtgtgtttgagtcagccagtcagtcgagtgccatggcaccatatgctagtggttctggtactgatgggaaccaataataattgtactgggatgttggcgtcgtgtcgtccttcccgtgctcctccgggggctcatctactagcagtcggtgttgtgttgtgtgtttgtgggcacgtcgatcgtgtgcgactttgtttgtgctctgtcaccatccatctattacct

SEQ ID NO: 15054 - DNA, 477 bp, Sorghum bicolor
  Clone ID: SORBI-28MAY03-CLUS104_35
gcacgagggtttcggtgcgggctgcgcgagcggtaccaaatcgaggcaaactctgaatactagatatgacccaaaaataacaggggtcaaggtcggccagtgagacgatgggggataagcttcatcgtcgagagggaaacagcccggatcaccagctaaggcccctaaatgaccgctcagtgataaaggaggtgggggtgcaaagacagccaggaggtttgcctagaagcagccaccctttaaagagtgcgtaatagctcactgatcgagcgcccttgcgctgaagatgaacggggctaagcgatctgccgaagctgtgggatgtcaaaatgcatcggtaggggagcgttccgccttagagggaagcaaacgcgaaagcgggggtcgacgaagcggaagcgagaatgtcggcttgagtaacgaaaacattggtgagaatccaatgccccgaaaacccaaggtttcctccgcaaggtt

SEQ ID NO: 15055 - DNA, 686 bp, Sorghum bicolor
  Clone ID: SORBI-28MAY03-CLUS104_36
cactgaccactgtgccgcgccgtgctcacacacagaacgacgatggccgcgtcggcgcttcaccagaccaccagcttcctcgggcaggccctggactacctgggcaacccgaacctggtgcacgcgcagagcatcctggccatctgggcgtgccaggtcgtgctcatgggcttcgtcgagggctaccgcgtcggcggcgggccgctaggggaagggctcgacaaggtgtaccccggcggcgcgttcgacccgctcgggctcgccgatgaccccgacaccgccgcggagctcaaggtgaaggagctcaagaacggccgcctcgccatgttctccatgtttgggttcttcgtccaggccatcgtcaccggcaagggacccatcgagaacctcttcgaccatgtcgctgaccccgtcgccaacaacgcctgggcttacgccaccaacttcgtccccggcaactaaagctgatcgagcgagcgagctgaagctgagcagagcatccatgcgtgcatgtcgagcgaggtctcttgtactctacttgttgttttcaatcgtaggcgtgtagtagttgcacgagatcgatgtaaactaagcacagatcgcatgtaacatcagtgtggatgaatcaatctatatcgatggcctgtaccatattcaattttcaaaaaaaaaaaaaaaggcggacg

SEQ ID NO: 15056 - DNA, 863 bp, Sorghum bicolor
  Clone ID: SORBI-28MAY03-CLUS104_37
ccgggcacacgactctcggcaacggatatctcggctctcgcatcgatgaagaacgtagcaaaatgcgatacctggtgtgaattgcagaatcccgcgaaccatcgagtttttgaacgcaagttgcgcccgaggccttccggccgagggcacgtctgcctgggcgtcacgccgacctcttctcctcgcgccgccgccgccggagccgtcgccatgtcgaagcgcgggaggggagggacggcggggaacaagttccgcatgtcgctgggtctgcccgtggcggcgaccgtgaactgcgcggacaacacgggcgccaagaacctctacatcatctccgtcaagggcatcaagggcaggctcaaccgcctgccgtccgcctgcgtcggcgacatggtcatggccaccgtgaagaagggtaagcccgacctcaggaagaaggtcatgcccgccgtcatcgtccgccagcgcaagccgtggcgccgcaaggacggagtctacatgtacttcgaagataatgctggagtcatcgtgaaccccaagggcgagatgaaaggatctgctatcactggacctattggcaaggagtgtgctgacctttggcctaggattgctagtgcagcaaacgccattgtctgatatcatggttgggggatgtttgagagagtttcgttgtgctccttattaggtccattttaacctgttttgtactccgtacctcaacatctgtgataatgtacttgattgaacatatgtggaaatgtacttgaggagtaatgtgcttcaaagggaaaaggcgcacaattaagggccagaactgtgcacttatgtggtcagttaagcaaaaaaaaaaaaaaaaaaggccccta

SEQ ID NO: 15057 - DNA, 1453 bp, Sorghum bicolor
  unsure (1)..(1453): unsure at all n locations
  Clone ID: SORBI-28MAY03-CLUS104_38
gcctactagctataaataagcggaggagaagaaacttacaaggattcccctagtaacggcgagcgaaccgggaccagcccagcttgagaatcgggtggcttcgtcacctgaattgtagtctggagaggcgtcctcagcgacggaccgggcccaagttccctggaaagggacgcctgggagggtgagagccccgtccggcccggaccctgccgcaccacgaggcgccgtcaacgagtcgggttgtttgggaatgcagcccaaatcaaaacgccacttgttctctagcttcctctccctcctctcatcggaagcaggcaggcaggcagcaatggccatggcgtcgtcgagcgggctgaggagctgcagcgccgtgggcgtgcccagccccctggcgccgtcgtcccggtggtccagccgcctgccgttctgcgccaacgccaccacctccggccgcgtcaccatgtccgccgagtggatgcccggccagccccgccctgcccacctcgacggctcctcgcccgggtaagctagctagctagctagcggctgagtctctgtctctgtctctgtctgacaacggcggcgcggcggccggcggcgtgctctgctctgatttctctagctctctctctctgacgattacagggacttcggcttcgaccctcttggtctggcgacggtgccggagaacttcgagcggttcaaggagtcggaggtgtaccactgccggtgggcgatgctggcggtgccggggatcctggtgccggaggctctagggctaggcaactgggtgaaggcgcaggagtgggcggccgtccccggcggccaggcgacgtacctggggaacccggtgccgtgggggtcgctgccgacgatcctggtgatcgagttcgtggccatcgcgttcgcggagcaccagcgcaccatggagaaagaccccgagaagaagaagtaccccggcggcgccttcgacccgctgggattctccaaggaccccgccaagttcgaggagtacaagctcaaggagatcaagaacggccgcctcgccatgctcgcgttcgtcggcttctgcgtgcagcagtcggcgtaccccggcaccggcccgctggagaacctcgcgacccacctcgccgacccgtggcacaacaacatcggcgacatcatcatccccagatcaatctccccttgagctcagatcagatgcatgcatgttttgtacgtgtgtcattgccttgcctgattggtgtcattactagctaggcattgcctgcctgcctctgcctgcgtgcaggagctgtacaacgacgacggcgacttcctgcgccggaaaaccccttgtaatgtaaagcttatattatcaagtagcggctactcttgtagtcttgtatcnnaaaaaaaaaaaaaaaaaaaaaaaaaaaaaaaaaaaaaaaaaaaaaaaaaaaaaaaaaaaaag

SEQ ID NO: 15058 - DNA, 575 bp, Sorghum bicolor
  Clone ID: SORBI-28MAY03-CLUS104_39
gccggccgggcctggaagatgcatctccatcctgatcgatcgtttgattattggcgagcttcattccattccatcagttcctttggcggaggatgtcgtgctgcggaggcaactgcgggtgcggctccggctgcaacccctgcacctgcaagtgagctgtataataaccccctgcactgcactgcagcccggaggaaggacggattcccttagctgtagtatagcagtgtcgtcactgtgtgtgtgtttgagtcagccagtcagtcgagtgccatggcaccatatgctagtggttctggtactgatgggaaccaataataattgtactgggatgttggcgtcgtgtcgtccttcccgtgctcctccgggggctcatctactagcagtcggtgttgtgttgtgtgtttgtgggtgcagtgcagcacagcagcaggccatgccccctgctctgtgggcacgtcgatcgtgtgcgactttgtttgtgctctgtcaccatccatctattacctataatatcccccgtctttgtgtactgtgcgtacccttcgcaaaaaaaaaaaaaaaaaaggccccta

SEQ ID NO: 15059 - DNA, 910 bp, Sorghum bicolor
  Clone ID: SORBI-28MAY03-CLUS104_40
cgccactgtatcagcccaccctgccgctcccctacttcgaccgcgtggcctactccgtccagctcctcggcatccgcgtcggcggcaaggcactgccaatcccggcgtcggtgctcgcgccggaccataccggcgcagggcagacgatggtggactccggcacgcagttcaccttcctcctcggggacgcatactccgccctcaaagccgagttcttgaaacaaaccaagcccctcctccgcgcgctcgacgaccccagcttcgcattccaagaagcgctcgacacctgcatccgcgtgcccgcggggcgcccgccgccgtcggcaaggctcccgcccgtgactctgctgttcaatggcgcggagatgtcggtggccggggacaggctgctgtacaaggtccccggcgagcaccggggagccgacggcgtgtggtgcctcacgttcgggaacgcggacatggtgcccctgacggcgtacgtgatcgggcaccaccaccagatgaacctgtgggtcgagtacgacctggagcgcggccgcgtcggtctcgcgcctgtcaagtgcgacgtcgccagcgagcggctcggcctgatgctgtgacgcggcctggcgaaccgtaaccgctctggctcgggggttagttgttccctcagtggccataaccttaacctgccaaacgtttctaagtttggaacatgtttatccttttttcatgtaaggaaggaaaacctgcataaccttgatcgtgcctgtggcatgtacggtgtttagcgtaaactgtaaacttagtgtagtgatgtgtttctttactttactgaacaagtagtgttgtatgtaaatatcaacttgtagaagatgtacaagcttcaatgaagtacattatgtataagatggtcatgatatgttgaaat

SEQ ID NO: 15060 - DNA, 982 bp, Sorghum bicolor
  Clone ID: SORBI-28MAY03-CLUS104_41
gcacgagggccattgatagctactccacggccagaaacccaccgcccacacacagcgagagcaagaagaagctagagatcgatggccggggagaagaagcagggcctgcagctgctggacttctgggtgagcccgttcgggcagcgctgccgcatcgcgctggacgagaagggcttgccctacgagtacctggaggaggacctactggccgggaacaagagcgagctcctgctccacgcaaacccggtccacaagaagatccccgtgctcctccacgacggccgccccgtctgcgagtccctcctcatcgtgcagtacctcgacgaggcgttcccggcggcgacgccgccgctgctccccgccgccggcgatccgtacgcgcgcgcgcaggcccggttctgggcggactacgtggacaagaagctctacgactgcggcacccggctgtggaagctcaagggggacggccacgcgcaggcgcgcacggagatggtcgagatcctccgcacgctggagggcgcgctcggcgacggcgaattcttcggcggggaggcgttcgggttcgtcgacgtcgcgctcgtgccgttcacgtcgtggttcctcgcctacgagcggttcggggacctcagcgtggagaaggagtgccccaggctcgccgcgtgggccaagcgatgcgcggaacggcctagcgtcgccaagaacctgtactcgtcggagaaggtctacgagttcatctgcgggttgaagaagaggttcggcatcgagtagagggatatggcctggattgatttgatgcatcgtgttcgtgtgagttggtcattgttgtgtttgtgtgggttgaatcgttgttgtgcgtccttatattacatcctttgtatcgatgtgtcgtgtctggcgtacgtgcagcggcagcggcaccgccgtgttgcctcgagcacacgtaccgcagctgaataaatggttcgtattggattttcttggt

SEQ ID NO: 15061 - DNA, 630 bp, Sorghum bicolor
  Clone ID: SORBI-28MAY03-CLUS104_42
gcacgagggtcgggaccacccgctgagtttaagcatataaataagcggaggagaagaaacttacaaggattcccctagtaacggcgagcgaaccgggaccagcccagcttgagaatcgggtggcttcgtcacctgaattgtagtctggagaggcgtcctcagcgacggaccgggcccaagttccctggaaagggacgcctgggagggtgagagccccgtccggcccggaccctgccgcaccacgaggcgccgtcaacgagtcgggttgtttgggaatgcagcccaaatcgggcggtaaactccgtccaaggctaaatacaggcgagagaccacctgagaggatggtgagctcttcttcgtgctgcgcgtaaagcacaagctggagcatggattacatatctcatggcctgaattccaagaacagtatctaagcaatgaagaatgtctcgccgaatcttgtgaagtagttgccatcccagctgctaaaatcctgtattttttactgcttgttcattgcttccttgtaaatgtgaatactagagtgttacttcagagattcacgagtgtacctacagtgcatgatcgtgcttgtctttctaaggctagagagaacatagtaacagattcgtt

SEQ ID NO: 15062 - DNA, 633 bp, Sorghum bicolor
  unsure (1)..(633): unsure at all n locations
  Clone ID: SORBI-28MAY03-CLUS104_43
cctgggcaaccccagcctgatccacgcgcagagcatcctcgccatctgggccgtccaggtcgtgctcatgggcgccgtcgagggctaccgcattgccggcgggccgctcggcgaggtcgtcgacccgctctacccaggcggcagcttcgaccccctcggcctggccgacgatcccgaggccttcgccgagctcaaggtgaaggagctcaagaacggccgcctcgccatgttctccatgttcggcttcttcgtccaggccatcgtcaccggcaagggcccgctcgagaacctcgctgaccacctggctgacccagtcaacaacaacgcctgggcctacgccaccaacttcgtccccggcaactaagctcatcagctgctcagttggctatgcaactccattgtcttttcggagagggcgtacgtggattgattgatgctgcaaagttaattagctgcatgtgtgtctcttgtttcacgttgcatttcagggggcaagtcgggatgatgagttggcgttgtacactaagatgaatgatgcttgtgcaatagtagttgtggttttgtttcccggtggttaattattgatttgtcaaaaaaaannanaaagggcggccctcgcgatctagaactagt

SEQ ID NO: 15063 - DNA, 804 bp, Sorghum bicolor
  Clone ID: SORBI-28MAY03-CLUS104_44
gccggccgggccgggaaaagcgtgcaggcagagcagaaaagaacacctacctaggaaaaatcccaagcagctgttgcaaccggttcctgcgaggagaaacaagcatgaggccccaggtggtgctgctcgtctcgctggctgtcttcgtcgtcctcgtagctctgccactcggcaaagcgaacgaggagaaggaggccgccgccgaaggggttgacgcgaggaggtggaggtggccgtgctgcgacgagtgcggcgtttgcacgaggtcgcagccgccgatatgccagtgcctggacacgtcgacgagcggctgcaacccggggtgcaaggcgtgcgtcaagtccatcagcgacggcctctacgagtgcaaggacaggatcgtcaacttctgcaagcgccgctgcacccgtcctgctgctgctgctgctgctgctgctgctgatgcgtgatctgcgcggtcgtcgtccgatcccagagccggcaaatgagctttgccaataaataatttccgttcggacttcggagttccctttttgcatctttctcaagatgcagacagggtttgaataaggtgatgcttgctgttttctgaaataaagagcatggatgtgttatgctcggagttctgtagtcatgggaggtagagaaaatgtaataatcgctttgtttatgtgcatctttagatgccatagaccgaggcatgactagctaataagcgcatggctacttgcatctctttgatgcaaaggccgtgatatggacatgtctatttcatataattcccacaaatatcacaaacatttt

SEQ ID NO: 15064 - DNA, 691 bp, Sorghum bicolor
  Clone ID: SORBI-28MAY03-CLUS104_45
cggcaacggatatctcggctctcgcatcgatgaagaacgtagcaaaatgcgatacctggtgtgaattgcagaatcccgcgaaccatcgagtttttgaacgcaagtgaaataccactacttttaacgttattttacttattccgtgggtcggaagcggggcatcgcccctccttttggctctaaggcccggccttgccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgataccacagaggattcagaacaagaagctcaacaagctcatgctggagtttgccagcggggtatacggggagctggattaggaattcctgttgttttataatcattatttatttataattataattaccccacagatgcgaatgcaaagcaactagggttgttgtattcttttgtagcatatttgtgatttccacccctcaaaataggggaaatctgtttggctggtcaaagtgtgcatatgctgtgggtggccaaacacgccacgtgtattgataaagcccctgccaagggggagagctagcatttgagtgatcgattgcc

SEQ ID NO: 15065 - DNA, 1369 bp, Sorghum bicolor
  Clone ID: SORBI-28MAY03-CLUS104_46
cacatccatatattgcacttatcttcccagtaatactactgtacattggcgagctgcaaataagatcaacgtgtttttttggctcaaataggagccggacgaagggaagagatttagtttagtacacaaacacacatgtaggactgacacagataattgagcgctgctacgtgggacacaaggattggttggattccactggcgaggcagtggcgccttagtacttgtaccccttgacgtacaaactttcagaggcggcggcgtccccggcgccggagccggtgtacttgcctagcccggcctcggagttggccttgcaccggacgaggaaggtggcctgcgcggcggcgacgttctccttcttgccgagccacttcttgagggtgctctgctgcagcgcgcggccgaaggagaaggacagcgtccagggcttgagcacctccagcttgttcatggcgtccaggttctgcgtcgcctcctcctcgctctgcccgcccgacaggaacacgaccccgggcaccgccggcggcacggtgcgccgcagcgccgccaccgtgtactcccctatcacctccgcgccaaccttggggctatcggaaccgggggtgaccatgttggtcttgaggagcgtgccctcgaggaggaccttgtggtcgttgagcgacttgtagacggcggcgaggacgcgctcggtgacggcggcgcaggtcttgatgtcgtggccgccgtcggtgaggatctcgggctcgacgatgggcacgagcccgtactcctggcagatgagcgcgtaccgcgcgaggccctcggcgttctgcctgacggcgagctcggagggctccgcggggccgaccttgagcacggcgcgccacttggcgaagcgcgcgccggccgcgtagtacttggcgcagcgcgcgcccagggagtcgaggccctgcgcggcggtctcgccgttggtgcccgcgatctcgacggtgcccttgtccaccttgatccccgggacggcgccggcggcgcggatcacgtccacgaacggcgtcccgtcggaggtcttctggtacagcgtctcctcgaagaggatgaccccggagaggtagtcgaacacgccgggcgccgtgaagagcagctcgcggagcgcctgccggttcgactccacgttctcgaggttgatgctggacaggcgcttgccgatggtgcccgtcgactcgtcggaggccaggatgcccttgcccggcgttgccaggtacttggcggtcttgatcagctcatctgtgtatttccccacaaaggcagacatggtgacccttttcagaagtggatgtggatcaagggagcaggagcaaaatccaaacgcgtgtggccgccgggcact

SEQ ID NO: 15066 - DNA, 648 bp, Sorghum bicolor
  unsure (1)..(648): unsure at all n locations
  Clone ID: SORBI-28MAY03-CLUS104_47
gccggccgggccgggctcacgcacgccgctgcagccgccgccgccgctaccgccccgcaccccgctcctctcccgtcgccgagatgacgaagcgcaccaagaaggctggaattgttggcaaatatggaaccaggtatggtgctagcttgcgtaagcaaatcaagaagatggaggtatctcagcactccaagtacttctgtgagttctgtgggaagtttgctgtgaagaggaaagcagttggcatttggggatgcaaggactgtgggaaggtcaaggctggtggtgcttacaccatgaacactgctagtgcggtcactgtcaggagcacgatccgtcgtttgagggagcagactgaagcatgataaagctcttgttaggcatattggggttctagttgaatcacactatattggccgtttggctgagataatgctccaccatttttggtttatgctctaggatctctaaaagttgggtgctaagatttgtactcggttaccattgtgaatttcacaagtgatatctgatcgtatccctgtattaatgacgtcaaatttggttgtggtctaccctttggttgcgtcattgggttgcaattcctttccattgaaaattcaactcaanaaaaaaaaaaaaaaaaggccccta

SEQ ID NO: 15067 - DNA, 1270 bp, Sorghum bicolor
  Clone ID: SORBI-28MAY03-CLUS104_48
gccggccgggtccggacacgactctcggcaacggatatctcggctctcgcatcgatgaagaacgtagcaaaatgcgatacctggtgtgaattgcagaatcccgcgaaccatcgagtttttgaacgcaagttgcgcccgaggccttccggccgagggcacgtctgcctgggcgtcacgcaaaaaaaaaaaaaaaaacaaaaacaaaaaaaaaaaaaacacacgactctcggcaacggatatctcggctctcgcatcgatgaagaacgtagcaaaatgcgatacctggtgtgaattgcagaatcccgcgaaccatcgagtttttgaacgcaagttgcgcccgaggccttccggccgagggcacgtctgcctgggcgtcacgcaaaaaaaaaaaaaaaaacaaaaacaaaaaaaaaaaacacacgactctcggcaacggatatctcggctctcgcatcgatgaagaacgtagcaaaatgcgatacctggtgtgaattgcagaatcccgcgaaccatcgagtttttgaacgcaagttgcgcccgaggccttccggccgagggcacgtctgcctgggcgtcacacgattcagaaaccctcgcctccctcttccttcccggccgccgcctccctcctcgtcctcttcctcgccgccgccgccgccggagggagaagggatgggtgccaatggggatgaagcgtcgcggataatcgtaccgatggcggtggaggggaccccggagcagctggcgttcgtccaggagtcgaagctgcagaagcgcaaggagaacgtggactgggccgtcaggaaccgggagcgcaaggcggccaagcgccagcgcatccgcgacgagcacaaggtcgtcgtcaagcggcccgaggatttcgtcaccgcgttccgcaacaaggagcgcgacttcctgcgggtgaagacccgcctcaaggtccgcaagcagccccccgtcgaggcgctcagctccaagctcgtcttcgcgattcgcatccctggctccgtggacttgcatccgaacatcaggaaggttttgaggaagctacgactgacgagggtcctcactggggtgttcctcaaggccaccgcgttgacgctgaagaggcttctcattgttgaaccctttgtcacctacgggtttccaaacttgaagaatgtgaaagagcttatttacaagaagggccgtgggttcttggacaaggagcctttccctcttaccagcacgatctaattgagaaggctcttggagatcacggcatcatatg

SEQ ID NO: 15068 - DNA, 751 bp, Sorghum bicolor
  Clone ID: SORBI-28MAY03-CLUS104_49
aattctgatctccatcctgatcgatcgtttgattattggcgagcttcatcagttcctttggcggaggatgtcgtgctgcggaggcaactgcgggtgcggctccggctgcaagtgcggcagcggctgcggagggtgcaagatgtacccggacatggctgagcagcaggtgaccaccaccgccaagactctcgtcatgggtgtcgcaccatcgtccaaggggcacgccgagggcgggttcgaggcggcggccggcgccggagctgagaacgacgggtgcaagtgcggccccaactgcagctgcaacccctgcacctgcaagtgagctgtataataaccccctgcactgcactgcagcccggaggaaggacggattcccttagctgtagtatagcagtgtcgtcactgtgtgtgtgtttgagtcagccagtcagtcgagtgccatggcaccatatgctagtggttctggtactgatgggaaccaataataattgtactgggatgttggcgtcgtgtcgtccttcccgtgctcctccgggggctcatctactagcagtcggtgttgtgttgtgtgtttgtgggtgcagtgcagcacagcagcaggccatgccccctgctctgtgggcacgtcgatcgtgtgcgactttgtttgtgctctgtcaccatccatctattacctataatatcccccgtctttgtgtactgtgcgtacccttcttatcttgtttgcgaatgtgtttacctttcttctgcc

SEQ ID NO: 15069 - DNA, 1153 bp, Sorghum bicolor
  Clone ID: SORBI-28MAY03-CLUS104_50
aatttcactctcggcaacggatatctcggctctcgcatcgatgaagaacgtagcaaaatgcgatacctggtgtgaattgcagaatcccgcgaaccatcgagtttttgaacgcaagttgcgcccgaggccttccggccgagggcacgtctgcctgggcgtcacgcagtatcgattccatccgccattgatcactgcacaagtgcgcgctcacaaacccacacacaaagctacaagaagagatggccggggagaagaagcagggcctgcagctgctggacttctgggtgagcccgttcgggcagcgctgccggatcgcgctggacgagaagggcctctcctacgagtacctcgagcaggacctcgcgaacaagagcgagctcctgctccgcgccaacccggtccacaagaagatccccgtgctcctccacgacggccgccccgtctgcgagtccctcatcatcgtgcagtacctggacgaggcgttcccggcgacgccgtcgctgctccccgccgccgccggcgacgcgtacgcgcgcgcgcaggccaggttctgggcggactacgtggacaagaagctctacgactgcggcacccggctgtggaagctcaagggggacggccacttgcaggcgcggacggagatggtcgagatcctccgcacgctggagggcgcgctcggcgacggcgagttcttcggcggggaggcgttcgggttcgtcgacgtcgcgctcgtgccgttcacgtcgtggttcctcgcctacgagcggttcggggacctcagcgtcgagaaggagtgccccaggctcgccgcgtgggccaagcgatgcgcggagcggcctagcgtcgccaagaacctgtacccgggcgagaaggtctacgagttcatctgcgggttgaagaagaggttcggcatcgagtaggatttggattgattgctgtcgtcaacagtgtttcatggttctgttggtaggtgatgagcagagcagtcgtgttcgtgagaggtcgtcgttgtgttgtgtggttgcattgggtggagttgttttcgtgcgttccttgtatccatgtgtgtgtcgtctggcgtccgtgcagcggcagcgccgtgttgcctcgtgcacgttttggagctgaaataaaatgggttgtattggaattt

SEQ ID NO: 15070 - DNA, 1162 bp, Sorghum bicolor
  Clone ID: SORBI-28MAY03-CLUS104_51
gggctcacatttggagtagggatggcgttcgtgatatggtcaaccagggtctgcaccaggctgctagcagagcttgcatccagcggagatgagcacaggggcctcatcgcttatgcgtgctggctcgtctacatgctcttctcgttgctcgtcattttctgataccgtttatggtatggaagattatgttcggaatttgtttagcggatgatgtggaccgcggactgccttttaccagccactggagtgtttttgctgtgttgttgcggatctacctacaatctggccagttggggaaatgttctgtagtgatctcttagttccagtgggcatggtttcggtgtagatcttggttaaaaaagaaaaggaaatcgaggtccagaaacagcaaatgtgcagtaattaggtttttgctgaagtattggtggaaatcttacttgctaaagggattggtcgtggtcagtgcaaatcttgtttactatgattacttaccattaaaaaaaaaaaaaaaaaaaaaactcgagactagttctctccaactgcgggtgcggctccggctgcaagtgcggcagcggctgcggagggtgcaagatgtacccggacatggctgagcagcaggtgaccaccaccgccaagactctcgtcatgggtgtcgcaccatcgtccaaggggcacgccgagggcgggttcgaggcggcggccggcgccggagctgagaacgacgggtgcaagtgcggccccaactgcagctgcaacccctgcacctgcaagtgagctgtataataaccccctgcactgcactgcagcccggaggaaggacggattcccttagctgtagtatagcagtgtcgtcactgtgtgtgtgtttgagtcagccagtcagtcgagtgccatggcaccatatgctagtggttttggtactgatgggaaccaataataattgtactgggatgttggcgtcgtgtcgtccttcccgtgctcctccgggggttcatttactagcagtcggtgttgtgttgtgtgtttgtgggtgcagtgcagcacagcagcaggccatgccccctgttttgtgggcacgtcgatcgtgtgcgactttgtttgtgctctgtccccatccatctattacctataatatcccccgtctttgtgtactgtgcgtccc

SEQ ID NO: 15071 - DNA, 1110 bp, Sorghum bicolor
  Clone ID: SORBI-28MAY03-CLUS104_52
ccacgcggaacggcaaccaacagttcttcacaacggaacaggggggatacgagaaagaggagaagagctcccagattctctcgcttgctcgctcggtcgcctgtgcgcgcttgatttcatcttccatcccctcgcacgcgattcctctgtccctctctccggcggctgctccgatcccaaaccgtgattcgcgcgatggcggccatcgccggcggcaacaagatccgcaacgccaagctggttcttcttggggacgtgggcgccggcaagtccagcctggtcctccggtttgtcaagggccagttcgtcgaattccaggaatcaaccatcggcgcggccttcttctcgcagactctggcagttaacgacgagacggtgaagttcgagatatgggacacggcggggcaggagcggtaccacagcttggctcccatgtattaccggggcgctgcggctgccatagttgtctacgacatcacgaatgcggcctcttttacacgtgcgaagaaatgggttcaagaacttcaagcacaaggaaactcaaatacaatagtggctcttgctgggaacaaggctgatttgttagaggcaaggcaggtgccagcagaagaagcaaaggcgtatgctcaagagaacagtctcttctttatggaaacttctgctaaaacagctatcaatgtgaatgacgtgttctatgagattgcgaagaaattgcttcaagggcagcaggttcagaacccacaaggcggaatggttctcaaccagagaccacctgagaggatggtgagctcttcttcgtgctgcgcgtaaagcacaagctggagcatggattacatatctcatggcctgaattccaagaacagtatctaagcaatgaagaatgtctcgccgaatcttgtgaagtagttgccatcccagctgctaaaatcctgtattttttactgcttgttcattgcttccttgtaaatgtgaatactagagtgttacttcagagattcacgagtgtacctacagtgcatgatcatgcttgtgtttctaaggctagagagaacagagtaacagattcgtttgattcacttgttccaaaaaaaaaaaaaaaaaaggccccta

SEQ ID NO: 15072 - DNA, 758 bp, Sorghum bicolor
  Clone ID: SORBI-28MAY03-CLUS104_53
aaatcaatccctgcctcatcaaacagtaggagtacttgtttacatgcacactgttctcgatcatcgatgtcgtccgtgacatcagacacgtaaaagtgctggcaacttggcatatatatcatcacataggaaaaacacgtcattattgagcacttacacattcgcatgacaacaaaataaccaagtgcaaacgaacagttacacgagagatcaagagacgagacaacgtttcgtaattattgttaccacgcgcagctcctcaaaagttccttttcgcatcagatggacagctccgtcgtcgccatctcctccctcttctgcagcgcgttcgcctccatcttgcagcacttgcacggcgggctcactatcggcaccgcgccgcgcgcatgcgcgtgcccattctgaggtcccttggcgtgggcgtccgtcttccgcgcgatgatgacggagttgatgacctcgtcgtccgggtggtacacggcgagcacgtcgaacccgccgcgccggatgtcctcagggtcgacgatcgggtacaggaacccgcgagccccgtgcgcgctccgcacgacgagcgccgccccgtccgccatgtgcctgccaaggtgcgccaccaccttggccttgtcctcggccgccatgccgacgagggcggccaggaacaccacgtcgtacttgccgaggccgtccgtgaggctggcgacgtccgcggtgtggaaggacattcgcttccgcaggccctcgtccgcgcggaccagctt

SEQ ID NO: 15073 - DNA, 691 bp, Sorghum bicolor
  Clone ID: SORBI-28MAY03-CLUS104_54
gccgccgcggcgtgtaccgcccgttcggcgacgccgccgtggacggcatcgacttctacatcgacaacggcgcgccggaccactacgacgagctggcccgccgcctcgacgggtacaaccggttctaccggggccggaagggggtgcggctcacggcgtcgccgcggtgcgggtgccctgactggcgcgtcgaccgggcgctgcagacggggctgttcgagcgcatccacgtcaggttctacggcgacgacaagtgctcctacaagaacggcggcacctggggcatcgtggaggagtgggacaagtggacggcgaggtaccccaaggcggaggtgtacctgggcctcgccgcggcggagagcggcgtgccggatggggcgcagggcaccatcgcggtctacctcaagtatctctactacgatctgctgcccaaggttcagaaggcgcccaactatggtggcgtcatggtgtgggacaggtactcggacaagaagaccggctacagcggcgtcgtccagggctgggcgtgaggttgttggttgttttacagctattattagtacgtgtgtgtacgtactaataataaaataagatccatttgaaacaatgatatatgggtcaaatgtatggcttatgtatgttctagctgtgttttgcagctgaatgaattatataatgttgttcagttgtc

SEQ ID NO: 15074 - DNA, 1269 bp, Sorghum bicolor
  Clone ID: SORBI-28MAY03-CLUS104_55
ctggatactgcttcgtagtgaacaaccagagagatgatcaatcgactcgcctctcctcttgttcaaggctcctgagatggggaatattggctgggtagagactagagtggttagggaatggtgatccaaatgggaacggccttggattttttggttttttgctcagtttggctgccgtcttgtacagtttagtgctgaattgtaacgctagtaagggcgcagtgggtgcgtagcaatttctgcaactgagttcctctttgaattcactgctcacttgggggttaacttgatgttaggccaaattgtctacaacaaactgaaagagaggtccgagcagttcgtggcaagagggctggtcaggacagaggagagcaagcagaagattgggggagccagtgatgtttacattgcggacataagagacacggatcgtctagcacctgctgtacaaggggtcgatgcgctcataatcctcaccagtgcagtcccaaaaatgaaaccgggtttcgaccctagcaaaggtgggcggcctgagttctactatgaagatggaatgtaccctgagcaggtggattgggttggccaaaagaatcagattgatgctgctaaagctgctggagtgaagcatattgtgttggtgggatctatgggaggaacaaatcctaaccatccgctgaacagcctgggtaatggcaatatactggtatggaagcgcaaggcagaacagtatttggcagacagtggagtcccttatacaatcataaggccaggaggtctacaagacaaggatggaggagtgagagagttaattgtggggaaagacgatgaacttctccagactgacacaaagtcgattcctagagccgatgtggctgaggtttgtgtacaggctctgcagtatgaagaggccaagttcaaggcatttgatttggcctcgaagcctgaaggtgtgggcacgccaacaaaggactttcgggcactgttctcccagattactgctcggttttgagtgagctgctgagaagcctactccaagttctagattgcatggtgtctgaagatataatcaggtagcttgagcatggagctgcagtttggtgcaattgcaaagctgtattaaaactgaagaaagaaattggtgcattgtttgcagtgcactgctgaacgtctggttgccattgtgtaaactgttaagagctaatatgacaagtaattaggaacccctgtttgcataaattgttgggcacaatttatccagcacagttagtc

SEQ ID NO: 15075 - DNA, 946 bp, Sorghum bicolor
  Clone ID: SORBI-28MAY03-CLUS104_56
ttgctggcaacttggcatatatatcatcacataggaaaaacacgtcattattgagcacttacacattcgcatgacaacaaaataaccaagtgcaaacgaacagttacacgagagatcaagagacgaaacaacgtttcgtaattattgttaccacgcgcagctcctcaaaagttccttttcgcatcagatggacagctccgtcgtcgccatctcctccctcttctgcagcgcgttcgcctccatcttgcagcacttgcacggcgggctcactatcggcaccgcgccgcgcgcatgcgcgtgcccattctgaggtcccttggcgtgggcgtccgtcttccgcgcgatgatgacggagttgatgacctcgtcgtccgggtggtacacggcgagcacgagcgagctgaacggcagggggcctgacccgacgaaggcgacgcgggaaggcgccaggcccgggacatagcggaccaggaggtcgtactccagcttgctcaggttgacgtagttgctgaagtaagggaagcggccgaggtggtcgagcgggttgtcgaagccggcgagcatgtcggcgtagtgcgcctcgaggtgtccctcggcgtcggagcagaggcggatgagctcctctcgcatcctctgcgcgtccgggccgagcttggtcacgtcgacggggctcggcgggacgcaggccatgacgaggttgatgaacagagcgtcgacgacgggggacgggctcagcgacggcagcttggcgatgtcggcgtggagggccgcgatcttctgcaccagggcagcaacctccacgttctgggcctccatggaagttggtagtttcgctgctaaagttgcagttgggaagctggtgaggagcacgagaagcagctgatcgatggtgtcttgagctcaagagcaggcaagtgttccagaactcgagctgcttgatccagta

SEQ ID NO: 15076 - DNA, 1751 bp, Sorghum bicolor
  Clone ID: SORBI-28MAY03-CLUS104_57
agcacgctgccctgcagcattttgtctggagttccaagcaaagctccgatctccggatcacactgatccccgccaggcgtgccggcgtccagtggttgcgtcgagggagccttggctagcgaccatgctcgtgaggagcgcatccacgccggtcctcggcgcgctgctcccctccggcagccactcgccggcggtgtcctccccggccgtccactttcccgagtcgccggcggcagccgcctaccacccgccgcccatctcctgccacctggccgggcccgggtccgggtccgaccacgagcgcactcgcggcctcgtcggcaccggcatgcgccgcacgtgctccgaggacaacctcgcgtctctggccggcgtccgcgcggacgaccaccaccaccaccacctcccgccgtccggcaagggcgcgccccgggcgcgcccggtgccgctcgagaccatccagtcgttcaggggccggcaggcgtcgtccaccgacgacgaagaggaggacgaggaggaggacgcgtacgaggtggagcgggagctgcgcttcggccagttcagctttgctggcggcgacggcaacggcagcacctactcgcaggagcacccgctgttcctggccaggggcctcggcatcgaccgcctcggctcgggcctcctcagcgccgacggcggcggcgggttcggtggcagcgatggcggtggtggcgggaacttggtggcgtcggggaacggaggggaccgctccggcatcgagatgcactacaagaagatgatcgaggaggacccctgcaacggcctcttcttgaggaactatgcacagttcctgtaccaggtgaaaggggactacaggagggcagaggagtactactcccgtgcgatactcgccgaccccgacgacggcgagctcctgtcggagtacgccaagctggtgtgggacgtgcaccgcgacgaggagcgcgcctccagctacttcgagcgggcggccaaggcgtccccgcagaacagccacgtcctcgccgcgcacgccgccttcctgtgggacacggacgacgacgaagagggcggcggcgatgtgctcagctgctacacggggttcgctcagcctgcgcactcgtcgcctctggcttcggcgacaacctgaacagaacagcctctccgatccgatcgtctctgaactatgaagtgaattgttggaggtagctagtatgatagtgtggcctgtgctcgtctctgtagctaccaataatatacgagcgaacataggcctagtccagcgtatgtctacttgtgtttgtttcagcaatgagaaagcagattggtactctcttttctttgggagcttaaccttgatctgttgttaatctatgttgtatatgcttatctgaagatgcgatgctagtcttcggctatacagtcctattataaatagcgcgctatagcactatttagcgtttctggaagagaactgctaagctaggaagatttcaacgctaaatgatggtttccgctattagcagctaatagcacgctaatttcgctaaattgggttagtttagcgcccctatttggccttgggcttcatttctatcgacccaaataacttggaggcccaaatagtagagatatacccctatgtgatgtatgttattattgatgtatcatgtatgaactacgaactttgatgtaatatgttagtaaccctttgaaatatctatcactattggtcttcataatgtttcatcttt

SEQ ID NO: 15077 - DNA, 1109 bp, Sorghum bicolor
  Clone ID: SORBI-28MAY03-CLUS104_58
cccacgcgtccgcccacgcgtccggcagcagcagcagctagcaaccggtccaacactctcacgctcgcagagtttgctcagcaatggccgcctccaccatgtcgatctcctccacggcgatggccggcacccccatcaaggtgggctccttcggcgagggccgcatcaccatgcgcaagaccgcggccaagcccaaggtggcggcgtccggcagcccctggtacgggcccgaccgcgtcaagtacctcggcctcttctccggcgagcccccgagctacctcaccggcgagttccccggcgactacggctgggacaccgcggggctgtcggccgaccccgagaccttcgccaagaaccgcgagctggaggtgatccactcccgctgggccatgctgggcgcgctcggctgcgtcttccccgagctgctcgcccgcaacggcgtcaagttcggcgaggccgtctggttcaaggccggctcccagatcttcagcgagggcggcctggactacctgggcaaccccagcctgatccacgcgcagagcatcctcgccatctgggccgtccaggtcgtgctcatgggcgccgtcgagggctaccgcattgccggcgggccgctcggcgaggtcgtcgacccgctctacccaggcggcagcttcgaccccctcggcctggccgacgatcccgaggccttcgccgagctcaaggtgaaggagctcaagaacggccgcctcgccatgttctccatgttcggcttcttcgtccaggccatcgtcaccggcaagggcccgctcgagaacctcgctgaccacctggctgacccagtcaacaacaacgcctgggcctacgccaccaacttcgtccccggcaactaaaagctgctcagttggctatgcaactccattgtcttttcggagagggcgtacgtggattgattgatgctgcaaagttaattagctgcatgtgtgtctcttgtttcacgttgcatttcagggggcaagtcgggatgatgagttggcgttgtacactatgatgaatgatgcttgtgcaatagtagttgtggttttgtttcccggtggttaattattgatttgtcagattaaggccaaaaa

SEQ ID NO: 15078 - DNA, 803 bp, Sorghum bicolor
  Clone ID: SORBI-28MAY03-CLUS104_59
gccggccgggccggggctccaactccaacctacccagcagcggccaggccagccacctccccccgtcgctctcacgctcttcgtgcccgccgcctcctcccctctccgtgcccgtctgaccaacatggcctccatcgccggatcttccgccctctccttcgccaggcccgtcaaggcaatcaacacgaattctctagctttctccccagtgaagaagggtaacacattcctccgcctgcaaccagtgcctatgagatctgtttcctgcgctgccaagaaggatacagtggacaaggtttgtgaaattgtaaagaagcagcttgctcttcctgacaacactgatgtttgtggtgaatccaaattctctgaacttggcgcggattcactggacacggttgagattgtgatgggcctcgaggagcacttcgacattagcgtggaggagtccagcgcgcagacaatcgcaaccgttgaagatgcggctgacctcatcgacaagcttgttgctgggaaggcatagatctgtatctcctaccattgtcctaccactctatgtctctccatttgatctaggtttctgtggtctgaagacttggtgattttctccgcactgctgttgttatgcccgtgtggtaataatacgagatgttttattaagcggttgaacattacggtggtgtaatctgttactgctaaggtgcattgttgtatgaattgtttctccctcagaagaagaatcacacaatccgggattctacgatgactgaaagtatggtactaaaaagttatggctactgttgaat

SEQ ID NO: 15079 - DNA, 1227 bp, Sorghum bicolor
  Clone ID: SORBI-28MAY03-CLUS104_60
ccgcacacagtgccaataagctcgtctctttctccccagctccagctccacgccggacgcagcagcagcagcagaagcagaagcagaagcagaagcagagatcgatggccgccctcgccgcctcctccacggccgccttcgccgcgaagccgcgcctccctcgcgcgcgcctctccgtggcctgctccgccaccggcgacggcaacgccaacagcgtgtcgctcgcgtcctccgtgaagacgttctcggcggcgctggcgctgtcgtcggtgcttctctcctcggccgccacctccccaccgcccgcggccgccgacatcgcggggctgaccccgtgcaaggagtccaaggcgttcgcgaagcgggagaagaactcgatcaagaagctcacggcgtcgctgaagaagtacgcgcccgacagcgcccccgcgctcgccatcaacgccaccatcgagaagacgaagaagcggttcgagaactacggcaagttcgggctgctctgcggcgccgacggcctgccgcacctcatcgtcagcggcgaccagcggcactggggcgagttcatcacccccggcctgctcttcctctacatcgccgggtggatcgggtgggtcggcaggagctacctcatcgccatcagcggcgagaagaagccccccatgagggagatcatcatcgacgtggagttcgccacccgcctcctccccagggggtccatctggcccgtcgcggcgtaccgcgagctcatcaacggagacctcgtcgtcgacgacaaggacatcggctactactaactgcgtgctgcacctgcttgcacatcgctgctggcgagggcgcagtacgtatgtggggaaagatcgatggcttttggtgtaggagctggtaggaggaaggaatccaagtgatctgttgtacttaaaagaaactggatgaagccttgtataattggacttctatctcttgtgtgtattcaccttcttgaaaattcttgagaatatgcttcaaaaaaataatcttgagaacaatttcattttgcattgcgttgccacttgcgtgttaatcgtcagtgaagaggtataacttcccaattagtagagcacaaaattaaagcacagaattggctcaagtgctcgcccagagggaagtaccaagttgtagtttagaatgtaattttatctagtctctgggagatgctcttagacaaaagcgtgatgtgagtgttggtcc

SEQ ID NO: 15080 - DNA, 711 bp, Sorghum bicolor
  Clone ID: SORBI-28MAY03-CLUS104_61
gtgcggcgctcgagccggcctggccggggatcgggtccacaccagccgccgccatgtcgaagcgagggaggggaggtacggcggggaacaagttccgcatgtcactgggtctgccggtggcggcgacggtgaactgcgcggacaacacgggcgccaagaacctctacatcatctccgtcaagggcatcaagggccgcctcaaccgcctcccgtccgcctgcgtcggcgacatggtcatggccaccgtcaagaagggaaagcctgacctcaggaagaaggtgatgcccgccgtcatcgtccgccagcgcaagccgtggcgccgcaaggatggtgtctacatgtacttcgaagataatgctggagtgattgtgaatcccaagggtgagatgaaaggttctgctatcactggacctatcggcaaggagtgtgctgacctttggcctaggattgctagcgcagcaaatgccatcgtttgagaacttgttggaatgtgtttagacttctgtatgatcatctcagtttctgtcgcaactgttgctaagagtgctattggacttaatggctcttttatgtttggtcactcaattttgtagtgaacagaaatttgtctaccatgtggatctatataacaatgtggttaccttaagttttctgtcttccattttttcatgagatgcttatactcaaaaaaaaaaaaaaaaaaggccccta

SEQ ID NO: 15081 - DNA, 1816 bp, Sorghum bicolor
  Clone ID: SORBI-28MAY03-CLUS104_62
gcacgaggcgcccccgcccccgccgccgcggtatccaccaccgccgcccccgcggccgcggccgacgctatggacgccgtggaggactgggggctgaggccgctgagcgaggtggacccggaggtgtacgacctaatcgagcgcgagaagcggcggcagcgttcgggcatcgagctcatcgcgtcggagaatttcacctcgctcgccgtcatggaggcgctgggttccccgctcacaaacaagtactcggagggcatgccgggtgcgcgctactacggcgggaacgaggtcatcgacgaggtggaggagctctgccgggcgcgcgcgctcgccgcgttccgcctggacccggaacggtggggcgtcaacgtgcagccttactcggggtcccccgccaacttcgcggcgtacacggggctgctccagccgcacgacaggatcatggggctcgacctgccctccgggggacacctcacccacgggtactacacggcgggcggcaagaagatttcggcgacctccatctacttccagagcctgccgtataaggtcagctccgacactgggtatgtcgactacgacaagctggaggagaaggccatggatttccgcccaaagcttatcatctgtggtggtagtgcgtaccctcgggagtgggattatgcaaggctcagggccatcgcagacaagtgcggggccatgttgctctgtgacatggctcatatcagtggtcttgtcgctgcgcaggaggctttgaatccttttgagtactccgatgtggttaccactacgacccacaagagtcttagaggaccaaggtctggtatgattttctacaggaagggcccaaagcctccgaaaaagggccagcctgagggtgctctgtatgactatgaggacaagatcaactttgctgtattcccatcactccaggggggccctcacaatcaccagattgctgctctagctgtagccttgaaacaggccatgtcacctggattcaaggcctatatccagcaggtcaaggcaaacacagttgcccttggtaaccatttgatgagcaagggctacaagttggttactgatggaacagagaaccaccttgttctctgggatctccgtcctcttggcttgactggtaataaagttgagatgctatgtgacctatgcaacattacactgaacaaaaatgctgtctttggtgacagcagtgcaatgaccacctggcggtgttcgcatcggtacacctgctatgacctcaaggggtttggttgagaaggactttgtgcagattgctgagtaccttcaccaagccgtgaccatctgcttgagcatccaggaggagcatggcaagcttctcagggacttcaaaaagggcttggtgggaaacaaggacatagagaacctgagggcggaggtcgagaagttcgccacttcgtttgagatgcctggcttcagggtgtctgacatgaagtacacagattagattgttgacctcggtgcaaaccctcctgttacagaacattggcacaaactctttctgttacagtaacattggtgcctctgaaatgtcacgtgaatggtggtacctgaacttcacacaactagagaggtagtagctttcagtttagtgacgccattctgttggtctgctatttgaaaggtctattttgctggaactgttaatgatatgtatgtttagagaataatggttgggaaaatggcattacattgcagataattctgcttagctcggtcttccaaatgttctgtaataaagcttccctttgtttgttagttggcttgatatgacacg

SEQ ID NO: 15082 - DNA, 2117 bp, Sorghum bicolor
  Clone ID: SORBI-28MAY03-CLUS104_63
cagcatgaagaagggggacgttttactagttcaacagagtcatgtacagcttggcaataatcggcatgcatacagaacaaacccaacacattttctaacttaccagtagccagggcacacactatacaggttcctcattccaatgacgggacatacaaccagctaacacaacgaacaaccaaccaactaatacaggaaaaatgccatccgtgaaacatcagttgccatcatatatcatggtcggatcagcagcacggaatcggtgctctgttcatgcttattctcccataggtgcggcccggtaatatgcaggtacagtagcagggaagaacatctgtctcacgccttcagctttaatgatagggaggatgatgccacatgcaccagaaatcagtctggctccaatccacattcgcttaggtgaaggaagagggagcatcaagcggccaacaccgtagatagcaacagcaaagaagtgtgcaactaaactcagtggccgaggattaagaccggagagtaaagcaataggcccatttgagaagacgcctccaaggctcaagtaatcaaaacaagcttggcgcatctcattcctagcttgatcaggcgaggcactgaagaccttgtacagagcgccggccaatgtgtttattgtggaagcaaccggcttccgcagtgtatagaacgattcaaggtacttgcacagggaagatgcgtcatgaagattgtggagaggcttgagaagattacgtaggacaacaatgtcggataatgcaacagtcattcctccaccagttaaagggtgtctcatattgaatgcatcccccatcaaaagtgccccaggggtcggatgtggagccgctggcatgctcctatttggcattgttcttatgcttcccttatcaatggccgctatgaaagagtcgtagatttctggaggaatctggggtgcaacaacagttttgagataatttgccatttcaccgctagctatggaaggcaccttctgaccagggacatcaaccaaacagcgcacctctgtgctgctaattgggtaaaataggattggagaaggattggccaagataacatggccatggtttggatgtggaagttggcaattctccaataccgcccaacaaaacatgatggaacatcaacctttggagagcaaagggcgcgtcgtagatttgaaaagcaaccatcacatacaatcgtcaggggagcataagcttttagttcttcacctgacttggttttgtattgaacacctttaacagtaccattttcttcaagaagtgatgtaacagttccttgctctaattggacattgggcaaagacgcagctttttgacgcatcctctgtataaacctcccattgtgaaagctcctaccagcaacatcagaatggaacttctccaagggataagcaagctttgtgttcctcccatctttgaataatgcgtaaccaaggacacgctgggcatcaatttcttccacacaatcttcgaggcccaactcaattaatttcaagtaacccccaggttgcaacagttcacccacaattctgtcaggttctgtcagatccctctcgatgacatgcacccgacggccatcctttcccagcgtgtatgccagcgcagatccagctactccggcgccgacgatgatgacgtccgtccggccgtcgccgaccgcgcagcctccctccggcgcgggtttggcttccaccagaggcgcctggggccgggcccggcggcggcggcgccccagaacggccgcaacaaggaccgccgctaggagcgtggccgcggcggcgccaatgagctggaacccgacgccggaggccgccgcagcagcagcagccatgccgcaatggggcctcctcgtgccgctccctgggaccttccggtgcgcggcgcgtttgcggccttgcgtatgcggcttgcgagaggggggggagggaggggaagaggagagtggtttgatgcgtctgggactctggggcgggcgaaggcggggcggggcggagagagagggagaggagcgatgggacgaggcggctcttcgagattcttccgcgttttatgggagaggaggaggttgcggagcggtgggct

SEQ ID NO: 15083 - DNA, 1028 bp, Sorghum bicolor
  Clone ID: SORBI-28MAY03-CLUS104_64
aaagctccaccccgcacacactgccaataagctcgtctctttcttccagctccagctccacgccggacgcagcagcagcagcagcagcagaagcagagatcgatggccgccctcgccgcctcctccacggccgccttcgccgcgaagccgcgcctccctcgcgcgcgcctctccgtggcctgctccgccaccggcgacggcaacgccaacagcgtgtcgctcgcgtcctccgtgaagacgttctcggcggcgctggcgctgtcgtcggtgcttctctcctcggccgccacctccccaccgcccgcggccgccgacatcgcggggctgaccccgtgcaaggagtccaaggcgttcgcgaagcgggagaagaactcgatcaagaagctcacggcgtcgctgaagaagtacgcgcccgacagcgcccccgcgctcgccatcaacgccaccatcgagaagacgaagaagcggttcgagaactacggcaagttcgggctgctctgcggcgccgacggcctgccgcacctcatcgtcagcggcgaccagcggcactggggcgagttcatcacccccggcctgctcttcctctacatcgccgggtggatcgggtgggtcggcaggagctacctcatcgccatcagcggcgagaagaagcccgccatgagggagatcatcatcgacgtcgagctcgccacccgcctcctccccagggggttcatctggcccgtcgcggcgtaccgcgagctcatcaacggagacctcgtcgtcgacgacaaggacatcggctactactaactgcgtgctgcacctgcttgcacatcgctgctggcgagggcgcagtgcgtatgtggggaaagatcgatggcttttggtgtaggagctggtagggggaaggaatccaagtgatctgttgtacttaaaagaaactggatgaaagccttgtataattggacttctatctcttgtgtgtattcaccttcatgaaaattcttgagaatatgcttcaaaaagataatcttgagaacaatttc

SEQ ID NO: 15084 - DNA, 1184 bp, Sorghum bicolor
  Clone ID: SORBI-28MAY03-CLUS104_65
gcacgaggatccgtccggagataagaggggagtggaagaaaagaggagaagatgagcagctgactttgcctcccccgttataaaagggaggagggggcagggaggaagccgtccatagattcctccgcctcgtcactccactccttgagatttgagaaccacaagggccaccccccacccaccctccaaggacatggcggacgccgtcgaccgcttgaagaccgggttcaacaagttcaagaccgaggtctatgacaagaagccggagctgttcgagcctctcaaggccggccagtcccccaagtacatggtgtttgcgtgctccgactcccgtgtgtgcccgtcggtgaccctgggtctgcagcccggtgaggccttcaccgtccgcaacatcgccgccatggtcccagcctacgacaagaccaagtacaccggcattgggtctgccattgagtacgccgtgtgcgccctcaaggtgcaggtcctcgtcgtcattggccacagctgctgtggtggcatcagggcgctcctctccctccaggatggcgcacctgacaccttccacttcgttgaggactgggtcaggatcggcttccctgccaagatcaaggtgaagaaagagcacgcttcggtgccgttcgatgaccagtgctccatcctggagaaggaggccgtgaacgtgtccctcgacaacctcaagacgtaccccttcgtcaaggaagggctggccaacgggaccctcaggctggtcggcggccactacaacttcgtgtcaggggagttcgacacatgggaaattaagagctaagctgcccggccggccgcttaacaactcctaccatcatcataaatatatataccacatacctaccgatatgcacccgatcgatgtgaatgcgtggagtattactcatgttttctgcatgcagcgacatatatatatatatatatatatatatatatatatataccggatcgcccaatgtgaatgtaataagtaatagcattttctaccgcttttatttctaacgccgagctttcatgtactatataatgtgttatatgatgagtaatttgaccgccctgtggtcaaaagacatcagctataatccttttttcgcaatatttattatgaaaaaaaaaaaaaaaaaaaaaaaagggcgccgctcgcgatctagaactag

SEQ ID NO: 15085 - DNA, 1142 bp, Sorghum bicolor
  Clone ID: SORBI-28MAY03-CLUS104_66
gccggccgggccgggacacgactctcggcaacggatatctcggctctcgcatcgatgaagaacgtagcaaaatgcgatacctggtgtgaattgcagaatcccgcgaaccatcgagtttttgaacgcaagttgcgcccgaggccttccggccgagggcacgtctgcctgggcgtcacgccagaaagcatcatcaccccagagcctctccttcccggtctccgcccgttgccttctccgtccccggctgcgtcgccggcgaacccaccaccgcgaatcggatcctccgacaaggcgagaggggagagatggggctcacgttcaccaagctgttcagccggctgttcgccaagaaggagatgcggatcctcatggtggggctcgacgccgccggaaagaccaccatcctctacaagctcaagctcggcgagatcgtcaccaccatccccaccatcggattcaatgttgaaactgtggagtacaagaacatcagcttcactgtctgggatgtcgggggtcaggacaagatcaggccgctgtggaggcattacttccagaatacacagggtctcatcttcgttgtggacagcaatgatagggaccgtgttgttgaagcaagggatgagcttcaccggatgctgaatgaggatgagttgcgtgacgctgtgttgcttgtgttcgctaacaagcaagatcttccaaatgctatgaatgcagctgagattactgataagcttggactgcattcacttcgccagcgtcattggtacattcaaagcacttgtgctacaactggtgagggattgtacgaaggcctggattggctgtccagcaacattgcaagcaagtcctaaattttcaagcgaggtttggatcatctaggagcttttggatgatgatggtgctggatatttagggttgggttgatatttccgtatgtaagatgtatgccctgagctcaacagttattgagctctgcttaagttttcacagttaaattgttttatgtaatttgggccttgagatgtttctgaaccaaacagctaaaaagagttcagttgagttaattggttgccattacattacgagattcattcatggtccatatgttcaacagaatcacatcagaatgatatgttttcacc

SEQ ID NO: 15086 - DNA, 823 bp, Sorghum bicolor
  Clone ID: SORBI-28MAY03-CLUS104_67
cacaagcgcggcccaagcacagcagtaaaatgcactcgtttccataaagcagcagagtccacaagtaccacgaccagggaaatgtacattactcagtgaaacagcagctgagtttgatatgacgcgatgccaagcataaaccccaattcaaatccgttcccaatactgtcaccaaccaacaaacccaagctaaattattcactgcatgcaatacgccaagtacatgcacaagcccacagattacagaaccaaatgaggtgcaaacttaagtgcccaatgaccaaaatagcatacgacttagaagccctgctcgaccaggtaatctccgagcctctccaccaccatattgcattgccctggagtcattggctcatcatagataccaataatcaaggccatgccagttttcttgatagtaatgcctccagtgcccttctttcctcggatgacagctccaggttcaccttggatcaccatgtactttgtacctccaacaaaaagaccagttggtgcaagagtaccaggctcatcaaagtccttcgtgatcgcagcaacctcctcaggctttaactgggggaagcccgtggactgcgcccagaggctgccgtcgaggccgaagatggcggcggcgctgaggtgctggccatcgatctcgcacatcaggtggtcgtcgacgtacgtctgccacgacatcttgctccgcgctcttcctcctccttctccggcgacgacttcgcttcttctactgggggtctgcttggttcccacgcggtgtctcggtggacggctggactggggatcggggaaatatcggtgcgagttt

SEQ ID NO: 15087 - DNA, 1292 bp, Sorghum bicolor
  Clone ID: SORBI-28MAY03-CLUS104_68
ggaagaaggggacgttttactagttcaacagagtcatgtacagcttggcaataatcggcatgcatacagaacaaacccaacacattttctaacttaccagtagccatcacacacacatacacaacacaagcatcagatagaagaagcagtgatctgatcgacatggccgccgccgccaccatggctctgacctcccgcgcgctcgtcggcaagccggcgaccaccagcaccagggacgtcttcggcgagggccgcatcaccatgcgcaagactgctgccaagcccaagccagcggcgtccggcagcccctggtacggggccgaccgcgtcctgtacctgggtccgttctccggcgagcccccaagctacctgaccggcgagttccccggcgactacggctgggacaccgccgggttgtccgcggaccccgagaccttcgccaagaaccgcgagctggaggtgatccactgccgctgggccatgctcggcgcgctcgggtgcgtgtttccggagctcctcgcccgcaacggcgtcaagttcggcgaggccgtgtggttcaaggccggttcacagatcttcagcgagggcgggctggactacctcggcaacccgagcctgatccacgcgcagagcatcctggccatctgggcgtgccaggtggtgctcatgggcgccgtcgaggggtaccgcgtcgccggtggcccgctcggggaggtggtcgacccgctgtaccctggcggcagcttcgacccgctcgggctcgccgacgacccggaggcgttcgcggagctgaaggtgaaggagatcaagaacggccgtctcgccatgttctccatgttcggcttcttcgtgcaggccatcgtcaccggcaagggtcccctcgagaacctcgcggaccacctggccgaccccgtcaacaacaacgcctgggcctatgccaccaacttcgtccccggcaagtgaccggcaggccgcaggagtccgccatggatgtcaccacgagagcattctagcgcatggtagggtctacattgccatgaggagggtccgtggcaagtgaatttaacttttgtatagaacagtgtgttaagcgttcgattatttgggattatacatacgaatgaggtatttggcggtatcctacatttgtacagatggagacaagaaggatgatcgtgtatgaacttttggcaaaggtagctttttggctgaaactaagagaaactcctaaaaatatggtatgcacaaagtttatcctagagaattaatttaagtcaattagtcactttttc

SEQ ID NO: 15088 - DNA, 985 bp, Sorghum bicolor
  Clone ID: SORBI-28MAY03-CLUS104_69
gccccagcaatcacatgattttattgacttattatgtttatcaacattcatagtatggtataaagttgacaacaatttattttcactccgaccccagtacgtatacttgcatgtattcaattcatgcatacggcacactactacgtctagtatgggctctggccgacgtagttgccccggcgggttgtagctgcagatgatgaagacgccggcgttgttgtcgcagacgacgcgggcgcagccgatggccgtggagtcacgccacaccacctgcgtgtagtgcccgcacaccttgccgtccgcgcagctgttggtgtcgtggttgtagtactgcttctcggaaacccacgacgccacggcgtcggacgccgaccagtcggcgccggcggagccccagaagatgttctcgccgtagggaccgccggagtggatcagcttgcagtcgccctgccgctgcgccgcgtagctctgcgcgtacgcggccaccgtgtcgtcccacgacaccgggccgacgccgacgtcggcgcgcgccgcgttgtgcgggttcacgtagtcctgcggcgagttctgcgccgcgcacggcgcgacgacggtggcagccagcgccagagctgcggcgacgaggcacgctagcagcttcgtcggtgacgaggaggacgacgccattgccgctgttgctgctgaccaagttatctgaatgagcagagatggcgcgctgttgtggcctcgtgccgaattcggcacgaggcaaaccccaatcttgaggaaaagctgagttgctagtaatgctttatagatgatacacacccacttggatttaataaggccctgatgtagggtgtgtgtatgtatttatgtaacagctagagagtacagtataacccaaacccaactcaatgaccactagctatggtccaccttgtcaactagaagaaacttttttttttaggaccaacaactcatatgaatcaattaaacctgtttt

SEQ ID NO: 15089 - DNA, 1946 bp, Sorghum bicolor
  Clone ID: SORBI-28MAY03-CLUS104_70
gcacgaggagcgaatcgacccatccatccatcaatcaaagcacgtcagcctcacaacatcatctcctgctcctccacaaccatggataaggcctacgtggccgtgctctccttcgccttcctcttcgtgctccactacctcgtcggccgtgctggcggcaacggccgcaagggcaacaatggcaaggggaatgctgcgcagcagcggctgccacccagccctcccgccgtcccgttcctcggccacctccacctcgtcaagacgccattccacgaggcgctggccggcctcgcggcgcgccacggcccggtgttctccatgcgcatgggctcccggggcgccgtggtcgtgtcctcgcccgagtgcgccaaggagtgcttcacggagcacgacgtggccttcgccaaccgccccaggttcgccacgcaggagctcgtgtccttcggcggcgccgcgctcgccacggccagctacgggccctactggcgcaacctccgccgcgtcgccgccgtgcagctcctctccgcgcaccgcgtcgcctgcatgtcctccgtcatctccgcagaggtgcgcgccatggtgcgccggatgagccgcgcggccgcggcggcgcccgacggcgccgcgcgcgtccagctcaagcggaggctgttcgaggtctccctcagcgtgctcatggagaccatcgcgcagaccaagacctcccgcaccgaggccgacgccgacacggacatgtcgcccgaggcgcacgagttcaagcagatcgtcgacgagatcgtgccgcacctcggcaccgccaacctgtgggactacctgccggtgctgcagtggttcgacgtgttcggtgtgaggaacaagatcatggccgctgtcagcaggagggacgcgttcctgcggcggctcatcgacgcagagcggcggaggatggacgacggcggcgacagcgacaagaagagcatgatcgccgtgctgctctcattgcagaagtcagagccggagctgtacacggataccatgatcatggcactttgcgggaatttatttggcgccggaacggagaccacatcgtccacgacagaatgggccatgtcgcttcttctgaaccacccggaggcgctgaagaaggcacaggcagagatcgacgcggtcgtgggcaactcccggctgatcaccgcagaagacgtgcctcgcctcggctacctgcagtgcgtcatcaacgagaccctgcgcatgtaccctgccgcgccgctgctcctgccgcacgagtcggcggcggactgcaaggtcggcggctacgacgtgccccgcggcacgctgctgatcgtgaacgcgtacgcgatccacagggaccccgcggtgtgggaggacccggccgagttcaggccggagcggttcgaggacggcaaggccgaggggcggctgctgatgccgttcgggatggggcggcgcaagtgccccggggagacgctcgcgctgcggaccgtcgggctggtgctcggcacgctgatccagtgcatcgactgggacagagtcgatggcctggagattgacatgaccgcgggtggcgggctgaccatgcccagggccgtcccgttggaggccacgtgcaagcctcgtgcagctatgcgcgatgttctgatggagctctgagcctctgatgaagagtaacatcttggcatatgatccctagggtctcactgcgtggtactgaggttcaaccggtactagtgtgtaggtgtgtagcagtatgctttggcttatggtgtgtgctgaactaaataagcttgggtgcgtaataccctcgtacgttttatttcttctgtaaaatatatggtcgtttgtatgagcaattagtagttgtttcacagttcacagtatggtttagcaaattgtgatcttctccagattatcttgtatagtattcaagaatatgtaaacaatttatt

SEQ ID NO: 15090 - DNA, 726 bp, Sorghum bicolor
  Clone ID: SORBI-28MAY03-CLUS104_71
ctactggaagtggcactcgcgcacacagcacaattgatgtccgccttccccgtccgcggctccacgtccagcagcagcatcgtcgccagcctcggcagcagccgcgcccccgcccccgcgccgtcctccgtccgccggcgccccagcctcatcaggaacgcccccgtcgtcgccgtccccgccaccctcgtgggcatggacgccgtcgagcgcttgaaggtcgggttccagaagttcaagaccgaggtctatgacaaaaagccagagctgttcgagcctctcaaggctggccaggcccccaagtacatggtgttcgcctgctccgactcccgtgtgtgcccgtcggtgaccctgggcctgcagcccggcgaggccttcaccgtccgcaacatcgcctccatggtgccaccctacgacaagaccaagtacagcggcaccgggtccgccatcgagtacgccgtgtgcgccctcaaggtgcaggtgctcgtcgtcattggccacagctgctgcggtggcatcagggcgctcctctccctcaaggacggtgcacctcacaacttccacttcgttgaggactggggcaggatcggctcccctgccaaggcgaaggtgcacaaagagcatgcctcagtgccgttcgatgaccagtgctccatcctggagaaggaggccgtgaacgtgtccctcgccaacctcaagacttaccccttcgtcaaggaacggctg

SEQ ID NO: 15091 - DNA, 1750 bp, Sorghum bicolor
  Clone ID: SORBI-28MAY03-CLUS104_72
gccccccgccccctcctcgcctccgccagtcctgtcaacccctcccacgccgccgccatggaccccgtcgccacatgggggctaaccccgctcgccggcgccgacccggagatctacgacctcctggagcgcgagaagcggcgccagcgtcgcggcatcgagctcatcgcctccgagaacttcacctccttcgccgtcatggaggcactcggctctccgctcaccaacaagtactctgagggcatgcccggtgcccgctactacggcggcaacgacgtcatcgacgagatcgagaacctctgccggtcacgcgcgctcgctgccttccgcctcgacgccgcgttctggggcgtcaacgtgcagccctactcgggctcccccgccaacttcgccgcttacaccgcgctgctcaacccgcacgaccggatcatggggcttgaccttccctccggcggacacctcactcacggctactatactgccggcgggaagaagatctccgccacctcgatctactttgagagcctgccgtacaaagtgagcgccaccaccgggtacatcgactacgagaaactcgaggagaaggcacttgacttccgccccaagctcatcatctgcggtggcagcgcgtacccgagggactgggactactccaggctcagggccatcgccgacaaggtcggggccctgctgctctgcgacatggcgcacatcagcggactcgtcgccgcggaggaagctgcaaatccttttgaatattgtgatgtggttaccactaccacacacaagtctcttagagggccaagggctggcatgatcttctacaggaaaggccctaagccccccaagaagggccagcctgagggtgctgtgtatgattatgaagacaagatcaactttgctgtgttcccatctctccaaggtggccctcacaaccaccagattgctgcacttgctgttgctctgcagcaaactatgacacctggcttcaaggcctatgcaaagcaagtgaaggccaatgctgttgcaattggaaactatctcatgagcaagggctacaagatggtgactgatggaactgagaaccaccttgttctctgggatctccgccctcttggcttgactggaaacaaggttgaaaaactctgtgacctttgccacatcacattgaacaagaatgctgtctttggtgacagcagtgcattggctccgggtggtgtccgcattggtgcgccagcaatgacctcgaggggtctagtggagaaggactttgagcagattggagagttcctccaccaggcggtgaccatctgcctgaacattcagaaggagtacggcaagctcctcaaggacttcaacaagggcctgttgaacaacaaggacattgagaacctcaagacccaggtggagaagttcgccgactctttcgacatgcctgggttcacgcttgagagcatgaagtacaaggagtagatgtctcccgtgtataacaaggccctcttgtaccaatgtttttcttggccatggcggagggtgccatggcactgcactgccacacttaaggtgatgatggcttatggattttgtctacaacgtcagcagtataggctcacaagtgccccctgccctctggtttggtcgccttcggtttatcaggttttcctttggtacttgttcgcagggagtcatgaaaatgtcaatcaggtgtttgccaataataattccgtggtttcagccagcagcttttttt

SEQ ID NO: 15092 - DNA, 1950 bp, Sorghum bicolor
  Clone ID: SORBI-28MAY03-CLUS104_73
caacagatactaatttattaaagtttcaccacccatgatggatgaagggtgatgaatgagtttacaaacacacacgtttggggcatttgggaacaaaaaaaatacctagtccaaacataacatggatcatactgctatgacgacattacgaggaacaacattctaggaatacaacatcacaaagttcagctagcaaacatttgaacaggggaatcctcagcagcagcacaaactttagtccgcatgacttacaactacaagcatgtcattactgatgcacctcacttgccttcctccacaattttgacaacatttttaacaccatccctcatctcctttgggatggctccgccttctgggagatcaaacttcctgcggctaagcgtcctcggcttccctggtggctgagggtccacgatctccagcatcccctcaagttcctcaagcatggatctctttgcattgcggaccatgtagtctggtccctcaagggcatcaactgtcagtagcaggacaatgatcttctcagcaaacctctggcgctcttcagtgtcatgtgcaacgcggcggcggtatgagatgttgtagaagaaggacctaatctccttgagcttggcttttgcaacagcgaggtcgcgaaggcaacggagcacctgggagcgatgggccaggtgcgctctgtagttcatctggatgagcaatgcggcatcttgtggggaaagttccttcctcttgcccttgcagtggttcatttcaaaagcctttctgatggccacgcatacacaacacagagcaagctatcatctgatcgacatggccggcgccaccatggctctcacctcccgcgcgctcgtcggcaagccggcgaccaccagcaccagggacgtcttcggcgagggccgcatcaccatgcgcaagactgctgccaagcccaagccagcggcgtccggcagcccctggtacggggccgaccgcgtcctgtacctgggtccgttctccggcgagcccccaagctacctgaccggcgagttccccggcgactacggctgggacactgccgggctgtctgcggaccccgagaccttcgccaagaaccgcgagctggaggtgatccactgccgctgggccatgctcggcgcgctcgggtgcgtgttcccggagctgctcgcccgcaacggcgtcaagttcggcgaggccgtgtggttcaaggcgggctcccagatcttcagcgagggcgggctggactacctcggcaacccgagcttgatccacgcgcagagcatcctggccatctgggcgtgccaggtggtgctcatgggcgctcgtcggcaagccggcgaccaccagcaccagtcgacgtcttcggcgagggccgcatcaccatgcgcaagactgctgccaagcccaagccagcggcgtccggcagcccctggtacggggccgaccgcgtcctgtacctgggtccgttctccggcgagcccccaagctacctgaccggcgagttccccggcgactacggctgggacactgccgggctgtctgcggaccccgagaccttcgccaagaaccgcgagctgaaggtgaaggagatcaagaacggccgcctcgccatgttctccatgttcggcttcttcgtgcaggctatcgtcaccggcaagggtccccttgagaacctcgccgaccacctcgccgaccctgtcaacaacaacgcctgggcgtacgccaccaacttcgtccccggcaagtgagcgagggcatgcttgtaccgtagacatacgtatccgtatgtactgcagggtgtaccagtatttgtgaagggagcttgggtcagagattgtaccagtagtgtatttgtatgcatgttctgacctgatcaataaaatatgctgtaaattgtatatgtctttatttatgcatactgtacatgattgttcagacaatcgttcgatc

SEQ ID NO: 15093 - DNA, 1061 bp, Sorghum bicolor
  Clone ID: SORBI-28MAY03-CLUS104_74
gcgttcgcacgcatacacaacacagagctaagcacccgaagaagctgtgatctgatcgacatggccgccgccaccatggctctcacctcccgcgcgctcgtcggcaagccggcgaccaccagcaccagggacgtcttcggcgagggccgcatcaccatgcgcaagactgctgccaagcccaagccagcggcgtccggcagcccctggtacggggccgaccgcgtcctgtacctgggtccgttctccggcgagcccccaagctacctgaccggcgagttccccggcgactacggctgggacactgccgggctgtctgcggaccccgagaccttcgccaagaaccgcgagctggaggtgatccactgccgctgggccatgctcggcgcgctcgggtgcgtgttcccggagctgctcgcccgcaacggcgtcaagttcggcgaggccgtgtggttcaaggcgggctcccagatcttcagcgagggcgggctggactacctcggcaacccgagcttgatccacgcgcagagcatcctggccatctgggcgtgccaggtggtgctcatgggcgccgtcgaggggtaccgcgtcgccggtggcccgctcggagaggtggtcgatcctctgtaccctggcggcagcttcgacccgcttgggctcgccgacgacccggaggcgttcgcggagctgaaggtgaaggagatcaagaacggccgcctcgccatgttctccatgttcggcttcttcgtgcaggctatcgtcaccggcaagggtccccttgagaacctcgccgaccacctcgccgaccctgtcaacaacaacgcctgggcgtacgccaccaacttcgtccccggcaagtgagcgagggcatgcttgtaccgtagacatacgtatccgtatgtactgcagggtgtaccagtatttgtgaagggagcttgggtcagagattgtaccagtagtgtatttgtatgcatgttctgacctgatcaataaaatatgctgtaaattgtatatgtctttatttatgcatactgtacatgattgttcagacaatcgttcgatct

SEQ ID NO: 15094 - DNA, 1117 bp, Sorghum bicolor
  Clone ID: SORBI-28MAY03-CLUS104_75
ggccgctcgaggccggccgggccgggaaacgccacttgttctctagcttcctctccctcctctcatcggaagcaggcaggcaggcagccagcaatggccatggcgtcgtcgagcgggctgaggagctgcagcgccgtgggcgtgcccagcctcctggcgccgtcgtcccggtggtccagccgcctgccgttctgcgccaacgccaccacctccggccgcgtcaccatgtccgccgagtggatgcccggccagccccgccctgcccacctcgacggctcctcgcccggggacttcggcttcgaccctcttggtctggcgacggtgccggagaacttcgagcggttcaaggagtcggaggtgtaccactgccggtgggcgatgctggcggtgccggggatcctggtgccggaggctctagggctaggcaactgggtgaaggcgcaggagtgggcggccgtccccggcggccaggcgacgtacctggggaacccggtgccgtgggggtcgctgccgacgatcctggtgatcgagttcgtggccatcgcgttcgcggagcaccagcgcaccatggagaaagaccccgagaagaagaagtaccccggcggcgccttcgacccgctgggattctccaaggaccccgccaagttcgaggagtacaagctcaaggagatcaagaacggccgcctcgccatgctcgcgttcgtcggcttctgcgtgcagcagtcggcgtaccccggcaccggcccgctggagaacctcgcgacccacctcgccgacccgtggcacaacaacatcggcgacatcatcatccccagatcaatctccccttgagctcagatcagatgcatgttttgtacgtgtgtcattgccttgccattactaggcattgcctgctgcctgcctgcgtgcaggagctgtacaacgacgacggcgacttcctgcgccggaaaaccccttgtaatgtaaagcttatattattaagtagcggctactcttgtagtcttgtatcaaatctaaactggtttagctgagtcccatggttatttcgagactaattaaccaggggaagtttagcttaaaacgaagaaaattcatacgagaactttgacaaaaaaaa

SEQ ID NO: 15095 - DNA, 3038 bp, Sorghum bicolor
  Clone ID: SORBI-28MAY03-CLUS104_76
ggccgaaaaacatgtttgtgacagagcagcagtgttggcatgtacatatactcgtacaacagaggactgatttcagatcaaaagaagaaaacttcctaaataaccgaatggtattacaagtacaatatacaccggcgaatacatctacagtttagaagaacctctccatgagttcagaatctgacaaaagttctttcaatccgataaatttgctatactgcaaggtgatccagccaacagctgatacataggcaacaagaaggcaggcacgcttcaaccgactggcaaatgctctgatgctatgcttcctcacagcccaccgggctgcagcaagcaacaatccatagaaacctctaaataagactgtaatgaacatcgaactcaacatgccgagcacaacacctgctgctacatatccaagcatccgttctgaactgaaatcttctgacacatacatctctgaaaacagtataagtatccttttgagcagctccgtagttgaaggttcctcagcagtacaattgaatagtttgtccgagtgaatatcagccttgttactacctagcatatatctgcaactgtatgattcattgaccttgaactttaatgttgttgaccatgcagcaccaaaatcaggtcgacaattatgaggaagagcctcttttggggcctctgccactgcataagatacttggccagaaaaatattctgtgtattcaacctgtaaaactgaagcccagtagtagtcatcatggcagcggaatcttctcttactcgacgggtagaagatatgcttagctctatagttcaataatccaagctcgttgacggcgcctcgtggtgcggcagggtccgggccggacggggctctcaccctcccaggcgtccctttccagggaacttgggcccggtccgtcgctgaggacgcctctccagactacaattcaggtgacgaagccacccgattctcaagctgggctggtcccggttcgctcgccgttactaggggaatccttgtaagtttcttctcctccgcttatttatatgcttaaactcagcgggtggtcccgactgacctggggtcgcggtccgagcaacgatgtgctgcggtgcccgaagggtccttagggccgatgcaccggccacgtgtcggggcgctgcaccgagaacaactaagtgtcgcccaccacgtgctgtgcccgacacgaatcgccggcagccccaacttcggcccaccgcgccatgcggcacggggagccaaaaaccacatccctccccgagggtgggttgggagtgtctgttggcgtgacgcccaggcagacgtgccctcggccggaaggcctcgggcgcaacttgcgttcaaaaactcgatggttcgcgggattctgcaattcacaccaggtatcgcattttgctacgttcttcatcgatgcgagagccgagatatccgttgccgagagtcgtgtggattaagatatcatcgctgctcagggagcggaaggcatgccgaccactccgctgtgcaaggcaacatgagtgttccttgacgcctaaggcgccgtgggttcttttgtggcccctctgccccaggttggagcaaggggaccttgtgccgagccaaagctcgacgacatgagagacatgttcacggtctgttttgtttaagggtcacgacaatgatccttccgcaggttcacctacggaaaccttgttacgacttctccttcctctaaatgataaggttcaatggacttctcgcgacgtcgggggcggcgaaccgccttcgtcgccgcgatccgaacacttcaccggaccattcaatcggtaggagcgacgggcggtgtgtacaaagggcagggacgtagtcaacgcgagctgatgactcgcgcttactaggcattcctcgttgaagaccaacaattgcaatgatctatccccatcacgatgaaatttcccaagattacccgggcctgtcggccaaggctatatactcgttgaatacatcagtgtagcgcgcgtgcggcccagaacatctaagggcatcacagacctgttattgcctcaaacttccgtggcctaaacggccatagtccctctaagaagctagctgcggagggatggctccgcatagctagttagcaggctgaggtctcgttcgttaacggaattaaccagacaaatcgctccaccaactaagaacggccatgcaccaccacccatagaatcaagaaagagctctcagtctgtcaatccttgctatgtctggaaggaaaaatcccaagcagctgttgcaaccggttcctgcgaggagaaacaagcatgaggccccaggtggtgctgctcgtctcgctggctgtcttcgtcgtcctcgtagctctgccactcggcaaagcgaacgaggagaaggaggccgccgccgaaggggttgacgcgaggaggtggaggtggccgtgctgcgacgagtgcggcgtttgcacgaggtcgcagccgccgatatgccagtgcctggacacgtcgacgagcggctgcaacccggggtgcaaggcgtgcgtcaagtccatcagcgacggcctctacgagtgcaaggacaggatcgtcaacttctgcaagcgccgctgcacccgtcctcctgctgctgctgctgctgctgatgcgtgatctgcgcggtcgtcgtccgatcccagagccggcaaatgagctttgccaataaataatttccgttcggacttcggagttccctttttgcatctttctcaagatgcagacagggtttgaataaggtgatgcttgctgttttctgaaataaagagcatggatgtgttatgctcggagttctgtagtcatgggaggtagagaaaatgtaataatcgctttgtttatgtgcatctttagatgccatagaccgaggcatgactagctaataagcgcatggctacttgcatctctttgatgcaaaggcccgtgatatggacatgtctatttcatataattcccacaaatatcacaaacatttaaaaaaaaaaaaaaaaaggccccta

SEQ ID NO: 15096 - DNA, 1352 bp, Sorghum bicolor
  Clone ID: SORBI-28MAY03-CLUS104_77
gcacgaggcgtcgtctccacagcaactcaagccatcgatctgcaagtctcactcttctgcataaacccagtgcatcaagcagcgcaatggcgagcagcaccatggctctctcctccacggccttcgccggcaaggccgtgaacgtgccgtcgtccctcttcggcgaggcccgcgtgacgatgcgcaagacggcggcgaaggccaagccggcggcggcgtccggcagcccgtggtacggccccgaccgcgtgctctacctgggcccgctctccggcgagcccccgagctacctgactggcgagttccccggcgactacggctgggacacggccgggctgtcggcggaccccgagacgttcgccaagaaccgggagctggaggtgatccactcccgctgggccatgctcggcgcgctcggctgcgtgttcccggagctgctcgcccgcaacggcgtcaagttcggcgaggccgtgtggttcaaggcgggttcgcagatcttcagcgagggcgggctggactacctgggcaacccgagcctgatccacgcgcagagcatcctcgccatctgggcctgccaggtcgtgctcatgggcgccgtcgaggggtaccgcatcgccggcggcccactcggcgaggtcgtcgacccgctctaccccggcggcagcttcgacccactcggcctcgccgacgaccccgaggccttcgccgagctcaaggtgaaggagctcaagaacggccgccttgccatgttctccatgttcggattcttcgtccaggccatcgtcaccggcaagggcccgctcgagaacctcgccgaccacctcgccgaccccgtcaacaacaacgcctgggcctacgccaccaacttcgtgcccggcaagtgaggaggtgtccggatgcatgtgagcgcgcgcgcgcactggtttcggcttgtaccatgatgtaaattactgtaccagggttcaatcaagaaggaataactgtgttcattatctcgcgccgcgtctaaatttctaatacggctcattcttttcctttttcattcatcactgtcggttttatttgcgtgaaaaatcaggtgtttgattagaagagggtcgctgaatttacaaatcagacttcagacatttgcttacctgactgatggacgccgtggggtagcaccctagcagtctagcacccatgcttctagtgatcattacagtgagaagagtaaaaagatcctgttttagctgcatgctgcattgttgatccgttgtggggattttttttcgattagtgtagtccagccattgagcaaccggtattcgacattgtcagaaaacggagctttgacaggatacaatttagtt

SEQ ID NO: 15097 - DNA, 2106 bp, Sorghum bicolor
  Clone ID: SORBI-28MAY03-CLUS104_78
cctactggaagtggcactcgcgcacacagcacaattaatgtccgccttccccgtccgcggctccacgtccagcagcagcatcgtcgccagcctcggcagcagccgcgcccccgcccccgcccccgcgccgtcctccgtccgccggcgccccagcctcatcaggaacgcccccgtcgtcgccgtccccgccaccctcgtgtaagcgggaggacgagcagctcatcaaaagtcaaacgagagagaaagggagagagggccacaccacatccattgatacgggaggagagacgaaagaaaacacaaggagatgagcagttgcctttgcctccctaaaaagaaggagggccagggggcggcagcgaagccgtccatagattcaaccacctcgacagtcgttcagaacccgaagcctacccaacctccacctcctccctccaagggcatggacgccgtcgagcgcttgaaggtcgggttccagaagttcaagaccgaggtctatgacaaaaagccagagctgttcgagcctctcaaggctggccaggcccccaagtacatggtgttcgcctgctccgactcccgtgtgtgcccgtcggtgaccctgggcctgcagcccggcgaggccttcaccgtccgcaacatcgcctccatggtgccaccctacgacaagaccaagtacagcggcaccgggtccgccatcgagtacgccgtgtgcgccctcaaggtgcaggtgctcgtcgtcattggccacagctgctgcggtggcatcagggcgctcctctccctcaaggacggtgcacctcacaacttccacttcgttgaggactgggtcaggatcggctcccctgccaaggcgaaggtgcacaaagagcatgcctcagtgccgttcgatgaccagtgctccatcctggagaaggaggccgtgaacgtgtccctcgccaacctcaagacttaccccttcgtcaaggaacggctggccaaagggaccctcaagctggtcggcgcccactacgacttcgtgtccgggaagttcctcacatgggagcctgtgatggacgccgttgaccgcttgaagagcgggttcgagcagttcaagatcgaggtctatgacaagaagccagagctttttgagcctctcaaatctggccaggcccccaggtacatggtgttcgcctgcgctgactcccgtgtgtgcccgtcggtgaccctgggcctgatgcccggcgaggccttcaccgtccgcaacatcgccgccctggtcccaggctacgacaagaccaagtacaccggcatcgggtccgccatcgagtacgccgtgtgcgccctcaaggtgcaggtgctcgtcgtcattggccatagctgctgcggtggcatcagggcgctcctctccctccaggacggtgcacctgacaacttccactttgttgaggactgggtcaagattggcttccctgccaagatgaaggtgaagaaagagaacgcttcggtgccgttcgatgaccaatgctacattctagagaaggaggccgtgaatgtgtccttggagaacctcaagacctacccattcgtcaaggaagggctggccaacggtaccttaaagctggtcggcggccactatgacttcgtgaaaggagagttcctcacatggaaagtctagagctaaggcacccggacggcccaactcctacatcatcataaatttataccacatatatacctaccgatatgcacccgatcgatgcgaatgcgcggagtactacatgcatgttttcagcaactacatatatacataccggatcgccccaatgtgaatgtaataagcaatagcattttcaaccgctttcatttctaacgccgagcttttatgtactatatattatatgatgcataattgaccggcttgtggtcaaaagacatcaactataatccttttttcataatattgttatgaagagtttacctctttttttttgtcattaacggatccagagaaacaggccaggagggcaacacgccaacaccctccgtcctaaaatagagtgcattttgacatttaagatgtgtcccaaaatatagtacattcaaggaacatgaagataatatttactt

SEQ ID NO: 15098 - DNA, 1997 bp, Sorghum bicolor
  Clone ID: SORBI-28MAY03-CLUS104_79
tcaatgcaaacagtaaattgtttgatcagttgctggagttggatcctgagtgtgtcgtttcccatggacaagcaacattattagagaagcaaagattaatagatgattgtctggagaaatcctatgaaatttccctgggatatggccagtttgggaattgtctggctgttgatgctgatgctatttcaaatttgagaagtgaacttggaaatcaactagctagcaagagccgtgatttgaatctaaggggtattggggctgttgtatacaaagtccctgagttgaataatgaacagatgctgaaaataagtctaagaagtttagaacaagaagacacaacttgtatctctcaggaatatggtggtgggggacatcggaatgcaagctcgtttatgatgagtgtgactgagtttgacaggtggaaggtcggagctggaccttctcgagcaaaaggtgcataaccatctggctttcttcattgctccacacttctgttaatcaagaagattaatgaagaaacacatgcagaggaacaaaaccccaaacttcggggtgtgagacatgagaaacatcatactcacatagcagttagcagataattcccgaaacttatgcagcattctgctaccatgtcatatcttaccctatgacacttattaataggctgccgtgtggacacttgcttttacaaaatctgctgaaaccataattgcagagctctacatgtgtcacatactaaaaaaaaaaaaaaaaaacaacatctatcgtaaacctcttctcactgcaaagcaatcaagcaagctccatcatacagcacacaatagctatagctagcagctagctagagcaaacatggcgtcccgacgccgccattcgtgcctaggggcgccgctcgtcctcgccctggcgttcgtgctcctctcctgcctcgccggcccggcgacggcgaagcagacgaaccaggtgaccgtcttctggggccgtaacaaggacgagggttccctgcgggaggcctgcgacacggggctctacaccaccgtcatcatctccttctacagcgtgttcggccacgggcgctactggggcgacctgtcgggccaccagctgggcggtgtcggcgccgacatcaagcactgccagcagtccaagggcatcctcgtgctcctctccatcggcggcggcggccatgactactcgctcccgtcctcgcagtccgcggcggacgtcgccgacaacctctggaacgcgcacctcggcgggcgccgccgcggcgtgtaccgcccgttcggcgacgccgccgtggacggcatcgacttctacatcgacaacggcgcgccggaccactacgacgagctggcccgccgcctcgacgggtacaaccggttctaccggggacggaagggggtgcggctcacggcgtcgccgcggtgcgggtgccctgactggcgcgtcgaccgggcgctgcagacggggctgttcgagcgcatccacgtcaggttctacggcgacgacaagtgctcctacaagaacggcggcacctggggcatcgtggaggagtgggacaagtggacggcgaggtaccccaaggcggaggtgtacctgggcctcgccgcggcggagagcggcgtgccggatggggcgcagggcaccatcgcggtctacctcaagtatctctactacgatctgctgcccaaggttcagaaggcgcccaactatggtggcgtcatggtgtgggacaggtactcggacaagaagaccggctacagcggcgtcgtccagggctgggcgtgaggctgttggttgtttaactgttttacagctattattagtacgtgtgtgtacgtactaataataaaataagatccatttgaaacaatgatatatgggtcaaatgtatggcttatgtatgttcgagctgtgttttgcagctgaatgaattatataatgttgttcagtttgtcaaaaatatatatataatgtagtttttttttactccc

SEQ ID NO: 15099 - DNA, 1922 bp, Sorghum bicolor
  Clone ID: SORBI-28MAY03-CLUS104_80
attatgaactccacaatcattttattcatattagtctacggtttaccaaggatgctctacgtaacatgggcacttatttaggcaattcatcatcaaaacgggtacaccagtctagcctaaaaatatcttgaacacttgtttagcaattcatcaaacggctgtactacgtagcagggaagccaataccatttgagattgagcccagcgtaaaaatgtcgcaagggttatacaaagacgttctgacgcacacgtgagccaaatgaaacattcataagaaatccaatgataataaaaatgctatcataaccaagcattgcacaaggtaaagagaaacaaacaattaaccgcagcaacttactcatccgatacttaatcgaaggcaaagtatgtaaggaaaattgcccgacagacaaagcaagggcagactcgacacaccctatgaccataatgtttttggggactgatgccaccacctagtaggatagttacgagtgtttggagatcaaagtctccgcccaaaacgaatgttggaagaatcctccctctacatgaattattaatttcttcgatatgaaaggcaaaaacttcaccagatcctgattgggcaggaccgggaacaaactgctcttgttcgtcatcatttttctccatttaagcaccgccagagccgtacttcttcccgaagaagaggatctggagctggtcatagccagaaagcacaccagcaccagcaatggcacgaagaatgttagcaccagcacccttgaacagggacttggggccttccttcttaaggatctgctggaacgcatccaaggagctcttgtacttgacagcctcaccagaagtcatcatcatccttctgcggacagtatcaatggggtaagatgcaagaccagcaccgttggtgatcagccaacccagagcaaaacttgcgaagaaattgtcctgaaggttgccggtgaggacaactggcttgatagaatcatagagcccgaagtacaaaccacggtaaacgatgattccaacacaagagatgttaaatccacggtaaagcccagcgataccatcagatttgagtgtcttgcggtagacatccacaagaccattgaattgcctatcacctcctcccttggcagccttggcgtcattggccaaccttgtcctggcatagtccagggagtacacaaaaaacaaagaggaagcaccagcagctccaccagaggccaggttgccagcaaaccacttccagtaaccatccttgtccttcttgaagttgaacaacctcttgaagtagtccttaaatgcaaagttcaaagcctgagtagggaagtaacgaataacatttgcagtgttacccctccacaaggaagagaaaccctcatccttgatggtacgtttgaagcagtcaccaatacccttgtatggctctgacagcctaccagacttgatcatctcatcctggttctgaataagcagcttcacacgctcaatgggagcagcagcagtcttcgaaacagcagctgaaacaccgcccatcatgaaatcaatcatgaagtttttgcctcccttctcagctggagcattggcaaaaagcggggtacgcatcactgggacattgatgccaccagtaacagacattgaagggctgaaaaggctctgtgtcatgtagttccttgtggcaaaactcctttcatacgaagagacagaagggcagatgttacgggcccgaacaccttcagagaagctggagctcaggtggaactggccaccaagcttatgaaggacagtgggttggttagcctggtccgccattaccacctcaaaactattggccttgggcaccggaggcggagagggaggcaggactgggcggcggctccgaactttcagaggcgcgtcgaggtcccggcccggccggc

SEQ ID NO: 15100 - DNA, 1593 bp, Sorghum bicolor
  Clone ID: SORBI-28MAY03-CLUS104_81
tttccaaacagaatgccctttttcttcccacacaaaaccatgagggtatacatagtcacacacacaacgatcaagtccatacacgacacacagtttagagcagctttatttattttgtatgaaaaaaaggaacatgaaagaaaacccaatctcggtatatatcaaaacatgtataagccgcccgtgaagtggaatcgcatcccaatccacatagtatttagttgtaggcgtcggggttggcgacgaggtaggcctcggcacccttgaaaatggcggtgactgcctccttggccttgacttcctcgcccttcacgtccacacccggcagcagcttgtaggtcgactccaccaccaccaccagcagcagcagcagctagcaaccggtccaacactctcacgctcgcagagtttgctcagcaatggccgcctccaccatgtcgatctcctccacggcgatggccggcacccccatcaaggtgggctccttcggcgagggccgcatcaccatgcgcaagaccgcggccaagcccaaggtggcggcgtccggcagcccctggtacgggcccgaccgcgtcaagtacctcggccccttctccggcgagcccccgagctacctcaccggcgagttccccggcgactacggctgggacaccgcggggctgtcggccgaccccgagaccttcgccaagaaccgcgagctggaggtgatccactcccgctgggccatgctgggcgcgctcggctgcgtcttccccgagctgctcgcccgcaacggcgtcaagttcggcgaggccgtctggttcaaggccggctcccagatcttcagcgagggcggcctggactacctgggcaaccccagcctgatccacgcgcagagcatcctcgccatctgggccgtccaggtcgtgctcatgggcgccgtcgagggctaccgcattgccggcgggccgctcggcgaggtcgtcgacccgctctacccaggcggcagcttcgaccccctcggcctggccgacgatcccgaggccttcgccgagctcaaggtgaaggagctcaagaacggccgcctcgccatgttctccatgttcggcttcttcgtccaggccatcgtcaccggcaagggcccgctcgagaacctcgctgaccacctggctgacccagtcaacaacaacgcctgggcctacgccaccaacttcgtccccggcaactaagctcatcagctgctcagttggctatgcaactccattgtcttttcggagagggcgtacgtggattgattgatgctgcaagttagctgcatgtgtgtctcttgtttacacgttgcatttcagggggcaagtcgagatgatgatgagttggcgttgtacactaagacgaaacgatgcttgtgcaatagtagttgtggttttgtttccccggtgggttaattattgatttgtcagattaaggtcatccattaatttgttcgtctgcgatgctttctgctgtttttatagtacttcctagctctaggaattttgcaagcataagtgcttggataaacagaaactatcgatgaaaatgaaagatatacacatgaatgcaatgcttaaattc

SEQ ID NO: 15101 - DNA, 2903 bp, Sorghum bicolor
  Clone ID: SORBI-28MAY03-CLUS104_82
aacggataatagcagcactattataccaacattaacgtacttagttcgataacacacgcatccagccccagccccattacattgcaggctagcaaaagtaaaccacacaaaataaaccgagatgttcagacacgataaccagaatagctacgctaacaactcgctcttcagccgggacacagggtaccccaggcttagtcgacctcctccatcttgctctcgccggcgtcgtcctccagagggggcatgtcagtgtcagcctccggggcctcgtcctcgtcaatgctcaggcccagcttgagcatgcggtggatgcggctgccgaaggtgttggggtcgtcgaggctgaagccggaggtgagcagcgccgtctcgaacagcagcatgacaaggtccttgacagacttgtcgttcttgtcagcctccgcgcgcttgcgcagctcctccatgatggcgttctccgggttgatctccatcgtcttcttggaggacatgtacccagacatgctggagtccctgagcgcctgggccttcatgatcctctccatgttggcggtccagccgtactcaccagtcacgaggcagcagggggagtccaccacgcggtcagagaccaccaccttctccaccttgtcgcccagcacctccttgatcaccttgcagaggccctcgaacttctccttgagctcctcctttttcttcttctcgtcctcgctctcatcaagcttcaggccctccttggtggcagagacaagcttcttgccctcaaactccttgagctgtccaatagcgtactcatcaatggcatccaccatgtacaggacttcatagcccttcttcttcagcttctcaaggaagggagagttctccacagccttcttgctctcgccagtgatgtagtagatgtcattctggccctccttcatcctggtcacatagtccttcaagctggtcagctcatctccgctcttggtggagtggtacctcaggagctcagcaatcttggtcctgttggtggagtcctcgtggatgccaagcttgaggttcttggagaaggcctcatagaacttgttgtagtcctccttgttctcggcaatctcaaagaacagctcaatgcacttcttgacaaggttcttcctgatgaccttgaggatcttgttctgctggagggtctcacgggagatgttgaggggaagatcctcagagtcaacaatgcccttgacaaagctcagccactctgggatcagctcctcacagttgtccatgatgaagacacggcgaacatagagcttgatgttgttcagcttcttcctggtgtcgaagaggtcgaagggggccctctttggcacaaagagaacggccttgaactcaagctgaccctcaacagaaaagtgcttcacggcaagatgctcctcccagtcgttggtcaagctcttgtagaaagcagcatactcttccttggtgatctcctcaggcttcctcatccagattggcttctgcttgttgaccaactgccactcgtgagaaacctccttgatcttcttctttttcttctccttttcttccttctcctcatcaacatcctcaaccttgccctcctcatccttcttatcttcctcatcttcatcatcagaaatttccttctcagtggtcttctcaatccagagagaaattgggtagctgatgaactctgagtgcttcttgatcagatccttcaggcggcgctcctcaaggtactccaactgatcatccttgaggtagagcgtcatctttgtacccctgccaagttgctccccagaggtgtcacgtgtgacagtgaaggagattctcactgaccactgtgccgcgccgtgctcacacacagaacgacgatggccgcgtcggcgcttcaccagaccaccagcttcctcgggcaggccctggtctcccgccccgccgccgccgccgccgatgccggcggccgcatcaccatgcgccgcaccgtcaagagcgctccccagagcatctggtacggccctgaccgccccaagtaccttggcccgttctcggagcagacgccgtcgtacctgaccggcgagttccccggcgactacgggtgggacacggcggggctgtcggcggacccggagacgttcgcgcggaaccgcgagctggaggtgatccactcgcggtgggcgatgctgggcgcgctggggtgcgtgttcccggagatcctggccaagaacggcgtcaagttcggcgaggcggtgtggttcaaggccggcgcgcagatcttctcggagggcgggctggactacctgggcaacccgaacctggtgcacgcgcagagcatcctggccatctgggcgtgccaggtcgtgctcatgggcttcgtcgagggctaccgcgtcggcggcgggccgctaggggaagggctcgacaaggtgtaccccggcggcgcgttcgacccgctcgggctcgccgatgaccccgacaccgccgcggagctcaaggtgaaggagctcaagaacggccgcctcgccatgttctccatgtttgggttcttcgtccaggccatcgtcaccggcaagggacccatcgagaacctcttcgaccatgtcgcggaccccgtcgccaacaacgcctgggcttacgccaccaacttcgtccccggcaactaaagctgatcgatcgagctgatcaagctgagcacagccatgcgtgcatgtcgagcgaggtctcttgtactctacttgttgttttcaatcgtaggcgtgtagtagttgcacgagatcgatgtaaactaagcacagatcgcatgtaacatcagtgtggatgaatcaatctatatcgatggcctgtaccatattcaattttcgatcaaaaaaaaaaaaaaaggacggccgctcgcgatctagaactag

SEQ ID NO: 15102 - DNA, 2282 bp, Sorghum bicolor
  Clone ID: SORBI-28MAY03-CLUS104_83
gcacgaggccctgaccgccccaagtaccttggcccgttctcggagcagacgccgtcgtacctgaccggcgagttccccggcgactacgggtgggacacggcggggctgtcggcggacccggagacgttcgcgcggaaccgcgagctggaggtgatccactcgcggtgggcgatgctgggcgcgctggggtgcgtgttcccggagatcctggccaagaacggcgtcaagttcggcgaggcggtgtggttcaaggccggcgcgcagatcttctcggagggcgggctggactacctgggcaacccgaacctggtgcacgcgcagagcatcctggccatctgggcgtgccaggtcgtgctcatgggcttcgtcgagggctaccgcgtcggcggcggcccgctcggggaagggctcgacaaggtctaccccggcggcgcgttcgacccgctcgggctcgccgatgaccccgacaccgccgcggagctcaaggtgaaggagctcaagaacggccgcctcgccatgttctccatgtttgggttcttcgtccaggccatcgtcaccggcaagggacccatcgagaacctcttcgaccatgtcgctgaccccgtcgccaacaacgcctgggcttacgccaccaacttcgtccccggcaactaaagctgatcgagcgagcgagctgaagctgagcagagcatccatgcgtgcatgtcgagcgaggtctcttgtactctacttgttgttttcaatcgtaggcgtgtagtagttgcacgagatcgatgtaaactaagcacagatcgcatgtaacatcagtgtggatgaatcaatctatatcgatggcctgtaccatattcaaaaaaaaaaaaaaaaaaaaaaaaaaaaaaaaaaaaaaaaaaaaaaaaaaaaaaaaaaaaaaaaactcgagcctaaccctcacgcgcgccgccacagccgccgccgccgcgcctcgcttgctttcccgtcgccaagatgactaagcgcaccaagaaggccggaattgttggcaaatatggaaccaggtatggtgctagcttgcgtaagcagatcaagaagatggaggtatctcagcattccaagtacttttgcgagttctgtgggaagtttgctgtgaagaggaaagcagttggaatttggggatgcaaggactgtgggaaggtcaaggctggcggtgcttacaccatgaacactgctagtgcagtcactgtcaggagcacaatccgtcgcttgagggagcagactgaagcatgatttagcttgttatatcagggttctctagttgctcttgtcaggcatgttggggttctcttgtggaatcactgtactggctgttggccgagatactactccagcatttttggtttatgctctaggatctctaaaagttgggtgctaagatttgtacttggttaccattatgaatttaacaagtgatatttgatcctctgcctgtctaaaaaaaaaaaaaaaaaaaaaaaaaaaaagattgcatctccatcctgatcgatcgtttgattattggcgagcttcattccattccatcagttcctttggcggaggatgtcgtgctgcggaggcaactgcgggtgcggctccggctgcaagtgcggcagcggctgcggagggtgcaagatgtacccggacatggctgagcagcaggtgaccaccaccgccaagactctcgtcatgggtgtcgcaccatcgtccaaggggcacgccgagggcgggttcgaggcggcggccggcgccggagctgagaacgaagggtgcaagtgcggccccaactgcagctgcaacccctgcacctgcaagtgagctgtataataaccccctgcactgcactgcagcccggaggaaggacggactcccctagctagtatagcagtgtcgtcactgcagtgtgtgtgtgtgtttgagtcagccagtcagtcgagtgccatggcaccatatgctagtggttctggtactgatgggaaccaataataattgtactgggatgttggcgtcgtgtcgtccttcccgtgctcctccgggggctcatctactagcagtcggtgttgtgttgtgtgtttgtgggtgcagtgcagcacagcagcaggccatgccccctgctctgtgggcacgtcgatcgtgtgcgactttgtttgtgctctgtcaccatccatctattacctataatatcccccgtctttgtgtactgtgcgtacccttcttatcttgtttgcgaatgtgtttacctttcttctgaaaaaaaaaaaaaaaaggcccct

SEQ ID NO: 15103 - DNA, 792 bp, Sorghum bicolor
  Clone ID: SORBI-28MAY03-CLUS104_84
ggccggccgggcccggaaaaaaaaaaaagattgcatctccatcctgatcgatcgtttgattattggcgagcttcattccattccatcagttcctttggcggaggatgtcgtgctgcggaggcaactgcgggtgcggctccggctgcaagtgcggcagcggctgcggagggtgcaagatgtacccggacatggctgagcagcaggtgaccaccaccgccaagactctcgtcatgggtgtcgcaccatcgtccaaggggcacgccgagggcgggttcgaggcggcggccggcgccggagctgagaacgacgggtgcaagtgcggccccaactgcagctgcaacccctgcacctgcaagtgagctgtataataaccccctgcactgcactgcagcccggaggaaggacggattcccttagctgtagtatagcagtgtcgtcactgtgtgtgtgtttgagtcagccagtcagtcgagtgccatggcaccatatgctagtggttctggtactgatgggaaccaataataattgtactgggatgttggcgtcgtgtcgtccttcccgtgctcctccgggggctcatctactagcagtcggtgttgtgttgtgtgtttgtgggtgcagtgcagcacagcagcaggccatgcccccctgctctgtgggcacgtcgatcgtgtgcgactttgtttgtgctctgtcaccatccatctattacctataatatcccccgtctttgtgtactgtgcgtacccttcttatcttgtttgcgaatgtgtttacctttcttctgtcaat

SEQ ID NO: 15104 - DNA, 409 bp, Sorghum bicolor
  Clone ID: 7552900
gcactttgatcatgcagctcctgggtgacaacttgaccctatggacttcggaccccaacgaggatggcggcgacgagatcaaggaagctgctgccccgaaagagtccccaaagggtcagtaaaatggatatgttgggaaaggggtgaccaggaccgctgtgcttgaattttgatagcttatcttttagtatcccttgttgttgttttccgtcatcacacgccccggtgtatgcatgcgatggagctgctgccattgctgctgttttgccgcgcgctttgttgtttcggttttttcaagtcgataaaatgatggctggatgctggtttttgtgctccaagccagccgcccccaaggaaaaaagacctgctcattttgtgttaaaaaaaaaaaaaacgagggggggcccgg

SEQ ID NO: 15105 - DNA, 524 bp, Sorghum bicolor
  Clone ID: 30980014
aagcccgccgccgccaagccgaaggcggccgccgccggtgcctcccacccgcccccaagccgaaggccaagctcgcagccgccaagaccgctgcgcccaagccgaccaagaaggacgccgccaagcccaagaagactgccgcagcagccaagcccaagaaggccgccgcggggaccaagcgcaaggcgccagagaagaagaaggtcgtggccaagccgaagaagtcccccgctgccaaggccaaggccaagcccaagaccgtcaagtcccccgccgccaagaaggcccggaaggtcgccgcatgagatgggttgcttaggtcgtagtagctctgatcgtcgtgtggtgttggttaggagttgtacaaattaagcgtgtgccccccaaagtgtctctgatggtgtgttctgtcttaggcaagatctatctaccgtggtttatttagtgtagcaaatggctagccttcttgtgatgcagatgtatccagttcatcctatatatgaaatcaacttggtttgcggaaa

SEQ ID NO: 15106 - DNA, 606 bp, Sorghum bicolor
  Clone ID: 30977664
cgtgtgggaggcggtggtgatggagatcgtgatgaccttcgggctggtgtacacggtgtacgccaccgccgttgaccccaagaagggcagcctgggcaccatcgcccccatcgccatcggcttcatcgtcggcgccaacatcctggtcggcggcgccttcaccggcgcgtccatgaaccccgccgtgtccttcggccctgccctcgtcagctgggagtggggataccagtgggtgtactgggtcggcccactcatcggcccactcatctacgagctgctcttcatctcccaaacccacgagcagctccccaccaccgactactaagccggccgccggcgaccccccaccaagcttgggttccgttccgtgcgcagctagcagatcatcaattctctcgatctctggatctccccctcgccgtttagtttctctcgtgcatgtgcatgcatcgtcgaacatctcaagctgctactgctgctgctgcgccggcgccgctcgatcgtcgcatcgtttgctttcttggacaagtctgtaaccgtgaattccggacccgtttgcttctgtaaaatttgtgcatttgcctgagtattcaccgagttccacgt

SEQ ID NO: 15107 - DNA, 672 bp, Sorghum bicolor
  Clone ID: 30977531
agttcaagtcaggtgcggagaggaaggatgctgcggagagccccatgaatgcttacaaagctgctcaggatattgctcttgctgatttggcaccaacccacccccatcaggcttgggctggcactcaacttctcagtgttctactatgagattctgaactcccctgatcgcgcttgcaaccttgcaaagcaggcttttgatgaggcaatctctgagctagacagcctgggagaggagtcctacaaggacagcactctgctgccccgaaagagtccacagagggtcagtaagatggacttcgatctcccgacctgatgcatttgctgatgttggggaggggtgaccaggaccgctgtggttgaattctgatagcttatcttctagtataccttgttgttgtcttccgtcatcacacgcaccggtgtatgcatgcgatggagctgctgccattgctgctgtttttaattaagcactctagatgtcgtcatgccgcgcgctttgttgtttcggttttttcaagtcgataaaatgatggctggatgctggttttcgtgctccaagccagccgccaccaaggaaaaaagacctcatcttgtgttgcagctgttgtgttttagaatgaccccacgtacggagtatttgacttgacaggcctgctgccgagtggtattc

SEQ ID NO: 15108 - DNA, 693 bp, Sorghum bicolor
  Clone ID: 9296752
ccccctgcgccccgtggtgtgccccagatcacggtgtgcttcgacatcgacgccaacggcatcctgaacgtctcggccgaggacaagacgaccgggcagaagaacaagatggtgcaggacgcggagaagtacaagtcggaggacgaggagcacaagaagaaggtggaggccaagaactcgctggagaactacgcctacaacatgcgcaacacgatcaaggacgagaagatcgcgtccaagctggccggcgacgacaagaagaagatcgaggacgccatcgacgcggccatctcgtggctggacgccaaccagctcgccgaggcggacgagttcgaggacaagatgaaggagctcgagtcgctgtgcaaccccatcatcgccaagatgtaccagggcgcgggcgccgacatgggcggcgccggcggcatggacgaggacgcacccgcgggcagcggcggccctggccccaagatcgaggaggtcgactaagcggttcgttgtcaggtctgcaggttgcgctagtgggtggcagcttgcgagttatcgtcgtcgtcgtggcgtgtccgcgttattttagtaatgtttatctgtggttggttggaactttttgtggtggtggttaattaatttttggacctcgtgatggtcggttggttggtgaacaatgttatcgtggcaagcgttaagtaatac

SEQ ID NO: 15109 - DNA, 663 bp, Sorghum bicolor
  Clone ID: 30977337
atgtgctcctaaatccttggggtgccctggtcgccgaacccttccgtccccgccgttgtctcgctggaattgagccaagcaacccctccgccgccccttgccctccgatgccgaggacgacaccgacgatccagacgccggtgccggcgccgagtccttcaagaagagccgcaacgaactgaagcgggaggcccgccgcgccgtgaagtgggggatggacctcgccagcttctccccgcctcagatcaagcgcatcctcagcgccgcgtcgctggagcgcgaggtgttcgatgcgctcatgctcgtcaagaaatttgggccggatgtgcgggaaggaaagaggagacagttcaattacatcggaagacttctgcgcaatgcacaaccagaattgatggatactctaatacaggcttccaaggatggagatgagagcaagttacatgccttacttagtgaaggtacattgttggtggaagaggaggaagtcgaggacctacctgatgaacaagaggacaatcaagagtatatcaaaattgcagatagatggtttgatggcctcctttgcaaagacatttcagttactaatgaagtttactctgtccatagtgttgaatttgatcgtcaggaactgcgaaagcttgtgaagagagctcacatggt

SEQ ID NO: 15110 - DNA, 622 bp, Sorghum bicolor
  Clone ID: 30976318
agtacgcggtgtctgagctgaacgagaaggacttctggcgcatgtttgacgcgtcccactacgagcactgccgccacaaatacggggcggtgggcacgttcatgagcgtgtactacaagtcgaggaaggggcgcaagacggagaaggaagtgcaggctatcaggaactactaccatgacaaccatgtgatccaggacatgctggtgccactgtacaaggttggagatgctcttgagtttgtgcatcgcgagatggaggtgtatcctctgtggctgtgccctcaccgcctgtacaagctgcccgtgaagacgatggtgtaccctgagcctgggttcgagcaccagcacaggcagggcgacacaagctacgcggacgaggcctaagctgggaccaaccgttcagcggcagcggcagagtttgtttacataagactttgtgatgatgcgaatctggacgagatgagatgtttctctcgttttgcttaattaattagaacttgattatgtagtgtgtgtctgtccgtagtactcttaagctcgtggtcagtcagtgacttgtcgttgatgcccagtgttggggtttatttatctttttctctaatgggattctcagatgattcggg

SEQ ID NO: 15111 - DNA, 470 bp, Sorghum bicolor
  Clone ID: 30976244
gtagctcgcttcgattgctccaggccagtagtgctttgttctgtcctggccggcgagcagtaatctccccctcggccgcgtccagcgacggaggggcagtcccaggctctgctgtaccgtgggagcccggccagctgcccagggtggccgggccttggctccgccggtggtctcgcttttcaccagagatgctttagctccgatgcagcccagcgaagttagctgtgggcattgtttcgtcttctttgttgccatggtactgaagtaaaccgcttgaatctgtttgctaccgcagcagcgctccgctcccacggacggacagattgagctcgacggatgagcatgtgtgagaaagatcagaatttgccatggggatacgacctgttccgcgacccttttgctcctcccaacgggtactacgggcctcctcccggctactgtgatggtcactgttgtgacctccattacgg

SEQ ID NO: 15112 - DNA, 723 bp, Sorghum bicolor
  unsure (1)..(723): unsure at all n locations
  Clone ID: 30975502
cttctcctctctctcttcctcctccctatcatcgccgctgcgccgtctcctccgctctcccgtcgaccggaaagatggcgtcccacattgttggataccctcgcatgggccccaagagggagctcaagtttgcccttgagtctttctgggatgggaagagcaccgctgaggatcttgagaaggttgctaccgacctcagggccagtatctggaagcagatggctgatgctgggatcaagtacatccccagcaacaccttctcctactacgaccaggtccttgacaccaccgccatgctcggcgctgtcccagaacgttactcatggactggaggagatgaccaagtggtttgacaccaactaccactttattgtccctgaattgggccctaacaccaagttctcctacgcttctcacaaggctgttaacgaatacnaggaggctaaggcgcttggtgttgataccgtgccagtacttattggaccagtctcataccttttgctctcaaagcctgccaagggtgtggagaagggattccctcttccttcccctcttagcagcatcctccctgtttacaaggaggtcattgctgagttgaaggcagctggggcttcatggattcagtttgatgagcccactcttgtcctcgaccttgattctaacaaattggctgcgttctctgctgcatacgcagaactggaatctgcactttctggattgaat

SEQ ID NO: 15113 - DNA, 609 bp, Sorghum bicolor
  Clone ID: 14327992
cacccctctctcccttggcctggagaccgccggaggagtgatgaccgtgctgatcccgaggaacaccaccatccccaccaagaaggagcaggtgttctccacctactcggacaaccagcctggtgtcctgatccaggtgtacgagggcgagaggacacggacccgcgacaacaacctgctgggcaagttcgagctctccggcatcccccctgcgccccgtggtgtgccccagatcacggtgtgcttcgacatcgacgccaacggcatcctgaacgtctcggccgaggacaagacgaccgggcagaagaacaagatcaccatcaccaacgagttcgaggacaagatgaaggagctcgagtcgctgtgcaaccccatcatcgccaagatgtaccagggcgcgggcgccgacatgggcggcgccggcggcatggacgaggacgcacccgcgggcagcggcggccctggccccaagatcgaggaggtcgactaagcggttcgttgtcaggtctgcaggttgcgctagtgggtggcagcttgcgagttatcgtcgtcgtcgtggcgtgtccgcgttattttagtaatgtttatctgtggttggttggaactttt

SEQ ID NO: 15114 - DNA, 594 bp, Sorghum bicolor
  Clone ID: 30972521
cgtcccgtccgccggcgccgccgagtccaaggtcttctacctcaagatgaagggcgactaccacaggcttttgatgaggcaatctctgagctagacagcctgggagaggagtcctacaaggacagcactctgatcatgcagctcctgcgtgacaacttgaccctatggacttcggacaccaacgaggatggcggcgacgagatcaaggaagctgctgccccgaaagagtccacagagggtcagtaagatggactcgatctcccgacctgatgcatttgctgatgttggggaggggtgaccaggaccgctgtggttgaattctgatagcttatcttctagtataccttgttgttgtcttccgtcatcacacgcaccggtgtatgcatgcgatggagctgctgccattgctgctgtttttaattaagcactctagatgtcgtcatgccgcgcgctttgttgtttcggttttttcaagtcgataaaatgatggctggatgctggttttcgtgctccaagccagccgccaccaaggaaaaaagacctgctcatcttgtgttgcagctgttgtgttttagaatgaccccacgtacggag

SEQ ID NO: 15115 - DNA, 223 bp, Sorghum bicolor
  Clone ID: LIB3480-031-P1-K1-B11
gttctgattcacctgctccaatggctgttctttctgctgctgatgctcccccggtctcagctatcgggtttgagggctatgagaagcgccttgagatcacaattgtgtccgagctctccaacaaggattttgactcctatgtcctctctgagtcaagcttggttatctatcctttgaagattggcatcaagacctgggggactaccaaacttctggttaccat

SEQ ID NO: 15116 - DNA, 312 bp, Sorghum bicolor
  Clone ID: 7553017
ttagacgtacttcaccaaaccaaacctcggacactaaaacaacttaatcgacctcctcgatcttaggaccagcaccgctcccaccagacggggcgtcctcatccatgccagcagcatcgcccatgcccgcgccagcgccgcagatcccctcaagctccttcatcttgtcttcaaactcgtccacctcagccagctggttgctgtccagccagctgatggcactatcgacggcgtcctcaatcttcttcttgtcctctgccgggagcttgtgttcctcatgttgtaggcgtagtctccgagggggggcccggg

SEQ ID NO: 15117 - DNA, 257 bp, Sorghum bicolor
  Clone ID: 7553025
gccctttgcttgtatggttggttttcgatcggccccagttgtaaatacctacgtaggcgtagcgagcgagatcgtagttcagttcagtcgtggtgcttgtgagcctgcccgtgctttgcaaacatgggatcaaagcttagtaaaccccggtaggtgtggttggtcccttggtggtagcaaagcaaagcatgctttgttttgtatcagcaagcaaagcatgctctgttattctgtatcctgtttttttaggtgctgta

SEQ ID NO: 15118 - DNA, 360 bp, Sorghum bicolor
  Clone ID: 7553033
gcacgagggctagcttcacctcacaggtcatcatcatgaaccaccctgggcagattggcaatggctatgccccagtgctggatgctgagcttgttaccaagattgataggcgatctggcaaggagcttgagaaggagcccaaattcctcaagaacggtgatgctggtatggtgaagatggttcccactaagcccatggtggtggagaccttctctgagtatcacatgaggcaaacggtggctgttggagtcatcaagagcgtggagaagaaggacccaactggagccaaggtgaccaaggctgccgccaagaagaaatgaggtgtctgtctggctggttctgtgttttctcgatttcgtc

SEQ ID NO: 15119 - DNA, 440 bp, Sorghum bicolor
  Clone ID: 7553062
tgtccgtggacttcaggtgctccgacgtgtcctccaccatcgacgcgtcgctcaccatggtcatgggcgatgacatggtcaaggtcgtcgcctggtacgacaacgagtgggggtacagccaacgcgtggttgatctggcgcacctggtggcggccaagtgccctctggaggacttctgcaaggacaaccccgagaccgacgagtgcaaggtgtacgaagcatgatgaggcccccttgttgtaggccaggggccgccgtgtgctcagaaaattcactagctttgcctcgtgttctttcgataagagacgtagacgaaaatgtgccgttttctatgagttgtgtatgtaatcactgaactcgtacaggcttccgcttttcgatcatttcctgttgggactcctgtaattctgcggtgtgtgtttatttcatcaataactttt

SEQ ID NO: 15120 - DNA, 480 bp, Sorghum bicolor
  Clone ID: LIB5052-001-A1-XP1-G11
ctgtgcggcgctcgaggcggccgggtccggagaggtgggttggcttctcctccccctccggttcggttcggttcgggtcgggttcgtcaggttcttcgggggttccggttcgtgggtgagcggaagagatggcggcgtcggacgttgagtaccgctactgctaccatgttgtgttgttaccctagtccatagggtttatctatcgtcttgttgttcgtcgtcgtcgtgtccgtgtgtttgttgttgttgcccatctgtgtttttgatcgcaagttgtgttagtgctgtgttcgtcctaaaaaaaaaaaaaaaaaaaaaaaaaaaaagaaaaaattattcgggccatctcgaaatagagagcccttattcgtgagaaaaagagacagtactcgccatccatcatgggtgttgtgtattatcaatataagagtgaaaaggaaatctgttctatgccaaaaaaaaaaaaaaaaaaggccccta

SEQ ID NO: 15121 - DNA, 372 bp, Sorghum bicolor
  Clone ID: 7553209
gggacggaccgggaacggttccttcgggggccttccccgggcgtcgaacaaccgactcagaactggtacggacaagattgcgatggtccccacggatgctgacgcaatgtgatttctgcccagtgctttgaatgtcaaagtgaagaaattcaaccaagctcacgaatgcccatctgcctgagctgttccagaatctcaacacttaaccttgttacaattactcctatgtattgctatgttgtgtgtacatgtaatgctacccctgtatgttgtacggcttatgggctctacaaatttgtatctcaagattctggatgatatacttacgcattctgacataatagaatgtaatttttattttatcttaattcc

SEQ ID NO: 15122 - DNA, 474 bp, Sorghum bicolor
  Clone ID: 7553210
agatgctctccatccagctccgcggattcgccgccaagggcaagctcgtgaaggtcaaggcctcgtacaagctctccgacgccgccaagaaggccgcccccaagccgaaggccaagctcgccgccgccaagaccgctgcgcccaagccgaccaagaaggacccaagcccaagaaggccgccgcggggaccaagcgcaaggcgcctgagaagaaggtcgtggccaagccgaagaagtcccccgccgccaaggccaaggccaagcccaagaccgtcaagtcccccgccgccaagaaggcccggaaggcgtagtagctctgatcgtcgtgtggcgttggttaggagttgtacaaattaagcgtgtgccccccaaagtgtctctggtgtgttctgtcttaggcaagatctatctaccatggtttatttagtgtagcaaatggccagttcttcctatatatgaaatcgattggtttccg

SEQ ID NO: 15123 - DNA, 163 bp, Sorghum bicolor
  Clone ID: 7553214
ccccccccgccaaaaaggcccggaaggttcccgcataaaatgggttgcttaggttgtagtaggagttgtacaaattaagggtgtgccccccaaagggtttttggggtgttttgttttaggcaaaatttatttaccatggtttatttagtgtagcaaatggtta

SEQ ID NO: 15124 - DNA, 539 bp, Sorghum bicolor
  Clone ID: 8088604
gaagaagttactaaaagggttgcgcagattaaaaatctgattgaggcagcagaacaagaatatgaaaaggaaaagctcaatgagaggatagctaagcttgctggtggtgttgctgtcattcaggtgggagcacaaacagaaactgaactaaaagagaagaagttgagagttgaggatgccctaaatgcaactaaggctgctgttgaggaaggtattgttgttggtggagggtgcactcttttgcggcttgcagctaaagtcgatgccatcagatgttgtggtcgtcgatatcaaggagccggaggccgcgcccctcgctaacccgatggacaactctggctatggatactgatgaagtgatgagatgatatggccaagccgcagttgccccatgggacgaaggtgatcaccatattattttttggtaggcgagacgtcgggtccaggtagtttcagataaaaatgtgagtttgttgtacggccaaaaggtgaaaataaggggaggatctgtagccccaaaatctgtgatgtaaacatgc

SEQ ID NO: 15125 - DNA, 652 bp, Sorghum bicolor
  Clone ID: 8088457
catccccaccaagaaggagcaggtgttctccacctactcggacaaccagcctggtgtcctgatccaggtgtacgagggcgagaggacacggacccgcgacaacaacctgctgggcaagttcgagctctccggcatcccccctgcgccccgtggtgtgccccagatcacggtgtgcttcgacatcgacgccaacggcatcctgaacgtctcggccgaggacaagacgaccgggcagaagaacaagatcaccatctcgtggctggacgccaaccagctcgccgaggcggacgagttcgaggacaagatgaaggagctcgagtcgctgtgcaaccccatcatcgccaagatgtaccagggcgcgggcgccgacatgggcggcgccggcggcatggacgaggacgcacccgcgggcagcggcggccctggccccaagatcgaggaggtcgactaagcggttcgttgtcaggtctgcaggttgcgctagtgggtggcagcttgcgagttatcgtcgtcgtcgtggcgtgtccgcgttattttagtaatgtttatctgtggttggttggaactttttgtggtggtggttaattaatttttggacctcgtgatggtcggttggttggtgaacaaagttatcgtggcaagcgttaagtaa

SEQ ID NO: 15126 - DNA, 502 bp, Sorghum bicolor
  Clone ID: 7553220
gcacgaggattccaatcccttttcttgagaaaaaaaaggaggagacgctccacatggggggcgaccacaagaaggacgacgagcacaagaaggaggagcacaagaaggccgaggagcaccacaagaaggacggggagcacaaggagggcatcgtggagaagatcaaggacaagatcaccggcgagcacggcgagaagtccgggaaggacaagaagaagaagaaggagaagaagcacggcgagggccacgaccatgacggccacagcagcagcagcagcgacagcgactgatctcccccctcgccgcctagctacgccgtgcgcttccatacgcagatgcaggtaccagttgctgatgtaatgtttcacgggtgtcatgcatatgtatgtgctacataatcaagggtgaaaaacgatgaaaaaagaaataacagagagtcagagatagcatgtatggtttgtttgccatgtgacggtgctagcttgcaataaaatgttaatgc

SEQ ID NO: 15127 - DNA, 342 bp, Sorghum bicolor
  Clone ID: 7553233
gctacggcgccccccgtgagggtggcggctacgcgagggaggaggcggctacggagccggtggctacggtggcggcggcggcggctacggcggtccccgtgagggcggcggcggctatggcggcggcggcggctacggtggcaaccgcggtgactccggcggcaactggaggaactccaagttatcctagctatctatctatctatagtatcgtgttaccgttccgttggattctgagttacccatgtgttagtgtccgttgaacctttggattaggtgttggtacccccgtgttcgatgatgttactaaatgagagaagagtgagcaaggtttttgttcgc

SEQ ID NO: 15128 - DNA, 572 bp, Sorghum bicolor
  Clone ID: 7660693
cggaggagtgatgaccgtgctgatcccgaggaacacccaccatccccaccaagaaggagcaggtgttctccccctactcggacaaccagcctggtgtcctgatccaggtgtacgagggcgagaggacacggacccgcgacaacaacctgctgggcaagttcgagctctccggcatcccccctgcgccccgtggtgtgccccagatcacggtgtgcttcgacatcgacgccaacggcatcctgaacgtctcggccgaggacaagacgaccgggcagaagaacaagatcaccatcaccaacgacaagggccgtctgtccaaggaggagatcgagaagatggtgcaggacgcggagaagtacaagtcggaggacgaggagcacaagaagaaggtggaggccaagaactcgctggagaactacgcctacaacatgcgcaacacgatcaaggacgagaagatcgcgtccaagctggccggcgacgacaagaagaagatcgaggacgccatcggttggttggtgaacaatgttatcgtggcaagcgttaagtaatactacggtattatctggttcggt

SEQ ID NO: 15129 - DNA, 490 bp, Sorghum bicolor
  Clone ID: 7553235
cgttgcttcgtcggtgggctcgcctgggccaccaacaacgagatcgactccaaggtcatcaccgaccgggagacggggaggtcccgcgggttcggcttcgtcaccttctcctttgagcagtccatgctcgacgccatcgagaacatgaacggcaaggagctcgacggccgcaacatcaccgtcaaccaggcccagtcccgcggcggtggcggcggctacggcggcccccgtgagggtggcggctacggaggaggcggcggcggctacggcgggccccgcgagggaggaggcggctacggaggcggtggctacggtggcggcggcggcggctacggcggtcccggcggcggctacggtggcaaccgcggtgactccggcggcaactggaggaactgattgtgtgggcccaccctggcttcggccaagttatcctagctatctatctatctatagtatcgtgttaccgttccgagtgtccgttgaaccttgg

SEQ ID NO: 15130 - DNA, 518 bp, Sorghum bicolor
  Clone ID: 9301956
ttaccaggtccagacatagcaaggatgtcgtggttcgggcaccaccaccacaaccagccggctcccccggcgtcggggccgaaccaggtgttcaagatcttctgccgcgccaacgagaactactgcctggccgtcgtgctctgggagtggtgcaagggcgagaaccagagctggaagatcctgccgtggggacccgaggcgaacgccgcggcgggggccaacggcggcgtgcacaccgtgcgcgtcttctgcaaggccggcggcgaggactactgcctgacggtgcgcaacgggacggcgtgccttgcgcccaccaacccgcgggacgagtaccagcactggatcaaggacatgcggcacagcacccgggtgcgggacgaggaagggtacccggccttcgcgctggtgaacaaggtcaccggggaggcgctcaagcactccacggggcagggccaccccgtgaagctggtgccctacaacccggagtaccaggacgagtcggtgctctggaccgagag

SEQ ID NO: 15131 - DNA, 522 bp, Sorghum bicolor
  Clone ID: LIB3476-037-P1-K1-G11
cccacgcgtccgggtaccggagagagaggagaggagaggagaggagaggatgtcgtggttcgggcaccaccaccacaaccagccggctcccccggcgtcggggccgaaccaggtgttcaagatcttctgccgcgccaacgagaactactgcctggccgtccgcgacggcgccgtggtgctggccccgaccaaccccaaggacgagcaccagcactggtacaaggacatgcgcttcagcacccgggtcaaggacgaggaagggatgccggcgttcgtcaagcactccctcggccagtcccacccggtgaagctcgcgcctttcaaccctgaccaggaggacgcgtcggtgctgtggacggagagcaaggacgtgggcaagggcttccgctgcatccgcatggtcaacaacacccgcctcaacttcgacgccttccacggcgacaaggaccacggtggcgtgcacgacggcaccggcgtcgtgctctgggagtggtgcaagggcgagaaccagagctggaagat

SEQ ID NO: 15132 - DNA, 695 bp, Sorghum bicolor
  unsure (1)..(695): unsure at all n locations
  Clone ID: 30947425
ctcctccattggactgctctccctgttgaccattgggtattgagtatcattgagccatggctgccaagttgactcgcctccacagtcttcgcgaacgccttggtgccaccttctcctctcatcccaatgagctgattgcactcttctccaggtatgttaaccagggcaagggaatgcttcagcgccatcaactgctatcaggccaaggcctggtgtctgggattacattcgagtgaatgtaagcgagttggctgtggaggagctgagtgtttctgagtacttggcattcaaggaacagctggtggatggaaattccaacagcaactttgtgcttgagcttgattttgagcccttcaatgcctcgttccctcgtccttccatgtcaaagtccattgggaatggagtgcaattccttaaccgacacctgtcttccaagttgttccaggacaaggagagcctgtacccattgctgaatttcctcaaagcccataactacaagggcacgacgatgatgttgaatgacagaattcagagcctccgtgggctccagtcatcccttagaaaggcagaagagtatctactgagtgtccctcaagacactccctactcagagttcaaccataggttccaagagcttggcttggagaanggttggggtgacactgcaaagcgcgtacttgacacactccacttgc

SEQ ID NO: 15133 - DNA, 517 bp, Sorghum bicolor
  unsure (1)..(517): unsure at all n locations
  Clone ID: LIB3476-010-P1-K1-G2
cggacgcgtgggcggaggggcagtcccaggctcggcggcggcgttcggcggctccccccaccttctctcgccagtcgcctcgcgccctcgcctgcgtcctccacgaaccggccgacgaccctgcgtacgcacctccctctcccctcccgccgttgctgttcccgtgggagcccggccagctgcccagggtggccgggccttggctccgccggtgctgtaagctatttgcgtccggatctgacctcagttacacgcctgtgttccgcccacgcaggatccagatcgtgctacggcggctcctgtccatccgccatgccgccagggtaaggtgaggctcaccaagtggtattctccgtacacccagaaggagaggaccaaggttattcgcgagctcagtggactcattcttacacgagggcccaaactctgcaactttgtcgagtggaggggtacaaggttgataccggaggatgctagcctgatttctgatgtgctngatgctgatgacaatgagctg

SEQ ID NO: 15134 - DNA, 623 bp, Sorghum bicolor
  Clone ID: 30161077
taagaggaaaaggagagataaggtttatggcaacaatgttgagatccaggcatttgcagagatgtacaatcgtcccattcacatatattcctacggtgcagagcccattaatatttttcaaggaagctataacacagacgttcctccaattaggttaagttaccatcatggtaatcattacaattcagtggttgatccccgccgacagacagttggggcaggccttggatttagctcccgttcagttgctggagcagatagaggcagcgaggactactttgtgctcccagacactgtactaactcgcagcatgcagttgctcctggcaatgggcttcagctacatccaggtcatggaggcctacagcatattcggcgaggacgtggactccatggtctgctacctggtggagaccggaggcaccggagcctcagcaggtggtagcaatcgccggaaaggaaaggctgctgagtgatgtgcgcaccttcattgctgtgaatgtaattgttgttgatcgaaatcgttgggcataagtcatactgacagtcttgtgagttgagatgtcgatatacctgctaccttatgggtgatgaataaatggaactcatgacttgagactttcg

SEQ ID NO: 15135 - DNA, 532 bp, Sorghum bicolor
  Clone ID: 30944133
ccgcctcctcctccttccctgcctgcctcccccccttccagatctcccgcccactccagagtcgagatccaccgcctccccgccccctcaccggagcagagcagcgcgagggagcgcgggacagaggccagccatgggcaaggaaggggccagcgccggcggcggcggcggcgacggcggcatgtcggagtcggtgatccgcaaggtcctgatctcgtacatgtacgtggctgtgtggatcttcctctccttctccgtgatcgtctacaacaagtacatcctcgaccccaagatgcacatggccttctgctcctccctcgccgtcgcgcttgtccgcgtcctccgcgtcgtcgacctcccgtcctcccccgccatgacgtcgcagctctacgtctcctccgttgtccccatcggcgcgctctactcgctctcgctctggttctccaactccgcctacatctacctctccgtctccttcatccagatgctcaaggcgctcatgcccgtcgccggctactccatcgggggtgct

SEQ ID NO: 15136 - DNA, 552 bp, Sorghum bicolor
  Clone ID: 30944125
tttgaggtcaaggccacagctggtgacacccatctgggtggtgaggactttgacaacaggatggtgaaccacttcgtccaggagttcaagaggaagaacaagaaggacatcactggcaacccgagggctctcaggaggctgaggactgcttgtgagagggcgaagaggactctatcttccactgctcagaccaccattgagatcgactctctgtacgagggcatcgacttctactccaccatcacccgtgccaggtttgaggagctcaacatggacctgttcaggaagtgcatggagcccgtggagaagtgcctgagggatgccaagatggctccaggacttcttcaacggcaaggagctgtgcaagaacatcaaccccgatgaggccgtcgcctacggtgccgctgtccaggccgccatcctgagcggcgagggcaacgagaaggtgcaggacctgcttctgctggacgtcacccctctctcccttggcctggagaccgccggaggagtgatgaccgtgctgatcccgaggaacaccaccatccccaccaa

SEQ ID NO: 15137 - DNA, 469 bp, Sorghum bicolor
  Clone ID: 30943762
gagatacttcacctccagctgaggaactatctctactcattccagtttttactcgatgtcaagagctggagggcttcagtacacagatacagggctggaaagacgaggtatgcacatttccggcaaacagatgaacttctggctgattcagggtggcactgcagcttatgctgctcatctccctgcctatctgctggagcagaatgatcggtacagatatctccttccaggcaactgcattagagagagtggctaggcagccgtttctgtctgcatcatgaccctgaggcgcacagacgtcgctcgcggatgtcccccgcactggaggagcgccctgccgtggtgggggttgtatttctcatccgattcgctgacttagttgagtttttattcattgcttccatgattgatatatgaactcgaaactatttgtagatctcataccgagcgacattcagattctttcctc

SEQ ID NO: 15138 - DNA, 321 bp, Sorghum bicolor
  Clone ID: 9847934
caacggcaaggagctgtgcaagaacatcaaccccgagggcaacgagaaggtgcaggacctgcttctgctggacgtcacccctctctcccttggcctggagaccgccggaggagtgatgaccgtgctgatcccgaggaacaccaccatccccaccaagaaggagcaggtgttctccacctactcggacaaccagcctggtgtcctgatccaggtgtacgagggcgagaggacacggacccgcgacaacaacctgctgggcaagttcgagctctccggcatcccccctgcgccccgtggtgtgccccagatcacggtgtgctt

SEQ ID NO: 15139 - DNA, 671 bp, Sorghum bicolor
  Clone ID: 30940722
ctctttcacttctccgaatccccaggcaggcaggtcggcgaagagggcaggtgaggcagcaaggccgagccgcgcgggggctcgggacgggacaggcagaggagacctacagaatcccagatccttcctgcccgcccgtgcccgtcggcgcgtcgttcttgccggccgcgcccgacctccggctcctcctccaggggaatcggatacacaacaagctgcaggatggtgctgtgggtcttcggctacgggtccctgatctggaaccccggcttcgacttcgacgacagaatcctcggctttatcaagggctacaagcgcacgtttaatctcgcttgcattgaccacagaggcacaccggagcatccggcgaggacctgcactcttgaaacggatgacgaggccatatgctggggaattgcatattgtgtcaagggtggcccagaaaaagagcgaaaagcaatgcagtacttggagagaagagagtgtgagtatgacctgaagatatccattggtttctacaaggaaggagatcccctgaaaccagctgtgacgggtgtcttagtatccaattggcaacaagtactatcttggccctgctcctttgcaggatatggcaaagcaaattgctacagccaatggccctactggctataatagggattacctgtcct

SEQ ID NO: 15140 - DNA, 629 bp, Sorghum bicolor
  Clone ID: 30932993
gcgctatgcggaattgcggacaacgccgcacccgtctagaagcccggagacaccctacacaccgtgcgtgcacgagacgactcgaaccccagttcaggaactgtaggagaaggggagagagagatggagaacggcggcggcaaaggcgacgtccccgacgatgcgaacgagcattgccctggaacgcagtcggaggaggcggggaaggcggatgcctgcgctgggtgccccaaccagcagatttgcgccaccgcccccaagggccccgaccccgatgtggttgctattgtcgagaggttggctactgtgaagcacaaattgttagttttgtctggaaagggaggtgttggaaagagtacattctcagcccaactctcgtttgctctagctgaaatggaccatcaggttggccttcttgacatagatatatgtggccctagcatccctaaaatgttaggccttgagggacaagatattcatcaaagcaaccttggctggtcacctgtgtatgttgagtccaaccttggtgtgatgtcgattggtttcatgctgcctaatccagatgatgctgtcatatggaggggtccccgcaagaatggactgatcaagcagttcttaaaggacgttga

SEQ ID NO: 15141 - DNA, 567 bp, Sorghum bicolor
  Clone ID: 9850356
gcacgaggcagcaactcaatcacgctccccttcccctcccctcccctccggcttccgcggaactagggctagaagccgccatgcagcccgacgccaacgccccctcccaccgcctcgcccgcgtcgccgcgcacctgcgcccgcagatggaggaaggcgcggtcgcgttcgcgctgaggcccgcggtgtgccgcgccaagggcggcgcgccggggttcaaggtcgcgatcctgggcgccgcgggcgggatcggacagccgctgtcgctgctcatgaagatgaaccctctcgtgtccgtgctccacctctacgatgtcgtcaacactcccggggtcaccgccgatatcagccacatggacaccagcttgatgcagcacttacaggaatggaccttgtaatcatacccgctggtgtccctaggaaaccaggaatgacaagggatgatttattcaacataaatgctgggattgttcgtacactttgtgaaggcgtttcaagatgctgccctaatgcaattgtgaatttgatcagcaacccagtgaactcaactgtccccattgctgctga

SEQ ID NO: 15142 - DNA, 623 bp, Sorghum bicolor
  Clone ID: 30939029
cctactggatcgccccgtcccaaatcctacacactattcgatccacccaaccctccccaaaacccccgaccgaggagagtagagcgcgagaagatgttcggcttcgggcaccatggccaccaccacggcgagaacccgccggcgcaccctcctgcccacggcggcgtgcacccgcccaccttcaagatcttctgcaaggccgacgaggggtactgcctcaccgtccgcgacggcaacgtggtgctggccccctccaacccgcgcgacgagcaccagcactggtacaaggacatgcgcttcagcaaccagatcaaggacgaggaaggcaaccctgcgttcgctctcgtcaacaaggccacgggcctcgccatcaagcactccctcggccagtcccacccggtgaagctggtgccgttcaacgcgccgtacggccacggcgagccgacggtccgcatctactgcaaggcggacgacgggttcagcgtgaccgtccgcaacggcagcgtgtgcctggcgccgacgaacccgcgcgacgagtaccagcactgggtcaaggacatgcggcacagcaaccgcatcaaggacgaggaagggtacccggcgttcgcgctcgtgaacagggt

SEQ ID NO: 15143 - DNA, 581 bp, Sorghum bicolor
  Clone ID: 30938615
gtggttagcgatctctctctatatttcttttcgaaagatccgttgctggcgttcattgttaagagtagcgatctctccatacatactatgctagtccctctagagaaatttcagaagttaccaattgagacctcatccaacaaggcattgaccattcccctctcgtggagcatttcacttctagcggccacacccctgtcatgaacataaactacggctacggagcctacgccggcagctctctaatgaacgcagcagtgcccccaggctccttcttcctccagtcgcagctgcgcgtgggaaccgccatgaccgtctcctccgagtcggcagctaccgtgcctcccatcctcccgcgcaacgtcgccgagaaggtcccattcagcaacctagcggacgtgctcgccgcgttccacatctcgccaagctccgccgaggcgacgacggtgggcgacaccctgagcctgtgcggagccccgccgtcactcgccggtgagcagaaggcctgcgccacgtcgctggaggacaccgtggagagcgccacgcacatgctcgtcgtcggcagcagcgttcgtcatggg

SEQ ID NO: 15144 - DNA, 580 bp, Sorghum bicolor
  Clone ID: 9854405
ctctgtggtacgagcacctgggaatgctggatgatgtcttccagcaccctgagagcatggagtgtgtgcagaaggtgaacaggatcgctgacaagtattgggatctgtacacaagcgatgacctcgagcaggatctcccaggccacctcctcagctaccccatcggtgtcactgccgatggcactgttactgcactgccggggatggacaacttccccgacacccgtgcccgtgtccttggcaacaagacgatttacatcccgaccattctcaccacatagagtgcagactgcacgtagcaccatggctgctctcctgtctggcctctgctaaggtgtccctgtgtttgtgttcaagacacttaaaaggttcagataggagtgttgttattgtagttattgagtgataataagtggattgtgcttggtgggacgataagagttataagtactggatccagattgtgttgtccctttgtctgtcatagctcgtgtaccttgctacgttgcagtgccgtttgtaagaggtgacttcagagttcagaactaaaacatgattgcttgttacaagtgtgtgatgc

SEQ ID NO: 15145 - DNA, 449 bp, Sorghum bicolor
  Clone ID: LIB3476-035-P1-K1-C9
ctcctccccatccgaaccaaatctaatcgacgcttccccgagatgggccgcaagttcttcgtcggcggcaactggaaatgcaacggaaccacagatcaggtcgagaagattgtcaaaaccctgaatgaaggacaggttccccctgcagatgttgttgagctctgctgggagaatcaaatgagtttgttggagacaaggttgcttatgcgctgtctcagggactaaaggtcattgcatgtgttggtgagacccttgagcagagggaggctgggtcaacaatggaagttgttgctgcacaaacaaaagcaattgctgagaagatcagtgactggagcaacgtagttgttgcctatgaaccagtatgggccattggaactggtaaagttgccaccccagctcaggctcaggaagtgcacgcatccctgagggattggctaaagatcaacgtc

SEQ ID NO: 15146 - DNA, 596 bp, Sorghum bicolor
  Clone ID: 30963423
cgtttccaggctagatcctgatggcaaaaagtttgacaaagtttctcgtgttgaagctcgcagcgagcagttaggtatgtatatgcagctggatgttgctacggatgtgtatcctctgcgtgctggtgagaaatttaacatggttttagcgcctactctgaatttggatggcactccagatactggctactacacacaggctggtagaaaaactctggcagataattatgaatatgtcatgcaagggaagctttacaaaatctcagaggacacctccagccaaaatgctaaagtggagatttatgcatcattcggtggtcttctgatgctgctcaggggtgacccttccactgctgctagctttgagctggatcagaggctttttctactcatgcgcaaggtttaaaactaccgcggaatgtgctacctaccctgataacctaatgctagttgttcacattgaggctattggtgtttggccttgttaatacctattttactttccatccacggtgcttgaccttacacccttgcttccccgtgggtgaagcttgttatctggtaatgagtactgtttcctttaacatggattcatg

SEQ ID NO: 15147 - DNA, 421 bp, Sorghum bicolor
  Clone ID: 30952931
agagccatagaggcaaacttgtgatcgtacacgctgcgctatgcggaattgcggacaacgccgcacccgtctagaagcccggagaaggggagagagagatggagaacggcggcggcaaaggcgacgtccccgacgatgcgaacgagcattgccctggaacgcagtcggaggaggcggggaaggcggatgcctgcgctgggtgccccaaccagcagatttgcgccaccgcccccaagggccccgaccccgatgtggttgctattgtcgagaggttggctactgtgaagcacaaattgttagttttgtctggaaagggaggtgttggaaagagtacattctcagcccaactctcgtttgctctagctgaaatggaccatcaggttggccttcttgacatagatatatgtggccctagcatccc

SEQ ID NO: 15148 - DNA, 454 bp, Sorghum bicolor
  Clone ID: LIB3478-005-P1-K1-D5
gagatctgcccacccccctcgccacttcccgtgaaccacaaacctaacgcggagcggcgcgggccggccgccgggcgaggtgcgcgtagctgctgccatcgatcgtcgccgggtccatccaccatgggcggcggcaacggccagaagtccaagatggcccgcgagcgcaacttggagaagaacaaggggtccaaggggagccagcttgagaccaacaagaaggccatgagcatgccgaggctaagcatccaaagacagatgtgtaccagtgcttcccccatctgaagaagtgaaaagcctctgaactagcaaccagtgccgtggtcatggagttgaggaaatgtgtctgttagctatgcggtttggtcacagtcagtacaggtcatggagcttgcctgtgcggagggtgttaattccgtgttgtctgccgtcaatcatgcgtcctgtcctatgt

SEQ ID NO: 15149 - DNA, 558 bp, Sorghum bicolor
  Clone ID: 30949468
gcaaggagctgtgcaagaacatcaaccccgatgaggccgtcgcttacggtgccgctgtccaggccgccatcctgagcggcgagggcaacgagaaggtgcaggacctgcttctgctggacgtcacccctctctcccttggcctggagaccgccggaggagtgatgaccgtgctgatcccgaggaacaccaccatccccaccaagaaggagcaggtgttctccacctactcggacaaccagcctggtgtcctgatccaggtgtacgagggcgagaggacacggacccgcgacaacaacctgctgggcaagttcgagctctccggcatcccccctgcgccccgtggtgtgccccagatcacggtgtgcttcgacatcgacgccaacggcatcctgaacgtctcggccgaggacaagacgaccgggcagaagaacaagatcaccatcaccaacgacaagggccgtctgtccaaggaggagatcgagaagatggtcggttggttggtgaacaatgttatcgtggcaagcgttaaggaatactacggtattattctggttcggt

SEQ ID NO: 15150 - DNA, 644 bp, Sorghum bicolor
  Clone ID: 30968876
aggagctgttggccttgctgccgcagaaggtgcaggaggtactcgctgagatgaccaatggaggggttgaccgtagtgtggagtgcactggtaacataaacgccatgatccaggcatttgaatgtgttcatgatgggtggggtgttgctgtgctggtgggtgtgccacacaaggacgccgaattcaagacgcacccgatgaacttcctgaacgagaggaccctaaagggaaccttcttcggcaactacaaaccgcgcactgacctgcccaatgtggttgagctgtacatgaagaaggagctggaggtggagaagttcatcacccatagcgtgccgttcacggagatcaacaaggccttcgacctaatggctaaaggagagggcatccgctgcatcatccgcatggagaactagattttgctttttttctctggttgtctggtctgggttgggttaaataaaaggggcagtgtcctctgtggatgtggagccacgcttgtgtgtatcacgtccagtttggccttgtccatcaggagaagtagcttgcacttttttttcgtaaatacgcaacagcgttgcgtatcattgtattataagaggatagaagttttaacattaataaaatacaagagtggccgttctcgg

SEQ ID NO: 15151 - DNA, 535 bp, Sorghum bicolor
  Clone ID: 30948781
gtgctctctcagaggtgggttggcttctcctccccctcttaccaagtcctcgtcctcggtttagggttcgttagggtttttgtggaggggagatatggcggcggcggacgtggagtaccgttgcttcgtcggtgggctcgcctgggccaccaacaacgagaccctcgagcatgccttcgccaacttcggccaggtcgtcgactccaaggtcatcaccgaccgggagacggggaggtcccgcgggttcggcttcgtcaccttctcctctgagcagtccatgctcgacgccatcgagaacatgaacggcaaggagctcgacggccgcaacatcaccgcctcccgctgcagccgctgccgacgaggccgcgcgggcgacggagacggtggtggtcgacaaccctcgccatcgcctcatggttctacgaatggaactggatatacaaaacttcatgcagaaccctcagctgcaggagtttgaattccagaactatccgacttcttacctccgctgtgctgctcatcgtgttgcacaaca

SEQ ID NO: 15152 - DNA, 646 bp, Sorghum bicolor
  unsure (1)..(646): unsure at all n locations
  Clone ID: 30969736
gctctatcttcctcgcagccccgctcaggctcggtcctcagcgcagatcttcttccgcacgtcggcggctccccctcgacggcgtccagcgacggaggggcagtcccagtctcggcggcggcgtcggcggctccccctccctcctctcgccagtcgcctcgcgccttcgcctccgtcctccgcgcaccggccggcgaccctgcaatggcactcaacaaggagtacacctacgcggagctggagaaggagccatactggccgttcgagaagctgcggatctccatcactggtgctggtgggttcattgcctcccacatcgcgcgccgcctcaagagcgagggccactacatcatcgcctctgactggaagaagaacgagcacatgtccgaggacatgttctgccacgagttccacctcgtcgacctaagggtgatggacaactgcctcaaggtcaccacgggggttgaccatgtgttcaacctcgcggctgatataggtngggatggggttcatccagtccaaccactctgtgatcatgtacaacaacaccatgatcagctttaacatgcttgaggctgctagaattaacggtgtcaagaggttcttttatgcatcaagtgcctgcatctaccctgaatttaagcag

SEQ ID NO: 15153 - DNA, 655 bp, Sorghum bicolor
  Clone ID: 30970248
ctggtctgggctttactggttggtcagaatcttctcccccaaaagccaaatgggatcgtgcgaaaaatgttgatgtattaggtgttgaattagctggaagtgcagttcaaattccccttgtgtggaatattcaagtgagcacatggttacgatactatgtctatgagaggctaattcagaaaggaaagaaaccaggtttccttcagttgttgggtacacagacagcaagcagtgagcagttcattcctccgcggtatcctggcttttctaaattttgcttatacattgctggtgcttaactactcctgcatcgggttcctggtactgagcttcaaagaaaccttggcgtcctaccagagcgtatattatgttggcacaattgttcccattgtgtttctcctgctgggcaatgttatcaagccagcaaggaaggcgaaggctcggaagaccgagtgaggaaatacacactcaagtgaccattacatagaagaaagatggagaagcttcaacgaagattacgacattctagttttcagtttatttattctgtccgtatcaaatcaaatttagtataaggataatgtggtggccccagttctcctttcacggaactcgattgcgattgactcatcattaaaacgtggcataaccactg

SEQ ID NO: 15154 - DNA, 588 bp, Sorghum bicolor
  Clone ID: 18063148
gcacgaggcccgttcttgcagacagcgaagtggctcccgtgcagcgaccttgccacctcgtcgtcttcggcaccctcttcccctccccgctcgctggcgccttcggctccccccaggaaggcgttgattgctggtgatagtggtactgttactgctggtgcgtctggttctgccggaattgcgacgagcagtggtgctggtgcagcgatgagcaggagcaactggctgtcgagatgggtgagctcctgctccgatgacgccaagacggcgtttgcagctgtgaccgtgccacttctctacggctcgtccctggctgagcccaagtccatcccgtccaagtccatgtacccgaccttcgatatcggtgatcggatccttgccgagaaggtctcgtacatattccgggatccggaaatttcggacattgtgatcttccgggctcccccaggacttcaggcttatggttacagctcaggtgatgtgttcatcaagagagttgtggccaagggaggagactatgtcgaagtgcatgatagcaagctgttcgttaatggagtagttcaggatgaggattatgtgctggagcca

SEQ ID NO: 15155 - DNA, 820 bp, Sorghum bicolor
  unsure (1)..(820): unsure at all n locations
  Clone ID: LIB5050-008-R1-XP1-F10
ctccggacatcactcccaaatcccccagcaaatcgtcgcctctccaagccacaccgccgcctccagctcgccgtcctccgcgccaagccccaaaagctcccctgatggcccgcacgaagcagacggcgcgcaagtccacgggcggcaaggcgccccgcaagcagctggcgaccaaggctgcgcgcaagtcggccccggcgacgggaggcgtgaagaagccgcaccgcttccgcccgggcaccgtcgcgctccgtgagatccgcaagtaccagaagagcacggagctgctcatccgcaagctcccgttccagcgcctcgtccgcgagatcgcgcaggacttcaagaccgacctccgtttccagtcctccgccgtcgccgcgctgcaggaggccgccgaggcgtacctcgtcgggctcttcgaggacaccaacctctgcgccatccacgccaagcgcgtcaccatcatgcccaaggacatccagctcgcgcgccgcatcaggggcgagagggcctgagcgaggcgagctcctcctcccgctgaagccgtcgtcgtcgtcgtcgtttgttgcttcgtgcctgctcgtaggatttgtgcttttgtcttgtttccttctggtggcactggcatgctggtaacattatgcttgttcgtagtcctagagggttgttcggttgctgggtaacctgcttgtttatcttgcactgatgctgatgtaatggtggtctgtttatcttaatggaatgcaatttgctaccgaannnnnnnnnnnnnnnnnnnnnnnnnnnnnaaaaggaaaaaaaaaaaaaaagcccctagggc

SEQ ID NO: 15156 - DNA, 578 bp, Sorghum bicolor
  unsure (1)..(578): unsure at all n locations
  Clone ID: 30975664
ccgccccctcctccgcctccacctccgtttcaccctcgcgccgcgcttccacagcccgagccctccccacctccggatccagatccgccgccaccaacgcctgctcctccccctcctcctcctcctgctgctgctgctgcaccaccaccaccaccaccacctcgaggaccagcagcaggggcggcggcggcggcggcatggggcgggacggtgctccggaaggtgctcctctcctacttctacgtcgcggtgtggatcttcctctccttctccgtctacgtctacaacaagtacatcctcgaccccaagatgtacaactggcccttccccatctcgctcaccatggtgcacatggggttctgctcgtccctcgccggcgtgctcgtccgcgtcctccgcgtcgtcgacctccccacctcgccttccatgaccccgcagntctacacctcctccgtcgtccccatcggcgcgctctacgcgatgtcgctctggttctccaactccgcctacatctacctgtccgtgtccttcatccagatgctcaaggcgctcatgcccatcggcgtctactccatcgg

SEQ ID NO: 15157 - DNA, 591 bp, Sorghum bicolor
  unsure (1)..(591): unsure at all n locations
  Clone ID: LIB5050-010-R1-XP1-A9
tgcggcgctcgagccggncgggttcaataacggaaccgtcttgtttccgatcccaaatcacctgccgcgccctccactcccacacgaagcagatggcccgcacgaagcagacggcgcgcaagtccaccggcggcaaggcgccgcggaagcagctggcgaccaaggcggcgcgcaagtcggcgccggcgaccggcggcgtgaagaagccgcaccgcttccgcccgggcaccgtcgcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgccgaggcctacctggtggggctcttcgaggacaccaacctctgcgccatccacgccaagcgggtcaccatcatgcccaaggacatccagctcgcccgccgcatccgcggggagcgcgcctagctgtttcattgtatctatctgctacactacatactaggcggttatgctctgctctaggagtgcgctgttcttgggtttttactttcgt

SEQ ID NO: 15158 - DNA, 532 bp, Sorghum bicolor
  Clone ID: 7554236
gcacgaggccgagactagctagtcttgtgctcgtgcagctgggacacatcacacacgtacagagacacaggagatggggtctctcatggctggctgggactcgccggttcttgccgacgacgacaagaaaggtatacgcgaaagaactgctgttgccagggatggaactcgatctctgatattaattaactctagctattgtgtgtcttttgatgtgttatataatactcagttaacgcgcgccggaaccggtcgctgaccaaggaggaagtggaggcgttctggaagcagcgtccgagtcggaggtcgtcggaggaaggcggcggcgagctcgcctcgcctctttcctcgccgccggccaccgccacgtggcaggagagcccgttcgggagctcggagaagccggcggcggcggcggtccgtgtggacggcttcctcccgggcggcggatccggagacgacgacgacgcggcagctgacagccccagcacgagccgcgactggtggacgcggagcagctgggcgttcctca

SEQ ID NO: 15159 - DNA, 471 bp, Sorghum bicolor
  Clone ID: 7217786
gcacgagggctccgtgagcactgccgcgagggaggtctccttctccgacgtccttggtgcgcagctcgtcgccaaggccactggagagaacgcggtgagggcgcccgctgaggcgaagctgaaggtcgccatcaacggcttcggccgcattggccggaacttcctccggtgctggcacggccgtgaggactccccgctcgacgtcgtcgtcgtgaacgacagcggaggcgtcaggaacgtacgtgaagatcgacgatgccaactgaagccgccgcactcgtattcagaatttcagacgctcgccacgaattctgacagaaatttgcatcatattggtgcgtttttttctcttgattctaggcgtctcaccttctcaagtatgactcgatgctgggcaccttcaaggctgacgtcaagatcgtcgacgacacgaccatcagcgtcgatggcaagcccatcaccatcgtctcc

SEQ ID NO: 15160 - DNA, 481 bp, Sorghum bicolor
  Clone ID: 14089203
gcacgagggtgacacattccaggttattcttctggaatcccgtgataggattggtggcagagttcacactgactactcgtttgggtttccagtcgatctgggagcatcttggcttcatggcgtctgtgaagaaaatcccttagcaccaataattggaaggcttgggcttccactgtaccgcacaagtggagatgattctgtgctgtttgatcatgatctggagaggtaaaactttgcattaggatgaattgtactttgagagacgatggagcaaatgatgggtgctaacttgttctatttcctttcagttatgcactctatgacactaatggacgtcaagtaccacaagagttggtagaaaagattgggaaggtgtttgagaccatactggaagagactggcaaattgagggaaggaaccaatgaagatatgtctattgcaaaagccattgcaattgttatggatagaaatccacacttca

SEQ ID NO: 15161 - DNA, 598 bp, Sorghum bicolor
  Clone ID: 30944269
agctatcgttgcaaaggcaaagcaagcgatccaaattctctccgtttttcttcagatctcgagttccgcgactagctttggatcccttctttcattcgagagagcgattctctggtggcaatggcgaagagcgagggtccggcgatcgggatcgatctcggcaccacgccgtcctatgtcgccttcaccgacaccgagcggctcatcggcgacgccgccaagaaccaggtcgccatgaatcccaccaacaccgtcttcgatgccaagcggttgatcggcaggaggttctctgacccttcagttcagagtgacatgaagctgtggccattcaaggtcatcccaggccctggtgacaagcccatgattgtagtcaactacaagggtgaggagaagcagttcgctgctgaagagatctcctccatggtgctcatcaagatgagggagattgctgaagcctacctcggctctacgatcaagaacgcagtggtgaccgtgccggcctacttcaacgactcgcagaggcaggccaccaaggacgccggtgtcattgcgggcctcaatgtgatgcgtatcatcaacgagcccactgccgctgcta

SEQ ID NO: 15162 - DNA, 646 bp, Sorghum bicolor
  Clone ID: 30160862
aaaattccccaatcccgccgccagcctccccacgcgcctcggaaccctagccccggcgacgccttcggatccggcgctcttatccggcggaatcgcccgcccgctcctacccccggtcgccgcgttccggcgtctcggctacccggcgtcatctacccgtcttcgacacctgcgatcgcctcttcgtagatcgaatttgttcagtgattcttctcgttccaattcgttgtatttcatctgagatctgaaaaaattattcgggccatctcgaaatagagagcccttattcgtgaggaaaagagacagtactcgccatccatcatgggtgttgtgtattatcaatataagagtgaaaaggaaatctgttctatgcctgtgccccatgcttttatctctgtgtctgaactcaagcagcttatcatgacgagcggtaagcacggccgtgggcgaacccgcggccgtgccacagaggatattgtcatctccaacgcccacactggcgaagaatatgcagatgaaagagcatccgtaccacagaacacaactgtgctggtccgcagaatttccattcctgggcaactgtcagagaagatcgtcttgtcccccacgcggaaagtcgcagaagaatgttctgtaccttgtaagt

SEQ ID NO: 15163 - DNA, 515 bp, Sorghum bicolor
  Clone ID: 7553015
tcttggtgtagcttgccactctcaccaatcaagttttcatgtctgatctcgacgttcagatcccaactgccttcgatccctttggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacagaggaagaacgtctctaatttccttgtccaggccggcattgtgaagaaggaacacatcaagattcatggtttctgagcaaccgccgggtccatagcaagccctgcatgcaaagcagctatatatctgaggtggagccctactactacgcctgcgcgttctcctatactacacataacacatagccccctccctgcgtgtatgcttgttaccgttgtgtcgaatcttgtacgaggctccatcgaacttcgatggctcgcttctttatctggt

SEQ ID NO: 15164 - DNA, 395 bp, Sorghum bicolor
  Clone ID: 6672590
catttcagaaggggagtttggctggggcggcacatctgttaaatgataacacaggtgtccaaagatgagctcaacaagaacagaaatcttgtgttgaacaaaagggtaaaagctacatttgattttgttgattttcaagtaggaatacaaactgtgaaagcatggcctatcgatcctttatttattttcttttaaaaaaaaatgtgtagaaaagccactacttggcgatagaggtgtcagaatagttaccatctgttggataaaggctgaacgcctcttaagtccgaatccatgctaaattattttctaagaagaagaagaagaaaaacctgtgttttttttaaaaagaaaaagaataagaaatcattcaaaaagaaaaaagaagaaaaaagaag

SEQ ID NO: 15165 - DNA, 464 bp, Sorghum bicolor
  unsure (1)..(464): unsure at all n locations
  Clone ID: 7552897
ccatggggacgtgtggctggaggggagtccaaccagtcctcgtcagccctatgttcggcggcaccaccgaccagaaagtggtggaggagaacctggagaagctgaagaaggtgctggaggtgtacgaggcgcggctcgccaagcacaagtacctcgccggagacttcctcagcctcgccgacctcaaccacgccccatgcttctgtgctcaacgcgtaccctcacgtcaaggcatggtgggatggcctcatggccaggccgtctgtccagaaggtcgccgcgctcatgaagccgtctgcttgaaattagtgatcgagtcttcgttcggcccatcgacccctgtgtgtgtcctcgttctcgatcggcatgtgtcatccaggtgttgaataagctagctagccgatcgagttgcatgcatgttttcgtgtctttgagaaataatattaagctatgtgtttcnaggg

SEQ ID NO: 15166 - DNA, 544 bp, Sorghum bicolor
  Clone ID: 7552535
aacaacctcctcggcaagttcgagctctcgggcatccctcctgctccccgcggcgtgcctcagatcacggtcaccttcgacatcgacgccaacggcatcctcaacgtctctgccgaggtcaagaccaccggccagaagaacaagatcacgatcaccaacgacaagggcaggcttagcaaggaggagattgagaagaagattgaggacgccgtcgatagtgccatcagctggctggacagcaaccagctggctgaggtggacgagtttgaagacaagatgaaggagcttgaggggatctgcaaccccatcatcgcgaagatgtaccagggcgctggcgcgggcatgggcgatgctgctggcatggatgaggacgccccgtctggtgggagcggtgctggtcctaagatcgaggaggtcgattaagttgttttagtgtccgaggtttggtttggtgaagtacatctgaactctgaaggttcttcgtgacatggttagacgtggtgttgcagtactgtgataaaacttatcagaataagttttcgct

SEQ ID NO: 15167 - DNA, 224 bp, Sorghum bicolor
  Clone ID: 6859186
gcacgaggaaattagttagatcaggtaaagcgaatgattagaggtatggggaaagtaagtttcttcgcctattctcaaactttaaataggtcttttttttttttttaaaagaaaattaatttttccgaagaaaaataaaaataaaaatgctctttgtgggccaatcgtggtaagcatgactggcgatgtgggatgaaccaaacgtgaaagttaaaggtgccaca

SEQ ID NO: 15168 - DNA, 611 bp, Sorghum bicolor
  Clone ID: 7536351
gaactaacagccaagggaacgggcttggccaggtcagcggggaaagaagaccctattgagcttgactctagtctgaaattgtgaagtatttttatgggtgtagaataggtgggagttgtaaaaaaacaatcttgaaataccactaccgtaaataatattttacttatctatttaaatttatgaataatgttaaaaagttattgaattttttcaacttcttgattttttctaaagagaaaaactacttttctcttataaaaaaacttatagaaaacatttcagaaggggagtttggctggggcggcacatctgttaaatgataacacaggtgtccaaagatgagctcaacaagaacagaaatcttgtgttgaacaaaagggtaaaagctacatttgattttgttgattttcaagtaggaatacaaactgtgaaagcatggcctatcgatcctttagaccttcggagtttgaagctagaggtgtcagaaaagctaccatctgttggataaaggctgaacgcctcttaagtccgaatccatgctaaattattttctaagaagaagaagaaaaacctgtgttttttttaaaaagaaaaagaataagaaatcattc

SEQ ID NO: 15169 - DNA, 410 bp, Sorghum bicolor
  Clone ID: LIB3478-046-P1-K1-B11
cgcccctccgcctctgctccttccgccgccgccgccgccgccgcgtctcctctacaggtaagaaggagaggaagagggcgaaatggtgaagcacaacaacgttatccccaacgggcacttcaagaagcactggcagaactatgtcaagacatggttcaaccagcccgcccgcaagcagaggcgccgcatcgctcgtcaaaagaaggctgtgaagatattcccacgcccaactgctggccctcttcgccccattgtgcaatgccaaactctcaagtacaacatgaagtcaagggctggtagaggctttacccttgaggagctgaaggcagcaggcattccaaagaagcttgccccgaccattggcatttccgtggatcaccgccgcaagaacaaatccctcgagggactgc

SEQ ID NO: 15170 - DNA, 182 bp, Sorghum bicolor
  unsure (1)..(182): unsure at all n locations
  Clone ID: LIB5051-007-A1-XP1-D4
gccggccgggcttactccatctgtgttactcctgtgcgtctattttgctcactctgagcagtagtatgaacccattgtgtgttcctgttgaaagatttcccattctaggtgcnaaaaaaaaaaaaaaaaaaaaaaaaaaaaaaaaaaaaaaaaaagaaaaaaaaaaaaaaaaaaggccccta

SEQ ID NO: 15171 - DNA, 324 bp, Sorghum bicolor
  unsure (1)..(324): unsure at all n locations
  Clone ID: LIB3480-029-P1-K1-D7
gggaggaactgcaggagaaggggagagagagagagagagagagagagagatggagaacggcggcggcaaaggcgacgtccccgacgatgcgaacgagcgttgccctggaacgcagtcggaggaggcggngaaggctgatgcctgcgctgggtgccccaaccagcagatttgtgccaccgcccccaagggctccgaccccgatgtggttgctattgtcgagaggttggctactgtgaagcacaaattgttagttctgtctggaaagggaggtgtcggaaagagtacattttcaagccaactgtcgtggctgtagctgcaatggac

SEQ ID NO: 15172 - DNA, 550 bp, Sorghum bicolor
  Clone ID: 9296300
agccaagcgttcatagcgacgttgctttttgatccttcgatgtcggctcttcctatcattgtgaagcagaattcaccaagtgttggattgttcacccacggccaagccaaggctgctggagccagtgtacctggtggagattcaggccccagaaaatgcacttggtggtatctatggtgttctgaatcagaagagagggcatgtcttcgaggagatgcagaggccgggtacccctctatacaacatcaaggcttacctccctgtcatcgagtcctttgggttctccagccaactgagggctgcaacctctggtcaggctttcccccagtgtgtgtttgaccattgggacatgatgggctctgatcctttggaggcgggctcccaggctgctcagctggtgctggatatccgcaagaggaagggtctcaaggaacagatgacccctctttctgagtttgaggacaagctctaattttctcgttttgctactgttacctggtttaattgtcggttcaactacctgtactgggaactactatcttgtttacct

SEQ ID NO: 15173 - DNA, 414 bp, Sorghum bicolor
  Clone ID: LIB5052-001-A1-XP1-H4
gccggccgggctgcgtctctgagtatcctcctcttggtcgctttgctgtccgggacatgaggcaaacggtggctgttggagtcatcaagagcgtggagaagaaggacccaactggagccaaggtgaccaaggctgccgctaagaagaaatgaggtgtctgctagctggttctgtgttttctcgagggatacctagttgaaacttaatatatcgtcattgctgttatcgcgtgagcaactaaactgtgctggcaatgtttgtctggtcgattgagtattgttattttcgttaaaaccagtgtactattaagactcaatttctgttatttttgtatcgaacatcgggtgttggccatatgtggttatgagttttgttactacccttgtcgaaaaaaaaaaaaaaaaaaggccccta

SEQ ID NO: 15174 - DNA, 266 bp, Sorghum bicolor
  Clone ID: LIB5047-003-R1-XP1-D10
gccggccgggtctggatctttgcgcttggggcaatgacgcagcttatgaggtcataccgaggcgcgtcaattgctggttgaaaactatttccaaaccccctcatcggccctgggcctttgagaatttctggaagggctcctcctcttcggagaagggaaagccctacaaatcatgtttaagttttattttgtttatactttatacagtaattatatgttttaattaaaacatcaatagtcaaaaaaaaaaaaaaaaaaggccccta

SEQ ID NO: 15175 - DNA, 687 bp, Sorghum bicolor
  Clone ID: LIB5051-011-A1-XP1-H10
gccggccggttccgagtgctctctcagaggtgggttggcttctcctccccctcttaccagtcctcgtcctcggtttagggttcgttagggtttttgtggaggggagatatggcggcggcggacgtggagtaccgttgcttcgtcggtgggctcgcctgggccaccaacaacgagaccctcgagcaagccttcgccaacttcggccaggtcatcgactccaaggtcatcaccgaccgggagacggggaggtcccgcgggttcggcttcgtcaccttctcctctgagcagtccatgctcgacgccatcgagaacatgaacggcaaggagctcgacggccgcaacatcaccgtcaaccaggcccagtcccgcggcggaggcggcggcggcggtggctacggaggcggtggcaaccgcggtgactccggcggcaactggaggaactgattgtgtgggcccaccctggcttcggccaagttatcctagctatctatctatctatagtatcgtgttaccgttccgttggattctgagttacccatgtgttagtgtccgttgaacctttggattaggtgttggtacccccgtgttcgatgatgttactgtccgctttggttactttccgctatgaaatgagagaagagtgagcaaggtttttgttcacaaaaaaaaaaaaaaaaaaggccccta

SEQ ID NO: 15176 - DNA, 403 bp, Sorghum bicolor
  unsure (1)..(403): unsure at all n locations
  Clone ID: LIB3476-035-P1-K1-C7
gttcctctcccgtggcaacgactgggcgacgcttccgccgccgccgccgcctcctcctcctacgcagattcccagttcttcgccggtcccttcgccgcgaaagagcaaccactaggctaaatctgcgagcggggcatctccatcaagtgactggtgctaattatgcgatcttcatgggctgactcagttgcgaacgccgaggaatcggcgcccgcgactgctgctgctgctaacggctctgttgtgactcatggcaactcgcgccccacgcgcagctcctacgtgcctnctcacctncgcggccggccagctggtgccggcgttgacacccaagcgggcctagtagcaccggcacaaggtggaccactgccctcggctgccgcacaaccttctggtcagggcg

SEQ ID NO: 15177 - DNA, 384 bp, Sorghum bicolor
  Clone ID: LIB3478-014-P1-K1-B11
atcgctgcttggagaggccatcaccgggaagggcatccttgcccagctgaacctggagacgggcatccccatctacgaggcggagcccctcctcctgttcttcatcctcttcaccctccttggcgccattggcgctctcggtgaccgtggtcgcttcgtcgacgaggaggtcaccggcctcgacaaggccgtccgcggagacgatggcgacggagaagctgggcatcaaggtggagcgcaacccgcccgagtcccgcctctccgagctcggcgtccgccagtggcccaagtgggggtgcgacaagagcaatttcccgtggacctactccgccaaggagacgtgctacctgctgcaaggggagggtgaagtgtaccccgagggtc

SEQ ID NO: 15178 - DNA, 551 bp, Sorghum bicolor
  Clone ID: 9302327
caatggaacaatgtaggcaagggaagtcggcaaaacggatccgtaacttcgggaaaaggattggctctgagggttgggctcgggggtcccggccccgaacccgtcggctgccggcggactgctcgagctgctcacgcggcgagagcgggccgccgcgtgccggccgggggacggaccgggaacggttccttcgggggccttccccgggcgtcgaacaaccgactcagaactggtacggacaaggggaatccgactgtttaattaaaacaaagcattgcgatggtccccacggatgctgacgcaatgtgatttctgcccagtgctctgaatgtcaaagtgaaaaacgtcaaccagtgattgcttggtcctctcgctctatcaagtgtgtagtgtgtcttcgaaagtgtgtaaagcctactgctgctctgtatatacagatgttgcttccaagacaggcgtttggtgggtgtacatgttgaatgcttgacgagaaacatcttattgtagttaaggggtcacactgttgttgttgctgttgttgttgacaataa

SEQ ID NO: 15179 - DNA, 466 bp, Sorghum bicolor
  Clone ID: 9848480
gcacgaggcagaagggatcaacagaggcaatatgagtttccgtgtgtcgctactcactttcctcctgttcgctgtgtttggaggtatgcgcccaaatttggcaacaacggacggccgcagtgctacagtgcccagtgctggttctgctatcattgcatactggcaaaaaatgctacctgactctaccatgccatcagctatacgtgaccttttgacccccaataataatgctgatgcaaacaaagacaacccttacccgataccagccacagccttttatgggaaagaagcgaataacctaaacccaacaatcttctacaggaaagaaataaatcgggacgacaacccttacgtgccggtcttggcttttcatggaaaagaagtgaataacctgaacccagtgaacaacctgccgctctcggccttttgtgggaaagaagtgaacaatcttccggtctcagccttt

SEQ ID NO: 15180 - DNA, 610 bp, Sorghum bicolor
  Clone ID: SORBI-28MAY03-CLUS49_78
gcacgaggcgcagcgccgccgctcatctccctcgcagcgccgctcaggctcggtgcctcagcgcagatcttctgctccttcccccactcgcgctcaggctcggtcccaaggattggatcttccgcgcgtcggcggctccccctcggcggcgtccagcgacggaggggcagtcccaggctcggcgacggcgtcggcggctcccctcaccttctctcgccagtcgcctcgcgccctcgcctgcgtcctccgcgcaccggccgacgaccctgcggtgattcaagtactgtgctttcaccaagatgtctgacggtcaggaaactgacaagaacatcgaaatttggaagatcaagaagttgatcaaggcattggaagctgctagaggcaatggcaccagcatgatctctctgattatgccaccacgtgaccaaatttcccgtgtgaccaagatgttgggtgatgaatatggtactgcttcaaacattaagagtagagtcaatcggcaatctgttttagcagccatcacctcagctcagcagaggctgaagctgtataacaaggttcccccaaatggacttgttctctacactggaacaattgttactgaagatgg

SEQ ID NO: 15181 - DNA, 798 bp, Sorghum bicolor
  Clone ID: SORBI-28MAY03-CLUS49_79
gcacgaggcaacacagcaataatggcggcggcggcggcgaagaagggcctggtgctgctggacttctgggtgagtccattcgggcagcgctgccgcatcgcgctagcagagaaaggcatcccgtacgagtactcggagcaggagctgctgggcaccaagagcgacctgctgctccgctccaacccggtgcacaagaagatcccggtgctgctccacgacgggcgccgcgtgtgcgagtccctcgtcgtcctcaactacctcgaggaggcgttcccggagaccaccccgaagctcctccccgacgccgcctacgcgcgcgcgcaggcccgcttctgggcggcctactccgacaaggtgtacgaggtcggcacgcggctgtggaagctcaagggcgagtcccaggcgcaggcgcaggcgcgcgccgagatcgtgcaggtgctcaggaacctggacggcgagctcggggacaagcgcttcttcgccggcgaggcgtttgggttcgtcgacgtcgcgctcgtgcccttcgtgccgtggctccccagctacgagaggtacggggagttcagcgtccaggagatcgcgcccgggctggcggcgtgggccccccggtgccccgagagggacagcgtcgccaagagccttcacccgccggaaaaggtggatgagttcatcaacctgctcaagaagacctacggcatcgatgagtagtagatagagcggactgactagcggagatgatacgtgtacgtgtggttgccatgcagtttttatttaccccggtgaatgaatgaactcttc

SEQ ID NO: 15182 - DNA, 341 bp, Sorghum bicolor
  Clone ID: SORBI-28MAY03-CLUS49_80
tttggccaccctgatctagcaatggggtttttttttggagctactgtttacccccattggccaacgccagcaatgatgtatccccattgctatgataatgttggtccaaagatatttcaggttcctttgtaccaatttttcaaccatggttaggagattttttttgcttgctggaaagttgggaaccctttttgttgaacttgctatgttgtgctgtcctatgttaaggggagttactttagattcgagccatttttattacaaaaaattcatgtagcgtcgaacgtagtttgtataaggagtcctaattcgttgaaactattatcgtgaactagtttggg

SEQ ID NO: 15183 - DNA, 664 bp, Sorghum bicolor
  unsure (1)..(664): unsure at all n locations
  Clone ID: SORBI-28MAY03-CLUS49_81
gagtgcggcggcctaggcatcggcatggaggacgactacgtcacgatcccctacggcctgctgctcctagccggtggcgtcgccggctacgtcaagcgcggcagcgccgcttctctggctgctgggggcggattcggcgccgcgctcctcctcgccggcgcgctcagcgcctgggccttcgcgcgtggcgctggtggtgctgccgccatcttcgccaccgtcctccagatcgtttgtgctgtgctattgactgttgtcatgggaataagatacgtcaaaacacgaaagataatgcctgctggaattattgctgctatcagtgcactcgtattgatattttacgtgtacaagatatctactggtggcaacaaggtttatatcccggtggctgccgagtgaggctgggtcgtgtggtgaaatatgctgtttctatggctgctcatggtgtttggttcacttctctggtaacgcagatagtttgggaaatggatcacggagggactggcatcagtgatcacggagggactttggttggggcacggtaatgttattgagaacaagttcccgtagatgtgctgcaccagcggcgtcctgtaataacgctttaacgctcgggaaggggtggaatcaagcgtgagtagtcctgtatcaatttaagcngcta

SEQ ID NO: 15184 - DNA, 606 bp, Sorghum bicolor
  Clone ID: SORBI-28MAY03-CLUS49_82
cggctgcggaccgcctgcgagagggccaagaggacgctctcctccaccgcccagaccaccatcgagatcgactcgccgcccaaggcggcggcgccgtccatcgccgaggcgctgctgctcgccacggtctgcatggtgggcctgcccgtggaggtgcgggtccgcgacggatccgcctacgccggcgtcctccacaccgcctgcgtcgacgccggatacggtgtcgtgctaaagaaagcaaagaagattgcaaacgggaagggagatgcgaatctgtcgctgggatcgtttgtggacactcttgttgttcacccagatgaccttgttcaagtgattgcaaagggtctttcactcccccttaaaggtgtctgtaaacctcttgattccaacatggtggccgccagtggatccttgaagcctcaaacttcacatgcaaatgacccaaaaatgtctaaaactggaaatatatctccacttacgcaacctgagaattgtgcctcggtgggtctggagaaaaatacttctgttaagaaaaatggtcaaaatagtggttgcactacaagtttaagctcttcaactggacatgtgaggccatgtttctgtgtg

SEQ ID NO: 15185 - DNA, 421 bp, Sorghum bicolor
  Clone ID: SORBI-28MAY03-CLUS49_83
aggagaaaggttccatgtgaacggcacttgcacatgggtaagccgatcctaagggacggggtaaccccggcagacagcggcgaccctctggaggacttctgcaaggacaaccccgagaccgacgagtgcaaggtgtacgaagcatgatgaggcccccttgttgtaggccaggggccgccgtgtgctcagaaaattcactagctttgcctcgtgttctttcgatagagaatactatatacagattcgccgaaagagacgtagacgaaaatgtgccgttttctatgagttgtgtatgtaatcactgaactcgtacaggcttccgcttttcgatcatttcctgttgggactcctgtaattctgcggtgtgtgtttatttcatcaatcatgccgacatgatcgatccatcatatacttttatact

SEQ ID NO: 15186 - DNA, 574 bp, Sorghum bicolor
  Clone ID: SORBI-28MAY03-CLUS49_84
gcacgaggccgcatcaggtctccaaggtgaacagcctctggccaatggaacaatgtaggcaagggaagtcggccaaaggtaacgactcaattgcctacatgcgcttcttcttccgcgacccacgccaggatgacccgcccgacgtcacgtcgtccgaaagtgaggacgaggacatgacggacgcaaccagctcagatgatgagtcggaaggtggggtaggccttggcgttcactccacatcgggtgatcccagccccagacagccttcgtctgcagaccaatccgcctcgcgctcaaactctagggacaaccccatgcaccactccacgggctcagctgcccatcgagccatgtttggtggctcggcccctcgctcgtctgtatcgtctgcgagctcgcctcgttcggaggctcgtgatgaacccattgaactcgaggccgtcatctcgtgcacctcggatggccttgttgtgtgcttgcgtcgtgcacgcccaatgctgccaggcaccatgcctattgctcaaccaacccaacagtacaacggcgtctttgccgctccttgggccacacagcc

SEQ ID NO: 15187 - DNA, 477 bp, Sorghum bicolor
  Clone ID: SORBI-28MAY03-CLUS49_85
gcacgaggatgaagccaacattgagacacatggttttgatgattctagcactttcaagcatcctacactagaacctatctgggcaaatgcaatgcttgatcgtgttgttagcatggtggagagagataagaatcatgcatgcattattgtttggtccctaggaaatgaatcttcatatggacctaatcatgtttccatgtctgggtggattcgtggaagggatccaacaagactccttcattatgagggaggtggttccagaacatcatccacagatattgtgtgccccatgtatatgcgtgtctgggatattgttaagatagcaaaagatccatctgaaacaaggcctctaattctttgcgaatattcacatgctatgggaaacagtaatgggaatattgatgcgtattggatggccatagacaacacttttggactccaaggaggttttatatgggactgggttgatgagggttt

SEQ ID NO: 15188 - DNA, 499 bp, Sorghum bicolor
  Clone ID: SORBI-28MAY03-CLUS49_86
gcacgagggggggaacgcctgaccagaggttgcagccctcagttggctggagaacccccagtgtgtctttgaccattgggacatgatgggctctgatcctttggaggctggctcccaggctgctcagctggtgctggatatccgcaagaggaagggtctcaaggaacagatgacccctctctctgagtttgaggacaagctctaaatttttggttgtttgttctactgttactattgctggtttaatcgtcaatttgtctattgtattgggaacgacttgaatattttctctcgttttagttaatgtacctgtctctgaactatattggtcatgtagtgtatgctgctgtgttgagagcctgagactccattttgatatctggtgtgatgtagcagatgaaacggagttggtatctgtgtggtttagttagtggttacatacttgtattccctgtgttgctcatttctattgtcttaataacgctttgcctaatctgtc

SEQ ID NO: 15189 - DNA, 722 bp, Sorghum bicolor
  Clone ID: SORBI-28MAY03-CLUS49_87
agtaccgcgagggaaagatgaaaaggactttgaaaagagagtcaaagagtgcttgaaattgccgggagggaagcggatgggggctggccttcttctcccctctggcaaactctgcttcggctccccacgcctcacgccgcctcgccgagacgagacccgcagaacagctgggttcagacttcttgggcgagagcgatatgagtggcccaagtcagtgctcatcccagccacaatttatgactagcgttggaaggagtaaccgctcgaatggccccggcactcctcttatcgaaagcatagatgttgatcagattgttattccagagaaaaacagttggaagaacttgttctcatacatagggcctggatttctcgtctcaattgcatatattgatcctggcaactttgagacggatctacaggctggagcacagtacaaatatgagcttctctggatcatacttgttgcatcctgcgccgctcttattattcaatcacttgcagccaggctaggggttgtgacagggaaacatcttgcggagcattgcagggctgaatatcccaaggtcacaaatttcgtcttatggattcttgcagaacttgctgttgttgcatgtgacattcctgaagtaattggaactgcttttgctctgaacatgctgttcagaatcccagtttggtgtggtgttctaataactggactcagcactctaatgctctta

SEQ ID NO: 15190 - DNA, 464 bp, Sorghum bicolor
  Clone ID: SORBI-28MAY03-CLUS49_88
cccaaataggtcaaccttttgaactgcctgctgaatccatgagcaggcaagagagcacctggcgaactgaaacatcttagtagccagaggaaaagaaagcaaaagcgattcccgtagtagcggcgagcgaaatgggagcagcctaaaccgtgaaaacggggttgtgggagagcaatacaagctgacgagcggcggcgcgacgaccccctcgggcctgatcgcggcggctgtggcgcacgccttcgcgctgttcgtggcggtgtccgtgggcgccaacatctccggcggtcacgtgaaccctgccgtgaccttcggcgcgttcgtgggcggcaacatcaccctgttccgcggcctcctgtactgggtggcgcagctgctgggctccacggtggcgtgcttcctgctccgcttctccacgggcgggctggccacgggcaccttcggcctgaccggcgtctccgtgt

SEQ ID NO: 15191 - DNA, 559 bp, Sorghum bicolor
  unsure (1)..(559): unsure at all n locations
  Clone ID: SORBI-28MAY03-CLUS49_89
gcacgaggctcaggctcggtcctccctcagcgcagatcttctgctccttcatctactcgcgctcagtggcgctcaggctcggtcccagggtcggatcttccgcgcgtcggcggcgtccagcgacggaggggcagtcccaggctcggcgtcggcgtcggcggctccccctcccgcctctcgccagtcgcctcgcgccctcgcctccgtcctccgcgcaccggccggcgaccctgcccaaaaagcttcagctgtgacagtgccggtacaattctgccaacaagttcctttgctacaaaaagataacactcacatctctcatggcaaagcctggaattttaggccgcagcagcgcacagaaatcaaatgagggcatgcgaatcatattctcagcagttgttggtgttatgctagggtacttgtttggcatttccttccccacagttaatataacaaagcttcacttcccttctagcattatctcctatattgaggacagagactctggcatcacaacccanacattattgaatcatgcatggacatctgcagctactcataa

SEQ ID NO: 15192 - DNA, 628 bp, Sorghum bicolor
  Clone ID: SORBI-28MAY03-CLUS49_90
gtgctctctcagaggtgggttggcttctcctccccctccggttcggttcggttcgggtcgggttcgtcaggttcttcgggggttccggttcgtgggtgagcggaagagatggcggcgtcggacgttgagtaccgctgcttcgtcggcggcctcgcttgggccaccgacgacaactccctccactccgccttcagcacctacggcgaggtcctcgagtccaagatcatcctggatcgggagacgcagaggtctcgtggcttcggcttcgtcaccttctcgacggaggaggcgatgcggagcgccatcgagggtatgaacggcaaggagctcgacgaccaccgccgccgcccgctccacgcccgcgaccactccccaacgggagggaagaagttcctgggctacttccagtgttgtatcaaggcctgaagaggactgcagtgctgcctgtgcctgtgttttgtcgcagcagaacacctgtgagcaatcaggtctcggttttgttaagtatccaaaaatgtgtaatatatttgttcttatgatcactcgttgggcctgtatgaagaacaaaccagcttatggggtaaacagcgttctctttggacaaaaaaacaaaaaaaaaaaaaaaaaa

SEQ ID NO: 15193 - DNA, 535 bp, Sorghum bicolor
  Clone ID: SORBI-28MAY03-CLUS49_91
ctccgctgctccgtctcctctggttcgacgacccgactcactgctccgccacgccgcgttcggatccggccctgagcctttcccgatcccgcccgtgtcccctgcatcgctcggcacgatccgcccccgctccacgactggtccgccgctgagctcccggcgcttccgcggccggcgccatggcgaccggcggcggcaacgagcaggcgccggcggaggccgagccgctggagctcgtgctgttccaggtcgccgagtgctacgtctacctgatacctccaaggatgacggctgcctcctacagggcggatgagtggaacgtcaacaaatgggcatgggaaggggcgctcaaggttgtcagcaagggagaggaatgcatcattaaactggaagataagaacacaggggagctttatgctagggcatttctcagagagggtgaaccacatccggtggaaacctgtattgatagcagcagatattttgtactacgcgttgaagagatatagatgggcgtcagcgtcatgctttcata

SEQ ID NO: 15194 - DNA, 730 bp, Sorghum bicolor
  Clone ID: SORBI-28MAY03-CLUS49_92
gcacgagggcttgagctccggttggtggtggttggtcggtacctagagggcggcggcgtcagcggcaggggaggtgggctgtgaggatgtcgtcgagcacgatccggaaggcgctgggcgcggtgaaggaccagaccagcatcggcctcgccaaggtcaccagcaacatcgcgcccgagctggacgtgctcatcgtcaaggccaccagccacgacgacgagccggccgaggagcgccacatccgcgagatcctccaccttacgtccggatcccgcgcccacgttgctgctgcagtggcagggtgctcccggaggctctcccgcactcgcgactatgtggtcgcgctcaagtcgctcatgctcgtgcaccgcctcctggtggatggcgacccgtgcttccaccgcgagctcctccacgccacgcggcggggcacccgcctgctcaacctctctgattttcgggacgaggcgcactctggatcctgggatcactctgcctttgtccgcacctatgcgctctaccttgatcagcgcctcgagttcttcctccatgagcgcaagcaggggtcaaataatggcagcagcagcagccataatggtccttcaccacgggaccgtgaccgttggggttcgcctgatccctatggccgccgctctccctcctactcgtcgccccctggatatggaggatatgatgattaccgcgagaggaatggtgggaacaatgatga

SEQ ID NO: 15195 - DNA, 613 bp, Sorghum bicolor
  Clone ID: SORBI-28MAY03-CLUS49_93
aaaacacacaccaatccatcgtcctcttcttcgccagcgccgccgaaccggccaccagcctcctccggtcctcccacctcgaaagcacggaagtctcccggaaggagctgtcacctagcagccatcgctggcgcggccgtccacctcctccctctcctcctccactgttattggattggcgtcggagtggagatcaacccgggcttggaatttccttcgttgctaattttctaggaagattggggtttcagctcaaacccccatgctcgacgctgaggacgaccctggcgggagatgacgaggatcttcgtgcagcgcgggaccgccggctcctcgtccagctccggtcgctcgggctcgcagccagcgcagcagccggcagcagctgcccgggaggaggagttgccgctgcaacctcagccacagctgccggagctattggccatagatgatacaactgagcatttaaatgagggcagcgagaacagcagtagcagcaataagccgttgaggacggatgacaccatttcagagagctcgagctctgcagaggagagggctgccagggagaagcctcctaaggatgactctaatgtaatcaaccccactttct

SEQ ID NO: 15196 - DNA, 784 bp, Sorghum bicolor
  unsure (1)..(784): unsure at all n locations
  Clone ID: SORBI-28MAY03-CLUS49_94
ccgggagtataaatgcaatcctcctcccaaggcagaccgcatcgccgtcgcagcttgcaatctcccatcccccgcccaaatccacctccgatctccccgcgcccggcaacgatggcccgcacgaagcagacggcgcgcaagtcgacgggcggcaaggcgccgcggaagcagctggcgacgaaggcggcgcggaagtcggccccagccaccggcggcgtgaagaagccgcaccggttccggccgggcacggtggcgctgcgtgagatccgcaagtaccagaagagcacggagctgctgatccggaagctgccgttccagcggctggtgcgggagatcgcgcaggacttcaagacggacctccggttccagtcctccgccgtggcggcgctgcaggaggccgccgaggcctacctcgtggggctcttcgaggacaccaatctctgcgccatccacgccaagcgcgtcaccatcatgcccaaggatatccagctcgcccgccgcatcaggggcgagagggcctgagcttccgctctctgttgctcttccttggcctttctggttctgcagtgctaagaactacttgtagtagatgggccggaccactcgttccttgcagtgtgctgtcgtgtaggaatggtaatgttctggatatgttgngtcttgatgcaatgcaacgcagtgtgattgtcgcttctggttcttgtttattgcaaaggctgcagtgtgtgatattgggatgtgtctggtctttctactactaagaatgtgactggtactattnatg

SEQ ID NO: 15197 - DNA, 335 bp, Sorghum bicolor
  Clone ID: SORBI-28MAY03-CLUS49_95
gggtgccgttcacggagatcaacaaggcctttgccctaatgggtaaaggagagggcatccgctgcatcatccgcatggagaattagattttgcttttttttttgggttgtttggtttgggttgggttaaataaaaggggcagtgtcctttggggatggggagccccgcttgtgggtatcacgtccagtttggccttgtccatcaggagaagtagcttgccctttttttttttttgtaaatacgcttgggtatcattgtattgaggggatagaagttttaccattattaaaatacaagagtggccgttttcggcctgcccgaaaaaaaaaaaaaaa

SEQ ID NO: 15198 - DNA, 642 bp, Sorghum bicolor
  unsure (1)..(642): unsure at all n locations
  Clone ID: SORBI-28MAY03-CLUS49_96
gcacgaggcaataatccgtcgcggcccgagctatagccggcaccagcactccagcagcgcagggaaaagctagctggccataggaatggggcgtgcgacaatgcggtggccgcagccggcgctgatgctcctcgtcgtggccgcgcggctggccaccgtcgccgtcgtcgtggtgcggggcgagccccaggtgccatgctacttcgtgttcggggactcgctcgtggacaacgggaacaacaacgacatcgcgtcgctggcgcgggccaactacccgccctacggcatcgacttcgccggcggcgccaccggccgcttcagcaacggcctcaccaccgtcgacgctatctctcggcttctgggcttcgacgattacatccccgcgtacgccggcgcgagcggcgatcagctcctcaccggcgtcaacttcgcctccgccgcagccgggatccgtgacgagaccggccagcagctggggcaacggatcagcttcggcgggcagctgcagaactaccaggcggcggtgcagcagctggtgagcatcctgggcgacgaggactcggcggccaaccacctgagccagtgcatcttcacngtgggcatgggcagcaacgactacctcaacaactacttcatgccggc

SEQ ID NO: 15199 - DNA, 1019 bp, Sorghum bicolor
  Clone ID: SORBI-28MAY03-CLUS49_97
ccacagccaagggaacgggcttggcggaatcagcggggaaagaagaccctgttgagcttgactctagtccgactttgtgaaatgacttgagaggtgtaggataagtgggagccctcgggcgcaagtgaaataccactacttttaacgttattttacttattccgtgggtcggaagcggggcatcgcccctccttttggctctaaggcccggccttgccgggccgatccgggcggaagacattgtcaggtggggagtttggctggggcggcacatctgttaaaagataaccaatcgctccaggtatgagtttggaaatcaccctcttctctttcgtcatccccaggaggtgattccatttatcgagatccctcttggcgtggagctgacttatgtggacacgctctcttccccaagagttctcgccacccatatgcccttttcattgctcccaaactccataactacttgtggttgtcggattgtgtacatctgccgagggccaaaggatgcctttgtgtctcgatggcattttgagaataagattagtagagaatatagcatcaatgtggaagatgctcttgacatgttctgtgaaggtttctcaccctatggtcctttttgggagcactgcctcgagtactggagggagagcatcgcaagtcctgacaaggttctttttctcaagtatgaggatatgacatcagaaccagtgaagtatgtcaaaaggatcgcatcgttccttggcgtcccattcagtattaaggaacaagaagatggggtgcctgaggaggttgtgagattatgcagcttcgagaagctcagcggcttgcatgccaatcaggcagcaggagacatcgctcggcatggcaacatggtcattgacaagtcggtgttctttagaaaaggaatcgtgggggattgggtgaatcacattagtgaagagatggggagaaagatagattccgttatagaagagaaactcaagggatctggcctgtgttttaacgtgtaatcattt

SEQ ID NO: 15200 - DNA, 595 bp, Sorghum bicolor
  Clone ID: SORBI-28MAY03-CLUS49_98
agctatcgttgcaaaggcaaagcaagcgatccaaattctctccgtttttcttcagatctcgagttccgcgactagctttggatcccttctttcattcgagagagcgattctctggtggcaatggcgaagagcgagggtccggcgatcgggatcgatctcggcaccacctactcgtgcgtcggcgtgtggcagcacgaccgggtggagatcatcgccaacgaccagggcaaccgcaccaacaccgtcttcgatgccaagcggttgatcggcaggaggttctctgacccttcagttcagagtggcatgaagctgtggccattcaaggtcatcccaggccctggtgacaagcccatgattgtagtcaactacaagggtgaggagaagcagttcgctgctgaagagatctcctccatggtgctcatcaagatgagggagattgctgaagcctacctcggctctacgatcaagaacgcagtggtgaccgtgccggcctacttcaacgactcgcagaggcagggcaccaaggacgccggtgtcattgcgggcctcaatgtgatgcgtatcatcaacgagcccactgccgctgctattgcct

SEQ ID NO: 15201 - DNA, 728 bp, Sorghum bicolor
  unsure (1)..(728): unsure at all n locations
  Clone ID: SORBI-28MAY03-CLUS49_99
tgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctcacggcgagaaccgacctactcgacccttctgccggcgatgcgctcctggccttaattggccgggtcgtgcctccggcgccgttactttgagctggatcagaggctttttctactcatgcgcaaggtttaaaactaccgcggaatgtgctacctaccctgataacctaatgctagttgttcacattgaggctattggtgtttggccttgttaataccttactttccatctacgttacacgagtacgggtacgagtatcggatacaatacgtatcggatacgcgaatacatactttctaaaaataaaacctactaaaatggtgtatccgagtatccgtatccgcgtatctgacgagtatcggatacggatacgtcaccccttggagtatccgtgtaacatagctttccatccatggtgcttgaccttacacccttgcttcccccgtgggtgaagnctgtt

SEQ ID NO: 15202 - DNA, 316 bp, Sorghum bicolor
  Clone ID: SORBI-28MAY03-CLUS49_100
gtgtttccagtggcgaacgggtgagtaacgcgtaagaacctgcccttgggaggggaacaacaactggaaacggttgctaataccccgtaggctgaggagcaaaaggagaaatccgcccaaggaggggctcgcgtctgattagctagttggtgaggcaatagcttaccaaggcgatgatcttcggagagtatataattttggggaatggtgtgtgtgtgtggccttgtcgaggcatgtgtcggagtgttttactgggatcataatcttccatgaaaaatgatataagccttcagcatgtaatctgagttttcggtgt

SEQ ID NO: 15203 - DNA, 606 bp, Sorghum bicolor
  Clone ID: SORBI-28MAY03-CLUS49_101
gtgctctctcagaggtgggttggcttctcctccccctcttaccaagtcctcgtccacggtttagggttcgttagggtttttgtggaggggagatatggcggcggcggacgtggagtaccgttgcttcgtcggtgggctcgcctgggccaccaacaacgagaccctcgagcatgccttcgccaacttcggccaggtcgtcgactccaaggtcatcaccgaccgggagacggggaggcggcggctacggcgggcgccgcgagggaggaggcggctacggaggcggcggctacggtggcggcggcggcggctacggcggtcgccgtgagggcggcggcggctatgccggcggcggcggctacggtggcaaccgcggtgactccggcggcaactggaggaactgattgtgtgggcccaccctggcttcggccaagttatcctagctatctatctatctatagtatcgtgttaccattccgttggattctgagttacccatgtgttagtgtccgttgaaccattggattaggtgttggtacccccgtgttcgatgatgttactgtccgctttggttactttccgctatgaaatgagagaagagtgagcaag

SEQ ID NO: 15204 - DNA, 824 bp, Sorghum bicolor
  Clone ID: SORBI-28MAY03-CLUS49_102
gccggccgggccgggaacgccccagcctcggcctctcctctcggctccaccacacgacactccagcctctgcccgcgacaacgctagtacgccaccgccaccaagcccgggcctcataaccctgctgggctaccgccgccgccgcccttcgccgatatcttcgccggagaagaacgcccaccagatccgccgctgcgatggagtccgtggtgaacccgaaggcgtacccgctggctgatgcgcagctgacgatgggtatcctcgatatcatccagcaggccgccaactacaagcagctcaagaagggagctaacgaagcgacgaagaccctgaacagggggatatcggagttcgtagtgatggcggcggatacggagcctctcgagatcctgctccacctccccttgctagctgaggataagaacgtgccatatgtatttgttccatcgaaacaagctcttggccgtgcttgtggtgtgacaagaccggtcattgcttgctcagtgaccagcaatgagggtagccagctgaaactacagatacagggcctcaaggactctattgagaagcttctcatctgatttactgagacctttcggtgtgatgggcctcggggacacattttcagaggcttggactggtgatggtgtcttgtttactagattttacactttccaaagtatgtttgaacactgttatgtggaccataatcgaattgtgttgtgtcttatatttgtgactcatgtattctcaaagatgcctgtgcatcctggtggcttggtatctgttgagattcaaccattactgtaacgattgattacaac

SEQ ID NO: 15205 - DNA, 741 bp, Sorghum bicolor
  Clone ID: SORBI-28MAY03-CLUS49_103
gcacgagggccgctcaggctcggtccctctccctcagcgcagatcttctgctccttcccccactcgcgctcaggctcggtctcttccgcgcgtcggcggctccccctcggcggcgtccagcgacggaggggcagtcccaggctcggcggcggcgtcggcggctccccccaccttctctcgccagtcgcctcgcgccctcgcctgcgtcctccgcgcaccggccgacgaccctgcgtagttttcttgtccagagcacagacaagatggttaacgcaatcaaggggctgttcatctcctgtgatatacctatggcacagttcattgttaacctgaacgcctcgatgccaccatcggagaggttcattgtgcacatgcttgatcctaccaacatgtttgtgcagcctcatgtggcgcacatgatcaggagtaagataggggagttcagggatcaaaacagctacgagaagccacagtgagggatctcattctattctacctcgcaattggcttcgttgcctcctcttcctccaaagatggatgccataccattttctgtggagctgcaatagaattggtggctggatggtgttgtcatgtctcacttatggtggtctagaataatgtctagtcgtgtgtgttgggtactatcggaaaatgcagcattgcagtggattgctctgtatctggatcgaacctttttttttactttatggtttgggatggtgctgataaactgaagct

SEQ ID NO: 15206 - DNA, 600 bp, Sorghum bicolor
  Clone ID: SORBI-28MAY03-CLUS49_104
gcacgaggggagagactcatcaccagagaggagatcgaggaggtgacgtgaggtgaggtttgcagcttgcaagtcggtcggcgtcatggcatacaacggccgtgaccagcggtacggcggcggcatcgctacgccagggtggtgctggcgccggcgaaccccaaggacgagtaccagcactggatcaaggacatgaggtggagcacgagcatcaaggacgaggaaggttacccggcgttcgcgctggtgaacaaggcgaccggggaggccatcaagcactcgctggggcagtcccacccggtgcgcctggtgccctacaacccggacttcctggacgagtccgtgctctggaccgagagccgcgacgtcggcaacggattccgatgcatccgcatggtcaacaacatctacctcaacttcgatgccctccacggcgacaagtggcacggcggtgtccgcgacggcaccgacatcgtgctctggaagtggtgcgagggcgacaaccagcgctggaagatccagccctactactgaaccaactgatcgatgatgagatctatcgatgatcatccatcgtcgcgtcgatcgatcctgtcgtca

SEQ ID NO: 15207 - DNA, 890 bp, Sorghum bicolor
  Clone ID: SORBI-28MAY03-CLUS49_105
atcagcagctgctgttatttcacaaacacagtacacaatgactcctttaatctacacaagccagcagcatcctgccagcaatgtatctgcttcattcatccgctgttggcgacccactcaatgagcgagcgcaagtacttggccacggcgcccctctgccaccggagcctcttccacctgctttttagaagcacagggtgcagccccaggatgtgctccggcatgaagtcatgcctcgtcaagatgcccaccaccggcgacctatcgcaggccttgggcacgacgaggaggtggcgcagaccgacctcccccctcgggcgcaagtgaaataccactacttttaacgttattttacttattccgtgggtcggaagcggggcatcgcccctccttttggctctaaggcccggccttgccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacaggccacgcccggtcgtcaagaggcaccgccccggcggtgcatgtttcatccatagtcgtcctttccccgtatatatgtacagtagtatgcctatgataaattttttttgctaccacggtttctgcctacgagtatgtactccttacgcatacgtactatgtatagcaatctagctactatatatgcgtagtatttactccttagtgcatgtgaaatctctctgttcattgttc

SEQ ID NO: 15208 - DNA, 556 bp, Sorghum bicolor
  Clone ID: SORBI-28MAY03-CLUS49_106
gcacgagggttccgcaagtgcatggaacctgtggagaagtgtctgcgcgacgccaagatggacaagagcagcgtgcacgacgtcgtgctcgtcggtggctccacccgcatccccaaggtgcagcagctgctgcaggacttcttcaacggcaaagagctgtgcaagagcatcaaccccgacgaggccgtggcctacggcgcggctgtccaggccgccatcctcagcggcgagggcaacgagaaggtgcaagacctgctcctgctcgacgtcacgccactgtcactcggtctggagactgcaggtggtgtcatgacggtgctcatcccgaggaacaccaccatcccgaccaagaaggagcaggtcttctccacgtactccgacgccccgtctggtgggagcggtgctggtcctaagatcgaggaggtcgattaagttgttttagtgtccgaggtttggtttggtgaagtacatctgaactctgaaggttcttcgtgacatggttagacgtggtgttgcagtactgtgataaaacttatcagaataagttttcgttttt

SEQ ID NO: 15209 - DNA, 609 bp, Sorghum bicolor
  Clone ID: SORBI-28MAY03-CLUS49_107
ggccgggttttccgaaaaaccaagcagtggaagagaatgtttaccaaagccacctttgttggagctggatttacaaggaaaccaccaaagtatgaacggttcattcggccaactggtctgcgtttcaccaaagctcatgtgactcacccagaactgaagtgcactttcaaccttgacataatttctgtgaagaaaaacccaaatggtccaatgtacacgtctcttggtgttatgacaaggggaacaatcattgaggtaaatgtcagtgagcttggcctggtaactcctgctggaaaagttgtttgggggaaatatgctcaagttacaaacaacccggagaatgatggctgtatcaatgctgttttgctagtgtagagccatagtgaaattttgtgtatggtggtgaatcgtcccagttgtatccgctctgatatgctttttttgttctttaccgatgtcatggctaatcccagtagtttgttgtgcaccatgggtagcaagcattctgtattcttgctgtgtgctatgaatgacttaactattatagcatgctatatgaatttgagtaatacaaattagcagtaaaaaaaaaaaaaaaaaaggccccta

SEQ ID NO: 15210 - DNA, 860 bp, Sorghum bicolor
  Clone ID: SORBI-28MAY03-CLUS49_108
gcacgagggagacgcatccgtccgtcgcctcccccaccccgccgccgccgcgcgtccgtgcgttcgttcgttcgttcgttcaccgcgtagggttagggtttgcggtcgacgccgcgccgccatggcgatcctctcgccgctcgccaccgaggtgttcatccccgtcgccgccgtcatcggcatcgtcttcgccgtcgtgcagtgggtgctcgtgtcgcgggtgaagctctccccgaccgcggccgccgcgtccggcggagggaagaacggctacggcgactacctcatcgaggaggaggaggggctcaacgaccacaacgtcgtcgtcaagtgcgccgagatccagaacgctatctccgaaggtgagcccggggatttttcctcagatctgggggctgccgctgggtcgtccgcttagatccgcgcatttcgcgctgctctggcgcgtttgccaaccgaggattacgtttttagtatgtttttttttcgtttattataggatatatacacacgtttctcgaaaagtgagagatctttgcggggggtaaaaggtgcgggcttttgttatcccttcgtttatttagtagatttcacgctgatctggtctggcggtgaagttgctaatattaggatgggtgcctgggtgagctcaaatgccattctattttgggggaccatagcaattgcttagacaacaaaagtttatgattttgttaggactgaaacgagtttcagactgcatgttttttacggaatggaagacaaatatctatgtggggggtgttggtacctctgtgggggctgccaattgatgtactacctcttcccccctccagagtccaaactatgtactttttatg

SEQ ID NO: 15211 - DNA, 530 bp, Sorghum bicolor
  Clone ID: SORBI-28MAY03-CLUS49_109
agaccggccagcagctgggcgggcggatcccgttcgcggggcaggtgcagaactaccagacggcggtgcagacgctggtgagcatcctgggcgaccaggacacggcgtcggaccacctgagccggtgcatcttcagcatcggcatgggcagcaacgactacctcaacaactacttcatgccggccttctacaacagggaccagcacatcttctgggacgcgttccacccgtcggaggcggccaacatcatcgtcggacgccggtcgtaccgcgccgagtcacccaacgacgtctacccgatggacatcagcacgctcgcctccatctgatctcatctcatccgtccaaattataacagcagtttcagttcattcccctaatatagtccaccgtactcaccaatgcaaagggtgcaaacggggctcgaatattctttactgtacaagctcgtatatctgtaatttttgcaactcatactttggtatatttgcagcggatacttagaaaaaaaaaaaaaaaaaaggccccta

SEQ ID NO: 15212 - DNA, 671 bp, Sorghum bicolor
  Clone ID: SORBI-28MAY03-CLUS49_110
atcatgcattggatggatgcccgggcattgagaaggaaggacgctttcagaggcgaaaggccatggggagagagcgtctgtgatccatggatctccgatcgggaaaccgtatccaagctccgtggctagtctgcgctctttggacttttcaaacttagcgaactgaaacatctgagtagctaaaggaaggaaaatcaaccgagaccccgttagtagcggcgagcgagagcggaacaagggttttcatcaaaagaaatccgaagcggtttcattcgatttgttgtggattggatgatggaaaaaccagcaagcagcaagcgtaggctgtgttgccgtagcgcgccctacggagttgtacaaagtcagcaaccgttttggggcgcaagcataggcaacacaggactgatgacggggtgctccttccgtcgcaagggcgattagattctgctgtctcttaatgggagaagagagaactttgctgttttgctaccttaccatgttccgcactcgtcgaagattttgttaattattatggctatttagcgtgccctggcaatgcttttgtaaacgcgcactttgcttgagcttagtgacatctactaaggtgctgtttggttttgctaaggtagtgtcaaatgttaatgaaatcagttgctggcgttatttgatgg

SEQ ID NO: 15213 - DNA, 582 bp, Sorghum bicolor
  unsure (1)..(582): unsure at all n locations
  Clone ID: SORBI-28MAY03-CLUS49_111
cccggccccgaacccgtcggctgccggcggactgctcgagctgctcacgcggcgagagcgggccgccgcgtgccggccgggggacggaccgggaacggttccttcgggggccttccccgggcgtcgaacaaccgactcagaactggtacggacaaggggaatccgactgtttaattaaaacaaagcattgcgatggtccccacggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggaggtcggcatctgggagtgagtgagccagcgagtcctcggaggtggagacgtgtgctgcatgtggcaatcctgcgattgccatgtgcataatctctgtttctggtacttggtagtattgctattgggttgtcagtagtagtggtcacaagtgttgtccactgatcactagtggtagcgattggagattggacctgaggttaataaggatggtgattgtgtgggaantgaccc

SEQ ID NO: 15214 - DNA, 639 bp, Sorghum bicolor
  Clone ID: SORBI-28MAY03-CLUS49_112
cgggtcgtcaacttctttctcggagaagaaacaatgacggtatctgaggaataagcatcggctaactctgtgccagcagccgcggtaagacagaggatgcaagcgttatccggaatgattgggcgtaaagcgtctgtaggtggcttttcaagtccgccgtcaaatcccagggctcgaccctggacaggcggtggaaactaccaagctggagtacggtaggggcagagggaatttccggtggagcggtgaaatgcattgagatcggaaagaacaccaacggcgaaagcactctgctgggccgacactgacactgagagacgaaagctaggggagcaaatgggattagagaccccagtagtcctagccgtaaacgatggatactaggtgctgtgcgactcgacccgtgcagtgctgtagctatggctgcaaggcttctgaaggatgtgaaactgtaacatgaattcaaagcacattttccccctgttttcggttcagtcaaggaggagaaccctagagctcgttttttcccttggtggagaactctagagctcctttatgttgttgtccttgatcatttttctctttgacattgttgtactggccatggcagtttttttattttgccttgttccttcaggg

SEQ ID NO: 15215 - DNA, 656 bp, Sorghum bicolor
  Clone ID: SORBI-28MAY03-CLUS49_113
gaagcaagccacacttggagcaggcaaaacaaaacaaatcatcggagcatcattgggagtacaaacatggcgggatatattaggggatagataaacgagtcatatgacagacaaaggtaccaaaccatactaaacaaggctaatgatgtccctcagcaatggcacagggtgccagagcatcacaagttccttaaaaagacttctttagtttactgctagggaaggcggagcatggcgcagcaaaagaggctctgcaacggctgcatctaggcgccaggaacgctgcctccagtctggtgaagcatggcgtcaatctcatcgccgtcttccatctccagctcatccggggtctgctcgccgcgaagcctgcggccatcaaacaggaatgcaatggcattcatatccacagactggcggtcacagtaggcgttcatcagcttcttcagctgggtggacctcttaatgcggaagaaaacctcattgccatccttgagattgatgtgggcgccgcccgcctccgcgggcttcttgtcctcctcaccggctccagacatcgtcgacgaaggctccgaactcagcagcggcagaggtcagtttcccggcgatcgatcaatcggtggaggcggcggccggcgcgggttttggtgggttcccaa

SEQ ID NO: 15216 - DNA, 789 bp, Sorghum bicolor
  Clone ID: SORBI-28MAY03-CLUS49_114
agaaatctcgtgtggaacaaaagggtaaaagctcgtttgattctgatttccagttctcattggcagccgatgccaagcaacacggttctggaaatctgcccttcaattcaccaagccggacctctgtgatggcggcttaccggatggatttgcaagatcaaggtctgcagtgtggccctctacatgatcaattggtcgccagccagagcattctgttctaggcgaattccactctgcagcatggatcgatcaggtgtcctagtgtataatacttatggtcttgctgtagcttcagcgcctgtattgaagtaattagccttctgggagcataacagaaaggggatcttccttccatggtggtccataatttgttggtgataccgagaatgtaacaaaaagaacgccaagaattcgatgccttggtattttcagactgttacttgagtggtatggctgaaaacatatcatgatgcatcctatgaagtggacttgcattcaatcatggatcctgcttttgcttgacgtggatcagcagaacctaattctagatccttctggtcagatgatgtatccacaaccttcgtgagtcgtgaccttctgattctgctgtatctgaagatgatgcttatattgagggtttcagagttcaaatcatgttgtagtccagatatatttatccatagtagtaactagttgcctattggtgcctgcccaaatctgtgtttggacaagtttcaaacttttctcggatgaacgcaactttgaagagaagataaacgaaattagtct

SEQ ID NO: 15217 - DNA, 788 bp, Sorghum bicolor
  Clone ID: SORBI-28MAY03-CLUS49_115
tacatgtgtataacagaaaatgggcttttatttagttagtgacgcatcaaacccacgcaccgccggctccatcttcctcgcagcgccggcgcagatcttctgctccttccccgactcgcgctcagtggcgctcaggctcggtcccagggatcggcggcgtccagcgacggaggggcagtcccaggctcggcggcggcgtcagcggctccccctcccgcctcgcgccctcgcctccgtcctccgcgcaccggccggcgaccctgcgtggatgtcaaatttttgttgacaagttgaagactactaactaatttgatcctgaggtgaagaagtaatgatccgcccaggctcaaaggagtcacaaaattatgatatcaataatcaaagagttcatcctcaaccaattgatgagaacatgactcagaacggggactcaatggacactatgatcgggaggatattcaacaacatatcccctttaaaatctgcatacattcagctgcaggaagcgcacaccccttatgaccctgacaaaatccaggaagctgataagcttgtcatagaggagcttacaagactttcagaactcaagcatgcttacagagaaaagcatcctaagccagtagctgcatctcctcaagattcgcgcttgctttctgaaatacaagagcagcagaatttgttgaagacctatgaggtcatggtaaagaagttccagtctcagatccagactagagatactgagataacccatttacaacagcaaattgatgaagctaaacttcggaaat

SEQ ID NO: 15218 - DNA, 526 bp, Sorghum bicolor
  Clone ID: SORBI-28MAY03-CLUS49_116
gcacgaggaacagaggcaatatgagtttccgtgtgtcgctactcactttcctcctgttcgctgtgtttggaggtatgcgcccaaatttggcaacaacggacggccgcagtgctacagtgcccagtgctggttctgctatcattgcatactggcaaaaaatgctacctgactctaccatgccatcagctatacgtgaccttttgacccccaataataatgctgatgatgctgaccatcatgttcacgaacatcgccatatcgatggtggccatgaccatttcgattcgaggaacatcggcttcctcttcctagaggacgccttgacacctggatccaaggttgccccttatatcgacccggctagcagccgaggtgctcctttgctgcctcgtgatgtggccgattccatcccgatgtccacaaagagcttcacggacatcctcagaatgttttcaccggtatcacgcgccatggcggagagcatatggtactcgctagagctgtgtgagcaccctcgccctatcaa

SEQ ID NO: 15219 - DNA, 1081 bp, Sorghum bicolor
  Clone ID: SORBI-28MAY03-CLUS49_117
ctacgcgagtgttcgggtgtcaaacccgtacgcgcagtgaaagcgaacggaggtgggagccccctcgtggggcgcaccatcgaccgatcctgatgtcttcggatggatttgagtaagagcgtaaatgtggggacccgaaagatggtgaactatgcctgaatagggcgaagccagaggaaactctggtggaggctcgcagcggttctgacgtgcaaatcgatcgtcaaatttgggtataggggcgaaagactaatcgaaccatctagtagctggttcctgccgaagtttccctcaggatagcagtaacgcgaattcagttttatgaggtaaagcgaatgattagaggcattggggttgaaacaaccttaacctattctcaaactttaaatatgtaagaagcccttgttgcttagttgaacgtgggcattagaatggagcgttactagtgggccatttttggtaagcagaactggcgatgcgggatgaaccggaagccgggttacggtgccaaactgcgcgctaacctagaacccacaaagggtgttggtcgattaagacagcaggacggtggtcatggaagtcgaaatccgctaaggagtatgaggagacgggatggtatgatgggcagatatgggttaaaactccagaagttttagctcgcgatcgacttctaggctcattttctgtcaagcctgtgctaaacagagtgaagttcaccttggtgggtctggcaggctccctgatcctttgcattcttctttacgtgaacaccgaaaacccaaaggaaccatatgttaataccggtggaagggctatccctggagtgtacagtgacactgccgcaaggtcatttgagcctgatgcattctgtggagagcctgatctttcgtagcatcgcaaagcttggacgttggaaggtttttagatggtggcatatggtctcatagggtatacaggttgttcccctctttgtcttgtggctcttgcctttgtatggtggatgcttccatttctgtacgggggttttgatccatcgactcagggtaatgtaaatatttgaccacacgtagtaccgattttt

SEQ ID NO: 15220 - DNA, 531 bp, Sorghum bicolor
  Clone ID: SORBI-28MAY03-CLUS49_118
gcacgaggcacacccctaagattgagcttagcttacctccacactccatcttcaagcacacagtcgtggttagagggccgtgaaaatgccgatcagcaagatcgccgtggggacccaccatgaggtgtaccacccgggcgccctcaaggcggcgttggctgagttcatctccaccctcatcttcgtcttcgccggccagggttccggcgtggccttcagtgagtcctccactcctactcttgcaacacaagctcgatcggcagctctcgtatggccttcagtagtttgtatttttcattggctttccactgacattaaacgagcagctacagaacatgagtacagagtagagagtagtactgtatctatttaagttcagcttatctgtcatgctctagcacaaagtcatggtcggctcttttgagttcgtcactgaaatgaaaggaaaaatgaaaagtcattttcgtcataagtactagctatcaggctttcagtagattttttttttatacaaagccaatgttaactaga

SEQ ID NO: 15221 - DNA, 592 bp, Sorghum bicolor
  Clone ID: SORBI-28MAY03-CLUS49_119
gcacgaggtcaagatgatggagaaatcgctgcccaccatgacctaccaggcgtggaggagggatacgcagaccgggcctccacagtaccagagtagcagtatctttgagaacgctacaccggaggaagtgagggacttcttcggggacgacgagttccgtatgtccaacaagtgggatgatatgcttatttatcataagacactagaggagtgccagaccactgggacgatgaaagtacattgggtccggaagttccccttcttctgcagtgacagagagtacataattgctcgccggatatggaaactggggggcgcctattattgtgtcacaaaggtaaaatagacttgaaaaactactgcatgttcttttgtaatacttccttatttggggattgattccaggaggtaatgggacttatgcttgatccctaattcaaaatatatactttcttggttgaattttgttacatagcctgttggttatagcatacgctacatatggactgtaatgttgacaatttatgttgttgcccccaactaactcagctaggaataggcacagatggacatgtacggctcagaagtcaga

SEQ ID NO: 15222 - DNA, 592 bp, Sorghum bicolor
  Clone ID: SORBI-28MAY03-CLUS49_120
ccttccccgggcgtcgaacaaccgactcagaactggtacggacaaggggaatccgactgtttaattaaaacaaagcattgcgatggtccccacggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccactgccgccgcagccaagcccaagaaggccgccgcggggaccaagcgcaaggcgcctgagaagaaggtcgtggccaagccgaagaagtcccccgccgccaaggccaaggccaagcccaagaccgtcaagtcccccgccgccaagaaggcccggaaggtcgccgcatgagatgggttgcttaggtcgtagtagctctgatcgtcgtgtggcgttggttaggagttgtacaaattaagcgtgtgccccccaaagtgtctctggtgtgttctgtcttaggcaagatctatctaccatggtttatttagtgt

SEQ ID NO: 15223 - DNA, 845 bp, Sorghum bicolor
  Clone ID: SORBI-28MAY03-CLUS49_121
ttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgccacgttcggggacgtgagcgatccgctcatcgacgatctcgatcccctcgagatggagcaaagggaaaagctagtgcgccggatgtgggatgtgtacacacgcacggataatcatgtacgacttccacggttctggcaagaagcatttgaggctgcatatgaggagcttgctggtgatgatacgcttgctactgatgcggctatatctgagattgctcgcatgtcaatccataggcctgaggttgagcaatcatggaataagaattagtttctacaaaagtggtgcattctgctaaaagagcaacatgcaagattcgtggagaacaagatggaaagaatgaagacgtggttgagggacttctggaggcaatctagtgatcttgaacttgaaggtgtcttttgaatgtgaagctaagaggaggatgtggagctttgtgtttcctttttcagtttctgtctgcttgtttagctggatgttgcttagtgcttatcatcgaaaaagcttgctatctataaaagctgggttttcctccgtaaaagaaaacagtaggtggtaatctgacagaaagagggaaactgtgtactgcaaaattctcatccgaacagagttatagcattttttgatatggttcccttgtaattaagtacctccgcttggtattttaagtgagttatcgcttgctcctagttgccagcaattata

SEQ ID NO: 15224 - DNA, 376 bp, Sorghum bicolor
  Clone ID: SORBI-28MAY03-CLUS49_122
gcacgaggatgaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaaccatcatgcccaaggacatccagctcgcccgccgcatccgtggcgagcgcgcctaggcggccggccggccgaccggccatataggtcatggtgcagtcgctgctcaggtagcttgtagtaggtgtggtcttgtggaaggaatggtgtagtgatctgcaatgtctgtcaaactgtcaacctcttgttgtcgtcaatggaaatcgtctatcttatgtgcctaaaaaaaaaa

SEQ ID NO: 15225 - DNA, 520 bp, Sorghum bicolor
  Clone ID: SORBI-28MAY03-CLUS49_123
ctgccctccagccaccgccgccgcttcgctcttctcacggccacgccgtccatcgaggcgaggtaaggtcagcatggtgagggtcagtgtgctcaatgatgcactcaagtccatgtacaatgctgagaagcgggggaagaggcaagtcatgatcaggccgtcctccccctcccccttgaaatctttgaaggaggtttcgatctcgaaaccgcccagggctcgccccgcaagtgcatggcagtgagcttcctggccaatgaggtgtcggacctgtgcatcggcaagccggccgtgaggtcgctcccgctctccgccgccgccggcgaccttgccgccgcgctccggagggtggcccgctctggcgccgcagcctgcgtcgcggtgaccggaccagcgcgcgccgtcgtcggccgggtcggcctcgcggacgtgctctgcttcctctgcaccgaccccgaggcgctcgcgcgccccgccgacgtgttctccaagccaggctccgccctcctgcccaaggacg

SEQ ID NO: 15226 - DNA, 343 bp, Sorghum bicolor
  Clone ID: SORBI-28MAY03-CLUS49_124
gcacgaggcggcgacacgctcgagaatagcggcggcgcaggtccccctccatctccgtcgtggtcattctaggttctgcgcacgcccgcactgatcttcggactctggggctcaaattcaccgtgaataccctgacgctacgagaagttgacacggtagggatctcaaagggaggtgcgaagacccaactgccgtctctgatgggcttcgccggccgggtatgcgcgctgctcttactcctggtcgctggtgctgtagcaaatgaccaggtcttcaccacttcaggtgtgacatttgggcggagttcgcgtgagccaaggtaccgcgacgaattccatcctgt

SEQ ID NO: 15227 - DNA, 563 bp, Sorghum bicolor
  unsure (1)..(563): unsure at all n locations
  Clone ID: SORBI-28MAY03-CLUS49_125
gtcagtcgggaccacccgctgagtttaagcatataaataagcggaggagaagaaacttacaaggattcccctagtaacggcgagcgaaccgggaccagcccagcttgagaatcgggtggcttcgtcacctgaattgtagtctggagaggcgtcctcagcgacggaccgggcccaagttccctggaaagggacgcctgggagggtgagagccccgtccggcccggaccctgccgcaccacgaggcgtcgtcaacgagtcgggttgtttgggaatgcagcccaaatcgggcggtaaactccgtccaaggctaaatacaggcgagagaccgatagcgaacaagtaccgcgagggaaagatgaaaaggactcttctatcagtacatgtcaggcttcactgctcgttggaaatattactttatatggtcaatttcagaagcctcaattatcatatctggtctgggctttactggttggtcagaatcttctcccccgaaagccaaatgggatcgtgcgaaaaatgttgatgtattaggtgttgaattagctggaagtgcagttcanatt

SEQ ID NO: 15228 - DNA, 506 bp, Sorghum bicolor
  Clone ID: SORBI-28MAY03-CLUS49_126
gcacgaggcccggccccagaactgcgcccaaaacccttgcgcctacaccgccgcctctctcgttccccggatccgccccgcaggtgcgcgcgcttgtaatcgaggagctgctgcggccaacaccaatcgaccatggcgacccgtattcagtttgagaacaactgtgaagttggtgttttctccaagctcacaaatgcttactgtctggtagccataggaggctcagagaacttctacagtgcctttgaggctgagcttgcagatgccattcctgtggtgaagacctctattggtggcaccagaataattggccgactctgtgttggaaacaagaatggacttctattgccacatactacaactgaccaagagcttcagcatctgaggaactgcttgcctgatcaagtggtggttcagcggattgatgagaggttgtctgcccttggcaactgcatagcctgcaatgaccatgttgcgcttacacaccctgaccttgacaaggagac

SEQ ID NO: 15229 - DNA, 881 bp, Sorghum bicolor
  Clone ID: SORBI-28MAY03-CLUS49_127
ctactgcatccatattgaaaggattattacgatcgaggctctttcactcagcacctgagttttctgtaaccgtgactagctagtcttgtgctcgtgcagctgggacacatcacacacgtacagagacacaggagatggggtctctcatggctggctgggactcgccggttcttgccgacgacgacaagaaagttaacgcgcgccggaaccggtcgctgaccaaggaggaagtggaggcgttctggaagcagcgtcggagtcggaggtcgtcggaggaaggcggcggcgagctcgcctcgcctctttcctcgccgccggccaccgccacgtggcaggagagcccgttcgggagctcggagaagccggcggcggtggtccgtgtggacggcggcttcctccctggcggcggatccgtagacgacgacgacgacgcggcagctgacgacagccccagcaggagccgcgactggtggacgcggagcagctgggcgttcctcaacgagccgccgcaggaggagccctccgccagggcgcagcagcgctacacgccgcagttccacgtcgcacgcatcgccaccggcaacgcctgatgactgatcgatgaaaacgccgccggcaaccatgcacgcagacgcagctgaccacaggccacgcccggttgtcaagaggcaccgccccggcggtgcatgtttcatccatagtcgtcctttccccgtatatatgtacagtagtatgcctatgataaattttttttgctaccacggtttctgcctacgagtatgtactccttacgcatacgtactatgtatagcaatctagctactatatatgcgtatgtatttactccttagtgcatgtgaaaatctctctgttcatgttgg

SEQ ID NO: 15230 - DNA, 626 bp, Sorghum bicolor
  Clone ID: SORBI-28MAY03-CLUS49_128
atgccattattatatttcttcttcccgcaagcaaagccataaccgaaaccgttagctactagcttaattagcactagcagttggctatatatagccagcaaccacaatcatcaggtacggtgccgtacgtgtacgtgtcctccatcaattcgatagatggtgtcggcggcggcagcgctggtggtggcaccgccggcgggcgaccctgcgtcattctaggttctgcgcatgcccgcactgatcttcgcactctggggctcaacttcaccgtgaataccctgacgctacgagaagttgtcacggtagggatctcaaagggaggtgcgaagacccaactgccgtctctgatgggcttcgccgtccgggtatccgcgctgctcttcctcctggtcactggtgctgtaacaaatgaccaggtcttcaccacttcaggtgtgacatttgggcggagttcgcgtgagccaaggtaccgcgtcgaattccatcctgttgattcgccgttccatccagagaatggtcaggaatccgtaccaatggctaatcatgaggggaaacattacaagtgctttctaccagttgaagaaactaaaaccatgaagtcaatgctcccacaaaatgcaactaat

SEQ ID NO: 15231 - DNA, 986 bp, Sorghum bicolor
  Clone ID: SORBI-28MAY03-CLUS49_129
gcacgaggttggcttctcctccccctccggttcggttcggttcgggttcgtcaggttcttcgggggttccggttcgtgggtgagcggaagagatggcggcgtcggacgttgagtaccgctgcttcgtcggcggcctcgcttgggccaccgacgacaactccctccactccgccttcagcacctacggcgaggtcctcgagtccaagatcatcctggatcgggagacgcagaggtctcgtggcttcggcttcgtcaccttctcgacggaggaggcgatgcggagcgccatcgagggtatgaacggcaaggagctcgacggccgcaacatcaccgtcaacgaggcccagtcccgccgccgccgccgccgctctcgccctcctccgcgaagatgccgaagaacaagggtaagggaggcaagaaccggaagaggggaaagaacgaggccgacgacgacaagcgcgagctcgtcttcaaggaagacgggcaggagtacgcgcaggtgacccggatgctcggcaacgggcggtgcgaggccatctgcgtcgatggcacgcgccgcctctgccacatccggggcaagatgcacaagaaggtctggatcgcggccggggacatcgtcctcgtcggcctccgcgactaccaggacgacaaggctgacgtcatcctcaagtacatgaacgacgaggcgcgtctgctcaaggcctacggggagctccccgagacgctcagactccaccgtcgccgcatgccgctgggagtccgccctggagatcttcgagctgctgcggaagcagcactggtacgagccgaggtcgcagacctacgcgcggctgctgatgatgctcggcaagtgccggcagcccggtcccgccgccgccctcttcaaggcgatgctctcggagcggctccggccgacggcggacgtgtacacggcgctcgtcggcgcgtacggctatagcggctttctggacgaggcgctggctgcc

SEQ ID NO: 15232 - DNA, 834 bp, Sorghum bicolor
  Clone ID: SORBI-28MAY03-CLUS49_130
gcacgaggcaggctcggtccctcagcgacggaggggcagtccctggccggcgacgtcggcggcgaccccttccgcctctcgccagtcgcctcgcgccctcgcctccgtcctctgcgcaccggccggagaccctgcgtacgcacctccctctcccctcccgcctctgctgtaccgtgggagcccggccaactgcccagggtggccgggccttggctccgccggtggtagctggagatggatctgattcttccgtataagattggggatctcgcggagtcaaaatccttggtgagcggttacaggggtgcatggtttcgctgcaagatacataatatgcgtgtcaagtttggatacctggagtgttacttggagtacattgattatcccggcgaaaagaaggaatgggttagggtctttcgaaagaactctgcaaggtccaaccaaaattcaagagagagtactcaaatcatgataaggccttcgtttccaaaatggtattttgtgcatgaagttcctgagcagttaccaaatagtgatgtcacagcaattgttgatgaaacctggaaaataggtgatctggttgattggttgacggaaggttgttattggtctgcgacaattactaagttactcaatgaagatctggtcgaagtagagctgccggcacctcccataggtgaaggccaatgttatcaagctaattgtagtgatctgaggcctactctcgagtggtctctagcaaaaggttggacggtccctctttcacaggcaaacggaaaaggttggcatgctgctcgtctacttcaacattataaatctgaatcagatgatgaa

SEQ ID NO: 15233 - DNA, 768 bp, Sorghum bicolor
  Clone ID: SORBI-28MAY03-CLUS49_131
agcaacgacggtcagagccatagaggcaaacctgtgatcgtacacgctgcgctatgcggaattgcggacaacgccgcacccgtctagaagcccgtacaccgctccattggggtcttctctctgcactctgcagcggtggataggtcggtcccgtccctctctctaccgttcgcaggataggcaaagcggagacaccctacacaccgtgcgtgcacgagacgactcaaaccccagttcaggaactgcaggagaaggggagagagagagagaaggggagagagagatggagaacggcggcggcaaaggcgacgtccccgacgatgcgaacgagcatgtggttgctattgtcgagaggttggctactgtgaagcacaaattgttagttttgtctggaaagggaggtgttggaaagagtacattctcagcccaactctcgtttgctctagctgaaatggaccatcaggttggccttcttgacatagatatatgtggccctagcatccctaaaatgttaggccttgagggacaagatattcatcaaagcaaccttggctggtcacctgtgtatgttgagtccaaccttggtgtgatgtcgattggtttcatgctgcctaatccagatgatgctgtcatatggaggggtccccgcaagaatggactgatcaagcagttcttaaaggacgttgattggggggagattgactatcttgttgtggacgctcctccaggaacatctgatgagcacatctcgatagtgcaataccttca

SEQ ID NO: 15234 - DNA, 577 bp, Sorghum bicolor
  Clone ID: SORBI-28MAY03-CLUS49_132
gaccaaacatagagagtgttaatggtaccgtgagccaaaatatcgctggaggtggcattgtaagtgggagtgggagtggcaatgatgtgtatcagaatcgattcccccaacgagaagctgcattgaacaaattcagactgaagcggaaagatcggaactttggtaaaaaggttcgctaccaaagcaggaagaggcttgctgagcagcggcctcgggtccgtggacagtttgtgcgacaatctgggcaagaagatcaagcagcacaagatctgagaattaagtggttcttcccatcactgatagtaacccattgattcccaacgttagagtactcaataaataagactagttgtcaatttctgtggtcgactccagattatcaccctagtgctatggagtcaaacatgtaatatttatgtatgttcgagcttggcggtttgcaatcttcattttccttgcagagatattcttagccaagtgtcttaaggaggagcaaatcagcagcgtcattgctattattatattactatacatactaatatgattgagctggaattctgttgtagttcatccattc

SEQ ID NO: 15235 - DNA, 648 bp, Sorghum bicolor
  Clone ID: SORBI-28MAY03-CLUS49_133
gcacgaggctcaattccccaatccctctgcagcctcgcgccttccgctccgcttcctcgcagcaaaccctagcctgcgttcccgatggcccgcacgaagcagacggcgaggaagtccaccggcggcaagacgccccgcaagcagctggcgaccaaggcggcgcgcaagtcggccccggcgaccggcggcgtgaagaagccccaccgcttccgccccggcaccgtcgcgctccgcgagatccgcaagtaccagaagagcacggagctgctgatccgcaagctccccttccagcggctcgtgcgggagatcgcgcaggacttcaagaccgacctccgcttccagagctccgccgtcgccgcgctgcaggaggccgccgaggcctacctcgtcgggctcttcgaggacaccaacctctgcgccatccacgccaagcgcgtcaccatcatgcccaaggacatccagcttgcgcgccgcatccgtggcgagagggcctagaagttcgtggtccgtcgtcattcagtagtgcctgcctgatgtagagatgtgctttgtactagcctgtgttaatgttgtggtggcctggtgaagtagtggtttccttgtttgtgatggcctgatgaggcgtctgatgttactatctcattttca

SEQ ID NO: 15236 - DNA, 526 bp, Sorghum bicolor
  Clone ID: SORBI-28MAY03-CLUS49_134
tagcattgagtatcacaccaaatgtccatgatagtctagcatcaagtaataaaactccaaagcgccatgaatctgctatagttgatacgatgccagaaagcagtcgctctcaaggcgagggtgtcgccgctaaggcctatgatgctcgtaaaccaaaaactggggagccgaagaaagaacatgcagcagtaactggctcacagggtaaatcatctgttccaggtcttgacgctagcagccatgttactggggcagcgagcgcccttgttgccctatcaactctgcgagagaagggtgggtgatagagcagcagcggtgttactaaaaactgtagttcccgttggatcagatcctggttctgtgcacttgattccgggccatttccatgcatatacgtgtggttatagcagtgatgtaagcaggtgggaatgtatggatcattgtatgttctaggacaggaatcaccccgtcgactcttctgaacaataaaccctctttgatcctatatatgcgtatggtttctgct

SEQ ID NO: 15237 - DNA, 993 bp, Sorghum bicolor
  Clone ID: SORBI-28MAY03-CLUS49_135
atccttccagctcccgcttcgaaatcaaggtagcacaaacagctgcagtttctagagccctctctgccactcgtgatctccaccagccacgatgcctgccctcgccaagcccgcctcccgccccgccaagaccgccgcggcgccgaagccgaagcccgccgccgccaagccgaaggcggccgccgccggtgcctcccacccgccctacttcgaggtgagccacgccgatctgcgtttggttttcacttattggtgattggtttccgtcggaattggggtctgatcgaatttttgttctattcgtgcccttgcagatgatcaaggaggcgatctcggcgctgaaggagaggactggctgcagctcccacgccatcggcaagtacatggaggacaagcacggcgcgtcgctgccggtcaacttgatgaagatgctctccatccagctccgcgggttcgccgccaagggcaagctcgtgaaggtcaaggcctcgtacaagctctctgacgccgccaagaaggccgcccccaagccgaaggccaagctcgccgccgccaagaccgctgcgcccaagccgaccaagaaggacgccgccaagcccaagaagactgccgcagcagccaagcccaagaaggccgccgcggggaccaaacgcaaggcgccagagaagaagaaggttgtggccaaaccgaagaagtcccccgttgccaaggccaaggccaagcccaagaccgtcaagtcccccgccgccaagaaggcccggaaggttgccgcatgagatgggttgcttaggttgtagtagctttgattgtcgtgtggtgttggttaggagttgtacaaattaagggtgtgccccccaaagtgtttttgatggggtgttttgttttaggcaagatttatttaccatggtttatttagtgtagcaaatgggtaggctttttgtgatgcagatgtatccagttctttcatatatatgaaatcaacttggtttgggg

SEQ ID NO: 15238 - DNA, 741 bp, Sorghum bicolor
  Clone ID: SORBI-28MAY03-CLUS49_136
agctggaaaagaagtacatcaaggttgtacaatggtcaagatcagataggaagcttttattcgatatggtcaacacaatactatcacaaatccttgctccatgcttgaacatgcaactcttgggtcaataccactaggaacttggctccactttggggatcagagggtctattggagaaactcttgaaggtgctagttcagagacgggaacaacttgcacccagtgacactaagccagagaagaaaggatttgatatgaagtggccagatatagcagactgtatcgacagggcaggaagggacattgagagaatgataaaagatgatctattggaagagctggtccttgagctactgttcagttaggtttccacggccggagtaggttttattatagcagtacagataccttgttttttctatatctagtttttttagtcagttgtaattgttcctttggtccctaccttcaatcagtgttattttttttctctctttgttattaaagcagtggttgacaggttttttttggtctagtccttgtgcttctggtggtattagagacgtgagttctattggattaggagatctctgtaggaaaattctattttacctcgaaaatcaagtactcttggaagtgaggtttgtaagaacagaagtcttttctgtcaagttttgtcggctgtgagagtttcaagtctgtaaacgagggcaaattatagtccacagacatatgtattg

SEQ ID NO: 15239 - DNA, 617 bp, Sorghum bicolor
  Clone ID: SORBI-28MAY03-CLUS49_137
gaaaggagcagcggcggcggcggggaggtctatggcgtccacggcagggtacctggcgcggcggacggcgcagaaggagcgggtgcgtctgctctaccgcagggcgctcaaggacacgctcaactgggccgttcaccgccacctcttctaccaggacgcgtcggatctccgggacaagttcgaggccaaccgacacgtggataacatggacgtgatcgataggctcatcgacgatgcggaggctcggtacaggaacttccagcaccccgatccctacattgttccatgggcaccaggcggcactaaattcactagaaacccccctccacctcaagggatcgagatcatctacaattatggcaaggaggaccagtaaacaagagtcctgcgagcggggcagaacttccagaattccaaatcacttcctgtttaattgagttgttgtacgagaaataagaacgaaaattactggactccatccatgcatgtcatttccttgttctgataaccatgtgctctacatctagtgcatattcaagtgatgtttgctgtcataaaatggaactatgctatctttgtcatgcagtttagaaaaaaaaaaaaaaaaaaggccccta

SEQ ID NO: 15240 - DNA, 1126 bp, Sorghum bicolor
  Clone ID: SORBI-28MAY03-CLUS49_138
cttgttggtacggagggacggaggaggctaggttagccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaagggtacctgtacagtaattacatgatttagacttgcttaactgtgtctaattattctaggaagaggcggtcgagatcgagaactccggttaaaaggagatagaagacatggaccttatgcctaggcattcctctgaaacaaccgaagacatatttgcagtactgctgcagggtcggttccaataaagggacatgggtgtacacatacatgtagacccaatattggttcactcctgcacttcagatgcctgaaaaagagtgatatgtatgatctgtagcagagacgccgatcggcctctgcatggaatatggattatctgttgcaaaatttgtgatctgttaatttgtttatcataacatactaattttttcccttgtttgactatataaaaataattgtaagttaattgtatgcgtctcaacacaaatcagaatcggtagacttgtgattttgtctaatacgttttttattcccagattcagaaattacaacgaactaaagctgtaattttagcataagatatatgcaatagccgtcaactgaaaaaaaagcttcgaagttaggaggcttgtcaaatagctaaatagctttaggttagggttttggtgctcagcttcgcaaggaagagaaggggtgaaatacccggtgggtgctcgtcgccggcgaagaggctgcacctggtttagggtggtggtggcggatcgagtgagaggggagcgagagagacagtttatttttcttttctctcccttcaaaattttttgttattgtttattttatatcgatcgtattcgttggacactgtcaatgtcctgtacaattttttttaaaaaaataaccagaataataatgatatgc

SEQ ID NO: 15241 - DNA, 731 bp, Sorghum bicolor
  Clone ID: SORBI-28MAY03-CLUS49_139
tggaacggacccctgcgtttgggctgcggccctgctgccttttctcccatcgccccctcccacctcgccgcccgcgtgagctctccctccctccctacttccctccctctccgtgccgccgccgactgggcgcccgcggccgccgccggacccttcggcaggccctcttctccccccctcgccggcgacgagcaccaccaggtgtacatgtgtgcacccatgcccttaactgcgcccgcccctgcaattgcaactggtttcctgtggatttggccgccggaggattgatgcagcctgtaggattgctgtagattggttgccaaattcggaggctgatcaggtcatgttgggggagcagcgcatgatactggccttggaatcagctagctcatcaagctctgcccctgatttgagtttgaccctctctggagagcttccttctgtgagtagcaggaactgtgtgattcagagcctgcaggtggggtgggcgcagaagggaggtgggcaggtggtggagggtctggtgaattgttacagcaagaagaagaagaagaataataagatcggcggtggtggttcgtggactcctgcagccaaatcctgggcttctgagatggagggtgctgacgagagtggtgaagttgaagtcgacacggccgagctcatcggtgtgattgggcgggagttggcgatttcatgcctgctccgtcttccccgggtctactactatg

SEQ ID NO: 15242 - DNA, 722 bp, Sorghum bicolor
  Clone ID: SORBI-28MAY03-CLUS49_140
ggccggggccgggaagttcactaaccacgctcgaaggcccaccaccacccaagtgccctcccgttcctgagtgggagatgacgagcccaatggtggccaccccggtccagctccgcacaaccggccgcctcaccttctgctgctcctccttccccagcgcaccagggacagccaccaccaccaggcgcccgcggcgattcgcggcggcgagggcgtccgcggagacgatggcgacggagaagctgggcatcaaggtggagcgcaacccgcccgagtcccgcctctccgagctcggcgtccgccagtggcccaagtgggggtgcgacaagagcaagttcccgtggacctactccgccaaggagacgtgctacctgctgcaggggaaggtgaaggtgtaccccgagggtcacggcgaggagttcgtggagatcgccgcgggggacctggtcgtcttccccaagggcatgagctgcacctgggacgtcgccgaggccgtcgacaagcactacaacttcgagtagccgatgacgacgacgacgacgatgtgtggtaagcggtggcagtaattggtgatggcctagtccaaatgtttggattgctcccgctagcttcctagttcctaccacgtgcttgtattgtagacttgctgtgctcttgtacactgaacctctgatgctccattcaagagttaaacagcataataaagctccggattagcggac

SEQ ID NO: 15243 - DNA, 723 bp, Sorghum bicolor
  Clone ID: SORBI-28MAY03-CLUS49_141
gcacgaggggaagacgatcgtattgggtggtgagcgcggcacagtcgcctgggtggacctgtggcgtggactcttcctctgcgacgtgctagaggagcccccggtgctacgcgacctcccactgcccgagccgacaaggggcaactggtctcgcctcctccaacaatggatccccaactgtctccgggacattaccatcaaccgacacaaagacactatcaagtacattgagatggaaatctggaaaccaagagtggtgaagaccatgcctaattcctacttggaatgggcgcgccataacaacagctgctcccaggtcatcatccctggtggctggaaagccacaacatggaccatggcaataccggttggttcatttgcggactggcgcccagactgtgaggaacttgcataccccaccataagcatggatgacgatgttgtctacttgctttctaggactacacctaggaacatgaggaaactagagttggtggttgctattgatttgaggaagaagatcgtacaaggagtggccgagcttgatgtccagaaagacttcatttttatgccgtcctattgcaccagtgagatttgcagatttttgaggaagagtacatatttaataaggttggtacatgccaagaaaatggagcaagtgatgatcatggtgatgatggtgatgaccacaagatgatcaagtgctcaactggaaaagaagaa

SEQ ID NO: 15244 - DNA, 627 bp, Sorghum bicolor
  Clone ID: SORBI-28MAY03-CLUS49_142
gcacgaggcgcaacgccctcgacctattctcaaactttaaataggtaggacggcacggctgctccggtgagccgtgccatggaatcgggagctccaagtgggccatttttggtaagcagaactggcgatgcgggatgaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgaacgccatgccccgatgagtaggagggcgcggcggccgctgcaaaacccggggcgcgagcctgggcggagcggccgtcggtgcagatcttggtgaattgttacagcaagaagaagaagaagaataataagatcggcggtggtggttcgtggactcctgcagccaaatcctgggcttctgagatggagggtgctgacgagagtggtgaagttgaagtcaacacggccgagctcatcggtgtgattggccgggagttggcgatttcatgcctgctccgtcttccccggtcttact

SEQ ID NO: 15245 - DNA, 723 bp, Sorghum bicolor
  Clone ID: SORBI-28MAY03-CLUS49_143
gcacgaggcatggaagtcgaaatccgctaaggagtgtgtaacaactcacctgccgaatcaactagccccgaaaatggatggcgctgaagcgcgcgacccacacccggccatctgggcgaacgccatgccccgatgagtaggagggcgcggcggccgctgcaaaacccggggcgcgagcctgggcggagcggccgtcggtgcagatcttggtggattcatggtagcatttgctggtaggaagtatgcagctagatctgttccgatatttgtatccaacacctcagttacagtgtccagcttcaccctggtacttgagttcaataaaggcaggcttcaaaacttgcactggaagaaggatggctgtggagcttgctccggcaagtcaaactttgtctgccttggcaaacaaacatgcgccatcaggacgcagagctgcaagacccaagggcctgtcgactgcagcatcggcatccagctggctttctctggtacggacaagcacgagtcagttctgaactcatggtacgaagtctccaacctcaggcaatactccctgtatgggctctactcaaacctcaaggacaccctgagtggccagttcaacaagatcttctaggctgttttggcgctgccaattgtctattctctcctccttccgctctttctgtcgaccgctctgaatctgatgttgtgcttaacattattttggtttgccgcccaggt

SEQ ID NO: 15246 - DNA, 814 bp, Sorghum bicolor
  Clone ID: SORBI-28MAY03-CLUS49_144
gcacgaggagcgcactttgaccgttctttcgagagtccggaactcactgtgcaaggatggtgtagctgaccaaggtagcctaaaggtaatgcttttatgtggttctgacttgctcgagtcattcagcactccaggtgtttggatcccagaccaggtcagaaccatatgcaaggactttggtgtgatatgtatacgccgagaaggaaaggatgttggaacaatgatagccaacagtgatatattgcaagaatgcagggataacatcatttcagtcgatgagattgtgccaaatcagatcagttcatccagagtaagagactgcataagaagatgtctatcgataaagtatcttactagtgatgaagtaattgaatacattagagaacacaagctgtttatggaaactgaaggcgttgatacaacgttgtaaaaatagtgttgtttggagttaaactctgtaatcaacatgtatcggctgtggacatctgcctctggatagcatctagatcgtgcatgctgagcagttacttaacacaaactcagcgaaataaacggtgctgaccacttaaatcatactactacaatttggttaaatgtggttctggagattgcagtgagttgtattttgattaattttgctcgagtgccagaatcaagtgctacataaaaaaaaaaaaaaaaaaaaacgcacactgacattattcgtattccattcagaaatgagaatggtattctccgcaagtggatctctcgttttgatgtctggccatacctggagacatacactgaggatgttgccagtgaaataatgtta

SEQ ID NO: 15247 - DNA, 1037 bp, Sorghum bicolor
  unsure (1)..(1037): unsure at all n locations
  Clone ID: SORBI-28MAY03-CLUS49_145
acagcctctggccaatggaacaatgtaggcaagggaagtcggcaaaacggatccgtaacttcgggaaaaggattggctctgagggttgggctcgggggtcccggccccgaacccgtcggctgccggcggactgctcgagctgctcacgcggcgagagcgggccncccgcgtgccggccgggggacggaccgggaacggttccttcgggggccttccccgggcgtcgaacaaccgactcagaactggtacggacaaggggaatccgactgtttaattaaaacaaagcattgcgatggtccccacggatgctgacgcaatgtgatttctgcccagtgctctgaatgtcaaagcgaagaaccttaccagggcttgacatgccgcgaatcctcttgaaagagaggggtgccctcgggaacgcggacacaggtggtgcatggctgtcgtcagctcgtgccgtaaggtgttgggttaagtctcgcaacgagcgcaaccctcgtgtttagttgccactatgagtttggaaccctcaacctgctcgagtacgagatgtggctcggcgacgatagcatcgcctccgctgagctcacccagaccgccaagatcgagaagcaggggatcaccaggatgcaggtgcccttcagcttcaggcctaaggactttggatccgctgtctgggacatgatcaggggaaggggcacggggtacaccatcaagaaggacgatgacgacgatgacgacgatgacaactgaactgaggcaggactggagcgctgctgttacctttcacacaaaatgcagcaaagcagagaaggatgtggggatcgtcatccacctgatacccttagtgctagttaagctcgtgccttagcttatggtgtcttgttgttttgcatcgtctgaacatcctcacttcgtcagtgtacgttgtggtgccatgcggttgtccagtttgaggtttcctctgtgtagtctcctgcgtgaattccttctccaaactttgcggttggaactgaagaataagaataaaattccatgac

SEQ ID NO: 15248 - DNA, 768 bp, Sorghum bicolor
  Clone ID: SORBI-28MAY03-CLUS49_146
tactgaatctccttgcccgttcgtgtctgtctctgttcattcgttccccacctcgccctcgagacctcttgctagggtttcgccaccgccgccgccgccgccatgcctcgccgcagctcagggaggtctgccccacgcccggccccacgtgccgctccagtgaggaacccaccacagccagctcgccaggctcctcctccagctcctgttcgggatggtggtggctccattcttggaggaattgggtccaccattgctcaaggtatggcatttggtactggtagtgccatggcgcacagggctgttgatgctgtaatgggtccccggaccattcagcatgagactgttgtctcagaggcggctgctgctgcccccgctgctccagcgatgaacactgatgcttgtggcatccattctaaggccttccaagattgtctcaacaactatggcagcgacatcagcaagtgccagttctaccttgacatgctgaacgagtgccgccgtggtggtgtgtctgcctaagcacctctattgggactattcatgggttttctttttactctcatggtatcattaataagacaccgtgaaacttgaaccatctgcttgaaacgtatgtaccgtgacatcactggtccatcttgttgaagcttatggttataccgtctttcctgggagtggtacattctgttatcccgtattgttggaacagacatctgtatctgtgtcactggtgatcataaatatttgaatgaaccagttatgtgg

SEQ ID NO: 15249 - DNA, 614 bp, Sorghum bicolor
  Clone ID: SORBI-28MAY03-CLUS49_147
ccagcaacgcagcgcgcagctatgggaagagcggcggcgatggcggtagcactgctggcggcgctggttgcggcggcggccacgttgccggggacggcgagcgcgtccccggcggaaggggtccagccgctttccaagatcgccgtccacaaggccaccgtcgaaatgcagccgtcggcgtacgtgcgggcgacgccgtcgctgctcggcgagcagggagaagacacggagtgggtgacggtgaagtacggctggacagacccttccgacgacgactggatcggcgtcttctctccatctgaattcaactcgtcggctacgtgtcctaacccatggccagcagaagaaccctatctctgcacagcacccatcaagtatcaattcgccaactactctgaaaactacatcttctggggcaagggcagcatccggctgcagctcatcaaccagcgctccgacttctccttcgccctcttcaccggcggcctcgacaacccgaagctgatcgcggtgtcggagccgatcgccttcaagaaccccaaggcgccggtgttcccacgcctggcgcagggcaagtcccacgacgagatgaccgtgacgtggaccagcggcta

SEQ ID NO: 15250 - DNA, 676 bp, Sorghum bicolor
  Clone ID: SORBI-28MAY03-CLUS49_148
cctactggatctgatttctcttttgatggtcacgcgaagctattccctattggtgaattattaatttgctgcttcaatggtcgtataaactcggaatcttggtctgagggatgaattagcaagctccaattttatggtccctgtcccttggcgccagctctcaccggccagatccagcaacgggcagggacggaccgcggtcgccggtcggcaagagaaaaaggtcagtggcagagcagcagagggcgtctgggtattcgtgcaaatatctcgatgttaagtgtttcaaattctattgccgctggtcttcctagctatgggctatatgcagagacaaggtttctctcacagagctataggaagttcgcatggaaatcctcttacaagtatctcagaatccgtgcagtgcagggaaatgatggccgtcgaaggctggttgacataatccgaatcattccagaactctcaagggactattttagaagccgttcgaggcgagctctttttggtggcatctcgctgcttggcggcttttacgttgcacagacaatctcactctctttcggtgcattgggtgtgaatgatgttctagcggcagttgtttgtgtcctgctgactgagtatgtgacaaagttctattacagccggcctaaggttaccttccccattgctctcc

SEQ ID NO: 15251 - DNA, 315 bp, Sorghum bicolor
  Clone ID: SORBI-28MAY03-CLUS49_149
aggtggtgaaccccctcaagggggaaaacccttttccttaaggccccctcattttttcaaaaaaagcttttggtttgctgcgctttatcatgttttatcgggcttcaaaatgttgtgatttttgatctcccccttgcttatcatttgtacttgtactgtcctaataagtggtacttgtgagggtcttattgtgtctgcttatttccctaaaggattatttctggttttactggttatgtaatgcttaaaccaatgaaagaagctacaggctccaccccctttgaaaagtaatgggccctcgtgcattttggttcc

SEQ ID NO: 15252 - DNA, 856 bp, Sorghum bicolor
  Clone ID: SORBI-28MAY03-CLUS49_150
gcacgagggaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgaacgccatgccccgatgagtaggagggcgcggcggccgctgcaaaacccggggcgcgagcctgggcggagcggccgtcggtgcagatcttggtggtagtagcaaatattcaaatgagaactttgaaggccgaagaggaaacctgaccctcttcttcctattaccagtggtccagagaactcttcatgggacagatggtttcagcgggtccgctcccgcagcaacaaatggtgggcatcaaaaggctctgacttctcgtagcttctgcaaagctgagatcatcctcatcagtgtgtgcagattaaattgaaacctgttgaaatgtatcatccattggtgtcctgggaaacagaataggtggtgtgactgcggtgtggcactcaaacacctctgatagtttttggagagaatcatcgtgtatgtagtaatccctaacaaggctgaacatcgatgtatccaaatcaggcctgattgttgctcgcgagatagtcttgagatcattttcctacagattctgactcactaggtcggatttctgatggtcatgtaatcttgctgttctttttcccccctcctgcaaacgtgaagatccacattgtctttggaaagtttcagaaaagagaatcagattgaacattgtgctgtgcgctt

SEQ ID NO: 15253 - DNA, 916 bp, Sorghum bicolor
  Clone ID: SORBI-28MAY03-CLUS49_151
aactagcccaaaccccttacccccaccgccgctcctcgcgccgccgccgagtctcctcaacaggtaaggagaggaagagggcgaaatggtgaagcacaacaacgttatccccaacgggcacttcaaaaagcactggcagaactatgtcaagacatggttcaaccagcctgcccgcaagcaaaggcgacgcattgctcgtcaaaagaaggctgtgaagatattccctcgcccaactgctggccctcttcgccccattgtgcaatgccagactctcaagtacaacatgaagtcaagggctggcagaggctttacccttgaggagctgaaggctgcaggcattccaaagaagcttgctccgaccattggcatttctgtagatcaccgccgcaagaacaaatcccttgaggggctgcaggctaatgtccagaggcttaagacatacaaggccaagctggttatcttcccaaggcgtgctcgcaaggtcaaggctggcgactccactgcggaggagcttgccactgccacccaggtccagggtgactacatgcctattactcgtggtgagaagcgttcagttgaggttgtgaaggttactgaggagatgaagtcatttgcggcctacggcaaactccgtcttgagcggatgaacaagaaacacctcggtgcacgccagaagaaggcggctgaggcagagaaggaagagaagaagtgaagcaaccagacgtagttaccaaattttgttctatcccgtttcagtcactactcactagtggatgttaactaccatcaagtgcttggtccaagttttattttgttgctggaaatagagagcagacgatccttttggtgtcctgctctttgataccagctggtacttgtttgtgatctcagctattgagctatctaaatgggatca

SEQ ID NO: 15254 - DNA, 756 bp, Sorghum bicolor
  Clone ID: SORBI-28MAY03-CLUS49_152
gcacgaggcacacccctaagattgagcttagcttagctccacactccagctccaagcacacagtcgtggttagagggccgtgaaaatgccgatcagcaggatcgccgtggggacccaccatgaggtgtaccacccgggcgccctcaaggcggcgttggctgagttcatctccaccctcatcttcgtcttcgccggccagggttccggcatggccttcagcaagctgacgagcggcggcgcgacgaccccctcgggcctgatcgcggcggctgtggcgcacgccttcgcgctgttcgtggcggtgtccgtgggcgccaacatctccggcggtcacgtgaaccctgccgtgaccttcggcgcgttcgtgggcggcaacatcaccctgttccgcggcctcctgtactgggtggcgcagctgctgggctccacggtggcgtgcttcctgctccgcttctccactcatcggcggcggcctcgctggcgtcatctacgagctgctcttcatctcccaaacccacgagcagctccccaccaccgactactaagccggccgccggcgaccccccaccaagcttgggttccgttccgtgcgcagctagcagatcatcaattctctcgatctctggatctccccctcgccgtttagtttctctcgtgcatgtgcatgcatcgtcgaacatctcaagctgctactgctgctgctgcgccggccgccgctcgatcgtcgcatcgtttgctttctggacaagtcttaac

SEQ ID NO: 15255 - DNA, 1022 bp, Sorghum bicolor
  unsure (1)..(1022): unsure at all n locations
  Clone ID: SORBI-28MAY03-CLUS49_153
gcacgaggcctcgtgccgaattcggcacgagggccgcttcatcgaggtgcaggaggcctacgagacgctctccgacccgagccgccgcgccagctacgaccgcgcgctcgcccgcggcgtctgcctcttagccttctccggccgccgctcccaatcccaccgcgcctaccaccaccaccaccaccaccaggagcaggaagagaaatttggctggagaaggtcatgggaagaccagattgcagagctgaagaggaggagcacgacaaaggattcagaagagaacctttcgtggggcgctcgtatgcggagaagggccgaggcatcatcagcagaacagctataatagtaataatcctaccaatgcaataatactcgtatgtagcatctgaaccaaaaccgactatatttttgggcaggcacgattagtagggtatatggtctgcgaggttattaagctgtggatctaagatgtaaagatgggcctgttggaaaaacctgcagcgacctgtagttagtaatgtagcagtagtagctgtagcggtggcatctgccaggattgggaaacagcagcacctggagtgtggctgctggttgctgaccaacatccatggccctggcgtatatatagttgatgagttgcttcctgctgccctgctgggatgtatgtaaacgactcaactatgttgtccttgagtcctgtacatttctggctagtccaatgtaaatagtacaaacatcaataacgaagaagcaagctagctgttcttccaaaaaaaaaaaaaaaaaaactcgagactagttctctcctatggaggtgcgcgtcaagatcctcttcacctcgctctgccacaccgacgtctacttctgggaggccaaggggcagactccggtgttccctcggatcttcggtcatgaggctggaggtatcatanagagtgttggagagggtgtgactgacgtagctcccggtgaccatgtccttcctgtgttcactggggagtgcaaggagtgcgcccactgca

SEQ ID NO: 15256 - DNA, 625 bp, Sorghum bicolor
  Clone ID: SORBI-28MAY03-CLUS49_154
gcacgaggacgtggagtaccgttgcttcgtcggtgggctcgcctgggccaccaacaacgagaccctcgagcaagccttcgccaacttcggccaggtcatcgactccaaggtcatcaccgaccgggagacggggaggtcccgcgggttcggcttcgtcaccttctcctctgagcagtccatgctcgacgccatcgagaacatgaacggcaaggagctcgacggccgcaacatcaccgtcaaccaggcccagtcccgccgccgcgcgaccgctcccaccagagatggggcgagacaagagccggcgtctctccggcagccgcgacttccggcagcgcctggtgctggcgacgctcacctccaccgccgtcaccatcgtggacatccgctccggggacgcggcgccggggctccgccctcacgaggtctccctcctccgcctcctcgacaagatctccgaccaccacaccattgagctcaacgatacaggaacgaagctgaagtaccgaccgggagtgattatagggggaaagggccttgagcacgattgcggggtacaccggggtattggctacttccttgagccgctcatactgcttggtctatttgcgagggctcctatatcgat

SEQ ID NO: 15257 - DNA, 648 bp, Sorghum bicolor
  Clone ID: SORBI-28MAY03-CLUS49_155
tcgtcaaggactggctgctcatcgccttctcctggtccgtcatccgcgacaccgtcacccccatcaacctcttcggctacgggatcgccttcctcggggtgggctactacaaccacgtcaagctgcaggcgctcaaggccaaggaggcacagaagaaggcggcgcaggccgacgaggaggccggctcgctgctgcaggagcgcgactcgcacggcgaccgcaagactgacacccaggcctagcgagtgtgatggatctcatgatccaaccgccctcgccctcattcggagacctggtgcaaacaccatctgaagattggtggcctgatacatggttgatttccacggagctgacatcggtttggtgctttgacgcctaaccccattggttgttcttgtggggattcttgaggaatttgttgtgtagggaacatcaggacgtagaactgcctgctggaccagaagaaacttggatctcacaatgccacttttcttttgtggagccaatactattgttttgctattctttttccatttttttttggtcccttccgagcgcctgtactgtattcaatcagtgaagggaactctacatcatcagtacttaaaatgacaatcatatggtactatctacaacaacctctgtccc

SEQ ID NO: 15258 - DNA, 528 bp, Sorghum bicolor
  Clone ID: SORBI-28MAY03-CLUS49_156
tccagccgcgtcctggaggccggagccatgaagcctgtcaatgtcgccgaacacaaccaccaccaccatggcctacactcccccacgcccgcgtcggcgaccaagatctcgattcccgtctcttccggcgaggcggcgctgttcgggaagggtaggtacaagggtgggccctcgccgccatcgccctcctcgcgctctggtccatgttcgccgcctccgtcacgctgcgcttgtcctccggggagctcgccgccacgttcggggacgtgagcgatccgctcatcgacgatctcgatcccctcgagatggagcaaagggaaaagctagtgcgccggatgtgggatgtgtacacacgcacggataatcatgtacgacttccacggttctggcaagaagcatttgaggctgcatatgaggagcttgctggtgatgatacgcttgctactgatgcgggtatatctgagattgctcgcatgtcaatccataggcctgaggttgagcaatcatggaataagaattagtttctac

SEQ ID NO: 15259 - DNA, 810 bp, Sorghum bicolor
  Clone ID: SORBI-28MAY03-CLUS49_157
cctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccattacgagttctatcgggtaaagccaatgattagaggcatcgggggcgcaacgccctcgacctattctcaaactttaaataggtaggacggcacggctgctccggtgagccgtgccatggaatcgggagctccaagtgggccatttttggtaagcagaactggcgatgcgggatgaaccggaagccgggttacggtgccaaactgcgcgctaacctagaacccacaaagggtgttggtcgattaagacagcaggacggtggtcatggaagtcgaaatccgctaaggagtgtgaaacctggagacgcccgagtctgccacttcctcaacaacgacgacgtcctctgggcgcccgctgcaactacacttgggacacagcaaggagcagccgaggacgtcgtcgtagctgcccagtagaggcagcagctaattaaaggatggtgcttgcatatatgcatgcacaccgtaccgcctacgcaagtattgttgttacatatgtgtgaaaataatacggctagctatcgatgcatgcacgcactcgcagtgtgattgagcttgctagctagctaatgtgattgtgcgggtgaaatttatgtatcgtatatgtaaagagcagcttgttgcatattactaataaattctgttttaaattataag

SEQ ID NO: 15260 - DNA, 1129 bp, Sorghum bicolor
  Clone ID: SORBI-28MAY03-CLUS49_158
gcacgaggaacgcgtaagaacctgcccttgggaggggaacaacaactggaaacggttgctaataccccgtaggctgaggagcaaaaggagaaatccgcccaaggaggggctcgcgtctgattagctagttggtgaggcaatagcttaccaaggcgatgatcagtagctggtccgagaggatgatcagccacactgggactgagacacggcccagactcctacagggcggatgagtggaacgtcaacaaatgggcatgggaaggggcgctcaaggttgtcagcaagggagaggaatgcatcattaaactggaagataagaacacaggggagctttatgctagggcatttctcagagagggtgaaccacatccggtggaacctgtaattgatagcagcagatattttgtactacgcgttgaagagaatatagatgggcgtcagcgtcatgctttcataggtttaggcttccgggaaaggcctgaagcatatgacttccaagctgctctacatgatcatatgaaatatttaaacaagaagaaggctgctgaagagatggttcagcattatgagaagcaatcatcagtggattacagcctcaaagaaggggagacattggttcttcagattaaaaataaagaaactggcaccaagacaaaatctgcattttttgagcaaggcctaaacaagctctcattgaacgaaaagacaaacaccaaggaggtccccgtctcccttaaactcccaccaccaccaccttcacctgtctctccaacggatcctggagtcgctgcttcgcctttcaaagcagaatttccgccccaagagcaaccagctgctgaacccatcagcagaaccagcgctctcccttccaaaggtgaacctactccggagctaccagctgctgcagagaaatcagagcacgaaaccgtggatgacgacttcggggacttccaggctgctgggtgatatcatgtatcttgtacatacagaatgttactgagactgcattttcattgtttggtttatcttttttcacatcagttgtgacttctgccggcactctgtgttcctgtatagagcttccatctcataacctatatacaaatacatggagaaacgttgtaccttt

SEQ ID NO: 15261 - DNA, 575 bp, Sorghum bicolor
  Clone ID: SORBI-28MAY03-CLUS49_159
gcacgagggcgggatgaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgaacgccatgccccgatgagtaggagggcgcggcggccgctgcaaaacccggggcgcgagcctgggcggagcggccgtcggtgcagatcttggtggtagtagcaaatattcaaatgaatcttcatatggacctaatcatgtttccatgtctgggtggattcgtggaagggatccaacaagactccttcattatgagggaggtggttccagaacatcatccacagatattgtgtgccccatgtatatgcgtgtctgggatattgttaagatagcaaaagatccatctgaaacaaggcctctaattctttgcgaatattcacatgctatgggaaacagtaatgggaatattgatgcgtattggat

SEQ ID NO: 15262 - DNA, 687 bp, Sorghum bicolor
  Clone ID: SORBI-28MAY03-CLUS49_160
ttaacggcctgccaaccctggaatcggttcagccggaggtagggtccagcggtcggaagagcaccgcacgtcgcgcggtgtccggtgcgcccccggcggcccttgaaaatccggaggaccgagtaccgtccacgcccggtcgtactcataaccgcatcaggtctccaaggtgaacagcctcttgcctacaattgtgagagcaaaaactgtccacacttcaggaaacttttcccagagtatgttgagaagtacaatcaactgcaacagttggagaacactgctgcagagccggtgcctcaggagaatcctgcacctgctccatcccctgctgtccagcaagctccggtggtggcaaatagggcgcaaccactggcggaggcgcgccgtgacaagaaccagaagaaggcagtgcccttctggatggtgctggtcatgttttcagtttttggtgccgtgatggcgttgcccttaatgcaactttgacaaaaataaagacaatgagaaggtgtgataccggggccgtaattttgtatagttttccattggtttgtgtgagtgtgactcagttgtcctttagactacctaccaccttggagtcatattgatgaatctatgatggtaacatctgtagaaccgttttctctcttttgactagtagcgtcagaagatcgttcgtattttgcttcc

SEQ ID NO: 15263 - DNA, 531 bp, Sorghum bicolor
  Clone ID: SORBI-28MAY03-CLUS49_161
attgctgtcaagtttgctgagcttgttcccaagattgataggcgttttggcaaggagcttgagaaggagcccaaattcctcaagaacggtgatgctggtatggtgaagatggttcccactaagcccatggtggtggagcccttttttgagtatcctccttttggtcgctttgctgtccgggacatgaggcaaacggtggctgttggagtcatcaagagcgtggagaagaaggccccaactggagccaaggtgaccaaggctccccccaagaagaaatgaggtgtttggctgatcctgtgtttttttgagggatccctagttggaactttaaatattgtcattcctgttattgcgggagcaattaaactgtgctggcaatgtttgtctggtcgatttagtactgttatttttgttaaaaccagggtgcttgccactaattttctgttatttttggatcgaacatcgggtgttagccaatggttttgagttttgttactctcgttatgtttccctgtttacatagcggttttt

SEQ ID NO: 15264 - DNA, 756 bp, Sorghum bicolor
  Clone ID: SORBI-28MAY03-CLUS49_162
cttctccacgcgcggcgtccgacctctgcagccccgggtgtccccgcgaccgccgctgctgccctacttcgccgcttgccaccttggccggcgacgagcaccaccaggacgccagcttaggttaaaatcaaaaaatattttgtcgggcgaataatacaaggcctacaccagaaggaatacccttgtgcggcaggcgaacagctgtctctatctctctgcagtgttatttggtttactatatgcagttgcaggggagaaaactaaagggtctgttcactgcagttagaagccgcagctgctgtacctgcagcaggcttcttctacagtatttacagtttagaaattgcatgcagctgcagagaacactcctaaacattatagtggagagagactttcgtgttgttttcatttagttgatctatgggcactaacctgcagatatatattataggtcaagaatgtattatcaggggcaagaacttgccctgatgacaactatttttttgtctttttattcacttctcctaatatttaacttttttgagtaagtgtgcagattaggtcttaaaaagggattgggattaagattttattgccagagctcgagctgtataattatccatttacacagtgggctgtacagggggtaaattcacaggaatattacttgatgatcgtataagatacatatgctgtgaactctctggtttgttttagctgcttgtgtttgtttttgtctacttaatcttgcacact

SEQ ID NO: 15265 - DNA, 925 bp, Sorghum bicolor
  Clone ID: SORBI-28MAY03-CLUS49_163
gtgctctctcagaggtgggttggcttctcctccccctccggttcggttcggttcgggttcgtcaggttcttcgggggttccggttcatgggtgagcggaagagatggcggcgtcggacgttgagtaccgctgcttcgtcggcggcctcgcctgggccaccgacgacaactccctccactccgccttcagcacctacggcgaggtcctcgagtccaagatcatcctgtcccgcgaccactccaagatcgcccagctggcagacaaatgtgttttggcctcgtctgggttccaaggtgatatcaaagctttgcagaaggctctgactgccaaggaactaatctatgaacacaacaataacaagaagatgagctgcccagcaatggctcaacttctgtcaaacacactctactacaagagattcttcccatactacgctttcaatgtgttggccggactggacacccaaggtaaaggatgtgtctttacatacgatgctgttgggtcttatgagaggacaggttatagtgctcagggaacaggttcagcgttgatgatgcctgttcttgacaaccagttgaaatcccctagtcctctcctactgccagctcgggatgcagtgacacctttgtctgaatctgatgcggttgatctggtgaaagacgttttcgcatcagccactgaacgagacatatacactggagatagattggaaattgtggtcatcaacagctctggcacacaccgagagtgcattgaactgaggaaggattagtgtaatgttcctgtgtaatcacactaccgttgttatgcatgaggatatttgttttttattgtcagatatctgtatttgaatttcctctaaacagaaagttgtattttgaatttccattctgttgattccagcaggagatggttataaagatat

SEQ ID NO: 15266 - DNA, 1428 bp, Sorghum bicolor
  Clone ID: SORBI-28MAY03-CLUS49_164
aaaaaaggtttccagtttccacgaaccaatctctctgcaaccgcaactgcaaccagggtttcgaaggaaggactagttgttttcctcttctacaaccaccacccgcacaagcaggcgttccccgtcacggccggcgcgctgctcggcgccggcgcgggcttcctctgggcggcgcagggcgccgtgatgacctcgtacccgccgcccaaccgccggggcacctacatctccctcttctggtgcctcttcaacctcggcggcgtcctcggcggcctgctccctttctccttcaactacaacagtggtgacgaccccaagaacgtcaacgacagcacctacatcgccttcatggccttcatgctcgtcggcgccgggctcaccgtgctcgtgctgccgcccgccaggatcgtccgcgacgacggcaccaaggccaccagggtcaccttctcgtccccggccaccgagggcgtcgagatcctcaagctcttcgccaactggaagatgctgctcgtgctcccggccgcctgggccagcaacttcttctacacctaccagttcaacaacgtcaacggcggactcttcacgctccgcaccaagggactcaacaacgtcttctactggggcgcgcagatgatcggctccgccggaatcggctacttcctcgacttcggattcgccagccgcaggaagagagggctggtcggagtcgtcgccgtcgccgtccttggaacggccatttggggagggggtctggcgaaccagctcaagtacagaactgtgccgttgctccaccccatcgatttcaaggatggccaccgctacgccggaccgttcctgctctacttcagctacggcctgctggatgccatgttccagagcctcatctactggatcatcggtgccctcgccaacgactcccaaatcctcagcaggtacgttgggttctacaagggagtgcagagtgcaggagcggcggtggcatggcaagtggacaagcaacacacccccctgatatcccagctgattgtgaactgggggctcatgaccatcagctacccattgcttgtgctgctggtgttcctggccgtgaaggacgaggactactctgtttcttcagtggaggaggacggcaaggagaaagatagtaagctgtcagcaccaaccagcttccactaaggatgatagatcacgatgttacgggtttttcatcaaagttgtagaaatcaagaaacaactgaagtacctatgcaaagaatatttagggtgtggcgtttttatgtatgtggattacctgatggggatgacagtattcgtttggtgattattactattctctccgtgttagattgagcatgcttgcatctactccttgtccgtggtgtaacatatgccatttttgagcaatgaaaggtttattatattcctgtc

SEQ ID NO: 15267 - DNA, 633 bp, Sorghum bicolor
  Clone ID: SORBI-28MAY03-CLUS49_165
tccgccaaagcaagcaggcacacacacacacacacacacacactctctatcctctcctcggcacccacaacgacatacaatggccaccgtcctgagcagcctccgcgcgccggcggccttctccgtcctccgcgttgcgccggcgccggcgccccccgccaccgtcgcgctgccggcgaccgtggcccgcggcgccaggctgcgggcgcaggccacctacaccgtgaagctggtcacgccggagggggaggtggagctgaaggtgcccgacgacgtgtacatcctggaccaggccgaggaggaaggcatcgagctgccctactcctgccgcgcgggatcctgctcctcctgcgccggcaaggtcgtcgccggcaccgtcgaccagtccgaccagagcttcctcgacgacgaccagatcgccagcggctgggtgctcacctgcgccgcctaccccacctccgacgtcgtcatcgccacgcacttggaggacgagctcaccgccggctcctaatcatgcatgcttatctctgttcgttattagcttcttattctttacgctcgttacctactgattgttgctttgcaattgcaattatcttattcatcatgtaagcgttgagttttcatccgtgg

SEQ ID NO: 15268 - DNA, 600 bp, Sorghum bicolor
  Clone ID: SORBI-28MAY03-CLUS49_166
atcactcaggtgacagaagaagcgaagcgtcaatccatccatcgcaaagcgaaccaggaaagcgcaaaagcaatctcttctctcgatttcgaatcgcgctcaggcgtactactacgctcgtcagctcgatttctagccttggtttgatttgagcgagggaaaagggagagatggcgagcagcaagggagagggtccggcgatcggcatcgacctcggcaccacctactcctgcgtcggggtgtggcagcatgaccgggtggagatcatcgccaacgaccagggcaaccgcaccacgccgtcgtacgtggccttcaccgacaccgagaggctcatcggcgacgccgccaagaaccaggtcgccatgaaccccaccaacaccgtcttcgatgccaagcgactcatcggccggcgcttctcggacccgtccgtgcaggcggacatgaagatgtggccgttcaaggtcgtcccgggccccgccgacaaacccatgatcgtggtgacatacaagggcgaagagaagaaattctcggccgaggagatctcctccatggtgctcaccaagatgaaggagatcgccgaggcgtacctcagcaccacca

SEQ ID NO: 15269 - DNA, 1009 bp, Sorghum bicolor
  Clone ID: SORBI-28MAY03-CLUS49_167
attctgcatccctcctcgtctctctcgccccctctcgctctccgacgactggtggacagccgccgccgccgccgccctaagccatctccctcgcagcgccgacgctcatctccctcgcagcgccgctcaggctcggtccctcagcgcagatcttctgctcctcccccactcgcgctcaggctcggtcccaaggatcggatcttccgcgcgtcggcggctccccctcggcggtgtccagcgacggaggggcagtcccaggctcggcggcggcgtcggcggctcccccatcgcctcgcgccctcgcctgcgtcctccgcgcaccggccgacgaccctgcgtacgcacctccctctcccctcccgcctctgctgttcccgtgggagcccggccagctgcccagggtggccgggccttggctccgctggttttagcgatcactggtagcgacttcatcaaagacattttgcaaaattatgcgatcttcatgggctgattcagttgcgaacgccgaggaatcggcgcccgcgactgtaactgctactgcccctgctgctaatcatcagaactcgcgccccaccctcagtgcatacgttcctccccaccttcgtggccgctcaggtggtcctctccctgagaacaaagcagcgcctgctgcagctcctgcaccagctgacgtaaggcctgctactgtgcagccttctggttacgcagctgttgttggtggcggctctcgctgggcaagccctgctgttggtggtagtggcggcggtggtggtagcgccatagttggtcctcgccagggtggtggcggtcgaggcggtggttggaactcccgacctgggtgggaccgtagagaccgtgaaccaaacccttttgccaatacagaggctgcagatgttgatttcgagagtcaggagaatacaggcatcaattttgacgcctatgaggatattcctgttgagacaagtggccatgacgtccctccgccagtcaatacctttgcagagat

SEQ ID NO: 15270 - DNA, 720 bp, Sorghum bicolor
  Clone ID: SORBI-28MAY03-CLUS49_168
gacttcaaagttaagaaatatgatttatgctgttttataatttaggaagatcttcaactccttcccccactcgcgctcggtcccaggcatcggagcggcccccactcggcggcgtccaccgacggaggggcagtcccaggctcggcggcggcgtcagcggctcctcctcccgcctctcgccagtcgcctcgcgccctcgcctccgtcctccgcgcaccggccggcgaccctgcgtacgcacctccctctcccctcccgcctctgctgtaccgtgggagcccggccagctgcccagggtggccgggccttggctccgccggtgactccaacgttcaagcatggggctactggcactgcagcggctcatgtccctgcagcgcgaccggcagcggcgtcaacgacaaacccgaaccccaatcctgaatggatggattgctgcttcatcactgggtaaaaggaagggctcttcctgtcaaaaagatgctcatggtgattctaaagttgccaaaagaatgagatgctcaatcccagcccttccggaggacatctggcgccatatacattccctattgccactgcgtgatgctgcccgtgctgcttgcttgtctcactcctttctacgttcctggaggtgtcatcccaacctcaccttaaatatgcatattcttggctcaaatgcaaatgtacctcgagagaattccagctgcataattgacaata

SEQ ID NO: 15271 - DNA, 735 bp, Sorghum bicolor
  Clone ID: SORBI-28MAY03-CLUS49_169
ctgcagtttctagagccctctctgccactcgtgatctccaccagccacgatgcctgccctcgccaagcccgcctcccgccccgccaagaccgccgcggcgccgaagccgaagcccgccgccgccaagccgaaggcggccgccgccggtgcctcccacccgccctacttcgagatgatcaaggaggcgatctcggcgctgaaggagaggactggctccagctcccacgccatcgccaagtacatggaggacaagcacggcgcgtcgctgccggccaacttcaagaagatgctctccatccagctccgcggattcgcagccaagcccaagaaggccgccgcggggaccaagcgcaaggcgcctgagaagaaggtcgtggccaagccgaagaagtcccccgccgccaaggccaaggccaagcccaagaccgtcaagtcccccgccgccaagaaggcccggaaggtcgccgcatgagatgggttgcttaggtcgtagtagctctgatcgtcgtgtggcgttggttaggagttgtacaaattaagcgtgtgccccccaaagtgtctctggtgtgttctgtcttaggcaagatctatctaccatggtttatttagtgtagcaaatggctaggctccttgtgatgccgacgtatccagttcttcctatatatgaaatcgacttggtttccgaaaaaaaaaaaaaaaaaaaactcgagactagtgctctctcttccctcgtgc

SEQ ID NO: 15272 - DNA, 811 bp, Sorghum bicolor
  Clone ID: SORBI-28MAY03-CLUS49_170
ccgggaacgcatcagcgtcagacacacgcagcggtccccacgcagcgcaccttctcttctccgccgcgtcgccgccgagggccgaacagcagcgtcggatcgatggagggctgggacaaggggaccaagagcacggtcggcgagatcccgctgctgtcgacgcgagcgggtccgcgggacggcgaggcgtggcggcagcggctcaaggaggagtaccgcgcgctcatcgcctacacgtcggtgaacaaggccaaggacaacgactggttccgcatcgccgccgccaacccggagggcacccgctgggaagggacctgctggtacgtccacaacctccgccgctatgagttcccgctccagttcgacatccccgtcgcctacccccaggtcgcccccgagatcgagctccccaccctcgacggcaagacccacaagatgtaccggggtgggaagatctgcctcaccgtgcacttcaagccgctgtgggccaagaactgcccgaggttcggtatcgcacacgcgctgtgcctcggcctcgcgccgtggctcgcggcggaggtcccgattctggtcgactcgggcatggtgaagcacaaggatgacgaggccgctccgtctgaggcatctgcctctgctcctccttcctagttgcaacttgcaacagctgagtgtccggtgagctaagggggtatcggaaatcaactcggcagtgattgatgaaccggcaaataaagagaaatacttgcgaatctaaacatcatgtgaaacatgtcccatacctgctgattgctgactgtgtgtactagtttcc

SEQ ID NO: 15273 - DNA, 932 bp, Sorghum bicolor
  Clone ID: SORBI-28MAY03-CLUS49_171
gcacgagggaaagatccgttgctggcgttcattgttaagagtagcgatctctccatacatactatgctagtccctctagagaaatttcagaagttaccaattgagacctaaagaccgacctgaatcatgcatccattggagctcttcctggtggtcttggttaccaccggtgccgcctctgcggtgtacagccatcctgccgccgctggtactccagcggcacggttttgggaggaggccctccctggcacacccatgccggaggccatcgccgacctcatccaacaaggcattgaccattcccctctcgtggagcatttcacttctagcggccacacccctgtcatgaacataaactacggctacggggcctacgccggcagctctctaatgaacgcagcagtgcccccaggctccttcttcctccagtctcagctgcgcgtgggaaccgccatgaccgtctcctccgagtcggcagctaccgtgccacccatcctcccacgcgacgtcgcccagaaggtcccattcagcaacctagcggacgtgctcgccgcgttccacatctcgccaagctccgccgaggcgacgacggtgagcgacaccctgagcctgtgcggagccccgccgtcactcgccggtgagcagaaggcctgcaccacgtcgctggaggacaccgtggagagcgccacgcacatgctcgtcgtcggcagcagcgttcgtcatggggtggtgtatttgtgggcggcctcgtcggcggcggcggtgccgccggcggcacaccaccaccagcagcagtacgttgtccaggcggtcacctcgctcgacggcgatcgccacgtcggctgccacgccatgccgttcccgtacgccgtctactactgtcacatgacggggcgggcgtccaaggagtacgcggtcttgctccgcggcgt

SEQ ID NO: 15274 - DNA, 943 bp, Sorghum bicolor
  Clone ID: SORBI-28MAY03-CLUS49_172
gccggccgggccggggcccgtgactttgcatttgcatccccgcccaaccaatcttcctcgttccgccgctcccactccagcggcgccggcggcgaggcgaggatctccacagcggccgcacctaccaacgtccaggagcaatggctctgtctgcgcctatacggatttctctcatcgtctcgttctttgggattctgtcgttcatacttggtgtcatcgccgaaaacaaaaagcctgcttctggaactcctattccaggaaaggatgtggtcatctgcaagtttccaagtgatccaactcttgcaatgggaagcctgtccattgtggcacttgttgtagctgccattgtaggccatgttgctatctttttcccatactcggacaagtcagttcctcgcggagcactgtttcaaagcaccagcttgacagtgttctttgttgttgctgagctcgtctcagccctggcttttgcaatgttgttgtgggcaactatcactgagggacttcaccgcagcaagaacatccaccacgacatgaattaccagtgccctactgcaaagaccggcctgtttggtggtgctgctttccttgcccttgacgctgctctcttctggcttgtttgccagatgctggccctcaatgcaagggctgactacctggacgaggatgacaacaagggcgaatatggccaggtttatgccgatgaagtcgatggctcgaaggtctgagcctatgcagtcatgcttgtcagggttttatgattagtgtcacttaactatattgtgtcatcaacaaagtcgctttagctctcgtaaatttgtatataagttggaaagtcttgcataaggctggtggttattctgcattttcaggtttcagtgtgatcaataaacagtttctcagtacaattggtttgctacttcccttggtgaactactgaacc

SEQ ID NO: 15275 - DNA, 894 bp, Sorghum bicolor
  Clone ID: SORBI-28MAY03-CLUS49_173
gcacgaggcttcgtcttcgccggccagggttccggcatggccttcagcaagctgacgagcggcggcgcgacgaccccctcgggcctgatcgcggcggctgtggcgcacgccttcgcgctgttcgtggcggtgtccgtgggcgccaacatctccggcggtcacgtgaaccctgccgtgaccttcggcgcgttcgtgggcggcaacatcaccctgttccgcggcctcctgtactgggtggcgcagctgctgggctccacggtggcgtgcttcctgctccgcttctccacgggcgggctggccacgggcaccttcggcctgaccggcgtctccgtgtgggaggcggtggtgatggagatcgtgatgaccttcgggctggtgtacacggtgtacgccaccgccgttgaccccaagaagggcagcctgggcaccatcgcccccatcgccatcggcttcatcgtcggcgccctcaaggcggcgttggctgagttcatctccaccctcatcttcgtcttcgccggccagggttccggcatggccgtcagctgggagtggggataccagtgggtgtactgggtcggcccactcatcggcggcggcctcgctggcgtcatctacgagctgctcttcatctcccaaacccacgagcagctccccaccaccgactactaagccggccgccggcgaccccccaccaagcttgggttccgttccgtgcgcagctagcagatcatcaattctctcgatctctggatctccccctcgccgtttagtttctctcgtgcatgtgcatgcatcgtcgaacatctcaagctgctactgctgctgctgcgccggccgccgctcgatacgtcgcatcgtttgcttttttggacaagtctgtaaccgtgaatcccg

SEQ ID NO: 15276 - DNA, 656 bp, Sorghum bicolor
  Clone ID: SORBI-28MAY03-CLUS49_174
atgcgaagcccgcatccgtcgtttcccccgcgtgccggcgtgtgctctccctctctccctcccccctctctgcaacggctggggctgggtggactacaacctccgccgcggccgccctacgccaggtgccgaggacttcgccggtctcttcgccggcgacgagcaccactaggcattatctccctcgcaccgccggctccttgagcgcagggccgacgctcatctccctcgcagcgccgctcaggctcggtccctcagcgcagatcttctgctccttcccccactcgcgctcaggctcggtcccaaggatcggatcttccgcgcgtcggcggctcccccctcggcggcgtccagcgacggaggggcagtcccaggctcggcggcggcgtcggcggcttcccccaccttctctcgccagtcgcctcgcgccctcgcctgcgtcctccgcgcaccggccgacgaccctgcgctgagctgactgtcccattcaataaagaaggcgataccagaagcaacactgaacccatcttactaaacccagttttggagttctatctgctgttggaacaacttacacagatatcatggcaaaccttgctgattcttttctagcagatctggatgaactgtcagacaatgaaggctatcctgaagaa

SEQ ID NO: 15277 - DNA, 1109 bp, Sorghum bicolor
  unsure (1)..(1109): unsure at all n locations
  Clone ID: SORBI-28MAY03-CLUS49_175
gcacgaggggtacctctccctcagcgcagactgctccttcccccactcgcgctcaggctcggtccaaggttcggatcttccgcgcgtcggcggcgtccagcgacggaggggcagtcccaggctcggcggcggcgtcggcggctccccccaccttctctcgccagtcgcctcgcgccctctcctgcgtcctccgcgcaccggcagacgaccctgcgctttgcaggcattgatttgcatctacaatgtctcaacttggcacatgctcattgccaggagctgcaacctatggcacttcaattaggagatttggaggttcgaaatttcagcagcctaaagctaatcacatctcatttggtcagaaagtatctgctaaagcaacattgagaattatgagatgcaacgctactcaaactcaaacacaaagcgtccaaaagaaatcttcaagtgcaactctgcaacgtgataagaaagggaaagtccaggggccaaaactggatgacgggagcggcgggttccctccattccgcttcggcaaaggtgggggtgggggtggaggcggcgtaggtggcagcaactactttggcggattccttctcttctcatgcgtgttgctcttagactacctgaaggaattcgagaagtacttgcttgctcagaggcaccgagctggagatgatggcggcaatgggctgctgcaggcatgatttgcctttcggcagtctcactagcactagctactggtttctgatgtgaagagtgcttcatgtgactctggcttaaatccaactgcggcgatcatacaatgcaagtgcaattgattgtactgggaactttcactgcagcttgctctgccattttatccgtgtggtgtccagtactgtggaaatcgcttgcctcattcccttgaactttcacaccttgtctcgagcaaggttcattggaacacacagtggtcaaaacttcaggctcttcgctggaaacttttttttttttttgttgttggtcacaataagtagaacaccttcctgggatgttagaaagttcattccatatgtatgtctaatccatcagttattaaaggtaaaaggacactataattcatntgtttg

SEQ ID NO: 15278 - DNA, 564 bp, Sorghum bicolor
  Clone ID: SORBI-28MAY03-CLUS49_176
gcacgaggggaccacccgctgagtttaagcatataaataagcggaggagaagaaacttacaaggattcccctagtaacggcgagcgaaccgggaccagcccggttcgtctggtgccctacaaccctgagtacgtggacgagtccgtgctgtggactgagagccgcgacgtcggccacggcttccgctgcgtgcgcatggtgaacaacatctacctcaacttcgacgccttccatggcgacaaggaccatggcggcgtccacgacggcaccaccgtcgtcctctgggaatgggccaagggcgacaaccagcgctggaagatcctgccctggtagatatgaagccatccaatcgcggcgttgagaagatcgaccggagaaactttaccttgctgccgtctccgtcctccgctccatgtcgttgatcgagtcgttctagttattatctttctgttttcgcgtcggttcctgaatgaacagtaataatataggagtactagttgttgtccatcagcgtgcgaccatgtctgaatctgatcgtatcttgctgggtgcgcgctgctgcta

SEQ ID NO: 15279 - DNA, 1053 bp, Sorghum bicolor
  Clone ID: SORBI-28MAY03-CLUS49_177
gcacgaggcttgctttatattcgttctcggctccgatctccgtccatccagtcgtcttggggcagccaagaggtagagtgcgcgtggatcttttcgtggaagggatgaagattacggcgctcctggtgctgaagccgtcgacctccggagccgggagctcctcgtccggcggcgagtcgggcccggaggcggtggtgctcgcgaacgcgacggacgtcagccacttcggctacttccagcgcagcgccgcccgcgaattcatcgtcttcgttgcccgcaccgtcgctcagcgcacccagccaggccagcggcagtccgtccagcacgaagaatacaaggtccactcccacaacagaaatgggctttgtgcggtggcattcatggatgatcactatcctgtacgaagtgcattttctctcctgaataaggttcttgatgagtaccagaaggcttttggggactcctggaaatctgctactgcagatggaactcaagagtgggctttcctgacagatgccttgacaaaatttcaggaccctgcggaagctgacaaattaatgaaaatccagagggacttggatgaaacaaaaattatacttcataaaactattgagagtgtccttgccagaggagagagattggatagcttggttgagaaaagctctgatctaagtgctgcttcacagatgttctacaagcaggcaaagaagacaaactcatgctgcacaatactttaaactttggcgcttccatatcatggttgcaagaaaaaaacggtcgatattgtgctaatttattgtaagttaagtcgcccatgaagcgtggatacgtggttgcaaggctcgagctcagtgctattggtctcagtttggaaggctgtagttttctccaagacctaccagaattgtaccgttttcttacgagaattccagctctcccaacaggccagggactttcatcattctttagtgatgaaaccttgtagcacccactaacaccattcattgtactatataaggcttgcctcaaactgcagaagttatcagtactgtt

SEQ ID NO: 15280 - DNA, 842 bp, Sorghum bicolor
  Clone ID: SORBI-28MAY03-CLUS49_178
cggccgggtacgagaccgcgatctccaagcacattttcttgttccgagccaccgagcccaaatcacccgccccctcctgacctcctccgctcccaatcctacccaccgcgatggcccgcacgaagcagacggcgcgcaagtccaccggcggcaaggcgccgaggaagcagctggcgacgaaggcggcgcggaagtcggcaccggcgaccggcggcgtgaagaagccgcaccgcttccgcccgggcaccgtggcgctgcgcgagatccgcaagtaccagaagagcacggagctgctcatccgcaagctcccgttccagcgcctggtccgcgagatcgcgcaggacttcaagaccgacctccggttccagtcctccgccgtcgccgcgctgcaggaggccgccgaggccggttccgtcgccctaggggagggagagcaggccggtgaggtctccgtcgcgcttgcctacgatggcgcgggctttgacgccgccgtgtacatgagcgcgctccgggcgcgccggtttgggaggtggatgctctggacgcccaggattggttccacgcaggatcttatcgcgcggaactttgcaaagctcccggtgcgcgttgtgtgcgttgccgacgtgcagttcaaagggagaggccgttcaaagaatgtgtgggaatccgcaccaggctgtctcatgttctctttcacatcacagatgcaggatgcacggaagttgccccttatgcaaaagttgtttgtccttccataactcaagctatccaggagctatgccgtgccaagggactaccagaacttgatgtgaggataaaatggccctatgaactctatctgg

SEQ ID NO: 15281 - DNA, 452 bp, Sorghum bicolor
  Clone ID: SORBI-28MAY03-CLUS49_179
gcacgaggcgcgatagtaattcaacctagtacgagaggaaccgttgattcacacaattggtcatcgcgcttggttgaaaagccagtggcgcgaagctaccgtgtgccggattatgactgaacgcctctaagtcagaatccaagctagcaaccggcgggctgaatcctttgcagacgacttaaaacgcgacggggcattgtaagtggcagagtggccttgctgccacgatccactgagatccagccccacgtcgcacggattcgtacagattcgattctatttgcatggtgtggtggcgttcttggagcttctggaattgggattcccgtagtgggatttgatttctagaggaaataaagcaatggcgaccgcggggaaggtgatcaagtgcagagccgcggtggcatgggaggctggcaagccgctgtcaatagaggaggaggaggtggcgc

SEQ ID NO: 15282 - DNA, 718 bp, Sorghum bicolor
  Clone ID: SORBI-28MAY03-CLUS49_180
ctgacatgcgtgcgagtcgacgggttctgaaacctgggatgcgcaaggaagctgacgagcgggaggccttcacgggctgcaccgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccataactacaagggcacgacgatgatgttgaatgacagaattcagagcctccgtgggctccagtcatcccttagaaaggcagaagagtatctactgagtgtccctcaagacactccctactcagagttcaaccataggttccaagagcttggcttggagaagggttggggtgacactgcaaagcgcgtacttgacacactccacttgcttcttgaccttcttgaggcccctgatcctgccaacttggagaagttccttggaactataccaatgatgttcaatgttgttatcctgtctcctcatggctactttggttcctttttgcgagtttttgggcagcgctggctggttcctattataggaattagctgtgacttttgcttcaaataaaagcctgctcgtctc

SEQ ID NO: 15283 - DNA, 699 bp, Sorghum bicolor
  Clone ID: SORBI-28MAY03-CLUS49_181
attgctgtcaagtttgctgagcttgttcccaagattgataggcgttctggcaaggagcttgagaaggagcccaaattcctcaagaccggtgatgctggtatggtgaagatggttcccactaagcccatggtggtggagcccttctcggagtatcctcctcttggtcgctttgctgtccgggacatgaggcaaacggtggctgtgggagtcatcaagagcgtggagaagaaggccccaactggacccaaggtgaccaaggctccccccaagaaggaatgaggtgtctgtctggctggttctgtgttttctcgatggatccctagttgaaacttaaaatttatcgtcattgctgctatcgacgtgagcaactaaactgtgctggcaatgtttgtctggtcgatttagtattgttattttcgttaaaaccagggtactattaagactcaatttctgttaatttttgtatcgaacatcgggtgttggccatatgtggttatgagttttgttactaaaaaaaaaaaaaaaaaaagggcgaccgctcgcgatctagaactagtcccgtgaggcgccgcctgccccgcacctgggcggggaggtcaccgtcaacaagagccgcttctgcttcccgcccaactccgtcgccacctccggcggcgtcttcgccggcgaggacccgctcaagttctactttccggttct

SEQ ID NO: 15284 - DNA, 556 bp, Sorghum bicolor
  Clone ID: SORBI-28MAY03-CLUS49_182
cgggcgcaagtgaaataccactacttttaacgttattttacttattccgtgggtcggaagcggggcatcgcccctccttttggctctaaggcccggccttgccgggccgatccgggcggaagacattgtcaggtggggagtttggctggggcggcacatctgttaaaagataacgcaggtgtcctaagatgagctcaacgaggagattgccgaccgcgtcaacaagatgcttgcggtgctcgacaccaacatcctctgggtgaaccctgactgtggtctcaagacccgtaagtacgcggaggtcaagcccgccctaaccaacatggtctctgctgccaagctcatccgcacccagctcgccagtgccaagtgaggactgtcgtctccgccatggcctattcctttaattacaaggagggtgtcatcgaagccatttgtttccaataatcagggtcccctgttcccgttctgctccatctgtttttagattagtatttttcttggctcgatgatcgccccaggcaatacctgttttactccatttggtgggtcagag

SEQ ID NO: 15285 - DNA, 701 bp, Sorghum bicolor
  Clone ID: SORBI-28MAY03-CLUS49_183
ccggggcgaccgcgacgaagctttagctgcagagcgcccgaccaaacctttcgcggccaaattccccaccggtcctccgatcaagccgcgctaggctagggtttcctcgcgcagcgacgcgatgccgaagaacaaggggaagggaggcaagaaccggaagcggggcaagaacgaggcggacgacgagaagcgggagctggtgttcaaggaggacgggcaggagtacgcgcaggtgacgcggatgctgggcaacggccgctgcgaggcgctctgcatcgacggcaccaagcgcctgtgccacatccggggcaagatgcacaagaaggtgtggatcgccgccggggacatcgtcctcgtcggcctgcgcgattaccaggacgacaaggccgacgtcatcctcaagtacatgaacgacgaggcccgcctgctcaaggcctacggcgagatccccgacaacgtcaggctcaacgagggcgtcgttgacgaggaggacgccggcgcgcaggatgactatatacagttcgaggacgaggacatcgacaagatctgatcatccgcctcttccacgcacggtccctttccatcctctgctgcctcggcccggccatggtggtaaactaaacgtatgtataatacgtataaaacaaatgtatcattctgttcttgactttttgtgacggttaccattctctctacctctt

SEQ ID NO: 15286 - DNA, 1371 bp, Sorghum bicolor
  Clone ID: SORBI-28MAY03-CLUS49_184
cgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggctgagactgaaggaaaaactgttgaagccaagaaaccaattgttgttaagtatggccttaaccatgtgacttacctcattgagcagaacaaggctcagcttgttgtcatcgctcatgatgtggatccgattgaactggttgtgtggcttccagccctgtgcaggaagatggaggtcccttactgcattgttaaaggaaaggctcgccttggatcgattgttcacaagaagactgcatcagtcttgtgtctgaccactgtcaagaacgaggacaagcttgagttcagcaagatcttggaggctattaaggcaaacttcaacgacaagttcgatgaggtgaggaagaagtggggaggtggtatcatgggctccaagtcgcaggccaagaccaaggctagggaaaagctgatcgccaaggaggctgctcagcggatgacctagattatccacttctgagtgtgccctgtagtttgacgcggaagaactgataatcgttgtgcactcgtattgtggttttctgaatcaagtttcatatgtttctgtccaccagaccatgtttagaaactttgcaagacagatgttacagtgtttatgcgatgtctcagctagtaaaaaaaaaaaaaaaaaaactcgagactagttctctccacgcagactgcatgcgatccccggaccccagcacgagatacatacaccgatggcgttcatcagcaacgacgtcgtggcgatgaaggcggcggccgtgtccgctctgctggtgttcgcggcggtggcgtcgaccgccgcgggcgcgccggcagtggcggtggcggaaggcgcggcgtcgatgcccgcgggcccgctggacatagggcagctgggcgccaagggcgacagcaagtcggacagcaccccgatgatcctcaaggcgtggaagaacgcgtgcgacgcgaccggggtgcagaagatcgtcatcccgccgggcaactacctgacgggcgggctggagctcaagggcccctgcaagtcctccatcatcatccgcctcgacggcaacctgctcggcaccgtcgacctcaacgcgtacaagcgcaactggatcgagatcgagaacgtcaacaacctgtccataaatggccactggaccatcgacgggcagggctccttgttgtgg

SEQ ID NO: 15287 - DNA, 882 bp, Sorghum bicolor
  Clone ID: SORBI-28MAY03-CLUS49_185
tgaagaagcgaagacaaaattttgaatgcacatatatgcatgtgtatatatatgaagctatcagcagcgtgctgttatttcacaaacacagtgcacaatgactcctttaatctacacaagccagcagcatcctgccagcaatgtatctgcttcattcatcctgctgttggcgacccactcaatgagcgagcgcaagtacttggccacggcgcccctctgccaccggagcctcttccacctgctttttagaagcacagggtgcagccccaggatgtgctccggcatgaagtcatgcctcgtcaagatgcccaccaccggcgacctatcgcaggccttgggcacgacgaggaggtggcgcagaccgacctcccggaacagcacgagcgcctttgccagcgacatggtctcgaccaccgtgtacggcgacgtgttggtgaaggggtgaaggtcgacgtacatctccatctcctccggcgacagcaccacgtcggcgatggcgtcctgcttcccggacccgcgcttgtcgaagtcctccgcctggaacctcccggccacgtactccttccggcaccgctcgggcgccgccaggaactccctcttcttgagcagcaccagcaggtgcgcgcgcagcaccaggccgtagagcaccggcggccccggcgagaatggcggctcgtcgacgacggggaacgcgtggtgccccgtggtccgcagcgtgtgcacgacgctcccgaccttctcgacgccgccgaagctccgcagcgggccggccaccacgtcgccgacggtgagctgccgcatgtacggctcggcgtggccgtcgaggtgcggcaggcccttgaggcgcaggatgaggtcgtagatgctggagttgaaggagtc

SEQ ID NO: 15288 - DNA, 499 bp, Sorghum bicolor
  Clone ID: SORBI-28MAY03-CLUS49_186
gcacgaggggcggtggaaactaccaagctggagtacggtaggggcagagggaatttccggtggagcggtgaaatgcattgagatcggaaagaacaccaacggcgaaagcagagatgaattcgccgccacagcaatcatggggtgcttcaccaggatcttggggttcacagtagatgaagtaatatcatgagagcccctatccagcctggggctcagggctcacagcaggttgagaggctgacaattcagcatctaattcatagatatattgtgagtggtgtcccaggtgtgaatgcccttaccgttccaatattcctaccgtgtttgggtggtcgtttgctcgcgtccatgtgttccacatgaagtggtagttgtagtagtagatctggatacggaccaaaacaaatagcattactgtcaatctgcaacagtcgagaaaacagtcgaaaacctttgcgaataacgccagttgttgtgctaaaaaaaaaaaaaaaaaaaa

SEQ ID NO: 15289 - DNA, 995 bp, Sorghum bicolor
  Clone ID: SORBI-28MAY03-CLUS49_187
actcatccatccatcctcggatcggtcgatcagccagccggtccgtcgtcgtcccaacctccatccctcgatcagcttctggaaaattaaggaaagcatgttcgggcaccaccaccaccatggccacggcgggcacggccaggccccgccgccaccgccgccgcatgagcagacgctgtacaagatcttctgccgcgccgacgaggcgtactgcctcacggtgcgcaacgacaccgtcgtcctcgcgtccaccaaccctcgcgacgaatcccagcactggtacaaggacatgaggcacagcaccaaggtgaaggacgcggagggccagccggcgttcgcgctcgtcaacagggccaccggcctcgccatcaagcactcgctcggccagtcccatcctgtgaagctggtgccctacatcccggactacctggacgagtcggtgctgtggacggagagccacgacgtcggcaagggcttccgctgcatccgcatggtcaacaacatccacctcaacttcgacgccttccacggcgacaaggaccacggcggcgtccacgacggcaccaccgtcgtggctctgggagtgggccaagggacccaaccagagctggaagctgctgccctggggcgacgaggcctacaacgcgccgcgcgcaccaccaggagggccgtacccaccgcctgcagcccagccggagccagcctacggcgggtaccggcccccgccgggcggcccagctgccggtggctacgcgccgccaccaccagggccgtacccaccgcctgcaccccagcaggagccaggctatggcgggtaccgtccccagccgcctgtgcacgagcctggctacagcggctacccgccggctccgggcaaccctgccccggggtacgggccccccgccgggtacgggtacggcaacctgcctcgcgtgctcgcgtctgagcccaccgtgcgcgtcttctgcaaggccggcgacgggtacagcctcacc

SEQ ID NO: 15290 - DNA, 712 bp, Sorghum bicolor
  Clone ID: SORBI-28MAY03-CLUS49_188
gcacgaggagcaaatcgacacctctccaagcccaccgccgcctcccgctcgccgtcctccgcgccaagccccaaagctcccccgatggcccgcacgaagcagacggcgcgcaagtccacgggcggcaaggcgccccgcaagcagctggcgaccaaggctgcgcgcaagtcggcgccggcgacgggaggcgtgaagaagccgcaccgcttccgcccgggcaccgtggcgctccgtgagatccgcaagtaccagaagagcacggagctgctcatccgcaagctcccgttccagcgcctcgtccgcgagatcgcgcaggacttcaagaccgacctccgcttccagtcctccgccgtcgccgcgctgcaggaggccgccgaggcgtacctcgtcgggctcttcgaggacaccaacctctgcgccatccacgccaagcgcgtcaccatcatgcccaaggacatccagctcgcgcgccgcatcaggggcgagagggcctgagcgaggcgacctcctcctcccactgaagccgtcgtcgtcgtcgtcgtcgtcgtcgtttgttgcttcttgcctgctcgtaggatttgtgctttgccttgtttccttctggtggcactggcatgctggtaacattatgcttgttcgtagtcctagagggttgttcagttgctgggtaacctgcttgtttatcttgcactgatgctgatgtaatggtggt

SEQ ID NO: 15291 - DNA, 679 bp, Sorghum bicolor
  Clone ID: SORBI-28MAY03-CLUS49_189
tcggtacctctccctcagcgcagactgctccttcccccactcgcgctcaggctcggtcccaaggatcggatcttccgcgcgtcggcggcgtccagcgacggaggggcagtcccaggctcggcggcggcgtcggcggctccctccaccttctctcaccagtcgcctcgcgtcctcgcctgcgtcctccgcgcaccggccgacgaccctgcgtacgcacctccctttcccctcccgccgctgctgttcccgtgggagcccggccagctgcccagggtggccgggccttggctccgccagtggtaatcgcctgtgatggattacttgaaatcttgctgggggccggcatcaccggccgggcgcccccgcagaggatcggatgccaccgggcgccaagacgggctcctgtggtacaaggacggcgggcaggtcgtagatggtgagttctccatggccgtggtccaggccaataacctgctggaggaccatagccaggttgaatccgggccgctgagcacatcggagcctggactgcaaggcaccttcgtcggggtctatgatgggcatggtggcccggagcgggcgcgtacatcaatgatcatctcttcaccacctgaggagattcgcatctgagcacaggggcatgtcagcagatgtgattccgaaggcattccgagcgact

SEQ ID NO: 15292 - DNA, 619 bp, Sorghum bicolor
  Clone ID: SORBI-28MAY03-CLUS49_190
ctctctcagaggtgggttggcttctcctccccctcttaccaagtcctcgtcctcggtttagggttcgttagggtttttgtggaggggagatatggcggcggcggacgtggagtaccgttgcttcgtcggtgggctcgcctgggccaccaacaacgagaccctcgagcatgccttcgccaacttcggcggctacggcggtcgccgtgagggcggcggcggctatggcggcggcggcggctacggtggcaaccgcggtgactccggcggcaactggaggaactgattgtgtgggcccaccctggcttcggccaagttatcctagctatctatctatctatagtatcgtgttaccgttccgttggattctgagttacccatgtgttagtgtccgttgaacctttggattaggtgttggtacccccgtgttcgatgatgttactgtccgctttggttactttccgctatgaaatgagagaagagtgagcaaggtttttgttcgcatctactgatctgaaattgctctgttcccgtgtttgattgagctcgttaataactttggctgcggctttagtgctaaaaaaaaaaaaaaaaaaaaaaaaaaaaaaaaaaaaaaaaaaag

SEQ ID NO: 15293 - DNA, 945 bp, Sorghum bicolor
  Clone ID: SORBI-28MAY03-CLUS49_191
gcacgagggttcgatcctggctcaggatgaacgctggcggcatgcttaacacatgcaagtcgaacgggaagtggtgtttccagtggcgaacgggtgagtaacgcgtaagaacctgcccttgggaggggaacaacaactggaaacggttgctaataccccgtatgctgaggagcaaaaggagaaatccgcccaaggaggggctcgcgtctgattagctacttggtgaggcaatagcttaccaaggcgatgatcagtagctggtccgagaggatgatcagccacactgggactgagacacggcccagactcctacgggaggcagcagtggggaattttccgcaatgggcgaaagcctgacggagcaatgccgcgtggaggtggaaggcctacgggtcgtcaacttcttttctcggagaagaaacaatgacggtatctgaggaataagcatcggctaactctgtgccagcagccgcggtaagacagaggatgcaagcgttatccggaatgattgggcgtaaagcgtctgtaggtggcttttcaagtccgccgtcaaatcccagggctcaaccctggacaggcggtggaaactaccaagctggagtacggtaggggcagagggaatttccggtggagcggtgaaatgcattgagatcggaaagaacaccaacggcgaaagcactctgctgggccgacactgacactgagagacgaaagctaggggagcaaatgggatttgagtaccctatgaccgaaaatgcataaagatgatgccctggatatctccatttcatttcgttgaatctggatgttttgttggggtctcaactagtttgctccctatgtacttcaaaaaccatagttttgatgccaaagttgcctaggaattcggtactctggaatttgccgtggacgtgaacaatgttaagttttgagcatttaaattaa

SEQ ID NO: 15294 - DNA, 735 bp, Sorghum bicolor
  Clone ID: SORBI-28MAY03-CLUS49_192
gcacgagggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgaacgccatgccccgatgagtaggagggcgcggcggccgctgcaaaacccggggcgcgagcctgggcggagcggccgtcggtgcagatcttggtggtagtagcaaatattcaaatgagaactttgaaggccgaagaggagaaaggttccatgtgaacggcacttgcacatgggtaagccgatcctaagggacggggtaaccccggcagacagcgcgatctcgcgtgttgcccgaaagggaatcgggttaagatttcccgagccgggacgtggcggttgacggcgacgttaggaagtccggtgtcaagacttcttcgatgcaccgtgttccttcgcctaccccatccgcatctatcggcgccggccatggctcttcgggctctggcgccgcttctggtgctgctcctggctcttcaagcgttggctcctcgggcgccggcagctcctcttcgggcctgccgctcttcaacgcggctggtcgggcctctttctccagccttgccgttgtcatcggcgcccttttcgcagccttcatgcacatctaa

SEQ ID NO: 15295 - DNA, 958 bp, Sorghum bicolor
  unsure (1)..(958): unsure at all n locations
  Clone ID: SORBI-28MAY03-CLUS49_193
gcacgagggtgaactatgcctgaatagggcgaagccagaggaaactctggtggaggctcgcagcggttctgacgtgcaaatcgatcgtcaaatttgggtataggggcgaaagactaatcgaaccatctagtagctggttcctgccgaagtttccctcaggatagcagtaacgcaaaatcagttttatgaggtaaagcgaatgattagaggcattggggttgaaacaaccttaacctattctcaaactttaaatatgtaagaagcccttgttgcttagttgaacgtgggcattagaatggagcgttactagtgggccatttttggcaagccatctgcacgcgctacgggctcagcgtgggggccaaggcggcgcccgtggtccgcgtactgctcatccttttcttccctgtcgcctacccgatcagtaagttgttggactcgctactgggaaagggacattttgcactaatgagaagagctgagctaaagacattagttgatatgcatggcaatgaggctggaaaaggtggagagctgactcatgatgaaaccactatcattacaggagctctggagctgactcaaaagattgcaaaagatgccatgactcctatatctgagacattctcacttgacataaatgctaagctggacttacacacgatgggtatgataatgactagagggcatagtcgtgttcctatatactctgggattccaagcaatattatcggccttatattggtaaaaaacttgattacttgccgagctgaggatgaagtgcccattcgtaatgttactatcagaaaaattccaagggtggctgatgatcttcctctctatgacattctaaatgagttccagaaaggtcacagccacatggctgtggtagttaaacgaacaaaggaatcangagcatccactgaanagcaaaagagcacaactgcagattataaaa

SEQ ID NO: 15296 - DNA, 1036 bp, Sorghum bicolor
  Clone ID: SORBI-28MAY03-CLUS49_194
gcacgagggcggaatcacagtccagagctctaaccaggccatgtcgccggcgtccctcgccgctcggctcctacgccgcgccgctaccacctcttcctctcctctctccgctcttgcccgccgcggcatccgttcctcggcgcccgttccactcccacgccgtctccctgccgccacctcatcgtcggctgggaccaccgcccgccgcttcctggcgtcgcagtccccggcgtcctcctcttcctccaagtcctccgcggacgagaacctgaggcgcgtcatcgagtctgagatcgagtgcgttgtccagtcggaggagagcaccgccgacaagcacattgatctaccagatgacttcccttttgagatcatagacaatcctggtgatcagacaataaccctccaaagggagattgcaggggagacaattaaagctgctatatacaccaactttgatacagaggaagatttggatgatgaggatgataagagtgacaaagatgaggaatctttcaaaccagcaattcaaatggttatcactattcaaaaaccagaaggtccaatcctagaatttgactgcaactttaatgatgacgaactagcaattgaaaatatgagggtggtgaaccgtgataaccctgatgctgaaaatgtgtatgaggggccacgatttccggtcttggatgagagcttgcagaaggccttgcacaggtaccttgaggtcagggggttcaaacattcactacatgactggctgtacgagtacatgatgagaaaggatgagaaagagtatgttgtttggttgaagaacatgaaggagttcatcggggcaaattgagtgtttgtagtttgttttattcgcattgtgagaactaggcatgtactcatcatgaaatcctaccatcataattgcgcaaagatacatggcatggccaccttgtttagttcctctcctaaagtttagtctctattatattggatgtttggacacatgcagtattaaattgacttaaaaaataactaattacacggatgc

SEQ ID NO: 15297 - DNA, 975 bp, Sorghum bicolor
  Clone ID: SORBI-28MAY03-CLUS49_195
ctactggaatccccccgtcacctacctccgtccccagatccgcctcctcctccttccctgcctgcctcccccccttccagatctcccgcccactccagagtcgagatccaccgcctccccgccccctcaccggagcagagcagcgcgagggagcgcgggacagaggccagccatgggcaaggaaggggccagcgccggcggcggcggcggcgacggcggcatgtcggagtcggtgatccgcaaggtcctgatctcgtacatgtacgtggcggtgtggatcttcctctccttctccgtgatcgtctacaacaagtacatcctcgaccccaagatgtacaactggcccttccccatctccctcaccatggtgcacatggccttctgctcctccctcgccgtcgcgctcgtccgcgtcctccgcgtcgtcgacctcccgtcctcccccgccatgacgtcgcagctctacgtctcatccgtcgtccccatcggcgcgctctactcgctctcgctctggttctccaactccgcctacatctacctctccgtctccttcatccagatgctcaaggcgctcatgcccgtcgccgtctactccatcggggtgctcttcaagaaggagaccttcaagtcctccgccatgctcaacatgctctccatctccttcggcgtcgccattgccgcctacggcgaggcccgcttcgacgcccgtggcgtggccctgcagctcgccgccgtcgccttcgaggccacgcgcctcgtcctcatccagatcctcctcacctccaagggcatctccctcaaccccatcacctcgctctactacgtcgcgccctgctgcctcgccttcctcgtcgtgccctgggtcttcgtcgagttgcccaaactgcgcgaagtcggcagcttccagccggacctcttcgtcttcggcaccaactcgctctgcgccttcgcgctcaacctcgccgtcttcctgct

SEQ ID NO: 15298 - DNA, 1117 bp, Sorghum bicolor
  Clone ID: SORBI-28MAY03-CLUS49_196
cggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgaacgccatgccccgacgctccacggcgacgtcaagccggacaacattctgctcggcgacggatgggtcgccaaggtgtcggactttgggtgctcaactatcaacgacaacgtgcaggtggtgcccaagggcacgctggcctaccttgaccctgagtttctgcaggaccgtcagataaccgagaagaccgacgtctacagcttcgggatcgtcctgattgagctcttgactggtaagaacccactggccgaagaatggaagaagctgaccgtgatgtttcagaacagcatgagaaatggcacccttggtgatcttctagacgctgacatagtcgaggaatggagcatgggactgatctatgaagttgcgaagctagtgagccgatgcatcgctgctccgggtaagacaaggccggacatgcgacaggtcgctaaggagcttcggggattttccgatgaaatgccagaaagctctgaggcgcgagtggctctcgggtttgaggatcgcagcaggtatagctacaccgccactgagggcgaaactactggattttctaatcttagtgcactgagcacagaactcgccagatgataggaaatcaggttttaaatagcgggctatagtgtgcttagctgcttgagagaggccacactaagctattgctatttttgctactatgccagttaagaccactgcattgcactttattagcgctctaaattgtataattctagctttgaaataacgcgctacttcaatcttagctttaatagtgaccgatctagttattacaataattatattttgtttcaatgattgttttttggaaacttgaacaattgaatttcaggaatcttgttatagtatcatatgttgtaaagtttcctaaggctccgaaacctttgaactatatttgtgcccagc

SEQ ID NO: 15299 - DNA, 438 bp, Sorghum bicolor
  Clone ID: SORBI-28MAY03-CLUS49_197
ggccgccgcacaccgggagaagccgacgctccgctaccgtatccgcggatcagcggcgagccgtaaccacgccacactgcttgccacccgacgagcagggtaacagttcccttcagccatgggtaaggagaagactcacatcaacattgtggtcattggccatgtcgactctggcaagtcgaccaccactggccacctgatctacaagcttggcggtattgacaagcgtgtgatcgagaggttcgagaaggaggctgcggaaatgaacaagcgttcattcaagtacgcctgggtgctcgacaagcttaaggccgagcgtgagagaggtatcacaattgatattgcgctgtgaagttcgagaccaccaagtactactgcactgtcattgatgcccctggacaccgtgacttcatcaagaatatgatcactggtacttcc

SEQ ID NO: 15300 - DNA, 1189 bp, Sorghum bicolor
  Clone ID: SORBI-28MAY03-CLUS49_198
ggctgatgaccctgactggtgtatacggattctggaagtatgtgagcaacctggagaggcgtgagacccgccgctaccttgagatgttctatgcttcgttcgcggaacaaaaaaaaaagtgagccggaccgaccgacgacccagccgagcccacgagagggaggcgctgcttgggctgtcggagccgcagcaggtcttgctccggccagccacggcggcatcggcatcggcatggcggggcggatggtgcggagctgcgtgcagacggcgctcaaggcggccaactccgtcgtggggcttgccggcatggccgtcatcctctacgcgctctggatgctccgcgcctggtacagggaggtcgccgaccaccacctccaccaacgcctcccggtcccctggttcatctacgcttttcttggcctggggatctttttgtgcctgttgacttgctctgggcatattgccgctgaaactgcaaatggtcactgcctctcttgttacatgatcatcgtatttgtgcttattatactggaaggcacaatcactatggatgtatgtctgaatagcaactgggaagaggatttcccccctgatccatcaggcaagtttgaggatttcaaggactttgtgaaatcaaattttgagatatgtgaatgggtaggcctctcagtggtggctgctcaggtgttatcaattattctggggatggtactcaggacccttgggcctgaacgtgagactgactatgacagtgatgatgacacaattgtgcctgcaaggctgcctctcctgagaaatcaggcccaacatggtttagactatgctgaacctaatacatctcgtaggagtgattcatggaaattgcggattttagacaaggtcaacaactaagatcttataatgatctcatacaacagaccatttgggaaagactttcgctcctagggtttcagaaggatgataagattataccctttttttcttcttgtggagagatgattagcagaagcgatagagtagttcttagttctgtctacttttgaatgccattcaacatgcacagatatttgagtagcatgtgactgacccttataaacccacaatgtatgggaaggatgttgtaccataatgtttcataaagagatgagggcattattggtgccttccctgaccaaagtcagaaatgttt

SEQ ID NO: 15301 - DNA, 1367 bp, Sorghum bicolor
  Clone ID: SORBI-28MAY03-CLUS49_199
gcacgaggcggcgatggggctacggcgtctgcgccgtcggcatcctctgcggcctggctgtcttcctgctcggcaccaggaggtacaggttcaagaagctggtggggagcccgctcacccaggtggccgccgtcaccgccgccgcgtggaccaagcgcaggctgccgctgccgtctgacccggacttgctctacgacgtggacgctgcgctcgccgccggcgccgacgtcaaggggaaggagaagctgccacacagcaaggaatgcaggttcctcgaccacgcggccatcatcgacggcaccggcggcgactcggcggcgagcaagtgggcgctgtgcacccggacggacgtggaggaggtgaagcaggtggtgcggatgctgcccatctgggccaccaccatcatgttctggaccatccacgcgcagatgaccaccttctcggtggcgcaggccgaggtcatggaccgcgccatcggcggctcgtcgggcttccacatccccgcgggctccctcaccgtcttcctcatcggctccatcctcctcaccgtgcccgtctacgaccgcctcgtcgcgccgttggcccgccgcgtcacggggaacccgcacggcctcaccccgctgcagcgcgtcttcgtcggcctcttcctctccgtcgccggcatggccgtggcggcgctcgtcgagcgccaccgccagacggccgcctccgccgagcacggggtcacgctctcggtgttcctcctgatgccgcagttcgtgctcgtcggcgccggcgaggcattcacgtacatgggccagctcgcgttcttcctgcgggagtgccccaagggcatgaagaccatgagcacgggcctcttcctcagcacctgcgcgctcgggttcttcttcagcacgctgctcgtcaccatcgtgcacaaggtcacgggccgccatggcggccgcggcggttggctcgccgacaacctcgacgacgggaggctcgactacttctactggctgctcgccgtgatcagcgccatcaacctcgtcatcttcacgttcgccgccaggggctacgtctacaaggagaagcgcctggccgacgccggcatcgagctcgccgacgaggagtctattgccgtcggccactgatacatgctgctaccacaaccctgcaagcatgcatctctcttttttttttcttcttcttcttttatttatgtgtttgatgacttgttttggcgtgaattcggtggggggtatgcgtgatgtattttggcacgcaggtggagctaattaacgtgtacgtaaagggtacaagaaatgtagatagaaatatacggcttaataagtgccaaatacgtagtgatgtacgttgtatctgct

SEQ ID NO: 15302 - DNA, 1039 bp, Sorghum bicolor
  Clone ID: SORBI-28MAY03-CLUS49_200
gcacgaggcccgtctccaccctcctccccctctgctggtcaccactccgaatcaaatcactgctcccccagcttcctttaccttcgcagcaagcaagccggtaccatcaagctagatcgcggggaagctcctcgcctcccccatcggcgctgctccggcgcgcagaagcgtcctctcgcggcggccggggagacaactccgcgccgccgtcgcgctgccgaagacgaaagactggagggaggatgggatcgtgagcccagttaaaaaccagggtcactgtggatcatgctggaccttcagcactactggtgcacttgaggctgcatatacccaggcaactggcaagcccatctctctttctgagcaacagcttgttgactgcggaaaaccattcaacaatttcggatgtaacggaggccttccatcccaggcctttgaatacatcaaatacaatggtggccttgacactgaggaatcttacccatacaaaggtgtcaatggaatctgcgacttcaaggctgagaatgttggagtcaaggttttggactcggttaacatcaccctgggtgctgaggatgaactgaaggatgctgttgctttggttcgcccagttagtgttgcctttcaggtggtcaatggtttcaggcagtacaagagcggagtttacactagtgacagctgtggaaatactcccatggatgtgaaccatgctgttctggctgttggctatggcgtcgaaaatggtgtcccctactggctcatcaagaactcatggggcgccgactggggtgataagggttacttcaagatggaaatgggcaagaacatgtgcggtgttgctacgtgtgcatcataccctattgtcgcatgaggcccctacgaaatgttacagtctggcatcaataatgcatgtttaacctgagctcggtgatgggttatacagaacggaaagtcttgcataaggctggtggttattctgcattttcaggtttcagtgtgatcaataaacagtttctcagtacaattggtttgctactta

SEQ ID NO: 15303 - DNA, 958 bp, Sorghum bicolor
  Clone ID: SORBI-28MAY03-CLUS49_201
gcacgaggacacctcgctcgccttcccttccacttccacatggccgctcctctccacgcgcgcctcctcccgctccccttgcccccgaaccctagccccggcctccccccgagcggcgcgcggcgggtgctccggcacccgcgccgctgcctcgcgacgccgccgtcgcggaacgggagctcctcctcgccggagaccgagtggtgcccggtgccgccggagcagcgccccgtgaacgagtacgaggcgctcgcggcgtccctgcccttctcctgggcggagggggacctccgcgtctactgctcccgcctcgcgctcacgggcgccgccgtcgcgctcttcgtcgggctccccgtcgccgccttcgggggacgcggcggggccggcggcgacgctctgcacctcgcgctcggcgccacggggtccgggatcctcgccgtcacgctcgccgtcgtgcggatgtacctcgggtgggcctacgttggcaaccgcctgctcagcgccacagtggagtatgaggagacgggatggtatgatgggcagatatgggttaaaactccagaagttttagctcgcgatcgacttctaggctcattttctgtcaagcctgtgctaaacagagtgaagttcaccttggtgggtctggcaggctccctgatcctttgcattcttctttacgtgaacaccgaaaacccaaaggaaccatatgttaataccggtggaagggctatccctggagtgtacagtgacactgccgcaaggtcatttgagcctgatgcattctgtggagagcctgatctttcgtagcatcgcaaagcttggacgttggaaggtttttagatggtggcatatggtctcatagggtatacaggttgttcctctctttgtcttgtggctcttgcctttgtatggtggatgcttcccattactgtacgggggttttgatccatcgaccagg

SEQ ID NO: 15304 - DNA, 584 bp, Sorghum bicolor
  Clone ID: SORBI-28MAY03-CLUS49_202
gcacgaggcacacccctaagattgagcttagcttagctccacactccagctccaagcacacagtcgtggttagagggccgtgaaaatgccgatcagcaggatcgccgtggggacccaccatgaggtgtaccacccgggcgccctcaaggcggcgttggctgagttcatctccaccctcatcttcgtcttcgccggccagggttccggcatggccttcagctgggagtggggataccagtgggtgtactgggtcggcccactcatcggcggcggcctcgctggcgtcatctacgagctgctcttcatctcccaaacccacgagcagctccccaccaccgactactaagccggccgccggcgaccccccaccaagcttgggttccgttccgtgcgcagctagcagatcatcaattctctcgatctctggatctccccctcgccgtttagtttctctcgtgcatgtgcatgcatcgtcgaacatctcaagctgctactgctgctgctgcgccggccgccgctcgatcgtcgcatcgtttgctttcttggacaagtctgtaaccgtgaattccggacccgttgttctg

SEQ ID NO: 15305 - DNA, 741 bp, Sorghum bicolor
  Clone ID: SORBI-28MAY03-CLUS49_203
cccaaacctgagggaggcgctatggccatcccgtgaggaggcccgcacccagatcttgagcatttgggaccaggcagacattgtcaaggtcagtgaagtcgagcttgagttcttgacaggcatcgactcggtggaggacgatgttgtcatgaagctgtggcgacctaccatgaagctgctcctagtgactcttggagatcaaggatgcaagtactatgccagggatttccatggagctgtcccttccttcaaagtacaacaagttgatacaactggcgcaggtgatgcgtttgttggtgctctgctccaaaggatcgttaaagatccatcctcactacaagatgagaagaaacttgtggagtctattaaattcgctaacgcgtgtggagcaatcaccaccacgaagaagggggcgatcccgtcgctgcccactgaagctgaggtcttgcagctaatagagaaggcatagataatcgtatttgctatggtttcactagcttcgactttctgcaaattgtattgtatgctgatctggttcagaagaagcgggtgctccatcttacctgccctttttgtttgccctagttccccttgtgaaagggtgttttgttttagaacttgcaataagcagagctttttttttatgttaagaatgcatttgatacgatcaaataattaatccataattgtagcatattttttaaaaacaaaaaatcatttgaacttttgttcagttggtgg

SEQ ID NO: 15306 - DNA, 784 bp, Sorghum bicolor
  Clone ID: SORBI-28MAY03-CLUS49_204
ctctccattccccgtgcgctcgaaggcacgaaattctccgcgtgaagtggtgggggaagcagcgaacccctagcagcgtgccccggatctcgccgcgggggggcaaggcaatggccgcgtcgtcggcgttcctgcccgagctgggcacgcaggtggtggtgcccgtcgcggccgtggtcggcatcgccttcgcggtgctgcagtgggtgctcgtctccaaggtgaagctcacccccgagccgccgcgccgcggggacggctccgccgggaagagcggcggcgccggcgccagcgagttcctcatcgaggaggaggaagggctcaacgagcacaacgtcgtcgtcaagtgcgccgagatccagaacgccatctccgaaggagcaacttctttccttttcactgaatacaagtatgtgggactattcatgggcatttttgctgtcctgatcttcctcttccttggttctgttgagagcttcagtaccaagagtcagccatgccactacagcaagggcaagacgtgcaagcctgcccttgccaatgctatcttcagcaccattgcctttgtgcttggtgcagtcacctctcttgtttctggtttccttggaatgaagattgcaacatatgcaaatgccaggacaactcttgaggctaggaagggtgttggaaaggcattcattactgctttccgctctggtgctgtgatgggcttcctgcttgctgctagtgccctttttgttctttatattgcaatcaacttgtttggaatttattacggtgatga

SEQ ID NO: 15307 - DNA, 679 bp, Sorghum bicolor
  unsure (1)..(679): unsure at all n locations
  Clone ID: SORBI-28MAY03-CLUS49_205
cgtccgagcagctgaactattgcaagaaattcacgagcacatggctatactatcagaggaccccaagatcaaaattcctgagtcatttgacaaagcctttcagtatgcaaaagatggaaatcatttcaccactgcaagctctgtgaaacaagcccttgaacctcttaaaaaatgtggggttagtgatggcgagatatgcatgatagcaaacgttgggcctgagactgttgaagaggtttatgcactagtgccatctctcaaggctaataggtcagctaccgaaggttcagtcactgaggttcttgctgtccttgcaaacataaaagctgctaagtgaatctccaatggaactagaccgataataaatcggaagcagccgtcttgtgtgatcaaggagcgcggaatctgcaaagtggtcctttggtcttttggatgtactgcataaacatgttgtgtatataaaaaaaacgtagtatgtgctgcatgaactcatctaggatgtctagctgctgaagtgcagattcagctgagtggttgaactagtctactcgaactgataagtactgtctgcagtctgcacttgtggctactgcttgaacaatgaagctgatgactcgttgccatctgttgaattgtgcctcgcaacttatntgttgtacttgcgggtttgtgagcagtc

SEQ ID NO: 15308 - DNA, 764 bp, Sorghum bicolor
  Clone ID: SORBI-28MAY03-CLUS49_206
gcacgaggctccccttccctctcaatcctgcaggctgcaggccctccccttctccttcgattttgcagctccaggcgaacgagcctctaggcagcgcgcttgccgttgaccgacgtcgccggcggcatggacggccatgtccttgcgcaacgccccatattgatacatccgtgcatggactcaccaccaccaccaacaacaacaaagcctattagtcccaagcaagttggggtaggctagagttgaaacccaacatgagcccatgatctccaaattctctcgcagggaccaaaaaggatggccctgcttattgctattctattttttaaatatataactgtggctacggcggtggcggcggcggctacggcggtggccgtggaggctacggcggtggcggtggcggctatggcggtggcggcggcggctacggtggtggcagccgcggcggcggtggctacggcaactccgatgggaactggaggaactgagcggtggggcccgcgcggccaagttatcttgttcgctactgctaccatgttgtgttgttaccctagtccatagggtttatctatcatcttgttgttcgtcgtcgtcgtgtccgtgtgtttgttgttgttgcccatctgtgtttttgatcgcaagttgtgttagtgctgtgttcgtcctcgtcttgagccccgtgcatcaatcaagcatgaactgggctccagggatcgatggatgttgtgtcaagtatcagtcaatcaataaaagaaaaaagg

SEQ ID NO: 15309 - DNA, 700 bp, Sorghum bicolor
  Clone ID: SORBI-28MAY03-CLUS49_207
cttttccccttcacagccctgtaccagtagtgtactactatcccccgctaccgctagccgccgcgctgctcctctggtggcggctcgcctccctcctcccccaccccaacccgccgccgccgccgcctcctctcgctccctcctccttaccccgagcttaagctctacctatccgtaggagaggaagaggggagaagggccggtcggtcggtcgggggctctcggatctcgccgctgcctcctcgttccttcgttgggatctcgctcgtcaagcgctatggccgccgtcgccccgcccccggttcccgcgcccgccgcgccggcaccggctgctgctgctgctccggctccggctcctgccaccgtccctgtcgcggatctttgctgttgtgcaaagaaaccacggatctgctgcagaagctgtcgctggatccgcagcccaaggcggcagatgcaacagagcctactgctgctgccaagaagcagggcgctgtgacgagccagccgctaagtgtggccataccgccggagcggtccatcacaccggtgcttcaagactttatggatcccaacctattctatctaccagcgtattactatggaggctacgacagttccatgagcgagtgggatgattatccaagatatctaaattcagatggagtggagattgccccagcagtatatggagatatttatg

SEQ ID NO: 15310 - DNA, 750 bp, Sorghum bicolor
  Clone ID: SORBI-28MAY03-CLUS49_208
ggggaggggaagaggtcccgaagacgacgaggtggcaaggtcgctgcacgggagccacttcgctgtctgcaagaacgggaggaaggacgtagggtgaaaccgagcgaaatcggagacgagcctgcaagagaagccgccgatccggtggccccaggcgtcggtcccgtcctctgcgcgagcaccgagagcagccccacggcaagagacggcggcggcgacttggacgataagcacgcacgcgtgagcagcaacgagtgagctccggcggcgatggcctggggcttcgggtggttgtggtcgcctccgtcatggcggtcgctgccgctgccgctgttgcggtgctgctcgggctggcgggtggaggtgaagatgcagaaggggcgccaggcgccgtcgtggaggaggcggctgccagaggcggaggcggaggcggaggagaagcggtggccgagcgacgcggcgaggttctgcgccacgtagccggagtaggagacggtgatgcggatcgccatggcgaacaggcagaggagccgtagcgagagcgagaagaggcggattgggctgtcgaggaagcaaccggagattggggcgccgacgagttagaggcaggcgaacattccggagggttacagagtggggggttgcgtcggggaagtcggggtcaggtctcccggcgagctgcctcgccggaagacgacgtcaacggtggcggtcaatggaggcggcgaggtgaaggcgaattgggggaga

SEQ ID NO: 15311 - DNA, 866 bp, Sorghum bicolor
  Clone ID: SORBI-28MAY03-CLUS49_209
gcacgaggctcaggctcggtccggcggtcccttagcgcagatcttctgctccttcccccactcgcgctcaggctcggtccctcagcgacggagggacagtcccaggctcggcggcggcgtcggcggctccccctcccgcctctcgccagtcgcctcgcgccctcgcctccgtcctgcgcgcaccggccgtcgaccctgcgtgtagtaagatggatatcctttatcagtgtaaggaggttttgaagatccagaagtttcggcgtatggtgtcgtatgctggattctactgcttcactgccctcattacttatgcttacacaagcaatacgacaagggctgggatctcaagggctgaccagtattatgcttcctaccctgctggtactgagctactgactgacactgcaaagctttacaaggctgcattaggcaattgttttgaaatagacgaatggggcccaatagagttctccatcatggcgaagcattttgaccggcaagggaaaccaccatatgcctaccatgcacaatatctggcgcacctcctctcccatgggcagctcgacggaagcggttaaatgcaggatgtgttgttcatagcatgcatcaatgcgattagaatgccactagatcttgtacaaaaatgttgccttgctagaacactgaggccagactgtatcagactagagattgcagaactggcatcagaaacaggttctgaattttcggccatcagctggtacgatatcggtgccgaatttgtaggttcgcgcaacaatttctgaaaaaacatgacattgtcctgttggagcatttacggtgtccttttattgttgaataataaaactctgaatgttagggcatgc

SEQ ID NO: 15312 - DNA, 1111 bp, Sorghum bicolor
  Clone ID: SORBI-28MAY03-CLUS49_210
cgcaagtgaaataccactacttttaacgttattttacttattccgtgggtcggaagcggggcatcgcccctccttttggctctaaggcccggccttgccgggccgatccgggcggaagacattgtcaggtggggagtttacacaagctagtggttcagaccaaagagcaagctgaactgtgcatccaagcatttgtaccttgaggtacccttagattgcagcaggactaaaaagagcagtgttgctgtattcacagcatttgttcttgcctggcaagaaatcatccttgcattcataaggttgtcgttatcatggtcaacagatgtacctggaaatcgtgaagttgcccctatggatggggcaagtgatccaagagcaatggttgttcttgcagtttcgctcagtttaaatcgtgtgcgtgatggagcatgaagccacagatgcagccttattgatcctgtatctgacaggctcatggaaatgtagcttatgctggaatggagtccagcatatgtaagatggattaatccaatggggattagccatcatggtctcatggccttcaggtgatgattgttcatctgaaacttatgtagttagtgtgcggtcctagtcccaactccctagtcaccgcccacaggtctgatgcccaagaagtgtatccagttctgtacaagcctgcaatcatcatcgtgatgtctgcattcatcagcctttggacctaactctggaggacccagttatgctcctttcctgagagttcccaagaagtgtatccagttctgtacaagtatgcagtcatcatcgtcttgtttacactactggttgtagccagttatggtcattcgtctgtaccatttttttagtgttgtatgtcctagcctcccaattaaggtgtgatttagctgtatactgccctctctgtgtttggtggttccaagcatagagcagttctctcgtactttaaaataaagccatggaatgggaaaccatggtgctggtacaaatgattgtgtactaaactcttaatgtatgcctgtgtcttgtgctccctttccactttttttttatcaaatagttatagcaattcaacagggtacgttgctcgttg

SEQ ID NO: 15313 - DNA, 1022 bp, Sorghum bicolor
  Clone ID: SORBI-28MAY03-CLUS49_211
gcagacctgcgactgcgagttagagagcgtaagccagccatggcgagggttttggcgacggtgctggtcttggcaggcgccgcgctgctcgcggcggccggcggcgccagcgcgaagcagggcgtgtggagcatcatcacgcggcccatgttccagagcatgctgagccaccgcggcgacagcggttgccagggcgcgttctacacctacgacgcgttcatcgaggccgccagcaagttccccggcttcggcaccaccggcgacgaccagacccgaaggcgggagctcgccgccttcttcggacagacgtcccacgaaactaccggtggatggccaactgctccgggtggacagtttgcctggggatactgccgggtgaaggaacagaaccccacggacccaccctactatggacgaggacccatacagctaactcatgagtacaactacaggcaagctgggcaagcgctgaacctgaacctggtgggcaacccggacctggtgtcgagcgaccccgtggtggccttcaagacggccatctggttctggatgacgccgcagtcgccgaagccgtcgtgccacgccgtcatgaccggcagctggacgccctccgccgacgaccgcgccgcggggaggctccccgggtatggcgtgaccaccaacatcatcaacggcgggatggagtgcggcaagggccagtccaccgacgccgccaaggaccgggtcggctactacaagaggtactccgatatgctccgagtgcgctacggggacaacatcgcctgcaaggaccagaagccttacggaggctgacaacgatcgatctatggttgctgcaagcctttcacgtgtgtttgcctctctagctaagaaaataaagatcaagctagcaaacgtacagggccggccggggcagcctctagcttcggcatgtgtctacttatatcatataaatcttcagagatgatatagtaccgtcacatctctggatgcatgattacgaataataatggcgccaatca

SEQ ID NO: 15314 - DNA, 1103 bp, Sorghum bicolor
  unsure (1)..(1103): unsure at all n locations
  Clone ID: SORBI-28MAY03-CLUS49_212
gcacgaggctggtctcgcctcctccaacaatggatccccaactgtctccgggacattaccatcaaccgacacaaagacactatcaagtacattgagatggaaatctggaaaccaagagtggtgaagaccatgcctaattcctacttggaatgggcgcgccataacaacagctgctcccaggtcatcatccctggtggctggaaagccacaacatggaccatggcaataccggttggttcatttgcggactggcgcccagactgtgaggtcgaagttaaagatgtcactgtggatgccagcgacccacatcactctgacctgctgtctaagctgaccagcagcaataccttgcaggaacttgcataccccaccataagcatggatgacgatgttgtctacttgctttctaggactacacctaggaacatgaggaaactagagttggtggttgctattgatttgaggaagaagatcgtgcaaggagtagccgagcttgatgtccagaaagacttcatttttatgccgtcctattgtaccagtgagatttgcagatttttgaggaagagtacatgcgcaaaagaagaacttaaacaaactgagaacaaagctattaaagcaactgaaaaagaagagggtgaaccaactgagatgcacgtgaaaggaccatccagcaggaagaagtatgtgaagcgtcctgtcaacctgtttgatgcgtgatgcttcagcaggaagaagtaaagtgtgtatggtgtcctgtcaacctgttagatgcggaccggtgatgcttcatgcagatactaggattggggagcttggtgaatcgatttatgagaattatgccaaaaataattatctgtattgtactgcaggcctggctactcgatttctgtactagaacttgcgtaggctcatgtcactagagctgaagcattctatctatcgtttggaaccttgtcagatggtgataatctgggcaggaatctgcatttggttttattgctttgaacattgtttttcntgtgttttggtttgattcaataatttattgtattcgttgtaatatactaaaaccaggcacggctacttattctaatcaatcaatg

SEQ ID NO: 15315 - DNA, 1134 bp, Sorghum bicolor
  Clone ID: SORBI-28MAY03-CLUS49_213
agctccccgttcctggttctcctgtagctggattccccggaaccacaagaatccttagaatgggattccaactcagcaccttttgttttgggattttgagaagagttgctctttggagagcacagtacgatgaaagttgtaagctgtgttcgggggggagttattgcctatcgttgtcctctatggtagaacccgtcggggaggcctgagaggcggtggtttaccctgtggcggatgtcagcggttcgagtccgcttatctccagcccgtgaacttagcggatactatgatagcaccgaaggttgccaattcgtcagttcgatctatgatttcgcattcatggacgttgataagatccttccatttagtagcaccttaggatggcatagccttaacgttaatggcgaggttcaaaagaggaaaggcttgcggtggatacctaggcacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggtggctgaggaagggaggtcatgctttactgatcagaaatgcagtgccaatccgctggctcttcagaacattaattgtgaacaagctgatcaagactgagtgagaaaatagtgtttccctgttaggaatttggtagtgagaaatgagatgaaatgatagatgccagagttctcgttaccaatatactgtgtcacacattgagcctttattagtgcttaatctgtaagtttttgtttgtgaaagtgcgggcgggcgcacgcctaattcctgcttgagtgttttgtactgtacataccggaact

SEQ ID NO: 15316 - DNA, 767 bp, Sorghum bicolor
  Clone ID: SORBI-28MAY03-CLUS49_214
gccggccgggcctcgacaggctctcagcaccaaattccggcggctgcggcgatggcggcggctgtggcgaggtcagggttccggcgcatgttctctgtctccgccttcgcaccgccgaaggcgcccgccccgcgcccccaggccgacccctcccccaacctcttcgtctccggattaagcaagcgtaccacaactgaaggacttagagacgcctttgcgaagttcggtgaagttgtgcatgctcgagttgtgaccgaccgtgtcagtgggttttcgaagggatttggctttgtaaggtatgctacaactgaagaggcaactaaaggaatagaaggaatggatggaaagttccttgatggatgggttattttcgcggaatatgctagacccagagcaccgccggagcaagcagagatgaattcgccgccacagcaatcatggggtgcttcaccaggatcttggggttcacagtagatgaagtaatatcatgagagcccctatccagcctggggctcagggctcacagcaggttgagaggctgacaattcagcatctaattcatagatatattgtgagtggtgtcccaggtgtgaatgcccttaccgttccaatattcctaccgtgtttgggtggtcgtttgctcgcgtccatgtgttccacatgaagtggtagttgtagtagtagatctggatacggaccaaaacaaatagcattactgtcaatctgcaacagtcgagaaaacagtcgaaaacctttgcgaataacgc

SEQ ID NO: 15317 - DNA, 1064 bp, Sorghum bicolor
  Clone ID: SORBI-28MAY03-CLUS49_215
gcacgaggcggcggcggacgtggagtaccgttgcttcgtcggtgggctcgcctgggccaccaacaacgagaccctcgagcaagctttcgccaacttcggccaggtcatcgactccaagcaccatggcgacccgtattcagtttgagaacaactgtgaagttggtgttttctccaagctcacaaatgcttactgtctggtagccataggaggctcagagaacttctacagtgcctttgaggctgagcttgcagatgccattcctgtggtgaagacctctattggtggcaccagaataattggccgactctgtgttggaaacaagaatggacttctattgccacatactacaactgaccaagagcttcagcatctgaggaactgcttgcctgatcaagtggtggttcagcggattgatgagaggttgtctgcccttggcaactgcatagcctgcaatgaccatgttgcgcttacacaccctgaccttgacaaggagactgaggagttcattgcagatgtgcttggtgttgaggtgtttaggcagactattgctggaaatatccttgtggggagttactgtgccttctctaacaggggtggcttggttcatccccatacatccgttgaagaccttgacgagctctcgacgctcctgcaagtccctcttgtcgctggaactgtgaacagaggcagcgaggtcattgctgcaggcatgacagtgaacgactggactgctttttgtggctcagacacgacggccaccgagctctcagtcattgagagcgtcttcaagctgagggaggggcagcccactgccattgtggaggacatgaggaagtctctgatagacagttatgtgtaacttatttgccagcagatgtgggtctcaagtattgcctgtgctaaaatgtattgcaagctatacttgagttatcagtagcacaacataaccttatgatatgtttgtggtgtatccgtggtttcagaatctcgagacttttccgtggaagctcgtgctatatcagtgaaaattggccactcgttttgttaagtttttttttccggc

SEQ ID NO: 15318 - DNA, 824 bp, Sorghum bicolor
  Clone ID: SORBI-28MAY03-CLUS49_216
aggaaccggtttaattagcttgcaaaatgcaaggtgctgcactattcgtgctttgaacaagcatctgccaaccggcagggaaaacaaatcggtcagccaaaaggaatttacaggcaaaactcaggaaataaatattctgagagaactgaaaccggagctcagctcatcaaagaagctccacgaaatataaggttattgtacacacttgctatccaccatcacttgagcgcgactactatcaggacggcaccgcgaaccgggttgcatcaggatcataaattgtatcactaatcttcgatggcggccaataccggagaatagatctaccaacaatattcctcactggaagtgggccccagttatgggaatcaaagctgttgttgcggttgtctcccagcacaaacacaaaaccttccggtacaagcactggttccagctcgtagttgtgtggctccagcacataatcctcatcctgaactactccattaacgaacagcttgccatcatgcacttcgacatagtctcctcccttggccacaactctcttgatgaacacatcacctgagctgtaaccataagcctgcaatgaaaacgttcaattcagacatcatgagaaaaacaatccaggggggcaggaaatagcacctgaagtcctgggggagcccggaagatcacaatgtccgaaatttccggatcccggaatatgtacgagaccttctccgcaaggatccgatcaccgatatcgaaggtcgggtacatggacttggacgggatggacttgggctcagccagggacgagccgtagagaagtggcacggtcacag

SEQ ID NO: 15319 - DNA, 918 bp, Sorghum bicolor
  Clone ID: SORBI-28MAY03-CLUS49_217
gcacgagggttggcttctcctccccctcttaccaagtcctcgtcctcggtttagggttcgttagggtttttgtggaggggagatatggcggcggcggacgtggagtaccgttgcttcgtcggtgggctcgcctgggccaccaacaacgagaccctcgagcaagccttcgccaacttcggccaggtcatcgactccaaggtctgtttcgtttcgtttcgttctcgctgggttttaattccgtggcctcttcgtggtgttgtgaggctagatccctgttgtcgttcaatagatctgccatgttttggtccggatctgcgttcgctcgaatcgtacgtcccgtctgacgccgccgccgtcatgtgattctgcaggtcatcaccgaccgggagacggggaggtcccgcgggttcggcttcgtcaccttctcctctgagcagtccatgctcgacgccatcgagaacatgaacggcaaggagctcgacggccgcaacatcaccgtcaaccaggcccagtcccgcggcggaggcggcggcggcggtggctacggaggcggtggcggcggctacggcggccgccgtgagggtggcggctacggaggaggcggcggcggctacggcgggcgccgcgagggaggaggcggctacggaggcggtggctacggtggcggcggcggcggctacggcggtcgccgtgagggcggcggcggctatggcggcggcggcggctacggtggcaaccgcggtgactccggcggcaactggaggaactgattgtgtgggcccaccctggcttcggccaagttatcctagctatctatctatctatagtatcgtgttaccgttccgttggattctgagttacccatgtgttagtgtccgttgaacctttggattaggtgttggtacccccgtgttcgaa

SEQ ID NO: 15320 - DNA, 1232 bp, Sorghum bicolor
  Clone ID: SORBI-28MAY03-CLUS49_218
tactggtataatccccacccatttagaccaccccgttggctcggctttgctttctcccctcgcaccggggaacgcggccgccgatccgctcccgatcccctaccctcccctgccctcctcctccttcccgccgactgatcccaccaaatccgcgcacgcgcagtcccggattcggttggcaggcgcgattggccgctcccgatcagccgcgccgcgggatagggctggatttgattggattggatccccaatagggttgccgcgtccgtgctttggggcgggcggggggagttactttagggtttcggcgggtgcggtcgccgtgtaggcggtggtagggttttgccatggcggagaagggctgcctgaagcggctccagaaggagtaccacgcgctctgcaaggagccgcctccacagatcgtggctcgtccgctgcccaacgacatattggagtggcactatgtacttgaaggaagtaaaggcacaccctttgaaggtggatattactatgggaagctcaaatttccaccggattatccttttaaacctccaagtatcagcatgacaacccctagcggcaggtttgcgccacacaaaagaatatgcctgtcaatgagtgactttcatcctgaatcttggaatccaatgtggtctgttgcaagcattctcactgggctcctgtccttcatgatggatgatgcactgacaactggaagcatcaagacatcagatgcagaaaagagacgtttagcaaaagcttcctttgcctacaattgtgagagcaaaaactgtccacacttcaggaaacttttcccagagtatgttgagaagtacaatcaactgcaacagttggagaacactgctgcagagccggtgcctcaggagaatcctgcacctgctccatcccctgctgtccagcaagctccggtggtggcaaatagggcgcaaccactggcggaggcgcgccgtgacaagaaccagaagaaggcagtgcccttctggatggtgctggtcatgttttcagtttttggtgccgtgatggcgttgcccttaatgcaactttgacaaaaataaagacaatgagaaggtgtgataccggggccgtaattttgtatagttttccattggtttgtgtgagtgtgactcagttgtcctctagactacctaccaccttggagtcatattgatgaatctatgatggtaacatctgtagaaccgtttctctaaaaa

SEQ ID NO: 15321 - DNA, 1112 bp, Sorghum bicolor
  Clone ID: SORBI-28MAY03-CLUS49_219
gagacgagaaacgtactcgtagtataatagtttttgcacaaagttgcgtgtgacagatacatacacccaacccaacccaacccaacccaacccatttgttcatcgttttgggccctcaaccaccaccaccaccattattattacactattcttcgtccacctcttttcctcccattcccgtaggaaaattatataaaaaaaaaggagattaaaaatcaaacacgttcaagaacagcataataataacaccgaagacgaactttctttcatctgcatgcatgcctttaccccttccgccctttggatggatctcccctctgcaatctcttcctccgcctgtccgccgtcgtcgatcagaacctaacgatcttggccgcgcgcaccaccgggttctcccgggcgatggcgtccctgccggcgcccttgtagtcgtagctgcagccgtgccggtccgagtaccggtgcgcgccgcaaaagcggacaagcctggcagcggtagcggcggcggcgcggtgaagacgccgtcggacttcctcaagtccatcaggggccgccccgtagtcgtcaagctcaactccggggtcgactacagaggtatattggcttgcctggatggttatatgaacattgcgatggagcagactgaggagtacgtgaatggtcagttgaagaacaagtatggtgatgcgttcatcaggggcaacaacgttttgtacatcagcacgtcgaagcggacccttactgatggcgcatagacggattggagccctctgtcctcccttgcgtgtcgtgtaacttcaaagccgttaactttggttgcgctctgactcagatgcatcctttttcaatctctgtactcgctgtctgggggaagttggggacacgatctcatcggcttgccaggtgctattttgatgtaaccgacatttattcagcttcccatgtatatgtggtgttgctttagggatatggataagatactgtgtttgcagcatcgcgttacgtcgtttcatcgttaatggtggtatcaactcgccaatgttgtgatctgctttgagggttttgaactcctacggttgatttgattgctataacgtccagaaacaattttt

SEQ ID NO: 15322 - DNA, 838 bp, Sorghum bicolor
  Clone ID: SORBI-28MAY03-CLUS49_220
agctagcagagaatatagagagatagagagaagctagggcaataaggtcgtcgttgatggctccgatgaagctgtacggtgcgacggtgtcgtggaacgtgacccggtgcgtggtggcgctggaggaggccggcgccgagtaccagatcgtacctatcgatttcgccaccgccgagcacaagagccccgaacacctcgcccgcaacccgttcggtcaagttccagctttccaagatggcgatctccacctatgggaatcgcgtgcgatttgcaagtacgttgcccgcaagaacaaggcagcagagctgctgagggaaggcaacctccaggagtcagccatggtggacgtgtggctggaggtggagtccaaccagtacaccgccgccctgaaccctatcctgtacgagtgcctcgtcagccctatgttcggcggcaccaccgaccagaaagtggtggaggagaacctggagaagctgaagaaggtgctggaggtgtacgaggcgcggctcgcgacgccccatgcttctgtgctcaacgcgtaccctcacgtcaaggcatggtgggatggcctcatggccaggccgtctgtccagaaggtcgccgcgctcatgaagccgtctgcttgaaattagtgatcgagtcttcgttcgttcactgcttggcttaatataaataagcccatcgacccctgtgtgtgtcctcgttctcgatcggcatgtgtcatccaggtgttgaataagctagctagccgatcgagttgcatgcatgttttcgtgtctttgagaataatattaagctatgtgtttggtatatatctttatctttatctaatatttaa

SEQ ID NO: 15323 - DNA, 454 bp, Sorghum bicolor
  Clone ID: SORBI-28MAY03-CLUS49_221
ttttgtgctgctgaagacgctgttgctacctcgcccaaatttgtttttcactgcttcgaaggtgtgaacatggagaatgctcctcctgtgaaggaccgcaaaatggctaattttttttgctgggaggaagtggatgccatggaaaaggatggagtgcttgatgagtaagatgggcttctggtgtcgatttgcttctgagttgttttttttatctttgcaatttcgttgtcgtcgtttggttattctgtgaagcagccaagccaggctattagagtatgaaaaatgtcgtctgtaagcatgttttcctatgttgccacatgctgaatcaatttgaataagtattaatacagctttaggtggtcagctgcgtttcccccaatgagcatatatgtatggagaaatgtctgtccaagcattttatttaagaataatatttttttttcgagttaaagtg

SEQ ID NO: 15324 - DNA, 656 bp, Sorghum bicolor
  Clone ID: SORBI-28MAY03-CLUS49_222
gaacccaaaagaccacaagaagcccgtgcaggaggtacttgctgagatgaccaacggaggggttgaccgcagtgtggaatgcactggcaacatcaatgctatgatccaagcatttgaatgtgttcacgatggctggggtgttgctgtgctagtgggtgtgccacacaaggatgctgagttcaagactcacccaatgaacttcctgaacgagaggaccctgaaaggaaccttctttggcaacttcaaaccacgcactgatctgccaaatgtggtggagctgtacatgaaaaaggagctggaggtggagaagttcatcacacacagcgttccgttcacggagatcaacaaggccttcgacctgatggctaagggagaaggcatccgctgcatcatccgcatggagaactagatttcgctgtctggtttgtgatctgacctgggttgggttaataaaagaggcaatgctgagcctgcccgttcgatgcggtagatacaggaccacgcttgtgtgtcgcgtttagtttggctttgtcaagcagtagaacagcatcccgtgtcttgtaattatatatcggcatgagtcttatgaaccatcatcttttggcgtaatatggtatgctactactatgagtctatgagtttcagtctataaactc

SEQ ID NO: 15325 - DNA, 1154 bp, Sorghum bicolor
  Clone ID: SORBI-28MAY03-CLUS49_223
gtgctctctcagaggtgggttggcttctcctccccctccggttcggttcggttcgggtcgggttcgtcaggttcttcgggggttccggttcgtgggtgagcggaagagatggcggcgtcggacgttgagtaccgctgcttcgtcggcggcctcgcttgggccaccgacgacaactccctccactccgccttcagcacctacggcgaggtcctcgagtccaagatcatcctggatcgggagacgcagaggtctcgtggcttcggcttcgtcaccttctcgacggaggaggcgatgcggagcgccatcgagggtatgaacggcaaggagctcgacggccgcaacatcaccgtcagcgaggcccagtcccgcggcggccgtggaggcggcggcgggggcgggtacggcgggggccgtggaggcggtggcgggtacggccgccgcccttcgccgatatcttcgccggagaagaacgcccaccagatccgccgctgcgatggagtccgtggtgaacccgaaggcgtacccgctggctgatgcgcagctgacgatgggtatcctcgatatcatccagcaggccgccaactacaagcagctcaagaagggagctaacgaagcgacgaagaccctgaacagggggatatcggagttcgtagtgatggcggcggatacggagcctctcgagatcctgctccacctccccttgctagctgaggataagaacgtgccatatgtatttgttccatcgaaacaagctcttggccgtgcttgtggtgtgacaagaccggtcattgcttgctcagtgaccagcaatgagggtagccagctgaaactacagatacagggcctcaaggactctattgagaagcttctcatctgatttactgagacctttcagtgtgatgggcctcggggacacatttttcagaggcttggactggtgatggtgtcttgtttactagattttacactttccaaagtatgtttgaacactgttatgtggatcataatcgaattgtgttgtgtcttatatttgtgactcatgtattctcaaagatgcctgtgcatcctggtggcttggtatctgttgagattccaaccattactgtaacgattgattacaacgggtttgagaattggatcgattgggtggttgc

SEQ ID NO: 15326 - DNA, 1452 bp, Sorghum bicolor
  Clone ID: SORBI-28MAY03-CLUS49_224
ggcaccaccgtcactcacacagcaccggtaccggagagagaggagaggagaagagaggagaggatgtcgtggttcgggcaccaccaccacaaccagccggctcccccggcgtcggggccgaaccaggtgttcaagatcttctgccgcgccaacgagaactactgcctggccgtccgcgacggcgccgtggtgctggctccgaccaaccccaaggacgagcaccagcactggtacaaggacatgcgcttcagcacccgggtcaaggacggggaaggcatgccggcgttcgcgctcgtcaacaaggccacggggctcgccatcaagcactccctcggccagtcccacccggtgaagctcgcgcctttcaaccctgaccaggaggacgcgtcggtgctgtggacggagagcaaggacgtgggcaagggcttccgctgcatccgcatggtgaacaacacccgcctcaacttcgacgccttccacggcgacaaggaccacggcggcgtgcacgacggcaccggcgtcgtgctctgggagtggtgcaagggcgagaaccagagctggaagatcctgccgtggggacccgaggcgaacgccgcggcgggggccaacggcggcgtgcacaccgtgcgcgtcttctgcaaggccggcggcgaggactactgcctgacggtgcgcaacgggacggcgtgcctggcgcccaccaacccgcgggacgagtaccagcactggatcaaggacatgcggcacagcacccgggtgcgggacgaggaagggtacccggccttcgcgctggtgaacaaggtcaccggggaggcgctcaagcactccacggggcagggccaccccgtgaagctggtgccctacaacccggagtaccaggacgagtcggtgctctggaccgagagccgcgacgtcggcaacggattccgctgcgtccgcatggtcaacaacatctacctcaacttcgacgccttccatggcgacaaggcacacggcggcgtccacgacggcaccgagatcgtgctctggaagtggtgcgagggcgacaaccagccggctcccccggcgtcggggccgaaccaggtgttcaagatcttctgccgcgccaacgagaactactgcctggccgtccgcgacggcgccgtggtgctggccccgaccaaccccaaggacgagcaccagcactggtacaaggacgtgcgatagcgatgcatcgcggacttccgagtggagtggtgttttcgtcagactgtcagtcactgtatctgtatggctagtgttccaacatttgtcagcccgttttcgagcaaggggagtgacagagtcaggagaagggccgggccataagctgctgcatgtcttatgtctgtactctgaatgaactctgtatgagatgagatctcatctcctttctcctaccgaatgaatgaaccatttggctttgctttgctt

SEQ ID NO: 15327 - DNA, 972 bp, Sorghum bicolor
  Clone ID: SORBI-28MAY03-CLUS49_225
agcgcagatcttctgctccttcccccactcgcgctcaggctcggtcccaaggatcggatcttccgcgcgtcggcggttctccctcggcggcgtccagcgacggaagggcagtcccaggctcggcggcggcgtcggcggctcccccaccttctctcgccagtcgcctcgcgccctcgcccgcgtcctccgcgcaccggccgacgaccctgcgtggatgccaattttttattgagaagttgaagactactagcttctttgatcctgaggtgaagaagtaatgatccgcccaggctcaaaggagtcacaaaattatgatatcaataatcaaagagttcatcctcaaccaattgatgagaacatgaatcagaacggggactcaatggacactatgatcgggaggatattcaacaacatatcctctttaaaatctgcctacattcagctgcaggaagcccacaccccatatgaccctgacaagatccaggatgctgataagcttgtcatagaggagcttacaagactttcagaactcaaacatgcttacagagaaaaacatcctaagccagtagcagcatcccctcaagattcgcgtctgctttctgaaatacaagagcagcagaatttgttgaagacctatgaggtcatggtaaagaaattccagtcccagatccagactagagatactgagataacccatttacagcagcaaattgatgaagctaaacttcggaaatcaaagttagagaagaaactgaaacaaaggggcctacttaacaagggatcagagggatctgaccaagaagaaaactacctcttcattggattgacacccaagttggttacctctggtggcgattaccccttccaagtaattcatgacttttcaaaggctttgatcaacatgattgaaggctgcaggttgggatcttgatggggctgctaatgcgattgaacctggtgagtttacacaag

SEQ ID NO: 15328 - DNA, 1256 bp, Sorghum bicolor
  Clone ID: SORBI-28MAY03-CLUS49_226
gtgctctctcagaggtgggttggcttctcctccccctccggttcggttcggttcgggtcgggttcgtcaggttcttcgggggttccggttcgtgggtgagcggaagagatggcggcgtcggacgttgagtaccgctgcttcgtcggcggcctcgcttgggccaccgacgacaactccctccactccgccttcagcacctacggcgaggtcctcgagtccaagatcatcctggatcgggagacgcagaggtctcgtggcttcggcttcgtcaccttctcgacggaggaggcgatgcggagcgccatcgagggtatgaacggcaaggagctcgacggccgcaacatcaccgtcaacgaggcccagtcccgcggcggccgtggaggcggcggcgggggcgggtacggcgggggccgtggaggcggtggcgggtacggccgccgtgatggaggtggtggtggctaccgccgcggcggcccccatcgccgcatcgctgctcgagggccccgtgctggtctgggccggccgcctctgcctctactacgcgctcctccacgtcgggctcgccggctccccgcgcaaccccttcctctcacacgagatcggcggcgaggacggcgccggggacagcgacctagggttctccaagtgggccgagaagctccgtggcggcgcctcaggtgacaaagatgctcaggataatagaaagctaactagcaaatggaagcccacaaccaaaggcacactgaagagaacataccgagtacgatcaacggatgaaggaaggcggatactgaaggagattgcttcagttctgtcccaagatgaccattttgtggatgcttcttctcacaagggttgccaaataaggagggaaagtgctcatggcgaaagtgtttgctgctacaacgtgagagcattgttcgatgagcttccaactcctcacctgcttctggagattacaccttttcctgctggacaacttaccgacaacgactaccgtaaggcagagaggcttgagatggtgctgaggctcagcgcttctatttaaaaaactagggactgatttttttctcaatttcctctaatactttctttgcccaagttgtaaattatcgtcctatgggcctgtaaattgatgcagctggctaagaactacttgtaaaacacgagttctgcttgattaatttgagcttaagaacctgatatacacttgggcgtttctctgaaatttattgaacagttttctttccttgggt

SEQ ID NO: 15329 - DNA, 1592 bp, Sorghum bicolor
  Clone ID: SORBI-28MAY03-CLUS49_227
gcacgagggccgcaggagacgctgcgcctgtcggtgatcgaccgcgtggcggggctgcgccacctggtgcggtcgctgcacgtgttcgccggcggcgagaacaagaagcaggcggcgccgccggcgaagtccctgcgggaggcgctgggaaaggcgctggtggactactacccgttcgcggggcggttcgtggaggaagacggggaggtccgggtggcgtgcaccggcgagggcgcctggttcgtggaggccgccgccgcgtgctccctggaggaggtccggcacctggaccaccccatgctcatccccaaggaggagctgctgccggagccggcgcccggcgtcaacccgctcgacatgccgctcatgatgcaggtgacggagttcacgtgcggcggcttcgtggtgggtctaatctccgtccacaccatcgccgacggtctaggcgccgggcagttcatcaacgcggtggcggactacgcccgtggcggcgccaccgccggcgccgtcaccagaccccgcatcaccccgatctgggcgcgcgacgtgatcccggacccgcccagaaatgccggcgccgccgccgcgcctcgacctgctggacctggtctacttcacgacggacctgagcccggaccacatcgccaaggtcaagtccagctacctcgagtccacggggcagcgctgctcggcgttcgacgtgtgcgtggcgcgcacctggcaggcccgcgtccgcgcgctccggctcccggacgccgccgcgcccgtccacgtctgcttcttcgccaacacccgccacctgctcccggcgacggcggcgccggcgagtgggttctacggaaactgcttctacaccgtcaaggcgacgcggccctgcggcgaggtggcggcggccgacgtcgtcgacgtcgtgcgcgccatccgggacgccaaggcgaggctcgccgccgacttcgcgaggtgggcggcgggcgggtttgatcgggacccctacgagctcaccttcacctacgactccctcttcgtctccgactggacgaggctagggttcctcgaggctgactatggctggggcacgccgacgcacgtcgtgccgttctcgtaccacccgttcatggccgtcgccgtcatcggggcgccgccggcgcctaagcccggcgcacgcatcatgaccatgtgcgtccaggagcagcacctgcctgagttccaggagcagatgaaccagccctgctcatgatccgatgtgatgatccaacctgctgctagtacgtatatgatcatgcatgcatgcgcgtgcaagtttggaatttgtcaataacgaacgaacgaaccgtacgtacgtcgtcgtcaactgaattggattcgaattcgcgtgtaatttgcttcttctatttgtccaaatttgccacaactagttgtacacacgtatataaaatccatcctactttacttgtatgtgtgaatgtatgtatgtcaagagtcaacaccttatacctgcccggctgcccaaaatataaaaatggtgggctagataagctctttttttatgcacctgtagcaattcacggaagaatgaaaaaaataaaggtcca

SEQ ID NO: 15330 - DNA, 731 bp, Sorghum bicolor
  Clone ID: SORBI-28MAY03-CLUS49_228
ctttttccccttcacagccctgtaccagtagtgtactactatcccccgctaccgctagccgccgcgctgctcctctggtggcggctcgcctccctcctcccccaccccaacccgccgccgccgccgcctcctctcgctccctcctccttaccccgagcttaagctctacctatccgtaggagaggaagaggggagaagggccggtcggtcggtcgggggctctcggatctcgccgctgcctcctcgttccttcgttgggatctcgctcgtcaagcgctatggccgccgtcgccccgcccccggttcccgcgcccgccgcgccggcaccggctgctgctgctgctccggctccggctcctgccaccgtccctgtcgcggatcaaaccacggatctgctgcagaagctgtcgctggatccgcagcccaaggcggcagatgcaacagagcctactgctgctgccaagaagcagggcgctgtgacgagccagccgctaagtgtggccataccgccggagcggtccatcacaccggtgcttcaagactttatggatcccaacctattctatctaccagcgtattactatggaggctacgacagttccatgagcgagtgggatgattatccaagatatctaaattcagatggagtggagattgccccagcagtatatggagatatttatggatatgggtatgctccttatggggcatactctcctgccacttcccca

SEQ ID NO: 15331 - DNA, 1360 bp, Sorghum bicolor
  Clone ID: SORBI-28MAY03-CLUS49_229
tcttagttactttgatgactcattgagatcacgcgagcaatggacatacgtatacgtacataatcactacacgcaacacgtacatacacagacaccagtaattaacaatattcagacgaactcatcctccatttcctgcatggacttgccggcggaggcgatctggcggttggacgtcatcttctcggccaccatgaggcccttgtagctccgtatctccgcccacttctccttctccagcctttcaatctcctccttccgtttcttctctttcagctgcatcttcctctcggccttttctgctgcatttgatgcctctttctcggcttttaagtctgctcggcgttctacccgggttttattcaacctgttgatgatctcattgacacgcttctcgactgtaagcacatggaccatccgtgggttgtggaagccaacttggccgacatccatggatggggacttcttgagattagaccagggcgtgtagatcacctcaacgttgttcatcttgttcccttgaatggaatgagcctttacgagctgcgcacagtcctccaagaggccctcgctgatggtatctatggtctcgcctttcttcagtctcagatagacgtgtgccgaggataccttgtccacatggaaccagacgtcctcggggaggccgtacttgatgagctcctcgttctcgttcttgtcggcgcccatgtagatggtgtagtcgccggcgtccggacgcgccttgaagtagagcaccatcgtcgctcgactcgatgtagctatatatcttcttcttcttcagtcctctcctatctctagctagcttctaccttcctaccggctacaccgtctctggattccaccggcggctactgtatatactacgtgtatattcaggtgtagctctgtcgccgcgcgcgcgcgcggccaataaagcagcaaaagcaagaggctgcaagagggaaggggagcaaggaggagcactacacggcagggaggtgtgcggccacggtggcggcggcggcggctacggcggtcgccgtgagggcggcggcggctatggcggcggcggcggctacggtggcaaccgcggtgactccggcggcaactggaggaactgattgtgtgggcccaccctggcttcggccaagttatcctagctatctatctatctatagtatcgtgttaccgttccgttggattctgagttacccatgtgttagtgtccgttgaacctttggattaggtgttggtacccccgtgttcgatgatgttactgtccgctttggttactttccgctatgaaatgagagaggagtgagcaaggtttttgttcgcatcaaaaaaaaaaaaaaaaaag

SEQ ID NO: 15332 - DNA, 1339 bp, Sorghum bicolor
  Clone ID: SORBI-28MAY03-CLUS49_230
gttggtttgccctcgaacccacgcaccgccggctccagcgccgacgctccatctccccccactggcgctcaggctcggtccctcagcgcagatcttctgctccttcccccactcgcgctcaggctcggtcccagggatcggatcttccgcgcgtcggcggctccccctcggcggcgtccagcgacggaggggcagtcccaggctcagcggcggcgtcggtggctccccctcccgcctctcgccagtcgcctcgcaccctcgcctccgtcctccgcgcaccagccggcgaccctgcgacttacgtgcatcttcgtggcaggagtcttgacaagttctcccaatggatcgagtaccgaatggaaggcctaaggtttccaacagacctgtagttgtgctttcagattctgattctgactctgaaggttttgtagaagcgctgactcctgttcactcgaagtcaaacgggaaggcttcgtcggcgagcctaaaaactggtgggaaggcttcagccttttctaaaggagaggcaagcaatggaaaagcatacagtagtggcaaaggtggaaagggttcttcgtcacatgcggtgcctaccaagtctgatgcggaactaaagctagagcttgatatccctccaaattctagaattcttatgaattgtgaagcagctgaactattgcaagaaattcacgagcacatggctatactatcagaggaccccaagatcaaaattcctgagtcatttgacaaagcctttcagtatgcaaaagatggaaatcatttcaccactgcaagctctgtgaaacaagcccttgaacctcttaaaaaatgtgggatatgcatgatagcaaacgttgggcctgagactgttgaagaggtttatgcactagtgccatctctcaaggctaataggtcagctaccgaaggttcagtcactgaggttcttgctgtccttgcaaacataaaagctgctaagtgaatctccaatggaactagaccgataataaatcggaagcagccgtcttgtgtgatcaaggagcgcggaatctgcaaagtggtcctttggtcttttggatgtactgcataaacatgttgtgtatataaaaaaaacgtagtatgtgctgcatgaactcatctaggatgtctagctgctgaagtgcagattcagctgagtggttgaactagtctactcgaactgataagtactgtctgcagtctgcacttgtggctactgcttgaacaatgaagctgatgactcgttgccatctgttgaattgtgcctcgcaacttatctgttgtacttgcgggtttgtgagcagttctctcctttaccatgttt

SEQ ID NO: 15333 - DNA, 508 bp, Sorghum bicolor
  Clone ID: SORBI-28MAY03-CLUS49_231
tgaaagcatggcctatcgatcctttatttattttcttttaaaaaaaaatgtgtagaaaagccactacttggcgatagaggtgtcagaatagttaccatagggataactggcttgtggtggccaagcgttcagagcgacgtcactttttgatttttcgatgtcggctcttcctacactgcttgaagcagaattcggcaaggttcggattgttcccccgccaatagggaacgtgagctgggtttagaccgtcgtgagacaggttagttttaccctactgactaaaaaaaaaaagtctttttttaatagtaattcgactcagtacgagaggaacggttgattcagataattggtgcccccgttggtcgataggcccccatgcggtcaagctaccatctgttggataaaggctgaacgccttttaagtccgaatccatgttaaattattttttaagaagaagaagaaaaacctgtgttttttttaaaaagaaaaagaataagaaatcattct

SEQ ID NO: 15334 - DNA, 654 bp, Sorghum bicolor
  Clone ID: SORBI-28MAY03-CLUS49_232
gcacgagggccgccaaaagctcccccgcccacaaagcgcgagcaatccacgtccacgcgcagcaccaccagtgccaccaccgtcaccaccaagctggtagcgcaaaggcgatggcgtcgctcaccatgatggcgtccttcgccgccgtggcggtggccgcgccctcgcgccgcggcagcttcgccgtggtcagggccgccaacaaggccgaccaccgctgccaccagcaggaggagcccgccagcgccaggctggcggcggcggcggcggccgaggagcccgccgagggacgccgcgccgtcatgctcgcggcggccgcggcggccgtggcggccatcggcggcgccggcgccgccatggcggaccccaagaaagggagccccgaggcgaagaagaagtacgcgcccatctgcgtcaccatgcccaccgccaagatctgccacaactgatcgagcacgcgcgcgcgcgttgcagggccggccgggggggtggtatataaatgtgtgtatgtgtacggtgtcgatcgtacgtctctcttgttgattcgagctttaatttagatgcatgcctgacgacgtgaggccgcttattgctttgctggcggtctcggagctgtaagaatatttcaagtgcaatgcaaattgaattcgggtg

SEQ ID NO: 15335 - DNA, 582 bp, Sorghum bicolor
  Clone ID: SORBI-28MAY03-CLUS49_233
gccggccgggaccggccctccgccgtcgcctctccactttcccccatccttctccgccgtcgccgtcgcggtcgcgtcccggtccgaagagcctccaactccgatggccaaccgctgggtccgacccgaggtgtacccgctgttcgcggcgatgggcgtggccgtcggcatctgcgggtttcagctcttccggaacatcaccggcaacccggaagtcagggtaaacaaggcagggagggcagctggtgtgcttgagaaccatgaggaggggaggcgttacgccatgcatggcctaagaagctttgtgcatgaaaagacccctgagatcatgcctgctattaacaagttcttcactgaccccaagtgaagcatgttgatggttctactgctacttgccattggggattgtacccttttctggcagttcgatgtgttgtgccgtccataaattggaagacatctcttactcttattaaaagtaccgtatgagtgcttggtaatggcttgctatatgtatgatggtgaatgagtttggtcgtccctctttgatgttcacaaaaaaaaaaaaaaaaaaggccccta

SEQ ID NO: 15336 - DNA, 1625 bp, Sorghum bicolor
  Clone ID: SORBI-28MAY03-CLUS49_234
tccggttcgaggttgaataggtcaactgctgatttgggacaagaggtttctatttaaacagatttattggatggcagaggctgtttatgatatgttgtctgaaacattaactaaggatgaagtgtacctctttgggaacagtcctaaagatgtagatgctctggttttgggacacgctctttttgtgctcaacgtgttgcctgagacatctgtgttgagggctacactacagaagcatgctaggctggtaaaatatgctgaacatcatttgttcgtcttgctgggggtgccatccggaagtttctcaagaaccctaccgtatgtagcctatgacctgtgtgtcatgtctggacaagtacactgtgaacattacattgacttgaaggtgtacaagctgaagtaccacatgctcgttccaaaagttgttctcgtagggctggatgaagatggatgtaatccattgcccggggaaactgaagaccctaaaagctttaccattgccagcgaacgctgcaagaaatgtatcaggactatgctcaagggccttgttatcaatgaagcgttgcaaatctgttttgaggatttcactgaagataatattgtacttactgaaacaggaaaagtgaaattcaagaatgtcaccattatcagttgtcttcgcagaggtccagaattcaagaggcgtctccatagaaacttcaagtgtgctgctaacattattcgagatctcttcaagcttattactccaactggtatacagtacaacattcctgaagatatcttgcacctgctcaatgtaattgagagggaattcgagtccaggtcaatgtttccagttcatgcctcgttggttcctttgacgcagtgctcatttttcttccaaaagatgtatgagaccatcagatctgtgttatcatttgaggagttagagcaattctggataaattaccatatgtggatggctggaagaaaaaagttatgaacaatgccttgctcagttaccctatcaatagaagacctgagagttatgaggtaccacaaaacaaaccagatcagcggaacctgaataaataccagaaaggttgcttaaatgatttggggatcaatccacctaggaaccaaagtgtgttgagtaatgagcaggaagagatgatcaaacaactgaggctgatcgattattggagaaatcgaactgtacacagaatggagccgtacaggtcttataccaaggagagcaccgaggagggcgaggatgcaccacgcaatgcgccttacaaggcggagggctctgaactcgtcaactatgtgaggtttccaatggcaccaacttaccttcagtgggagctgataaagaggcgggaagctgatggtcatgttgtttgggaaagctttttctaggcttaattctgtcatcagtagatcacacgtaatgctctacttgtgccccagttggcaccaacttaccttcagtgggagctgataaagaggcgggaacctgatggtcatgttgtttgggaaagctttttctaggcttaattctgtcatcagtagatcacacgtaatgctctacttgtgccccagttatcttgtagtactgtttaacttctgactaaaaaaattggttt

SEQ ID NO: 15337 - DNA, 636 bp, Sorghum bicolor
  Clone ID: SORBI-28MAY03-CLUS49_235
gcttgggcaggcaagcaaaaggtcaaaatgcatcggtaggggagcgttccgccttagagggaagcaaacgcgaaagcgggggtcgacgaagcggaagcgagaatgtcggcttgagtaacgaaaacattggtgagaatccaatgccccgaaaacccaaggtttcctccgcaaggttcgtccacggagggtgagtcagggcctaagatcaggccgaaaggcgtagtcgatggacaacaggtcaatattcctgtactaccccttgttggtacggagggacggaggaggctaggttagccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaagggtacctgtacccgaaaccgacacaggtgggtaggtagagaatacctagggggcaccccttctcccgaagttacggggctattttgccgagttccttagagagagttgt

SEQ ID NO: 15338 - DNA, 779 bp, Sorghum bicolor
  Clone ID: SORBI-28MAY03-CLUS49_236
caaagaaatcagcaaagtggtcaaatagctgaacaagagccagcaaattctatctggtctagcagttaccatgtgtgattaagtaacttgtaccaggatgattgctggagttgctggggactattggattaagtggcacagcctgacctattgagcttggcccatacctgcagcattcccgtagtattaaatttcttttgagaatggtgatctttgaagcatgacaacggctgctgttaggtttgggagtgccaccatcttctgggctaaagtgtgagtggaagatgattgatctgtcggcagtttgatggggatgaattatgaggtctttaatgctgacacaaagggttaatgaaacaaactcgaatccagtgattgtaggcacactgcacggaccatatgattcatctctcattggacatatagctaccacaaaaatggggtgagtggatagttgctgccgcaactagaaggccaattcagtttggatgtcagttgtcagttcggctatgccatctaagaataaaagtttgaggaccaacgagcatgttgccaagtcatttctcaagtataaattactgcctctagttatcttgatacttcccttctggaaacagtgtcggttgctgttgcacttgtggctgttgcgctgttgcaagtcacgattaaattcttggaacagtttgtcatggtttgtttggctcctatatgttattaatctggaactgtatgaactatggaccaaccctcagtgttacatacaacgtctggtttgactg

SEQ ID NO: 15339 - DNA, 996 bp, Sorghum bicolor
  Clone ID: SORBI-28MAY03-CLUS49_237
gcacgaggagaagacccaaccaaaaagccatcagcccatcaacaccatgtcgacgcccgcgcttgcgacggctgccgagggagcgacgcgcatcatcctggtgcacggcacgggccatggcgggtggtgctggtaccgggtcgccacgctgctccgcgccgcgggacaccgcgtggacgcgccggacatggcggcgtctggcatcgactcgcggcagctccgcgacgtgcccaccttcgaggactacacgcggccgctgctcgacgcgctccgggcgctcctgccgggagagaaggcggtcctggtcggccacagcttcggcggcatgaacatcgcgctcgccgcggagatgttcccggagaaagtggctgccgccgtgtttgtcaccgcgttcctgccggactgcaccaacccacgctcgcacgtcatcgagaaggttatcgggtcagactggatggacaccgtcacggatgcagagcacgtcccaccctcggtgttcctggggcctgaattcctacgccacaagctctaccagctgagcccaccggagaactacacgctgtcccagagcctggcccgggtgagctccttctacgtgccagacctgcagagccagacgccgttcagcgagtccaggtacggcgccgtgaggaaggtgtacgtggtctgcaagcacgacctggccataaccgaggcgtaccagcacacgatgatcgccggctgccccgtggaggaggtgagggagatcgccgccgccgaccacatgcccatgttctccacaccggctgagctcgctgggcacctcgcccacgtcgccaacaagtacgcttgataccaaggttttcgtcacaaatgtaaacccgggcgaaaatggaaacctactccagtcatacttcatacttcggggttcggaggccgtcttctaaagattgcttggaacttccaactgtgcacatgtaataagttagaaaatcagcctcccaataaagtttcttt

SEQ ID NO: 15340 - DNA, 937 bp, Sorghum bicolor
  Clone ID: SORBI-28MAY03-CLUS49_238
gcacgagggcggtggatacctaggcacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctcaaccccatcacctcgctctactacgtcgcgccctgctgcctcgccttcctcgtcgtgccctgggtcttcgtcgagttgcccaaactgcgcgaagtcggcagcttccagccggacctcttcgtcttcggcaccaactcgctctgcgccttcgcgctcaacctcgccgtcttcctgctcgtcggcaagacgtccgctctcacaatgaacgtcgccggcgtcgtcaaggactggctgctcatcgccttctcctggtccgtcatccgcgacaccgtcacccccatcaacctcttcggctacgggatcgccttcctcggggtgggctactacaaccacgtcaagctgcaggcgctcaaggccaaggaggcacagaagaaggcggcgcaggccgacgaggaggccggctcgctgctgcaggagcgcgactcgcacggcgaccgcaagactgacacccaggcctagcgagtgtgatggatctcatgatccaaccgccctcgccctcattcggtcggttctgaacccagcccccctgcctagtgtactccaaatgtgtgatccatccaacccttacaagtttgatgcgaaatttgttcatttcttgtctttgacttgatctggtggtagcaaggcaaataagcacgggaaagatgcaagctttgtgtcgaacatgtggaaaaaaaaaatatatgagcaat

SEQ ID NO: 15341 - DNA, 702 bp, Sorghum bicolor
  Clone ID: SORBI-28MAY03-CLUS49_239
gccggccgggttcggtcacccagcaatctcaatctcccgagcaatcaccagcagaagaatcctccggcgaagcaaagcccaagcctccctccccactcactcgatggcccgcacgaagcagacggcgaggaagtccaccggcggcaaggcgccgaggaagcagctggcgacgaaggcggcgcgcaagtctgccccggcgaccggcggggtgaagaagccccaccgcttccgccccggcaccgtcgcgctccgtgagatccgcaagtaccagaagagcacggagctgctgatccgcaagctgccgttccagcgcctggtgcgggagatcgctcaagacttcaagactgacctccgcttccagagctccgccgtcgccgcgctgcaggaggcggccgaggcctacctcgtcgggctcttcgaggacaccaacctctgcgccatccacgccaagcgcgtcaccatcatgcccaaggacatccagctcgcccgccgcatccgtggggagagggcctagagcgtcgtcaccgtggaggaggaagtagtagtcctagtttctgtcatcagtgtcggatcagaaggtgtagagatgtgctgggttctttattagtttgtgttggtcggatcatgcagaagttggttgttcactgctgtaatttaactatcatgatgcaatggtaatgaagtcgtcagttatcagctccc

SEQ ID NO: 15342 - DNA, 1162 bp, Sorghum bicolor
  Clone ID: SORBI-28MAY03-CLUS49_240
cggctcccagcgccgacgctcatctccctcgcagcgccaggctcggtcccaaggatcggatcttccgcgcgtggtggcggctccccctcggcggcgtccagcgacggaggggcagtcccaggctcggcggcggcgttcggcggctccccccaccttctctcgccagtcgcctcgcgccctcgcctgcgtcctccacgaaccggccgacgaccctgcgatccagatcgtgctacggcggctcctgtccatccgccatgattaacttcgtgctcctgatcagccgccagggtaaggtgaggctcaccaagtggtattctccgtacacccagaaggagaggaccaaggttattcgcgagctcagtggactcattcttacacgagggcccaaactctgcaactttgtcgagtggaggggttacaaggttgtataccggaggtatgctagcctgtatttctgcatgtgcattgatgctgatgacaatgagcttgaagtccttgagatcatccatcatttcgtcgagatactggaccgctattttggcagtgtatgtgaactggatttgatattcaatttccataaggcctactacatactggatgagattctcatcgcgggtgaacttcaagaatctagcaagaagaatgttgcaagacttattgctgcacaggattcattagtcgaggctgctaaagaggaagccagctccataagtaacatcattgcacaggctacaaaataaagttcaccactcaaatgcctgcccctttgctctgttttgtcgttatacaagcaattgtaatgtactggactgctagtccattttctctgctcatgtttcctatggaatacggatttgaagactccaggtcatttagaatgagcgtgatgtgtaactacatagtatgtgttccgttggaagtaaagtcgtgattttcaggatttgcccagggatagttgtaaattcctggagttgtaagtgcatattttttcattgatcgtttatagtgttatctaatgtctgaaaaccactgcaagttgtgatgcgttattcaacaaattcattcatgctttgtagcgcctgtgtttagtaggtcagaaacttgggtggctatactatatttgtaagcttctgtgcatgtaaacagattccagtcttccggg

SEQ ID NO: 15343 - DNA, 810 bp, Sorghum bicolor
  Clone ID: SORBI-28MAY03-CLUS49_241
gcacgagggctagctggcagagcaaacaaaacactccatattgtcgctagctacccagcttctgattctgctaccttgcttaattagctatagcaatcacacgctagctagctagtactacagtccagtaatggccaccgccctgagcagcctccgcgcgccggcggccttctccctcggcatcgccgccgccccggctccggcggcggccgccaccgtggtggcgctgcccgcggccaagccggcccgcggcgccaggctgcgcgcgcaggccacgtacaacgtgaagctgatcacgccggacggggaggtggagctgcaggtgcccgacgacgtgtacatcctggaccaggccgaggaggaagggatcgacctccccttctcctgccgcgcggggtcctgctcctcctgcgccggcaaggtcgtctccggcaccgtcgaccagtccgaccagagcttcctcgacgacgcccaggtcgaaggcggctgggtgctcacctgcgccgcctaccccacctccgacgtcgtcatcgagacgcacaaggaggaggacctcgtcggctaataagcagccgcatgccatgcacaccacacaccacacgatctgtatgggccaagcaagctagctagctaccatgccatgcatccatccatgacagcagcacagctccatgcatcatcatctgttatactactctcttatttataatccaattttacttcggatgcatgatatgatatatgagtttcactatgctcaagcaaatcaaataataatgtttttttttctctaaaaaaaaaaaaaaaaaa

SEQ ID NO: 15344 - DNA, 1198 bp, Sorghum bicolor
  Clone ID: SORBI-28MAY03-CLUS49_242
aaaagtctcgtctcattttttcttctcaagccgattccccatctccgccctgcctgccggagagcacgagcacgagcaccaccgtcccggcagcgcggagcgcggtccgctccatccgcgcacggcctcagacgagcggggggcgcacggacgctgcgaccgggatggatctcaaggatagcctctccagatttaagcaacagcaggagagatgccagtcatctttggcgagcatagctgcttcgagctcaaagccaaagcacagggcccaaccagcacatgctcccaacgttccagcaaggccatcacaacctgttaagttttcgaatgatacagaaaggctgcagcacatcaattcgattaggaaatctcctgtcggagcacagatcaaacttgtcattgaactgctttacaagacaagacaagcttttactgcagaacagataaatgatgcaacttatgtcgatatccatggtaataaagctgtctttgacagcttgagaaacaaccccaaagtaagctatgatgggaggcgtttctcttacaagtccaagcatgacctgaagggaaaagatcaactgcttgttttgattaggaagttcccagaaggtcttgctgttgtggaagtgaaggatgcatatccaaatgtattggaagatttgcaggctctgaaggctgcaggtgaggtttggctgttatcaaacatggactcccaggaggacattgtataccctaatgatccaaaagcgaagatcaaggttgatgatgacctgaagcagctcttccgtgaaatagagctaccacgtgatatggtcgacatagagaaggagctacagagaaacggtttcaagcccatgaccaatactgccaaacgacgagcagctgcccagatcaatggcgtgaaacccaaggctaagcccaagaagaagcagcgtgagatcacaaagcggaccaagctcacgaatgcccatctgcctgagctgttccagaatctcaacacttaaccttgttacaatcgttgatgactcaaagagggttcatgttactcctatgtattgctatgttgtgtgtacatgtaatgctacccctgtatgttgtacggcttatgggctctacaaatttgtatctcaagattctggatgatatacttacgcattctgacataatagaatgcaaaacctcaagattttccttattt

SEQ ID NO: 15345 - DNA, 723 bp, Sorghum bicolor
  Clone ID: SORBI-28MAY03-CLUS49_243
caaggacatgcggcacagcaaccgcatcaaggacgaggaagggtacccggcgttcgcgctcgtgaacagggtcaccggcgaggccatcaagcactcgcagggcgagggccacccggtgaagctggtgccgtacaacccaaactaccaggacgagtcggtgctgtggaccgagagccgcgacgtcggccacgggttccgctgcatccgcatggtgaacaacatctacctcaacttcgacgccttccacggcgacaaggaccacggcggggtgcgcgacggcaccgccgtcgtgctctggaagtggtgcgagggcgacaaccagcgctggaagatcgtcccctggtaaatgtgcggtgctggggctgcattggtcatcacccaagatctggagatggagttggagagcacagccacctgtggtcagcagcagcagctgctgctgccgtgttgttagaataaagctggtgtgcgatcgatccgtggtgatggtgtgtctttgtgtgtgtttacttccagtcgtcagtcgtgtgtccttggagccagtcctgcttccgtgagagaggggtacttcctcggtgagcttatctcactaagcattaccccatctgaagcttgttatgcagagagagttttcagaccttgagtgttacctctgtgttgtactcggatccttccctttttgtctaaagtgggttttatcaactcgcggtttagctttgacgt

SEQ ID NO: 15346 - DNA, 1030 bp, Sorghum bicolor
  Clone ID: SORBI-28MAY03-CLUS49_244
aacagtccaataagcgccgcagcaacgcttcaagataggtttaacggcccccttatccagctcaaccccgtcgtcccccgctcctcagctttcgttctcgcgctcagtgtcatttgcagttcccggcagtagccatggcgtcggtgcagctgtctgggccgcgggtggtggcggctgcgaaaccagctacggtgggcgggctcctcctgacgccgtcccttgcggtgccaacggggctggagggccagggggctcgtggtgagggccgccacggtcgtgtcacccaagtatacttccataaaaccattgggagacagagtacttgtgaagatcaagacatctgaggctaaatctgagggagggattttacttccagtatcagttcagacaagaccacaaggaggggaagttgttgcggttggagaagggagaagtttcggaagtaacagcattgagatcagtgttccggttggtgcacaagttgtctactcgaaatacgcgggcacagaattgaaattcaatgatgccgaccatctcattttgaaagaggatgacataattggtattctcgacagtgatgatgtgaaggatatgaaaccgctgaatgatcgcattctgattaaggttgctgaagctgaagaacaaactgctggtggtttgctattgacgcaggcgactaaggagaaaccttctgttggaacagtggtagccgttggcccagggccattgggtgaggacggcagcaggaatcccctgcggatcactcctggaagcaacgtgatgtatagcaagtatgcagggagtgagttcaagggcgaggacggtcagtacatcgtgctcaggtcgtctgacgtcatggctgttcttacctctgattccgaagcatacagcgccatttatgaaatgtaggaagctttgatgttgaggccgaaccttgtcttccatttttctcctgtttggaattgctggaaggttttagctgtactttggtgcgaattacaaggaaaataaagctgagtagcgtagactg

SEQ ID NO: 15347 - DNA, 827 bp, Sorghum bicolor
  Clone ID: SORBI-28MAY03-CLUS49_245
gccggccgggccgggctagtcgccgcccacacacacatcccccaccatccccgccgccgcaggcgagaaacctcaggtaagggcgggcggcagccgccggagccgggcgcgcctgccaagatgcagatcttcgtgaagaccctgacggggaagaccatcacgctggaggtggagtcctcggacaccatcgacaacgtgaaggccaagatccaggacaaggagggcatcccgccggaccagcagcggctcatcttcgcggggaagcagctggaggatgggcgcaccctggccgactacaacatccagaaggagtcgacgctgcacctggtgctccgcctgaggggaggcgccaagaagcgcaagaagaagacgtacaccaagcccaagaagatcaagcacaagcacaagaaggtgaagctcgccgtgctccagttctacaaggtggacgacgccaccggcaaggtcacccgcctccgcaaggagtgccccaacgccgagtgcggcgccggggtcttcatggccaaccacttcgaccgccactactgcggtaagtgcggcctcacctacgtctacaaccagcaggcgtagaggagaaagaagggaaatggaaagtcttgctaggtgatgataatcttctttttttcgttttgttttgtcgcgtgttagtagttttgttggaattggaacagaacacctgctgcatctctctcttatggcgaggatgccaacttttgttttgatcatatcatgtcgttatgggtcctgtcaagcactcactgttgaattcgagttatgtttgggttaatcttatactatgttttcatttc

SEQ ID NO: 15348 - DNA, 1438 bp, Sorghum bicolor
  unsure (1)..(1438): unsure at all n locations
  Clone ID: SORBI-28MAY03-CLUS49_246
accatgaaagagtcggacggagccatattcgtgtagcttccgtgcgaccgattcaacggaacctcaatcgtctactcgatcgcttgtgtgtgtgtgttgatatggcgagatcggcgtttgttccgatggcggaggagaaagagcaaggtggtgcgggtgccggaagaggagcaggagcaggagcggccgtcaataacaaggagcagcaggaggtgctgctggtgcacagccaggtgcggcggatcaagaaggaggacgaggaggccagggagcgcctcctcaagctgcgcctgctggagaccaggcccgctgccgccgccggcggggtggcgtggcgagccccgcgctctctgtcgccgctccgccgtgccgggagcgccatcccggtcccggtcccagtcccggtgggggagtagcagcagcgcctcgcagccctctgcttgtatcgtatctaagagcatcagtcagtactcgcggttggttctcgatcggccgcagttgtagatacctacgtaggcgtagcgagcgagatcgtagttcagttcagtcgtggtgcttgtgagcctgcccgtgctctgcagacatgggatcagagcttagtagacgacggtagggtggcagccagcatctatacgccatgtgtggttggtgccttggtggtagcatagcatagcatgctctgttctgtatcagcaagcatagcatgctctgttattctgtatcctgtcttcttaggtgctgtatatatgatgatgagagggagtttacctgctttacctannnaaaaaaaaaaaaaaaaaaaactcgagactagttctccttgcacatgggtaagccgatcctaagggacggggtaaccccggcagacagcgcgatctcgcgtgttgcccgaaagggaatcgggttaagatttcccgagccgggacgtggcggttgacggcgacgttaggaagtccggagacgccggcgggggcctcgggaagagttatcttttctgcttaacggcctgccaaccctggaatcggttcagccggaggtagggtccagcggtcggaagagcaccgcacgtcgcgcggtgtccggtgcgcccccggcggcccttgaaaatccggaggaccgagtaccgtccacgcccggtcgtactcataaccgcatcaggtctccaaggtgaacagcctctggccaatggaacaatgtaggcaaggtcacccgcctccgcaaggagtgccccaacaccgagtgcggcgccggcgtctttatggccaaccacttcgaccgccactactgcggcaagtgcggcctcacctatgtctacaaccagaaggcgtaatcgcttgcgccgatttgctttacccgcctacctatcaagcatccacctgttggttactcgaattgaatctcatttagatctgtctgaggttgaaacttaaatggaagc

SEQ ID NO: 15349 - DNA, 684 bp, Sorghum bicolor
  Clone ID: SORBI-28MAY03-CLUS49_247
gcacgagggagatgatcaaggaggcgatctcggcgctgaaggagaggactggctccagctcccacgccatcgccaagtacatggaggacaagcacggcgcgtcgctgccggccaacttcaagaagatgctctccatccagctccgcggattcgccgccaagggcaagctcgtgaaggtcaaggcctcgtacaagctctccgacgccgccaagaaggccgcccccaagccgaaggccaagctcgccgccgccaagaccgctgcgcccaagccgaccaagaaggacgccgccaagcccaagaagactgccgccgcagccaagcccaagaaggccgccgcggggaccaagcgcaaggcgcctgagaagaaggtcgtggccaagccgaagaagtcccccgccgccaaggccaaggccaagcccaagaccgtcaagtcccccgccgccaagaaggcccggaaggtcgccgcatgagatgggttgcttaggtcgtagtagctctgatcgtcgtgtggcgttggttaggagttgtacaaattaagcgtgtgcccccccaaagtgtctctggtgtgttctgtcttaggcaagatctatctaccatggtttatttagtgtagcaaatggctaggctccttgtgatgccgacgtatccagttcttcctatatatgaaatcgacttggtttccgg

SEQ ID NO: 15350 - DNA, 1256 bp, Sorghum bicolor
  unsure (1)..(1256): unsure at all n locations
  Clone ID: SORBI-28MAY03-CLUS49_248
ccggaaaaaaaaaaaaaaaaatccgcctccaaaccctacccttcttcattccttcccctccggcgccgccaccccagactctccgccgccggcaagatgggccgcgtgatccgcgctcagcgtaagggtgcggggtccgtgttcaagtcgcacacccaccaccgcaagggccctgcccggttccggtccctcgacttcggcgagcgcaacgggtacctcaagggcgtggtcaccgacgtcatccacgacccgggccgcggcgcgccgctggccaaggtcaccttccgccacccgttccgctacaagcaccagaaggagctcttcgtcgctgctgagggcatgtacacgggccagttcgtctactgcggacgccgtgctacgctctctatcggcaacgtcctgccgctcagggggatccccgagggtgccgtcgtctgcaacgttgagcaccacgttggggaccgcggcgtctttgccagggcgtctggggactacgctatcgtcatcagccataacccagacaacggcacatcaaggatcaagctcccgtctggtgctaagaagattgtcccaagtagctgccgtgccatgatcgggcaggtcgctggtggtggcaggactgagaagccaatgctgaaggctggcaatgcctaccacaagtaccgtgtgatgaggaactgctggcctaaggtgcgtggtgtggccatgaaccctgttgagcatcctcatggaggaggtaaccaccagcacattggtcatgcctccactgtccgccgtgatgctcctcctggccagaaggttggtctcattgccgcgaggaggactggtcgtcttaggggccaagctgctgctactgctgccaaggctgacaaggccacttaaactcgttaaattttctatatgcagcattagatatcttatagattaaaacatgtttggatcttaattttgtgtgtcattctgatgagcgatgaacatggacgtttcagtttttgtggcaagctactgatgagatttttgttctctttaatcaaagttgtactttatgttctcttgtttttgtctagttgttacaaaacttaagtacttcattccaaactgtattttgttctggttttctagatacataacttttgctacgcacctagatatatggtaaaagctgtgtatctacaaaagccataataacttacaatttggaacatgggatatttcataatctgtacactgatatgcatttttttntcagtttttcc

SEQ ID NO: 15351 - DNA, 1784 bp, Sorghum bicolor
  Clone ID: SORBI-28MAY03-CLUS49_249
aaacctcagatccgccccctcctccgcctccacctccgtttccaccctcgcgccgcgcttccacagcccgagccctccccacctccggatccagatccgccgccaccaacgcctgctcctccccctcctcctccaccaccacctccacctcctgctgctgctgcaccaccaccaccaccaccacctcgaggaccagcagcaggggcggcggcggcggcatggggcgggacggcggtggcggcgtcgccggcggcatgtccgactcggtgctccggaaggtgctcctctcctacttctacgtcgcggtgtggatcttcctctccttctccgtcatcgtctacaacaagtacatcctcgaccccaagatgtacaactggcccttccccatctcgctcaccatggtgcacatggggttctgctcgtccctcgccgtcgtgctcgtccgcgtcctccgcgtcgtcgacctccccacctcgccttccatgaccccgcagctctacacctcctccgtcgtccccatcggcgcgctctacgcgatgtcgctctggttctccaactccgcctacatctacctgtccgtgtccttcatccagatgctcaaggcgctcatgcccgtcgccgtctactccatcggcgtcctcttcaagaaggagaccttcaggtcctcctccatgctcaacatgctctccatctccttcggcgtcgccatcgccgcctacggcgaggcgcgcttcgacgtgcgcggtgtcgcgctgcagctcgccgccgtcgccttcgaggccacgcggctcgtgctcatccagatcctgctcacgtccaagggcatctcgctcaaccctatcacctcgctctactatgtcgcgccgtgctgcttctgcttcctcgtcgtgccctgggccttcgtcgagctgcctaggctgcgcgccgtcggcaccttccaaccggatttcttcatctttgggaccaactcactctgcgcctttgcgctcaaccttgccgtcttcttgctagtcggcaagacctcggcgctgaccatgaacgtcgcgggagtagtcaaggattggctgttgattgcattctcgtggtccgtgatccgggacaccgtcacccccatcaacctgtttgggtacgggatcgcgttcctaggggtgggctactacaatcatgtcaagctccaggcgctcaaggctaaggaggcccagaagaaagccgcccaggctgatgaggaggctgggtcgctcttgcaggagcgcgatgggcacggtgatcgcaagagtgacaatcaggcttagagtgccagatccgatcctggcttccccatattggggaactgatggaaggtgcaaagactggagtttggtctacggttgctttcaaggaggtgtatgccgatttcttgtgctcctttaactttgggtccgaagagcaaatcagaagtatttatgggttaggaaatatgcacctgctttctggagagctttgccctgttatttatttagacacttttgttctacagataggcagccttgccttactacctctcttgtccattgcctacatttatttgttctcctactagtagattagggactaaagatgtactgctgcagattgttaatttggtcgttattttcgatatataatgagcttactgtaatgtacgagttgagttgagtctctcttgcaaagtttttttttgtttattcgcggactgatcggcatgttgtatgttaggatgcctttttcagatattagttgagatgtatatagtcatactctctgtc

SEQ ID NO: 15352 - DNA, 811 bp, Sorghum bicolor
  unsure (1)..(811): unsure at all n locations
  Clone ID: SORBI-28MAY03-CLUS49_250
ccgggctagcttagccgccactgccctccagccaccgccgccacagccgccgcttcgctcttctcacggccacgccgtccatcgaggcgaggtaaggtcagcatggtgagggtcagtgtgctcaatgatgcactcaagtccatgtacaatgctgagaagcgggggaagaggcaagtcatgatcaggccgtcctccaaggttatcatcaagttcttgacggtcatgcagcgtcatggctacattggtgagtttgaatatgtggatgaccaccgttctgggaagattgtggtggaactgaatggaaggctaaacaaatgtggtgttattagccctcgctttgatgttggtgtgaaggagattgaaggatggactgccaggctgctcccatcccgtcagtttggctacattgtgttgacgacttctgctggcatcatggaccatgaggaggcccgtaggaagaatgttggaggcaaggttctaggtttcttctattgaagggagtatggcgaaagcactgatgtttccaacaagaactcatctgagcttttgttttttggtctgaatagagtgctttgttaagattgtggaacgtgttgtgtgcttcagaaattgagaaccctgttatgagctatccctgcagttaattattatgacctatatgcctgtcttgtgtttctcgtcttgccatctcagatgaagattagagttccttattttacttgaatgttgttgactatactggtgtggagcattgatttcattaagtttgatatctaaaaaaaaaccanaaaaaaaaaaaaaaagggcccta

SEQ ID NO: 15353 - DNA, 1363 bp, Sorghum bicolor
  Clone ID: SORBI-28MAY03-CLUS49_251
tactgggttccttcccttctcctcagcgccgccgcggctctaccctaaccctccccaccaccatggccggcgcacaggagaccctggtgctcgccggcgtgatgcgcggccacaacggcgtggtgacggcgatcgccacccccatcgacaactccgatctcatcgtctcctcctcccgcgacaagtcgctgctggtctgggacctcaggaaccccgtccaggccgccggggacggcaccaccaccgccgactacggcgtcccactccgccgccttacaggccactcccacttcgtccaggacgtcgtcctcagctccgacggccagttcgcgctctcggggtcctgggacggcgatctccgtctctggaatctcaccacgggcgaaactacctgccgcttcgtcggccacgagaaggacgtcctctccgtcgccttctccgccgacaaccgccagatcgtgtccgcgtcccgtgatcgcaccatcaagctgtggaacaccctcggcgaatgcaagtacacaattggcggcgaccttggcggcgccgagggccacaatggctgggtttcgtgcgtccgcttcgcctaatacctaccaaccgacgatcgtctccggctcctgggaccgcagtgtcaaggtgtggaacctcaccaattgcaagcttcgctgcactctccaaggtcacggcggttacgtcaacgccgtcgctgtgagccctgacggctcgctgtgcgcctccggagggaaagaccatgttaccctgctgtgggacctgaccgagggcaagaggctgtacgcgctcgacgcgggtgacatcatccactcgctctgcttctcgcccaaccgctactggctctgcgcagcgacacaggaatccataaagatctgggatcttgaatcaaagcacgttgtccaggatctcaagcctgaggtatcgtctaccaaagatcagatgctctactgcacatgcttgagctggagtgctgatggaagcacgctctatgctggttacactgatggaagcatccggatctataagatttctgcatatggctactaggtctaaataatgaattcgttttgatagtcttgtcatgggaaatggctctgttattttagtttttttttactgtttgaaggcacaatatttgccaagtacttctgcttaattcactttatatcagtagcttcagtcatgagatatggatactgtggaaataggatctgttttcggtttttttggactccttttatcctacatcgtgcaatcgatggtgccacattcaatcccgtgatgctggtataatcaatatttcttatggccacattttttcttggaaattttaaataacaaaataggtatc

SEQ ID NO: 15354 - DNA, 860 bp, Sorghum bicolor
  unsure (1)..(860): unsure at all n locations
  Clone ID: SORBI-28MAY03-CLUS49_252
cttcagattgctcaaaggaacagcttggacattgatgtggatctagcccttggctttgctgctcactatgggaagatagaaaccatgggatgcttggttgaagaaggtaatgctgttggctttcttggccctntgatgcgtgctgctgaacgtggatgcctccaagttgtggaatggtttgtcaaccacgggtgtcgagaaatggagctttgtctagctcttactgctgccacctctagtagccagattgcagttgctgcttatcttcttcctcttgtcccgcaacatgttcttgcccccctcagcatcgagattatcaaaggcttagaggtcagcttgtggaggctgcaagcaggctcgaggatcggcaagtggaaagggatagccaaagcagagaactcttggccatcttggagcaccacatcccacgattcatgacccaaacttgaaggtaggcaggcatcctctctgaaccactgctgtgcaatgcaagcaaaaagcaacttagaagggcaatgcaccgtcttcagtgccgccaccatgtccctgcttggggacatccccaaaacgatagcatcttgagttggctctcctggaggcgatgatcttcggagagtatataattttggggaatggtgtgtgtgtgtggccttgtcgaggcatgtgtcggagtgttttactgggatcataatcttccatgaaaaatgatataagccttcagcatgtaatctgagttttcggtgtaattcaacactagtcttgtgacaacatgtcgctagctatggctagtgacttttttgatcatggactggccatctgtcctggcttcataaacataaacgaagagacagagtatattc

SEQ ID NO: 15355 - DNA, 1476 bp, Sorghum bicolor
  Clone ID: SORBI-28MAY03-CLUS49_253
gcacgaggcaattccggcgccggagaagacgcgcgcaggccccacccagccgtctccaatccaagcagcgctccgctcccacggacggacagcttgagctcgacggatgagcatgtgtgagaaagatcagaatttgccatggggatacgacctgttccgcgacccttttgctcctcccaacgggtactacgggcctcctcccggctactgtgatggtcactgttgtgacctccattacggtagagcagcacatccagatgagactcagttgcattcttctcaactcacatatgatttgtacaacccatcagtaggcatctaccatcctggaagcacccatgagcatgagcacgagacagtatatgtagagccgtctagttcctctccagacgcagctggtgacggttattttgagatggaggaggaagtagggaagaggttttaccccatggtcccagttccccatgtccccaaaattaatggagaaattccatcaattgatgaagccactatggaccatgaaaggctgacagaaaggttgaagctgtatgagttggttgaacacaaggtgcaaggagatggcaactgtcagttccgagcactatcagaccagctttaccaaagtccagatcaccatgagtttgtgagggagcagataattaaccagcttaaaactaaccgtgacgcctatgatggatacgttcccatggcatatgatgattacttggagaaagttgcacgaaacggtgaatggggtgaccatgtgactctacaggctgctgctgacaagtatggagtaaaaatctttgtgatgacatcgttcaaggatacttgctacatcgagatccagcctaaggttcagaagtccaacaaagtggtactgttgagcttctgggcggaggtgcactacaactccatatatccgcagaatgatgcaccgaggtcacagacggcgaccaagaggaggagatggtggccgttctcgcagcaccaccaccattgatggcggattacagagggctcggcgcatcatcttcatctctccaggactgggatggatgtcggagcggtggagctcgtcatgattcaggatcaggtggtggtcctgggggcccggccatcgtccaaatgatacaagggacgtacggcattatgattaatatatccagagcagagcagaccagacctgataatgggaatgggatgaatgaaattgaaataaacatgggatgggatgggaatcgtcgtcccgtacatagttaagagtggaggccggtgagtgtcaactcaactcttgtattgttgtttatatctacaaattttgccggaatgaggctagaattattgggaaacgattatgataataatgttgatgataataaattggttaagaattgagatgacccagttgctggttgagctctgatcatcatgaacagaatggactaaagcacagatggatttcccagtgcatct

SEQ ID NO: 15356 - DNA, 1222 bp, Sorghum bicolor
  Clone ID: SORBI-28MAY03-CLUS49_254
gcacgaggcgcgctcaggctcggtcccagggataggatcttccgcgcgtcggcggccccccccctcggcggcgtccagcgacggaggggcagtcccaggctcggcggcggcgtcggcggctccccttcccgcctctcgccagtcgcctcgcgccctcgcttccgtcctccccgcaccggccggcgaccctgcgaatacccaagtgccatcgtgggttcaggagaaggatgtacgggaggcgtgcatcgcagctgctgaaggagatcgactcctctgaggctggccagctcgcgccattcaacactgacgtgtttgatcaggtgattagagagtgcaatgagcacaactcacagtttcaatcattgatcaggaaaatggttgagcaaaacttagacatcgagacaactagaaatgaggatcactatggtgcagctatccaccatctttccctgctccgtaacaaaagatgcctgatggcttacatgtacaaccgagcagaagttattcagagttttagatggaaggttggtcctgtgcttcctcacgacatacaagaaaagctccatttctcagagaaagagtacttcaagaaccactctgcagccattaaatcatacatttcagagatggatatagatttgacagtggatatggttcctcccaaggatccttacattcaggttcgggtgctggaggacattggcgaagtatctcttggtgaccattctgtctcattgaccaagaactcactccatttcctaaggcgcacagacgctgaacaatttatatcacagggtcttatggaagaatttctggagtagagatcacatatgaatatatgatgcacaataggatgtgcgctgcctctttctcatcagtgctgctacctggtggaatagcactggtgatgcttgaagagactatttgcaacaacgaaaggacacatgtcatcctgggtctgtagggtacatgagacgttttctgtaccagggagcttctaactagtcgccggcaatgatttcttgctctagatgatcgagtgaagtttataataactctgttagtggcagttttcttcatgatgtattattttgtagtagaactcgcaactttgtaagctgtaaaagcagtcttactaaatccattgccttgttagtctgtttacatgtggattccttttggtcagtgtgccatacaagaaagcagatgttgataacatttt

SEQ ID NO: 15357 - DNA, 938 bp, Sorghum bicolor
  unsure (1)..(938): unsure at all n locations
  Clone ID: SORBI-28MAY03-CLUS49_255
ctgggctagcgccgcacccgcacactcccgcagtagccgccgccgccgccgcccagccacaggaaggaggaggaagaagatgccggcggggcacgggctgcggtcgcggacccgcgacctgttcgcgcgggcgttccgcaagaaggggtacatcccgctcaccacctacctgcgcacctacaagatcggcgactacgtcgacgtcaaggtgaacggcgccgtgcacaagggcatgccgcacaagttctaccacggccgcaccggacgcgtctggaacgtcaccaagcgcgccatcggtgtcgagatcaacaagcaggttaatggccgcatcatcaggaagcgtatccatgtacgtgtggagcatgtgcagccctcccgatgcacagaggagttccgcttgaggaaagccaagaatgaccagctcaaggcggatgccaaggcccgtggtgaggtgatcaaaaccaagaggcaacctgtgggacccaaacctggcttcatggttgatggtgctacgcttgagacagtcactcctattccttatgatgtggtcaatgatctcaagggtggttactagagaggattcttgtaccttgagcagttcaagtgagctggcataaatacttatctgaatctttttgataactgcgtagttcttttgttctggttttatgaacctattaccaatgtggctattgctagttaacgttaaagattttgccatggttgagtgaaaccttttatgttaaaaaaaaaaaaaaaaaaaaaaaaaaaaaaaaaaaaaatcnncctaaaatgacttactgtgatttaagaaatgaaaaaacaagctaaactccccccaaaaaggcctaacgggaattgggcaatagaaaccccgccttatcttgaatccttaaaaaaaaaaaaaaaaagggcccctaggccccggtcctctataa

SEQ ID NO: 15358 - DNA, 763 bp, Sorghum bicolor
  Clone ID: SORBI-28MAY03-CLUS49_256
ctgtgcggcgctcgaggcggcaggccgggaaaccctagcttagccgccactgccctccagccaccgccgccgcttcgctcttctcacggccacgccgtccatcgaggcgaggtaaggtcagcatggtgagggtcagtgtgctcaatgatgcactcaagtccatgtacaatgctgagaagcgggggaagaggcaagtcatgatcaggccgtcctccaaggttatcatcaagttcttgacggtcatgcagcgtcatggctacattggtgagtttgaatatgtggatgaccaccgttctgggaagattgtggtggaactgaatggaaggctaaacaaatgtggtgttattagccctcgctttgatgttggtgtgaaggagattgaaggatggactgccaggctgctcccatcccgtcagtttggctacattgtgttgacgacttctgctggcatcatggaccatgaggaggcccgtaggaagaatgttggaggcaaggttctaggtttcttctattgaagggagtatggcgaaagcactgatgtttccaacaagaactcatctgagcttttgttttttggtctgaatagagtgctttgttaagattgtggaacgtgttgtgtgcttcagaaattgagaaccctgttatgagctatccctgcagttaattattatgacctatatgcctgtcttgtgtttctcgtcttgccatctcagatgaagattagagttccttatttttaaaaaaaaaaaaaaaaaggccccta

SEQ ID NO: 15359 - DNA, 665 bp, Sorghum bicolor
  Clone ID: SORBI-28MAY03-CLUS49_257
gggtgcgctgcggccgggtcggatctgagacgagacgagcccccccctcctcctcccgaacgaactgcttacccatcccactccacccgccgcctccgccggatctcgtcggactcggatccgcccgaccaccccgcgccgccgcagcagcagatcagagaagatggccgcagtcgacaccttcctcttcacctcggagtctgtgaatgagggacacccagacaagctctgcgaccaggtctcagatgctgttcttgacgcttgccttgctgaggaccctgacagcaaggttgcttgcgagacctgcaccaagaccaacatggtcatggtctttggtgagatcaccaccaaggccaatgtcgactacgagaagattgtcagggagacctgccgcaacattggtttcgtgtcagctgatgtcgggcttgacgctgaccactgcaaggtgcttgtgaacattgagcagcagtctcctgatattgctcagggtgtgcacggccacttcaccaagcgccccgaggagattggagctggtgaccagggacacatgtttgggtatgccactgatgagacccctgagctgatgcccctcagccatgtgccttgccaccaagcttggtgcaaaactcaccgaggtccgcaagaatggaacctgcgcctggctc

SEQ ID NO: 15360 - DNA, 2099 bp, Sorghum bicolor
  Clone ID: SORBI-28MAY03-CLUS49_258
gagggcagctccggagccgcacgggcgcgggcgaggcaggcaggcaggcagtggctcctcctccccctgctttcgaaatcagctcatcaattcgacctatcacacagctatcatcatcgtcatcatcccctaccactcctctttctctcctatgctgctctaattcattggggaaaaagaaaacaaaaaaaaaaagagtccttgtatcgatttctggtggcgactgttgctggggtttccttgtctggttcttgatttgcgccaggacggatttgccgtccactcgggttccgccgtgcggtgtggtgctgaatcctcctctgttcccttattaggtttggatcgggggtagggatggaagtggacagaaggaagaatttgcagattggatccaaggggaaggaggaggttcagagcaagaatcagaggcgggaggagccgctggcatcgtcggaggtggacatggatgagccagaggctgccgagagcggcgacatggttgttgatggcaacaatggcagctccaaagagagccccgtgccacccatggattccaagaactccaagggctgtgcggccaagaagcggagatccgtgagcgccgactttggggcggagctggacttggaccttggcaatggggaggagagtggggcacagcaggaggagaggaagctctctaggcaggaccgggttgagctttgcaggtcgttccagcacgcagtcagctcccatgattgggagagcgcagaggggctggtaggaatggccgatgcacaagggctcaacgatgtgctctgcgtggctgtggatgcgatttggttcttgagtgacaaggacgagctccttgctattgtggggttgatcaggaggattgtgtctgagggcgcaaaggattttacccgtgctgcgctccggacatcattcctcgcatcgtgcgtatcagcatgtaggggacggtcgactagccttgctgatgcagtgagcttcatgggtcagaaattgcatgaacgactccaagaatcccaaggtgatgaggtattgaaagcagaagcaagtgcaaaggtgcacaggtttacagaatgggctctaaagtgtatcgggctgcattcgcgtgttcgagagaataggggcaaaggaaaccatgacactgtcatcgaggttcaacttcagttgtctgctttcaagacatttcttgatcttgctgataatgagcttactgggaaggattttacggaggcttttgatgctgcatgcttccctcttacactcttttcaaccaccttcgaccaaggatgggcgtcaggaatatcagcagctgcagtacaagggcttttagagttgttggtagagggtggtgcagacaatgtaaaccaatgctttcttgaagctgcacgctatggcagcactgagcttgtccggatcttacttcagattgctcaaaggaacagcttggacattgatgtggatctagcccttggctttgctgctcactatgggaagatagaaaccatgggatgcttggttgaagaaggtaatgctgttggctttcttggccctttgatgcgtgctgctgaacgtggatgcctccaagttgtggaatggtttgtcaaccacgggtgtcgagaaatggagctttgtctagctcttactgctgccacctctagtagccagattgcagttgctgcttatcttcttcctcttgtcccgcaacatgttcttgcccccctcagcatcgagattatcaaggctgctggtgagaggagtacaggttccctgcatggtgtcgattttcttctccgttcagatttcctcaatgacccaactgccacatatgctgtggcagacagtattgcaagatgtaccgattaaactgtggatgcaaagcttacgtctttcatgaatgagcattggagcgaggcagctttttctgcaagatttgaatctgcacaacagcactttgttaatttcatgacgataatgcaaaggggggaatcaccaatcctcctaggggacctacctcttgagctggtaattgccatggcctacctgccactctataaggaatgtatgagttccattgagcgacttttgcctca

SEQ ID NO: 15361 - DNA, 764 bp, Sorghum bicolor
  Clone ID: SORBI-28MAY03-CLUS49_259
gccggccgggttgggaaccctagactccaccccccaccccgccgcacccaaaccctacccagccgccgccgtcgccgccgccgcagcgcggaggcgaccccccaaccgccgccaagatgcagatcttcgtgaagaccctgacggggaagaccatcacgttggaggtggagtcctcggacaccatcgacaacgtgaaggccaagatccaggacaaggagggcatcccgccggaccagcagcgtctcatcttcgccggcaagcagctcgaggacggccgcaccctcgccgactacaacatccagaaggagtccaccctccacctggtcctccgcctccgcggtggcgccaagaagcgcaagaagaagacgtacaccaagcccaagaagatcaagcacaagcacaagaaggtgaagctcgccgtgctccagttctacaaggtggacgacgccaccggcaaggtcacccgcctccgcaaggagtgccccaacaccgagtgcggcgccggcgtctttatggccaaccacttcgaccgccactactgcggcaagtgcggcctcacctatgtctacaaccagaaggcgtaatcgcttgcgccgatttgctttacccgcctacctatcaagcatccacctgttggttactcgaattgaatctcatttagatctgtctgaggttgaaacttaaatggagcagtagtatctatcatattggtaaaaaaaaaaaaaaaaaaaaaaaaaggaaaaaaaacaaaaaaaaaaaaaaaa

SEQ ID NO: 15362 - DNA, 675 bp, Sorghum bicolor
  Clone ID: SORBI-28MAY03-CLUS49_260
tggcttcaaccctcagacgcagtcggccgccgcagaccgggagaagccgacgcgccgcaaccgtatcctcagatcagcggcgggccgtaaccacgccactttgctgccgcccgacgagcagcgtaacagttgccttcagccatgggtaaggagaagactcacatcaacattgtggtcattggccatgtcgactctggcaagtcgaccaccacaggccacctgatctacaagcttggaggtattgacaagcgtgtgatcgagaggttcgagaaagaggctgcggagatgaacaagaggtcgttcaagtatgcgtgggtgcttgacaagctcaaggctgagcgtgagaggggtatcacaattgatatcgccctgtggaagtttgagaccaccaaatactactgcactgtcattgatgcccctggacaccgtgacttcatcaagaatatgatcacgggtacttcccaggctgactgtgctgttcttatcattgactccaccactggtggttttgaggctggtatctccaaggatggccagacccgtgagcatgctctccttgctttcacacttggagtgaagcagatgatttgctgttgcaacaagatggatgccaccacacccaagtactcgaaggcccgttatgatgaaattgtgaaggaagtctcttcctacctg

SEQ ID NO: 15363 - DNA, 1529 bp, Sorghum bicolor
  Clone ID: SORBI-28MAY03-CLUS49_261
gatccgatccccaatcccccaactcgactactgcagcgagaggagagagaaggaaaggagcagcggcggcggcggcggggaggtctatggcgtccacggcagggtacctggcgcggcgggcggcgcagaaggagcgggtgcgtctgctctaccgcagggcgctcaaggacacgctcaactgggccgttcaccgccacctcttctaccaggacgcgtcggatctccgggacaagttcgaggccaaccgacacgtggataacctggacgtgattgataggctcatcgacgatgcggaggctcagtacaggaacttccagcaccccgatccctacattgttccatgggcaccaggcggcactaaattcactagaaacccccctccacctcaagagatgcggacattgaaatgggaatgcatcaggctgatgcttcagacaacttaaaggatttcttgaagaaggtcgatgcaattgagagtttaattgcaaagctgacaaatctattgaataagctccagactgcaaatgaggaatccaaagcagttacaaaagcaagttccatgaaagcaattaagcagcggatggagaaagatattgatgaagtggggaaaattgctcgtcaggcaaagacaaaagttgatgaactggaaaaagataacttattgaataggcaaaaacctggatgtggaaagggttctgccgtggaccgatcaagagagcagactactggagcagtaaaaaagaaattgaaggagcggatggatgattttcagaccttgagagaagcaatcaggcaagagtatcgggaggttgttgaaagaagggtttttactgtaactggtaatcgtcctgatgaagagacaattgatgatttgatagagactggaaaaagtgagcaaatattcaaagatgctatccaacatcagggaagaggccagatactggacacagttgctgaaatacaggagcgacatgatgctgtaagggatctagagaggaagcttttggagttgcaacagatattcatggacatggcagttcttgttgaggctcaaggagacatgatcaacaacatcgagacacatgtctcgaacgccaccaatcacatacagcaaggtgtgaccgcactccagagcgcgaagaaactgcagaagaattcgaggaagtggatgtgctatgccatcatcctactgctggtgatagtggtggtcattgtcgtcgcggtcatccagccatggaagaagggctagcgtggttccaaacagggaggagggcatggcatgggatataccttgttgccctttttgctgtttgtgtaatatgtgtgcagttttttgtggggtgattcgtgatttattatatcgttgtacctatggtcgacacatcagaagctttggcatttctattcattctgtgtgtgtgtgtggggggggtggggggggggatagttcggtccggtggtaatgacactccaatggctcccgctccgtgaaatgtcgttgtgatcatatgctgatgaaaaatggcgct

SEQ ID NO: 15364 - DNA, 807 bp, Sorghum bicolor
  Clone ID: SORBI-28MAY03-CLUS49_262
ctgtgcggcgctcgaggcggccggtcagcccccgcctcctacgcacacgggaataacctgctgggctaccgccgccgccgccgccgtccttagctgatatcatcgccggcgaagagcgccccagatccgccctcccgtactatggagtccgtggtgaacccgaaggcgtacccgctggctgatgcgcagctgacgatgggtatcctcgacatcatccagcaggcggccaactacaagcagctcaagaagggagctaatgaagcgaccaagaccctcaacagggggatatcggagttcgtagtgatggcggcggacacggagccgctcgagatcctgctccacctcccattgctagctgaggataagaacgtgccatatgtatttgttccatcaaaacaagctcttggccgagcttgtggggtgacaaggccggtcattgcttgctcagtgaccagcaatgagggtagccagctgaaacaacagatacagggtctcaaggactctattgagaagcttctcatctgatttaccgaagacgtttcagtgtgatgggcctcagggacacaattttcagaggcttggactggtgatggtgtcttgtttactagattttacgctttataaactatgtttgaacactgttaggtcaaccctacttgaattgtgctgtgtcttttatatttgtgactgtcatgtattctcaagatgcttctgcatcatggtggcttggtttctcttgagattctgaccatcattgtaacggttgattacgatgggtttgagaattggatccattggatgggtgcc

SEQ ID NO: 15365 - DNA, 690 bp, Sorghum bicolor
  Clone ID: SORBI-28MAY03-CLUS49_263
agggcccttttttttttttttttttcgccgatcaatttctgcattaacattttattgcaagctagcaccgtgcagccataattttagtagtacacatcacatggcaaacaaaccatacatgctatctctgactctctgttatttcttttttcatcgtttttcacccttgattatgtagcacatacatatgcatgacacccgtgaaacattacatcagcaactggtatgtatcctactccaggcatctgttccacctgcatctgcgtatggaagcgcacggcgtagctaggcggcgaggggggagatcagtcgctgtcgctgctgctgctgctgtggccgtcatggtcgtggccctcgccgtgcttcttctccttcttcttcttcttgtccttcttctccttgtggtccttgtccttgtgctcgccggacttctcgccgtgctcgccggtgatcttgtccttgatcttctccacgatgccctccttgtgctccccgtccttcttgtggtgctcctcggccttcttgtgctcctccttcttgtgctcgtcgtccttcttgtggtcgccccccatgtggagcgtctcctcgatcttgtggatgatgccagacatggtggtgacttgtcttttttttctcaagaaaagggattggaatgctagctatgcgtccgtcggtcccggcccggccggc

SEQ ID NO: 15366 - DNA, 806 bp, Sorghum bicolor
  Clone ID: SORBI-28MAY03-CLUS49_264
accgatcaatttctgcattaacattttattgcaagctagcaccgtggcagccataattttagtagtacacatcacatggcaaacaaaccatacatgctatctctgactctctgttatttcttttttcatcgtttttcacccttgattatgtagcacatacatatgcatgacacccgtgaaacattacatcagcaactggtatgtatcctactccaggcatctgttccacctgctttcaagccaacatcgtcaacatcttgagatcgatccagcaaagatcaaaaccaaacaaaaaaaaaagaacttttaattgttcaagagcaataatctaggcgtataagtatgtgcatggtgttcggccagagcccagcccaaatcacctgcatctgcgtatggaagcgcacggcgtagctaggcggcgaggggggagatcagtcgctgtcgctgctgctgctgctgtggccgtcatggtcgtggccctcgccgtgcttcttctccttcttcttcttcttgtccttcttctccttgtggtccttgtccttgtgctcgccggacttctcgccgtgctcgccggtgatcttgtccttgatcttctccacgatgccctccttgtgctccccgtccttcttgtggtgttcctcggccttcttgtgctcctccttcttgtgctcgtcgtccttcttgtggtcgccccccatgtggagcgtctcctcgatcttgtggatgatgccagacatggtggtgacttgtcttttttttctcaagaaaagggattggaatgctagctatgcgtccgtcggtcccgg

SEQ ID NO: 15367 - DNA, 1696 bp, Sorghum bicolor
  Clone ID: SORBI-28MAY03-CLUS49_265
ttacacttgcattggtatccaactgcaatcttcacacacacacacacacacacacacacacatataccagaccggctccttgtgatcgaagacgtaaacttggcgggagcaatcagagccagcagggagacgcccagaccagagaccaccaccggcgacacgctcgagaatagcggcggcgcaggtccccctccatctccgtcgtgagttctcgcggcggatctccttcccccactcgcgctcaggctcggtccctcagcgcagatctccttttcccccactcgcgctcaggctcggtcccagggattggatcttccgcgcgtcggcggctccccctcggcggcctccagcgacggaggggcagtcccaggctcggcggcggcgtcggcggctccccctcccgcctccgtcctccgcgcaccggccggcgaccctgcgtcattctaggttctgcgcacgcccgcactgatcttcggactctggggctcaaattcaccgtgaataccctgacgctacgagaagttgtcacggtagggatctcaaagggaggtgcgaagacccaactgccgtctctgatgggcttcgccggccgggtatccgcgctgctcttcctcctggtcgctggtgctgtagcaaatgaccaggtcttcaccacttcaggtgtgacatttgggcggagttcgcgtgagccaaggtaccgcgtcgaattccatcctgttgattcgccgttccatccagagaatggtcaggaatccgtaccaatggctaatcatgaggggaaacgttacaagtgctttctaccagttgaagaaactaaaaccatgaagtcaatgctcccacaaaatgcaactaatgttatagtagaaagtgaaaggagaattaagccaaaggagccagatgagttacttgaggttctcaaggatcagtgtttctacaggcacgaaggttggtggtcgtatgagttctgttatcatgggaaaatcagacaggtccatgtagacgatgaaaaggttatccaagaatttgttctaggtgaatacgatgatgacgcgactgctgcataccacgaaaatagcacctctgagttagctaatgatgacaatcatgtgaaagatatatctaagaggtatcatgttcacttgtataaaaatgggactgtatgtgatctcacagatattccccgggagacagaggttagatttgtctgctcggagcctactgtactgattagttcaatcaaggagatctcttcctgcaaatatgttgtaacaattcaaagtcccatgctttgcaaaaacccgttgttccagcaagagaaacgaaccctctccatccactgcaatgagttgcctgctaaagcagaatccaatgtggtggatgactcgcttccaaaagaagcgcagatatccatcatccctgatcaggatgggctacatgattttccagcttatgctacttgatatgcctccaataatcatgtctgatgtagaaaaggcacagttttggaggcgcagtggcaactgagcaacaaatgtattaactattatcccatggatcctacagcagaggctccttgtaaagtaggttgagacgatcattttgcagtgctaattatataggatgattatacgagggtagaaaagtttctcagtattagtaaaggaaacaagtttgagacagtaatatttgcttgaaa

SEQ ID NO: 15368 - DNA, 1433 bp, Sorghum bicolor
  Clone ID: SORBI-28MAY03-CLUS49_266
gcacgagggcggcccggcctggatcaagatgatggagaaatcgctgcccaccatgacctaccaggcgtggaggagggatacgcagaccgggcctccacagtaccagagtagcagtatctttgagaacgctacaccgtgagtaagtgagggacttcttcggggacgacgagttccgtatgtccaacaagtgggatgatatgcttatttatcataagacactagaggagtgccagagcactgggacgatgaaagtacattgggtccggaagttccgcttcttctgcagtgactgagagtacataattgctcgccggatatggaaactggggggcgcctattattgtgtcacaaagggtataccatgctcatccgttccacggcgtaataaacctcgaagagttgatttgtattattcaagctggtgcatccgtgcagtggaatccaagagagggaacggagggttgacagcctgtgaggttctcttgtttcaccatgaggacatgggtatcccatatgagattgcaaagcttgggattcggcaaggaatgtggggatgtgtaaagaaaattgagcctggactccgggcctatcaggaagccagggctgcaggggagccagcgtcacggagtgccttgatggcccgaatcaatactaaggtcggtgacaattttgttcggtcactggaatccaacagcgacgaatcagaaatcgtggaagcagaagagaagcctgcgaggaaccacgtggcaaggttccttgtactcggaggggcagttgctctggcctgtactcttgatcaagggctcctaaccaaggctctcatctttggcgtcgcacggaaattcgttgggcagaggaagacattgtagcatctctgatctttcccagcgtcctccacgtggcccatgtgctgattagactcgccctgattcgctgacctggagcggaggaaagaggtgattcagtggctggtttattggcgctaattccattgtgactggaagagagcagatgaagagcattttggtgtacatatattctgtgccggctgtcggataatgaggaagagggaatagggtaaacgatgtacttcccatttggaaaaggaattccttactatatatataaatttgtttcatgtaatcttgtatctcagaaccagaccagatcagatgattatgcagatgagaagaacaagtgtttttctgcgtgccgtgttaacgtaagaggagcagtcgatggacttgctggtattgggagagggaactcaaatgtgcctggtgcagcttgggctcctacacgttatgtcttctaccgtgttccttatgggctcggtttaagaaatgggcaacaatttgccaattatgaatcagaacctagggtgggccgcaatggagatatttcagcaaatggtgtgactgcattggttaacc

SEQ ID NO: 15369 - DNA, 731 bp, Sorghum bicolor
  Clone ID: SORBI-28MAY03-CLUS49_267
agtttttcatcgtgttgtcatgcctgatttcagtctcagtaaacttcagtacttttctcgtgattgggaagacatctcctgtaacttaccaagttcttggccatctgaaaacatgcttggttctcacctttggctatgttctgcttcacgatccgtttagctggagaaacatacttggaatcctaattgcggtaattgggatggttttgtattcatacttctgcactagagagactcagcaaaaaccagcagaagtctccccacaagtaattcaggcgaaagagggtgaatcaaaccctctgatctcagactccctgagcgctgctgaaaacgggggcagtgccaccgacgacgaacctctgaaggtaccaatgtggagctcaaagtactcgaaggcgtgaaggctgttctgttactagtgtacggtgctatacagaattcagcttggttaggcagatactagggttggaaggcaaccctgttcctgttccatttttggccttctattttttttcttcctttctggcatatactataaatatatgtgctgtcagtaaatggatctcactcttcagaggataatacctcagctcgagacgagtggtctgcctgaaagctattttcttatgctccactccacatgtgtaacttggtagatggacatgatgtcaacagtagtagtttgcattcttttgtactagtagtatatgtatatttctcagtcttctgtt

SEQ ID NO: 15370 - DNA, 1047 bp, Sorghum bicolor
  Clone ID: SORBI-28MAY03-CLUS49_268
ctcgaggccggccgggccgggttgaacacgagctctcctctcttcttgacgaagggcggtggtttggttactggagccagcttggtgggttcggttgccaccaaagcgcccccgcgaaatctcgccgccgaccgccatggcagccgccgacgcgacgcgtacgctgctcgttgcgctatctctcgccgtagtcgcctgctgcttcccgcagctggcggcggcggacacgaacggcgtctacgagccgtgcagcgacgcacggatccagcgcggggatggcttcaccttcggggtggtcttcgcgggatacaacaccttcttctccggcaacacacagctctccccctgcgaccgccgcctcaatctcgctgcctccgggcagctcgccctcttccgccccaaggtcgacgagatctccctgctcaccatcaacaccaccaccggattcaacccagcttcagctggtggattcatggtagcatttgctggtaggaagtatgcagctagatctgttccgatatttgtatccaacacctcagttacagtgtccagcttcaccctggtacttgagttcaataaaggcaggcttcaaaacttgcactggaagaaggatggctgtggagcttgctccggcaagtcaaactttgtctgccttggcaaacaaacatgcgccatcaggacgcagagctgcaagacccaagggcctgtcgactgcagcatcggcatccagctggctttctctggtacggacaagcacgagtcagttctgaactcatggtacgaagtctccaacctcaggcaatactccctgtatgggctctactcaaacctcaaggacaccctgagtggccagttcaacaagatcttctaggctgttttggcgctgccaattgtctattctctcctccttccgcctctttctgtcgaccgctctgaatcctgatgttgtgcttaacattattttggtttgccgcccaggttgcttgtatgcagatcagttttaaccctgtctaagctctaccgtatgtaccgttgcccgttggtgtc

SEQ ID NO: 15371 - DNA, 909 bp, Sorghum bicolor
  Clone ID: SORBI-28MAY03-CLUS49_269
ttcgggccgcctcacttcaacccctccttctcagctcctcgcgccgccgccgcgtctcctcttctacaggtaagaaggagagggagaaggcaaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccacgcccaactgctggccctcttcgccccattgttcaatgccagactctcaagtacaacatgaagtcaagggccgggagaggctttacccttgaggagctgaaggctgcgggcattccaaagaagcttgctccaaccattggcatttctgtggatcaccgccgcaagaacaaatccctcgagggactgcaggccaatgtccagaggcttaagacatacaaggccaagctggttatcttcccaaggcgtgctcgcaaggtcaaggctggtgactctactccagaggagcttgccaccgcaacccaggtccagggtgactacatgccaattactcgtggtgagaagcgctcagttgaggttgtgaaggttacagatgagatgaaggagtttgcagcctatggcaagctccgccttgagcggatgaacaagaaacacctcggtgcccgccagaagaaggcagctgaggcggagaaggaagataagaagtgaagtggccgaacatagtacctgttttgttctattcagccattagtggatgctactaccatcaagtgcttgttctaagttttttttgggtactggaaatagagaccagacaaacattttggtgtcctactgtttgataccttgtacttgtttgcgaactcagctatctaatgggttattgaattcttgcc

SEQ ID NO: 15372 - DNA, 570 bp, Sorghum bicolor
  Clone ID: SORBI-28MAY03-CLUS49_270
ttgctgaggccaatgttggggactttggtgcggcagcaggatcaaaggactacgttcatgtacgcatccagcagggtaatggtcgcaagagtttgactactgtccagggattgaagaaggagttcagctacagcaagatcctcaaagatttcaagaaagagttttgctgcaatggtacagtggtccaggacccagaacttggacaggtcattcaactccagggtgatcagaggaagaacgtttttaatttccttgtccaggccggcattgtgaagaaggaacacatcaagattcatggtttttgagcaaccgccgggtccatagcaagccctgcatgcaaagcagctatatatttgaggtggagcatatctatctggctgtgtacaagcaggcctactactacgcctgcgcgttttcctatactacacataacacatagccccctccctgcgtgtatgcttgttaccgttgtgtcgaatcttgtacgaggctccatcgaacttcgatggctcgcttctttatcagaacaagattgaataaacaatatttggtaaaaagggggggcccggg

SEQ ID NO: 15373 - DNA, 681 bp, Sorghum bicolor
  Clone ID: SORBI-28MAY03-CLUS49_271
gccggccgggccgggctctcccggctcagactcgtctgttgcagctcctcctccgccgccgccgcccccgccccgcatcggtttccctcctaccctccgccggtagccgaaagcaagatggttctccagaacgacatcgacctcctcaacccgccggcagagctcgagaagctcaagcacaagaagaagcgcctcgtccagtcccccaactccttcttcatggatgtcaagtgccagggatgcttcagcataaccactgttttcagccactcccagactgttgttgtgtgcccaggctgccaaactgtcctctgccagcccacaggaggaaaggcgaggctcacggagggctgctctttccgccggaagggagactagagcggggtctgttagtactggatcggttgtcaatctacagcatgtagtcttcaagttttgctctatgctagtgtcatgaattgccttagctaaggctttccataatgttgttcgactgctgctatgtattgctattgcatgttggctattgctagacttttgctggtttggttcagatcatgatttgaattatatttatgctattgacgatatttggtgacatgatggtgtttcttggtagtcaatagtcatggtcacttatcctttggatggagggaaaaaaaaaaaaaaaaagggccccta

SEQ ID NO: 15374 - DNA, 718 bp, Sorghum bicolor
  Clone ID: SORBI-28MAY03-CLUS49_272
acgctcgaaggcccccaccaaccaagcgcgtcccgttcctgagtgggagatgacgagcccaatggtggccaccccggtccagctccgcacaaccggccgcctcaccttctgctgctcctccttccccagcgcaccagggacagccaccaccaccaggcggccgcggcgattcgcggcggcgagggcgtccgcggagacgatggcgacggagaagctgggcatcaaggtggagcgcaacccgcccgagtcccgcctctccgagctcggcgtccgccagtggcccaagtgggggtgcgacaagagcaagttcccgtggacctactccgccaaggagacgtgctacctgctgcaggggaaggtgaaggtgtaccccgagggtcacggcgaggagttcgtggagatcgccgcgggggaccttgtcgtcttccccaagggcatgagctgcacctgggacgtcgccgaggccgtcgacaagcactacaacttcgagtagccgccgacgacgacgacgacgatgtgtggtaagcggtggcagtaattggtgatggcctagtccaaacgtttggattgctcccgctagcttcctagttcctaccacgtgcttgtattgtagtcttgctgtgctcttgtacactgaacctctgatgctccattcaagagttaaacagcataataaagctccggattagcggaaaaaaaaaaaaaaaaaaggccccta

SEQ ID NO: 15375 - DNA, 1590 bp, Sorghum bicolor
  Clone ID: SORBI-28MAY03-CLUS49_273
tcaaatagctgacactttcacttggggtaaagagagcacaatgtgaaaagtactacaaacggtcctgagttctgaccaaagcttgttcaaatcaagaacaaaaccatgtgaaaagtcaatactttggatactagcagtacagtattttagaagtaccgggtaggtcctttacattacatggccaaaaaagcaactcgaatcctggtaaggtttggactcaagtagcggtgaacacaaatcctttgcgaaaaaacataacagggaacttcatgtaaaagaaaccgagggcaccacgctgtgaatcagatattattgctaccagcatcttgatttcacaccaaagcatcttccctggttatatgacatctgaaccctcacatttagcatcagaaataaactgttaatccctcctcccttgccatgacatggtgattcagatctatctacaactactaactccaaaatcaccagcacagttgctatttcttcagtaaagctccaaaaattgcaggtggatgagtaaaagctacggccgcacaatatggcatggtctactaggcaactgattcaatgtgattttcactgtcctccttgagacattccataggtagcttgaagcttaaacaaaacatagcctatgcagcataagcctccattgctagggaacgaaggaacctcataagtgttttctttgctccagaaagcttcacattagaatcttccccatctttattgtgtgtgctttcttggaccatgtgagctctcttcacaagctttcgcagttcctgacgatcaaattcaacactatggacagagtaaacttcattagtaactgaaatgtctttgcaaaggaggccatcaaaccatctatctgcaattttgatatactcttgattgtcctcttgttcatcaggtaggtcctcgacttcctcctcttccaccaacaatgtaccttcactaagtaaggcatgtaacttgctctcatctccatccttggaagcctgtattagagtatccatcaattctggttgtgcattgcgcagaagtcttccgatgtaattgaactgtctcctctttccttcccgcacatccggcccaaatttcttgacgagcatgagcgcatccaacacctcgcgctccagcgacgcggcactgaggatgcgcttgatctgaggcggggagaagctggcgaggtccatcccccacttcacggcgcggcgggcctcccgcttcagttcgttgcggctcttcttgaaggactcggcgccggcaccggcgtctggatcgtcggtgtcgtcctcggcatcggagggcaaggggcggcctgcgggtcggagggcgcgcgggtggcggcggaggccaggtaagggcgccgcgagtgaggacaggaggcgggcctccttgaggaagaggagcggacgacgtagcagcacggcggcggcggccgcgtgcgccatggcggaggggttgcttggctcaattccagcgagacaacggcggggacggaagggttcggcgaccagggcaccccaaggatttaggagcacatgaccgttcgttcgcagctccagccagctgaacgaactggat

SEQ ID NO: 15376 - DNA, 2164 bp, Sorghum bicolor
  Clone ID: SORBI-28MAY03-CLUS49_274
ctactggatcgtcctcttcttcgccagcgccgccgaaccggccaccagcctcctccggtcctcccacctcgaaagcacggaagtctcccggaaggagctgtcacctagcagccatcgctggcgcggccgtccacctcctccctctcctcctccactgttattggattggcgtcggagtggagatcaacccgggcttggaatttccttcgttggtaaggaaccctaatttggtcggatgggattttcatcttcgacaacgcccgcgaggtcgatcgacctcagctgacgcgagggattggaaagctaaggtgcgggtgtagctaattttctaggaagattggggtttcagctcaaacccccatgctcgacgctgaggacgaccctggcgggagatgacgaggatcttcgtgcagcgcgggaccgccggctcctcgtccagctccggtcgctcgggctcgcagccagcgcagcagccggcagcagctgcccgggaggaggagttgccgctgcaacctcagccacagctgccggagctattggccatagatgatacaactgagcatttaaatgagggcagcgagaacagcagtagcagcaataagccgttgaggacggatgacaccatttcagagagctcgagctctgcagaggagagggctgccagggagaagcctcctaaggatgactctaatgtaatcaaccccactttcttagtagaggaactgatagggctccagatccctgatcagattgaacatggagattctgtgccgtcaggcactagttcatcacagatggcgggtgcagcttcacacccgccaccaccgccagctccacctccaaaaccattgttggggaataatgggttgcggagaatggggcctggaagttcaaacagtgtgcggattggatcttcaagaaggccagtagcttggccaccagtggtagcccggacatctgcttcaggttctcggccttcttcgcctaggtcactcgttgatggtgaaggttacaatagtgctgatgaacagggcccctgttacccctcgagttatgatgattcggaaagggagcgtatgtttgagcatgacctaaggcgagtgaaagggttggaaatcagaaagatggccgaagacgggaactgtctattcagagctgttgctgatcaagtatatggagacgcagaagcttatgacatggctaggcagatgtgtgttgattatatggaaagggaacgggatcatttctctcagttcataactgaaagttttacattatactgtaagaggaaaaggagagataaggtttatggcaacaatgttgagatccaggcatttgcagagatgtacaatcgtcccattcacatatattcctacggtgcagagcccattaatatttttcaaggaagctataacacagacgttcctccaattaggttaagttaccatcatggtaatcattacaattcagtggttgatccccgccgacagacagttggggcaggccttggatttagctcccttagagggaccaataatgttgacagggaccaggtgaaggctgcaataaaagctcagcaagaccagcaaattgagaatgcacttttggctgaagggcgattctactccgatctggagttaacagagagggaaatagaacggatggtgatggaggcctcgcgttcagaatatctggccaaggagaaaaagcttaacattagggagtcatcgacatcaggggcagagccatcgtcatctgccgcaattagtggttcctcccgttcagttgctggagcagatagaggcagcgaggactactttgtgctcccagacactgtactaactcgcagcatgcagttgctcctggcaatgggcttcagctacatccaggtcatggaggcctacagcatattcggcgaggacgtggactccatggtctgctacctggtggagaccggaggcaccggagcctcagcaggtggtagcaatcgccggaaaggaaaggctgctgagtgatgtgcgcaccttcattgctgtgaatgtaattgttgttgatcgaaatcgttgggcataagtcatactgacagtcttgtgagttgagatgtcgatatacctgctaccttatgggtgatgaataaatggaactcatgacttgagacttttcg

SEQ ID NO: 15377 - DNA, 1328 bp, Sorghum bicolor
  Clone ID: SORBI-28MAY03-CLUS49_275
ggtacctgagaaaaattgctctgcagagtgatgctgtacatatagcaactgacagatgctcacaacaaaccatatagcaacattaagagtgtacagcgtctgtgcacatcagatgtacagcagcgacatttccagcctctgagcatttctctatacaacgaccaaggcccatctgctaacaacttttaaacactggtactctgatgagcccaactaaagcactagagggaacatacagaccgttctgaaaagcatatatataggtaaatgtctggtgacagatgacgctgtttagttctcagcatttattccaaaaatccggaccttgtgcatattcggtagtttggcgaccacaagcacactaacggcaagggtattgaggaagagcataggttgttggtagtctgtggtgtgcaaagctatcagatacaggactacaggaacaacaatgaggaacttcctattgcgagtaagctgtttgccattgtccatttgttcccaccaagtcaatccgttgtacattccctggtcatcagcaaaaggtgttcctttcttccaatggaaaaagtggtatgtgatcgcgaagtggaagaggttgacgacggtccacgcggtgccaggggtgcagccgaagacggagaggacgaggagccaggagaagaagacgatgaggatgtaggtcgtccagacgcccgggtacatgaaccactcggtgttcttgttcagatccgcgggcgggaacgcctgcacgtacagcttcgccatcccggggctcccgagcaatccctaatcgccggcccgccggcctcgacgaacccttccgcccccggcgacgggagaacggcaggacacggtggggggacagacgggagcagcaacgagctgtgtggttgcgtgcttgcggtccgctgtggcggctgcggtggcgggatttataggtgcgggatcggaggggacgccgagggagggagggagggaggttggagccgcggcgttcaaagatgggggcgaaaaattaacgaggctacggcggtcgccgtgagggcggcggcggctatggcggcggcggcggctacggtggcaaccgcggtgactccggcggcaactggaggaactgattgtgtgggcccaccctggcttcggccaagttatcctagctatctatctatctatagtatcgtgttactgttccgttggattctgagttacccatgtgttagtgtccgttgaacctttggattaggtgttggtacccccgtgttcgatgatgttactgtccgctttggttactttccgctatgaaatgagagaagagtgagcaaggtttt

SEQ ID NO: 15378 - DNA, 1247 bp, Sorghum bicolor
  Clone ID: SORBI-28MAY03-CLUS49_276
gtgctctctcagaggtgggttggcttctcctccccctcttaccaagtcctcgtcctcggtttagggttcgttagggtttttgtggaggggagatatggcggcggcggacgtggagtaccgttgcttcgtcggtgggctcgcctgggccaccaacaacgagaccctcgagcttgccttcgccaacttcggccaggtcctcgactccaaggtcatcaccgaccgggagacggggaggtcccgcgggttcggcttcgtcaccttctcctctgagcagtccatgctcgacgccatcgagaacatgaacggcaaggagctcgacggccgcaacatcaccgtcaaccaggcccagccgccgccgccgccgcgtctcctctacaggtaagaaggagaggaagagggcgaaatggtgaagcacaacaacgttatccccaacgggcacttcaagaagcactggcagaactatgtcaagacatggttcaaccagcccgcccgcaagcagaggcgccgcatcgctcgtcaaaagaaggctgtgaagatattcccacgcccaactgctggccctcttcgccccattgtgcaatgccaaactctcaagtacaacatgaagtcaagggctggtagaggctttacccttgaggagctgaaggcagcaggcattccaaagaagcttgccccgaccattggcatttccgtggatcaccgccgcaagaacaaatccctcgagggactgcaggccaatgtccagaggcttaagacatacaaggccaagctggttatcttcccaaggcgtgctcgcaaggtcaaggctggtgactctactgtggaggagcttgctaccgtcacccaggtccagggtgactacatgcctattactcgtggtgagaagcgctcagtcgaggttgtgaaggttactgacgagatgaagtcgtttgcggcctacggcaagctccgccttgagcggatgaacaagaaacaccagggtgcccgccagaagaaggccgctgaggcggagaaggacgagaagaagtgaagcaggtatacataatagagatagtaccctgtttttctccgatgcagccactagtggattgatactaccgtcaagtgcttgttcttaagtttttattttttggtgctggaaatagagaccagactatagttttgttgcccaactgctttatacctgttacttggtaacttggttgcaaactcatcacctattttcgtctctaatggctcctaggttt

SEQ ID NO: 15379 - DNA, 1790 bp, Sorghum bicolor
  Clone ID: SORBI-28MAY03-CLUS49_277
gcacgagggcctccctcccgtctcctccctcctccccctctgctggtcaccactccgaatcaaatcactgctcccccagcttcctttaccttcgcagcaagcaagccggtaccatcaagctagatcgcggggaagctcctcgcctcccccatcggcgctgctccggcgcgcagaagcgtcctctcgcggcggccggggagacaactccgcgccgccagttgcggcggcggcggcggcttccgtgaggtggcctttggccccaggggcggcgggctcgtggcggccggcgggatgaacagccacgcggccggaacaagcaacggcggatccggggatgcggccgccgggggcgcggccaggaggaacaccaggatgcctaagtattccaagttcacacagcaggagctgccagcttgcaagccgattcttactccaaaatgggttgtctctgttttcttcatcgtcggagtcatctttgttcccattggtgttgtttcactgatagctgcaagagatgttgttgagattattgatcggtatgatgaggcatgtgtgccaggcaacatgactgatgacaagcttgcctacatccagaatgaaaccatatccaaagagtgcataaggaatcttacggttacaaaggatatgaagcagcctatttttgtgtattatgaactcgataacttctaccagaaccataggaggtatgtaaagagccgaaatgatgcacagctaagagatgctagtaaagctaaccagacatccgcttgtgaacctgagaagaccacggctaatgggcaaccaattgttccttgtggcctcattgcttggagcttgtttaatgatacatataattttactcgtggtactgagaacttgacagtggacaagaaagacatctcctggaagagtgatagggagcataaatttggtaaagatgtctatccgagcaacttccagaatggtgcacttaaaggtggagcaacacttaacccaaagatcccgttgagtgagcaagaggacctcatcgtttggatgcggactgcagcacttcctacattcagaaagttatatgggagaatacactttgacctcaaggagaatgacacaataacagtgagattgaataacaactacaatacatatagcttcggcggcaagaaaaaactggtcctctcaactgcaacctggcttggggggaagaacgactttcttggctttgcgtaccttatagttggcgggctctgcattttcctggcatttgcattcaccttgctgtacttcgtaaaaccaaggaaactgggagaccacaactacttatcctggaacagacaccctgcaggacgctaagatgttttggaatgccaagtgtccatgctacttgaagtgtaacttgtatgaaatgaaatgctctgaaccagaaatctgttgggcatatgcaagtatggttcaggctagaacttcatgtacatttttttacaaaagggatctaggtggctacgtgattttgtttcttgtgttctttagagctgcatgtagcagtgatcatgagaatacctatacctatagatctctaatggcttgcttcgtggtatgagcgctctaaacggtttccgctaatagtttactatgtgatgttcatgcttcgactaccgaagatctgttatcagtcaagggtgcctaggtaacgattgatgtagattgattgtaatatcctcaaagggaaacagtaccaacttctgtacaaatcgatcactgtctgatgtttgtttgtctactacgatttcata

SEQ ID NO: 15380 - DNA, 914 bp, Sorghum bicolor
  Clone ID: SORBI-28MAY03-CLUS49_278
gccggccgggtcgggatccattcacagctcccgcttcgaaatcaaggtagcacaaacagctgcagtttctagagccctctctgccactcgtgatctccaccagccacgatgcctgccctcgccaagcccgcctcccgccccgccaagaccgccgcggcgccgaagccgaagcccgccgccgccaagccgaaggcggccgccgccggtgcctcccacccgccctacttcgagatgatcaaggaggcgatctcggcgctgaaggagaggaccggctccagctcccacgccatcgccaagtacatggaggacaagcacggcgcgtcgctgccggccaacttcaagaagatgctctccatccagctccgcgggttcgccgccaagggcaagctcgtgaaggtcaaggcctcgtacaagctctctgacgccgccaagaaggccgcccccaagccgaaggccaagctcgccgccgccaagaccgctgcgcccaagccgaccaagaaggacgccgccaagcccaagaagactgccgcagcagccaagcccaagaaggccgccgcggggaccaagcgcaaggcgccagagaagaagaaggtcgtggccaagccgaagaagtcccccgctgccaaggccaaggccaagcccaagaccgtcaagtcccccgccgccaagaaggcccggaaggtcgccgcatgagatgggttgcttaggtcgtagtagctctgatcgtcgtgtggtgttggttaggagttgtacaaattaagcgtgtgccccccaaagtgtctctgatggtgtgttctgtcttaggcaagatctatctaccatggtttatttagtgtagcaaatggctaggcttcttgtgatgcagatgtatccagttcatcctatatatgaaatcaacttggtttgcggaattc

SEQ ID NO: 15381 - DNA, 1176 bp, Sorghum bicolor
  Clone ID: SORBI-28MAY03-CLUS49_279
cgaaagatggtgaactatgcctgagcggggcgaagccagaggaaactctggtggaggctcgaagcgatacaaagaatgttattgcaaagccttcagctaacagggagagagtaacgtcaccatcagccatcaaatctacccagcatgcctcagcatttcatactatacagaatcaaacatcacctgctaatctggttggtaaagacaaagctgatgaaggaatttccaatgcagtgaaaatgagccacccaacagaggttccacaaagctgcgtccagcatcatcaccacgtgcattattacctccatgttatgacacagaaacagtcatcaatcgaccgtggatcatcagatgttcagtgtggttcgtcaaatgtgtttgatcctcctgttgaaggacatgctgcaaactatagtgtgaatgggggtgtctcagttggtcataatgggtgcaatggccagaatggaacgagcactgtccccaatattgcaagaccaaacatagagagtgttaatggtaccgtgagccaaaatatcgctggaggtggcattgtaagtgggagtgggagtggcaatgatgtgtatcagaatcgattcccccaacgagaagctgcattgaacaaattcagactgaagcggaaagatcggaactttggtaaaaaggttcgctaccaaagcaggaagaggcttgctgagcagcggcctcgggtccgtggacagtttgtgcgacaatctgggcaagaagatcaagcagcacaaggttcagaaagatgacacggaccttctaatacgtacaacatggcatcttcatcgacagatctgacaattaggtggttcttcccattgcgcatcttcattgacagatctgagaattaagtggttcttcccatcactgatagtaacccattgattcccaacgttagagtactcaataaataagactagttgtcaatttctgtggtcgactccagattatcaccctagtgctatggagtcaaacatgtaatatttatgtatgttcgagcttggcggtttgcaatcttcattttccttgcagagatattcttagccaagtgtcttaaggaggagcaaatcagcagcgtcattgctattattatattactatacatactaatatgattgagctggaattctgttgtagttcatccattcatcg

SEQ ID NO: 15382 - DNA, 744 bp, Sorghum bicolor
  Clone ID: SORBI-28MAY03-CLUS49_280
tggatctctggcccctcccccagtcatccatctctcccacaccgcagccgccgcctgcccgccaccgcgcctgcgacgagatccggcgccggcagcgagctctagcacccgcgacgatcagcagctgccagcgacgcgcgcagcccagcaggaataaatattgttattggtagtgtgatatttataagaagtcaagatggtgaagttcacggctgaagagctccgtggcatcatggacaaaaagaacaacattcgtaacatgtctgttattgctcatgtggaccatggcaagtctacgcttacagattcccttgtggcagctgctgggattattgcccaggaagttgctggtgatgttcgcatgactgatactcgtgcagatgaagcagagcgtggtattacaatcaaatctaccggtatctctctttactatgagatgactgacgagtcactgaagaattacaagggtgagagagatggtaaccaatacctgatcaaccttattgactcgcctgggcacgttgatttttcttcggaagtcacagctgctcttcgcatcaccgatggtgctcttgtggtggttgactgtattgaaggtgtctgtgtgcaaactgaaactgtgcttcgccaagcccttggtgagaggattaggccagttcttaccgtgaacaagatggacaggtgcttccttgagcttcaggttgagggcgaggaagcttaccagaccttctcccgtgtcattga

SEQ ID NO: 15383 - DNA, 751 bp, Sorghum bicolor
  Clone ID: SORBI-28MAY03-CLUS49_281
gcacgaggggaactagctagctagaacactcgatcggcaaaaagaagcaaagcaagcggcgcatcgcagtcgcgggcggcaccaccggccagcaggagcatcagatcgagcggcggccacgccatggcgcaggagggcggcctgaggctggtgtcgcacccgatcgcggcgcacggcgggcggctgacgcggcagtactcggcggaggggcagggcgcgaagaaggacatgtcgccgccgctggagtggtacggcgtgcccgagggcacgcggtcgctggcgctgctggcgcaggacatcgacgccgaccccgccgtgccgtggacgcactgggtggtcgccaacatcccgcccaccaccaagggcctccccgaggggttctccggcaggtagcagggcgccgccgccccaccgcgcgagtacggcggcttgcaggagggaatcaacgactggaagcagcccgggtggcgcggccccgtgccgccctcccacggccaccgcatccagttcaagctctacgcgctcgacgacgagttgcaccttggcaacaaggtgaccagggataagcttctggaggccatccagggtcacgtgctggaagaaaccgagctggtcgccgtgttccaaggagtcgtttccaactaacaccaccatggttcctcacatctctgttggtgtggtgtggtgtgctttgtatttgtgtggcaaccttgtaattttgatcgaataaaaagggaactttacacggggt

SEQ ID NO: 15384 - DNA, 1637 bp, Sorghum bicolor
  Clone ID: SORBI-28MAY03-CLUS49_282
ctactgggtgcagagcgagacgcatccgtccgtcgcctcccccaccccgccgccgccgcgcgtccgtgcgttcgttcgttcgttcgttcaccgcgtagggttagggtttgcggtcgacgccgcgccgccatggcgatcctctcgccgctcgccaccgaggtgttcatccccgtcgccgccgtcatcggcatcgtcttcgccgtcgtgcagtgggtgctcgtgtcgcgggtgaagctctccccgaccgcggccgccgcgtccggcggagggaagaacggctacggcgactacctcatcgaggaggaggaggggctcaacgaccacaacgtcgtcgtcaagtgcgccgagatccagaacgctatctccgaaggagcaacatcgtttcttttcactgagtaccaatatgttggtatcttcatgtctatcttcgccgttgtgatcttcctcttccttggttcggttgagggattcagcacgaagagccagccctgcacctatagcaaggacaagtactgcaagcctgcactgttcactgccctcttcagcactgtgtccttcttgcttggagccatcacctctctggtatctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgtacatcaccattaatgtatttaagttgtattatggtgatgactgggagggtctttttgagtctatcactggctatggccttggtgggtcgtccatggctctcttcggaagagttggtggaggtatctacacgaaggctgctgatgttggtgccgatcttgttgggaaggttgagaggaacattcctgaggatgatcctaggaacccagctgtgattgctgataatgttggtgacaatgttggtgacattgctggaatgggatctgatctctttgggtcatatgctgagtcttcctgtgctgcccttgttgttgcgtctatttcatctttcggaattgaccatgacttcactgggatgtgctacccactccttgttagctctgttggtatcatcgtctgcttgatcaccaccctttttgctactgatttctttgaagtcaaggctgtgaaagaaattgagcctgcacttaagaagcagctcatcatctccaccgccctgatgactgttggtattgctgtaatcagctggttagcccttccagctaagttcaccatctacaacttcggtactcagaaggatgtctccaactggggcttgttcttctgtgttgcaattggtctgtgggctggtctgattattggttttgtcacagaatactacactagcaatgcatacagtcctgtgcaagatgtcgcggattcgtgcagaaccggtgctgccactaatgtcatttttggtctcgctcttggatacaagtcagttatcatcccgatttttgctattcgctgttagcatctatgtcagtttctccattgctgcaatgtacgggcatcgctgttgccgctcttggtatgctgagcacaatcgcaactggtcttgccattgatgcttatggtcccatc

SEQ ID NO: 15385 - DNA, 1899 bp, Sorghum bicolor
  Clone ID: SORBI-28MAY03-CLUS49_283
attcagtccactgctactctgctatccgcgccggagtcgccgccacgattaccatggcctcccgatccgccgggcagctcttcctcgccctcctactcctggccgtcgtcgtcgcggcctccgcttccgacgccgacgccgccgccgggggcgccaagtggcgggaggagcaggcgcgggaccgggtgccgcgggtgcccgggcaggccttcaacaccagcttcgcgcagtacgccgggtacgtgaccgtcagcgagcagcgcggcgccgcgctcttctactggttcttcgaggccgacaaggacccggcgtccaagcccctcgtgctctggctcaacggagggcctggatgctcgtccattgcttttggactcggagaagaagtaggacctttccatgttaatgcagatgggaagggggtgcatgtcaatccttattcttggaacaaagttgcaaatttgctgttccttgattcacctgttggtgttggttactcctattcaaacacctctgatgatgctttaaaaaatggggatgcgagaactgccacggattcattggcattcttactgaagtggcttgaacggtttcctcagtacaaggaacgtgaattttatttgacaggagagagttatgctggtcactatgttcctcaactggctcaagccataaaaaggcaccatgaggctactggtgacaaatcaattaatctaaagggctacatggtaggaaatgctctcactgatgatttccatgaccactatggaatatttcaattcatgtggactactggcctgatctctgatcaaacatacaagctgctgaatgttttctgtgactacgagtcctttgtgcattcatctccacagtgtgataagattcttgatattgctagcactgaagctggaaacattgattcatatagcatcttcacacctacatgccatgcatcttttgcctcctcgaagaacaaagtgatgaaaaggctacgttctgctggaaaaatgggagagcagtatgatccatgcactgagaagcattcaattgtatacttcaatctagctgaggttcagaaggcacttcatgttaatccagtcattggaaaatcaaaatgggagacctgcagtgaagctgttaatactcattggggggactgtgaaagatctgtgctgcatatatatcatgagcttatacagtatggccttcgtatatgggtgttcagtggagatacagatgcagtgattccagtgacttcaactagatacagcatcgatgctctcaagcttccaacaataactccatggcatgcttggtacgacgatgacggtgaggtcggtggatggactcaagggtataagggactcaattttgtgaccgtgaggggagcaggtcatgaagttcctcttcatcgacccaaacaggctctcacactaatcaaatcattcttggctgggagcccaatgcctgtgcaatccagtacacatagcgacatgtaatctgtactatcacaactgattcaagagatgaacatcccaaagcacccaaatcaaccattgttcaacccggcttgttcttccacttgctatagccatttatgtatcagagctactggtgccggttactgtagccgtttatttattggccctgttggtgcttggtactgattctcccctaaaacaggggacagaactacagaatagtttttgttgccatggaactgataccatgtgttaccgacttaccgtgagcctaagaataaatttgcatcagcgtcacagccactgtattctaaacatcgcaccatagtcttttctatgcacaaggtgtgatttctgatgtccgcaataaatgatctggacttggaaaaagatatgaaatgctgctgtgttgcatctgtgg

SEQ ID NO: 15386 - DNA, 1652 bp, Sorghum bicolor
  Clone ID: SORBI-28MAY03-CLUS49_284
ctcagtaccactccttgtttaggacacttgacagcgtccatcatgatgacttccaccagccaaactttgagggtggatcaatcaagaaaggtggtccaagagagccatggcatgatatccattcacggctggaagggcctattgcttgggatgttctttacaactttgagcagagatggaggaagcagggtggcaaggacctccttgtacgtctcagggatctttctgacatcattattcccccttctcctgtgatgttcccggaggacagagaaacatggaatgttcagctcttcagatccattgatggtggtgctgcttttgggttccctgagactcctgaggaagctgcaagagctggccttgtgagtggaaaggatcaaatcatcgatcggagtatccaggatgcatacataaatgccatccgaagggcgaagaacttcatctacattgagaatcagtacttccttggaagttcatatggctggaaggccgaaggcatcaagccggaagaaattggtgctcttcacttgattccgaaggagctctcattgaagattgtcagcaagattgaagctggggaacggtttactgtttatgttgtggtgccaatgtggcctgagggtgttccagaaagtgcttctgttcaggcaatccttgactggcaaaggagaacaatggatatgatgtacactgacatcacacaagctctccaagccaagggaattgaagcaaatcccaaggaatatctcactttcttctgcttaggtaaccgcgaggtgaagcaggagggagaatatgaacctgaggaacacccagaacctgacactgattacatccgggctcaagaggctaggaggtttatgatctatgttcataccaaaatgatgatagtggacgatgagtacatcatcattgggtctgccaacatcaaccagaggtccatggacggtgccagggactctgaaatcgccatgggcgcataccagccgtaccacctggcgaccaggcagcctgcccgtggccagatccacggcttccggatgtctctgtggtacgagcacctgggaatgctggatgatgtcttccagcgccctgagagtgtggagtgtgtgcagaaggtgaacaggatcgccgagaagtattgggatctatactcgagcgacgacctggagcaggatctcccaggccacctcctcatgtacccaatcggtgtcactgccgacggcaccgttactgagcttccggggatggagaacttccctgacacccggtgcccgtgtcctcggcaacaagtcggattaccttccacccatcctcaccacatagagtgcagactgcaggtagcgccgtggctcctctcctgtctggcctcaactttggtgtccctgtgtttgtgttcgagacactgaaggttcagatagcagtgttgttattatagtttttattgagtgataataagtgcattgtgcatgatgggacgataggagttagagttgtttattactactaagtactggatccagattgtgttgtccccttgtctggtatagctcgtgtagcttgctacgttgcggtgctgtttgtaagaggtgacttcagagttcaggacttaaacacgattgcttgttcaaaaaaaaaaaagaaagggc

SEQ ID NO: 15387 - DNA, 863 bp, Sorghum bicolor
  Clone ID: SORBI-28MAY03-CLUS49_285
gccggccgggccgggaaccaaaccacaccaactctccccaatccagcagcagccctcgagtgagtcgtccccgcacctcagcagagagacgccactaccaccaccaccgcaagcgacgacggcgagatgttcctgcggcggatcttgaccggcggtggcggcctggcggcgctgagggcggcgcgcgccgtgaaggagacgacggggatcgtgggccttgaggtggtgcccaacgcgcgggaggttctcatcgggctctacacgcgcacgctcaaggagatcgaggccgtccccaaagacgagggctaccgcaaggccgtcgagtccttcacgaatcaccgcctccagatctgccaggaggagggcgactggaagaccatcgaggaccgaatcggatgcgggcaggtcgaggagctcatcgaggaggccgaggacgagctcaagctcatcgccaaaatgattgaatgggatccatggggtgttcctgatgactatgaatgtgaggtgattgaagacgacaccccaattcctaagcatgttcctcagcaccggcctgttgctctgcctgaggagttcttcaagacactagatgctgtcaaatctgatcccgctctgcaaggcgatgctcctccccaagtgaaggcataaagatgactcttcccgttcccggttatgtcatttcacattttgctgcgttgagtagggactagtttcttgtgtcatctgccagcaatgtgcttgttccgagcagaataaatttctggcgagtaccttcaaagagtgaatttgaactcagtgattcgacacagtaaatttgttgtccatgaatacttgatgccctgaacatcgtttgttttgccgtt

SEQ ID NO: 15388 - DNA, 1754 bp, Sorghum bicolor
  Clone ID: SORBI-28MAY03-CLUS49_286
gcatccatatagacacacgtcgctcggaacggaatcggagctcgcatccgaccgcgagcaagcggaccaaatcctcctccttattctatcgcgcgcccgcatctggccgcctcgaccatcggcggcggcggcggcgacgatggggctggagatggaggcgatggcggcgtcgatcggcgtgtcggtgcccgtgctccggttcctgctctgcttcgcggccaccatcccgacgggcctcctgtggcgcgcggtgcccggcgccacggggcgtcacctctacgcggggctcacgggtgccacgctctcctacctctccttcgggccctcgtccaacctcctcttcgtcgtgcccatgacgctcggttaccttgccatgctcttgtcccgtcgccacgccgggctcatcaccttcctcggcgccttcggcttcctcatcgcatgtcatgtgtactacatgagcggggatgcatggaaggagggaggcattgatgcaactggcgctttaatggttttaacgctgaaagtcatttcatgcgcaataaactacagtgatggtatcttgaaggaagagggtttacgcgatgctcagaaaaaataccgactgactaagcttccttctctaattgaatattttgggtactgtctctgttgtgggagccattttgctggaccggtatatgagatgaaagattatcttgattggactgagaggaaaggaatatgggctagcccaactccttcgccattgttacctactttgcgtgctctagttcaggctggtgtatgcatggggttatatttatacctgtcacctaaatttccactctcacggtttagtgagcccttatattatgaatggggtttctggcaccgactcttctatcagtacatgtcaggcttcactgctcgttggaaatattactttatatggtcaatttcagaagcctcaattatcatatctggtctgggctttactggttggtcagaatcttctcccccaaaagccaaatgggatcgtgcgaaaaatgttgatgtattaggtgttgaattagctggaagtgcagttcaaattccccttgtgtggaatattcaagtgagcacatggttacgatactatgtctatgagaggctaattcagaaaggaaagaaaccaggtttccttcagttgttgggtacacagacagtcagcgccatctggcatggactgtatcctggatatatcatattctttgttcagtcagcattgatgataaatggttcacgagttatatacagatggcagcaagcagtgagcagttcattcctccgcggtatcctggcttttctaaattttgcttatacattgctggtgcttaactactcctgcatcgggttcctggtactgagcttcaaagaaaccttggcgtcctaccagagcgtatattatgttggcacaattgttcccattgtgtttctcctgctgggcaatgttatcaagccagcaaggaaggcgaaggctcggaagaccgagtgaggaaaatacacactcaagtgaccattacatagaagaaagatggagaagcttcaacgaagattacgacattctagttttcagtttatttattctgtccgtatcaaaccaaatttagtataaggattaatgtggtgaccccagttctcctttcacggaactcgattgcgattgactcatcattaaaacgtggcataaccactgggttttccttctacttaatgactacttatacgtgtgtgcg

SEQ ID NO: 15389 - DNA, 928 bp, Sorghum bicolor
  Clone ID: SORBI-28MAY03-CLUS49_287
ccgggaaaaaaaaagatccgttaagactagactttcctcatcgctgccgccgcccgccgccttctcctcctcctcctccggcgacctagggagaggggcagggaagagaagggcgcgacgccggctgtcgagtaggcgggccggcgggcggagatgtttctggtggactggttctacggggtgctggcgtctctggggctgtggcagaaggaggccaagatcctcttcctcggcctcgacaacgccggcaagaccacgctcctccacatgctcaaggatgagagattggtccagcatcagcctacacagtatccaacttctgaagagctgagcatcgggaagatcaagttcaaggcatttgatttaggaggacatcagattgctcgccgtgtttggaaggattactatgctaaggtggatgcagtggtctaccttgtggatgcctatgacaaggagcggtttgctgagtcaaagaaggagctagatgcgctcctatcagatgactccctggccactgtcccattcctgatcctggggaacaagatcgacatcccttatgccgcttcagaggaggaactccgttatcacatggggctgagcaacttcaccactggcaagggcaaggttaacctgggcgagtctaacgtccgccccctggaggtgttcatgtgcagcgttgttcgcaagatggggtacggcgatgggtttaagtgggtgtcacagtacatcaactagtgttagctagctaccgtggtactccctgtaccttagctaccacaagagagatagggagccacctgcctggtcatggttgttcatggtgccagtacatatgtgttcatggaagtagtgcaaaatctgggatcttgtgccagatttttcgtctgttacagtgtgatgatcgtggaagaggagcaccttttatata

SEQ ID NO: 15390 - DNA, 1700 bp, Sorghum bicolor
  Clone ID: SORBI-28MAY03-CLUS49_288
ccgggctcagacgccgtcggccgccacagaccgggagaagccgacgcgccgccaccgaatcctcagatcagcggcgagccgtaaccgcgccactctgctgccgcccgacgagcagcgtaacagttgcctgcagccatgggtaaggagaagactcacataaacattgtggtcattggccatgtcgactctggcaagtcgaccaccactggccacctgatctacaagcttggtggtattgacaagcgtgtgatcgagaggttcgagaaagaggctgctgagatgaacaagaggtcgttcaagtatgcgtgggtgcttgacaagctcaaggctgagcgtgagagaggtatcacaattgatatcgccctgtggaagtttgagaccaccaagtactactgcactgtcattgatgcccctggacaccgtgacttcatcaagaatatgatcactggtacttcccaggctgactgtgctgttcttatcattgactccaccactggtggttttgaggctggtatctccaaggatggccagacccgtgagcatgctctccttgctttcacacttggagtgaagcagatgatttgctgctgcaacaagatggacgccaccacacccaagtactcgaaggcccgttatgatgagattgtgaaggaagtctcttcctacctgaagaaggttggatacaacccagacaagatccactttgttcccatctctggttttgaaggtgacaacatgattgagaggtccaccaaccttgactggtacaagggcccaaccctgcttgaggctctggacttgatcaatgagccaaagaggccttcagacaagccactgcgtctcccccttcaggatgtgtacaagattggtggtattggaactgttcctgtcgggcgtgttgagactggtatcatcaaacctggtatggttgttaccttcggtcctagtggccttacaactgaggttaagtctgttgagatgcaccacgaggctctccaggaggcccttcctggtgacaatgttggcttcaatgttaagaatgttgctgtgaaggatctgaagcgtgggtatgtggcctccaactccaaggatgaccctgccaaggaggctgctagcttcacctcccaggtcatcatcatgaaccaccctgggcagatcggcaacggctacgccccagtgctggactgccacacctcacacattgctgtcaagtttgctgagctggttaccaagattgataggcgatctggcaaggagcttgagaaggagcccaaattcctcaagaacggtgatgctggtatggtgaagatggttcccaccaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgccgccaagaagaaatgatgcgcttctgtttgctcgtgggatacctagttgaaacttcaaaaatatatcgtcattgctgttgttgctgttatcgcttgagcaactaaactgtgctggcaatgtttgtctggtccatctagtactgttttttttgctaaatccagggtgctgttgagactcaattctgttatttttgtatcgaacaacgggtgttagccatatatggttgagtttttgct

SEQ ID NO: 15391 - DNA, 934 bp, Sorghum bicolor
  Clone ID: SORBI-28MAY03-CLUS49_289
gcacgaggtgcatccatactcatccaattgaaaggattattacgatcgaggctctttcactcatcaggacctgattttcctgtaaccgtgactagctagtcttgtgctcgtgcagctgggacacatcacacacgtacagagacacaggagatggggtctctcatggctggctgggactcgccggttcttgccgacgacgacaagaaagttaacgcgcgccggaaccggtcgctgaccaaggaggaagtggaggcgttctggaagcagcgtcggagtcggaggtcgtcggaggaaggcggcggcgagctcgcctcgcctctttcctcgccgccggccaccgccacgtggcaggagagcccgttcgggagctcggagaagccggcggcggcggcggtccgtgtggacggcttcctcccgggcggcggatccggagacgacgacgacgcggcagctgacagccccagcaggagccgcgactggtggacgcggagcagctgggcgttcctcaacgagccgccgcaggaggagccctccgccagggcgcagcagcgctacacgccgcagttccacgtcgcacgcatcgccaccggcaacgcctgatgactgatcgatgaaaacgccgccggcaaccatgcacgcagacgcagctgaccacaggccacgcccggtcgtcaagaggcaccgccccggcggtgcatgtttcatccatagtcgtcctttccccgtatatatgtacagtagtatgcctatgataaatttttttttgctaccacggtttctgcctacgagtatgtactccttacgcatacgtactatgtatagcaatctagctactatatatgcgtatgtatttactccttagtgcatgtgaaaatctctctgttcattgttcagaaaaattacccatttgtaaaaaaaaaaaaaaaaaaaaaaa

SEQ ID NO: 15392 - DNA, 2224 bp, Sorghum bicolor
  Clone ID: SORBI-28MAY03-CLUS49_290
gcacgaggatgaagttatccctgctgaaaatggttcacatgcatggcgatatcttgaagatctgcagaacaacattgaccttgtattgactgaggttttcatgccttgtctatctggcatcggtctgcttagcaaaatcacaagtcacaaaatttgcaaggacattcctgtgattagtaagtagttttcctcaactccctaatgcacatgaaatgttatcccgttaattgttgggtttaaatacttttagccgctacactgatgtgttttgcatgcagtgatgtcttcaaatgactctatgagtatggtgtttaagtgtttgtcgaagggagcagttgacttcttggtaaagccactacgtaagaatgagcttaagaacctttggcagcacgtttggaggcgatgccacagttccagtggcagtggaagtgaaagcggcatccagacacagaagtgtgccataccaaatactggtgatgagtatgagaacgacagtgacagcaatcatgatgatgaagaaaatgatgaagacgacgacgatgacttcagtgtcggactcaatgctagggatggaagtgataatggcagtggtactcaaagctcatggacaaaacgtgctgtggagattgacagtccagaacctatgtctcctgatcaactagcagatccacctgatagtacatgtgcacaagtaattcaccccaaatcagagatatgcagtaacaagtggctaccgacagcaaacaaaaggaatggcaagaaacataaggagaataaagatgaatctatgggaagatacttagaaataggtgctcctaggaactcaagtgcagaatatcaatcatctctcaatgacgtatctgttaatccaacagaaaaacgtcatgagactcacatgccccaatgcaaatccaaaaagaaaatgatggcagaagatgattgtacagacatacctagtgaaataaatactgaaactgctgatttgattagctcaatagccagaaacacagaaggccaacaagcagtacgagctgttgatgcacctgatggcccttccaagatgcccgatggaaatgataagaatcatgattctcatatcgtggtgacaccccatgagttgggtttgaagagattgagaacagatggagctgcagatgaaatccatgatgagcgaaatattctcaaaagatcagatcagtcagccttcaccaggtaccatacatctgtggcttccaatcaaggtggagcaagatgtggggaaagctcttcaccacaagataacagttctgaggctgtgaaaacagactctacatgcaagatgaagtcaaattcagatgctgctccaataaagcagggctccaatggcagtagcaacaacgatgtgggctccagtacaaagaatgttattgcaaagccttcagctaacagggagagagtaacgtcaccatcagccatcaaatctacccagcatgcctcagcatttcatactatacagaatcaaacatcacctgctaatctggttggtaaagacaaagctgatgaaggaatttccaatgcagtgaaaatgagccacccaacagaggttccacaaagctgcgtccagcatcatcaccacgtgcattattacctccatgttatgacacagaaacagtcatcaatcgaccgtggatcatcagatgttcagtgtggttcgtcaaatgtgtttgatcctcctgttgaaggacatgctgcaaactatagtgtgaatgggggtgtctcagttggtcataatgggtgcaatggccagaatggaacgagcactgtccccaatattgcaagaccaaacatagagagtgttaatggtaccgtgagccaaaatatcgctggaggtggcattgtaagtgggagtgggagtggcaatgatgtgtatcagaatcgattcccccaacgagaagctgcattgaacaaattcagactgaagcggaaagatcggaactttggtaaaaaggtagcctgttttcagttacatgcctgtcgtagtagctatgacttgaaatcagtaataggtatttgagtgttgaagggccttccactgagtatgtcaagaaagagtagggatccaaatggtttgcacaattattaccagaaaagatagaagtgattattaataataatctctacctttggaggatataaaattgattatgctactttcagctaccccttttgtctttttttagaaaaa

SEQ ID NO: 15393 - DNA, 800 bp, Sorghum bicolor
  Clone ID: SORBI-28MAY03-CLUS49_291
ccgggaccaccgcatctcacacccctaagcttgagcttagcttagctccacactccagctccaagcacacagtcgtggttagagggccgtgaaaatgccgatcagcaggatcgccgtggggacccaccatgaggtgtaccaccctggcgccctcaaggcggcgttggctgagttcatctccaccctcatcttcgtcttcgccggccagggttccggcatggccttcagcaagctgacgagcggcggcgcgacgaccccctcgggcctgatcgcggcggctgtggcgcacgccttcgcgctgttcgtggcggtgtccgtgggcgccaacatctccggcggtcacgtgaaccctgccgtgaccttcggcgcgttcgtgggcggcaacatcaccctgttccgcggcctcctgtactgggtggcgcagctgctgggctcgacggtggcgtgcttcctgctccgcttctccacgggcgggctggccacgggcaccttcggcctgaccggcgtctccgtgtgggagggcggtggtgatggagatcgtgatgaccttcgggctggtgtacacggtgtacgccaccgccgttgaccccaagaagggcagcctgggcaccatcgcccccatcgccatcggcttcatcgtcggcgccaacatcctggtcggcggcgccttcaccggcgcgtccatgaaccccgccgtgtccttcggccctgccctcgtcagctgggagtggggataccagggggtgtactgggtcggcccactcatcggcgggggcctcgctgggcgtatctaccagctg

SEQ ID NO: 15394 - DNA, 814 bp, Sorghum bicolor
  Clone ID: SORBI-28MAY03-CLUS49_292
gtgcggcgctcgagccggccgggccgggaaccctagcttagccgccactgccctccagcccccgccgccgcttcgctcttctcacggccacgccgtccgtcgaggcgaggtaaggtcagcatggtgaggatcagtgtgctcaatgatgcactcaagtccatgtacaatgctgagaagagggggaagaggcaggtaatgatcaggccgtcatccaaggttatcatcaagttcttgacggtcatgcagcgtcatggctacattggtgagttcgaatatgtggatgaccaccgtgctgggaagatagtggtggaactgaatggaaggctaaacaaatgtggtgttattagccctcgctttgatgttggcgtgaaggagattgaaggatggactgccaggctgctcccatcccgtcagtttggctacattgtgttgacgacctctgctggcatcatggaccatgaggaggcccgtaggaagaatgttggaggcaaggttctaggtttcttctattgaagggagtatggcaaaagcactgatgtttccaacaagaactcatctgagattttgttttttggtctgaatagagtgctttgttaagattgtggaacgtgttgtgtgcttcagaaattgagaaccctgttatgagctatccctgcagttaattattatgacctatatgcctgtcttgtgtttctcgtcttgccatctcagaggaagattagagttccttcttttacttaatgttgttgactatacttgtgtgaagcactgatttcattaagtttgatatctaaaactgagctaaatcagttgg

SEQ ID NO: 15395 - DNA, 848 bp, Sorghum bicolor
  Clone ID: SORBI-28MAY03-CLUS49_293
gccggccgggccgggcaaacacaacacacccacgaaccgcaacccgcaccgttccctttccccacctcgatctcgcgcgctagggtttcgtctcgccgccgccgccgccgccgccgccgctctcgccctcctccgcgaagatgccgaagaacaagggtaagggaggcaagaaccggaagaggggaaagaacgaggccgacgacgacaagcgcgagctcgtcttcaaggaagacgggcaggagtacgcgcaggtgacccggatgctcggcaacgggcggtgcgaggccatctgcgtcgatggcacgcgccgcctctgccacatccggggcaagatgcacaagaaggtctggatcgcggccggggacatcgtcctcgtcggcctccgcgactaccaggacgacaaggctgacgtcatcctcaagtacatgaacgacgaggcgcgtctgctcaaggcctacggggagctccccgagacgctcaggctcaacgagggcgtcgacgtcgatgggcccgaggacggcgaggagggcagcgactacatccagttcgaggacgaggacatcgacaagatctaagaaatctttttctccttgcggggctactctattattgtgtgactttgtgttctagtatgtggtggtatggtttaggctgggctggctgttgtggattagctatcctgcctgcgtggatcacaatcctgcctgagtgatcttgtaataggatcgaggtggttaaataatcgcggataatttcgtttttaatctggtacatgctgttacaggatgttctatactaagttgttattgttctggattgtgttctattaaaaaaaaaaaaaaaaaaaa

SEQ ID NO: 15396 - DNA, 1415 bp, Sorghum bicolor
  Clone ID: SORBI-28MAY03-CLUS49_294
cttagcgatctctctctatatttcttttcgaaagatccgttgctggcgttcattgttaagagtagcgatctctccatacatactatgctagtccctctagagaaatttcagaagttaccaattgagacctaaagaccgacctgaatcatgcatccattggagctcttcctggtggtcttggttaccaccggtgccgcctctgcggtgtacagccatcctgccgccgctggcactccagcggcacggttttgggaggaggccctccctggcacacccatgccggaggccatcgccgacctcatccaacaaggcattgaccattcccctctcgtggagcatttcacttctagcggccacacccctgtcatgaacataaactacggctacggagcctacgccggcagctctctaatgaacgcagcagtgcccccaggctccttcttcctccagtcgcagctgcgcgtgggaaccgccatgaccgtctcctccgagtcggcagctaccgtgcctcccatcctcccgcgcaacgtcgccgagaaggtcccattcagcaacctagcggacgtgctcgccgcgttccacatctcgccaagctccgccgaggcgacgacggtgggcaacaccctgagcctgtgcggagccccgccgtcactcgccggtgagcagaaggcctgcgccacgtcgctggaggacaccgtggagagcgccacgcacatgctcgtcgtcggcagcagcgttcgtcatggggtggtgtatttgtgggcggcctcgtcggcggcggcggtgccgccggcggcacaccaccaccagcagcagtacgttgtccaggcggtcacctcgctcgacggcgatcgccacgtcggctgccacgccatgccgttcccgtacgccgtctactactgtcacatgacggggcggccgtccaaggcgtacgcggtcttgctccgcagcgtcaccggcggcagcagtgcgccggtcaccaaggcggcgatctgccacctcgacacctccaactgggacccggcgcacccggccttcgagatgctgcacacacggccgggcggcgagccggtttgccacttcatgtcctatgccagtttgctctttggtgagaaggcagccaattaacggttaataacaaaatacattgaagaacgctgctcatccaagcttcatcataagtataattagctgtgtggtgtctttttttattgcgagtaattagctgtggtgtctggtatatataagtatgtccggtctccgttcttgtatagtatatatagcatgtttctgttgcactgttggtgtatgtcgtccttagttcatctcagatacgtatcttgtgtattgctgtggcgtggcgtcctatattgtactgtggttatgtggaaaaatatggttttttagggcactat

SEQ ID NO: 15397 - DNA, 1716 bp, Sorghum bicolor
  Clone ID: SORBI-28MAY03-CLUS49_295
gccggccgggccgggaagacgcagtcggccgccgcacaccaggagaagccgacgcgccgccaccgtatccgcggatcagcggcgagccgtcaccacgccacactgcttgccgcccgacgagcagcgtaacagtttcctgcagccatgggtaaggagaagactcacataaacattgtggtcattggccatgtcgactctggcaagtcgaccaccactggccacctgatctacaagcttggtggtattgacaagcgtgtgatcgagaggttcgagaaagaggctgcggagatgaacaagaggtcgttcaagtatgcgtgggtgcttgacaagctcaaggctgagcgtgagagaggtatcacaattgatattgccctgtggaagttcgagaccaccaagtactactgcacggtcattgatgcccctggccaccgtgacttcatcaagaatatgatcactggcacttctcaggctgactgtgctgttcttatcattgactccaccactggtggttttgaggctggtatctccaaggatggccagacccgtgagcatgctctccttgctttcacacttggagtgaagcagatgatttgctgctgcaataagatggatgccaccacacccaagtactcgaaggcccgttatgatgaaattgtgaaggaagtctcttcctacctgaagaaggttggatacaacccagacaagatccactttgttcccatctctggttttgaaggtgacaacatgattgagaggtccaccaaccttgactggtacaagggcccaaccctgcttgaggctctggacttaatcaatgagccaaagaggccttcagacaagcccctgcgtctcccccttcaggatgtgtacaagattggtggtattggaactgttcctgtgggacgtgttgagactggtatcatcaagccgggtatggttgtcaccttcggtcctagtggccttacaactgaggttaagtctgttgagatgcaccacgaggctctccaggaggcccttcctggtgacaatgttggcttcaacgttaagaatgttgctgtgaaggatctgaagcgtgggtatgtggcctccaactccaaggatgaccctgccaaggaggctgctagcttcacctcacaggtcatcatcatgaaccaccctgggcagattggcaatggctatgccccagtgctggactgccacacctcacacattgctgtcaagtttgctgagcttgttaccaagattgataggcgatctggcaaggagcttgagaaggagcccaaattcctcaagaacggtgatgctggtatggtgaagatggtcgctttgctgtccgggacatgaggcaaacggtggctgttggagtcatcaagagcgtggagaagaaggacccaactggagccaaggtgaccaaggctgccgccaagaagaaatgaggtgtctgtctggctggttctgtgttttctcgatggatacctagttgaaacttaaaatatatcgtcattgctgttatcgacgtgagcaactaaaactgtgctagcaatgtttgtctggtcgatttagtattgttattttcgttaaaaccagggtactattaagactcaatttctgttatttttgtatcgaacatcgggtgttggccatatgtggttatgagttttgttactacccttgttgcagtgtttgcctgtttacttgttttgctcgtccttgccg

SEQ ID NO: 15398 - DNA, 2235 bp, Sorghum bicolor
  Clone ID: SORBI-28MAY03-CLUS49_296
tgggtccccgattcctcctcaattcctccaccgcgtacgcgctgacccggcgagtccagtagatattcttttccccaacatctccccgatactctcgacgagagcgtctctccatggccggaaagggagacgggccggcgatcggcatcgacctcggcacgacctactcgtgcgtcggggtgtggcagcatgaccgagtcgagatcatcgccaacgaccagggcaaccgcacgacgccgtcgtatgtcgccttcaccgactccgagaggctcgtcggcgacgccgccaagaaccaggtcgccatgaaccccatcaacaccgtcttcgacgcgaagcggctcatcggccggcgcttctctgacgcgtcggtgcagagtgacgtcaagctgtggcctttcaaggtgatcccgggctccggcgataagcccatgatcggggtgcagttcaggggcgaggagaagcagttctcggcagaggagatcagctccatgatcctgaacaagatgaaggacacggcggaggcctacctcggcaccaccatcaagaacgccgtcgtcaccgtcccggcctacttcaacgactcccagcgccaggccaccaaggacgccggcgtcatctccggcctcaacgtcatgcgcatcatcaacgagcccaccgccgcggccatcgcctacgggctcgacaagaagtcgagcagtgacggcgagaagaacgtcctcatcttcgacctcggcggcggtaccttcgacgtctcgctcctcaccatcgaggagggcatcttcgaggtcaaggccaccgccggcgacacccacctaggaggcgaggacttcgacaaccggctcgtgaaccacttcgtccaggagttcaagaggaagaacaagaaggacatcaccggcaaccccagggcgctccggcggctgcggaccgcctgcgagagggccaagaggacgctctcctccaccgcccagaccaccatcgagatcgactcgctctacgagggcatcgacttctacaccaccatcacccgcgcccggtttgaggagctcaacatggacctcttccgcaagtgcatggagcccgtggagaagtgcctccgcgacgccaagatggacaagagcagcgtgcacgacgtcgtgctcgtgggcggctccacccgcatcccccgcgtgcagcagctgctccaggacttcttcaacggcaaggagctgtgcaagagcatcaacccagacgaggctgtcgcgtacggcgccgccgtccaggccgccatcctcaccggcgagggcaacgagaaggtgcaggacctgctcctgctcgacgtctcgccgctctcgctcggcctggagacggccggaggcgtcatgacggtgctcatccccaggaacaccaccatccccacgaagaaggagcaggtcttctccacttactccgacaaccagcccggcgtgctcatccaggtgtacgagggtgagagggccaggaccaaagacaacaacctgctcggcaagttcgagctctctggcatccctccggcgcccaggggcgtcccccagatcaccgtgtgcttcgacatggatgccaacggcatcctcaacgtgtcggctgaggacaagaccaccggccagaagaacaagatcacgatcaccaacgacaagggccggctgagcaaagaggagatcgagaagatggtgcaggaggcagagaagtacaaggccgaggacgaggagcacaagaagaaggtggacgccaagaactcgctcgagaactacgcctacaacatgcgcaacaccatcagggacgacaagatcgcctccaagctcccggaggccgacaagaagaagattgatgacgccatcgagggggccattaattggctcgacaacaaccagctcgccgaggtcgacgagtttgaggacaagatgaaggagctggagggcatctgcaaccccatcatcgccaagatgtaccagggcgctgctggtcctgacatggccggtggcatggatcaggatgctccgccggctggtggcagtggtgctggccccaagatcgaagaagtcgactaaatgaggaattttgatagttttgcttattaaataattacaaactggatcctagtactcttttcatgcattttcctttttggccattcatcgggcccctactttatgtttaaatttattatatattattaccgtggctataaatagtgattagtatactacacttttcattcct

SEQ ID NO: 15399 - DNA, 914 bp, Sorghum bicolor
  Clone ID: SORBI-28MAY03-CLUS49_297
gtggcccaaacatggttgttgatatgtgtaagggagtgcagtatctcaatgaaatcaaggattctgtcgtggctggtttccagtgggcatcaaaggagggtgcactggctgaggagaacatgcgcggaatttgctttgaggtctgtgatgtcgttcttcatgctgatgctatccacaggggtggtggccaggtcatcccaactgccaggagggtcatctatgcttctcagctcacggccaagccaaggctgctggagccagtgtacctggtggagattcaggccccagaaaatgcacttggtggtatctacggtgttctgaaccagaagagagggcatgtgtttgaggagatgcagaggccgggtaccccgctctacaacatcaaggcttacctccctgtcatcgagtcgtttgggttctccagccaactgagggctgcaacctctggtcaggcgttcccccagtgtgtctttgaccattgggacatgatgggctctgatcctttggaggctggctcccaggctgctcagctggtgctggatatccgcaagaggaagggtctcaaggaacagatgacccctctctctgagtttgaggacaagctctaaatttttggttgtttgttctactgttactattgctggtttaatcgtcaatttgtctattgtattgggaacgacttgaatattttctctcgttttagttaatgtacctgtctctgaactatattggtcatgtagtgtatgctgctgtgttgagagccctgagactccattttgatatctggtgtgatgtagcagatgaaacggagttggtatctgtgtggtttagttagtggttacatacttgtattaccctgtgttgctcatttctattgtcttaataacgctttgcctgatctgtcagttaaattc

SEQ ID NO: 15400 - DNA, 1191 bp, Sorghum bicolor
  Clone ID: SORBI-28MAY03-CLUS49_298
aaaaaaaaaaaaaaaaaaaaaaaaagacgcagtcggccgccgcacaccgggagaagccgacgcgccgccaccgtatccgcggatcagcggcgagccgtaaccacgccacactgcttgccgcccgacgagcagcgtaacagttgccttcagccatgggtaaggagaagactcacatcaacattgtggtcattggccatgtcgactctggcaagtcgaccaccactggccacctgatctacaagcttggaggtattgacaagcgtgtgatcgagcggttcgagaaggaggctgcggaaatgaacaagcgttcattcaagtatgcctgggtgcttgacaagcttaaggctgagcgtgagagaggtatcacaattgatattgccctgtggaagtttgagaccaccaagtactactgcacggtcattgatgcccctggacaccgtgacttcatcaagaatatgatcactggcacttctcaggctgactgtgctgttcttattattgactccaccactggtggttttgaggctggtatctccaaggatggccagacccgtgagcatgctctccttgctttcacacttggagtgaagcagatgatttgctgctgcaataagatggatgccaccacacccaagtactcgaaggcccgttatgatgaaattgtgaaggaagtctcttcctacctgaagaaggttggatacaacccagacaaaatccactttgttcccatctctggttttgaaggtgacaacatgattgagaggtccaccaaccttgactggtacaagggcccaaccctgcttgaggctctggacttgatcaatgagccaaagaggccttcagacaagccactgcgtctcccccttcaggacgtgtacaagattggtggtattggaactgttcctgtcgggcgtgttgagactggtatcatcaaacctggtatggttgttacctttggtcctagtggccttacaactgaggttaagtctgtctggctgatcctgtgttttcttgagggatacctagttggaactttaaatattgtcattcctgttattgcgcgagcaactaaactgtgctggcaatgtttgtctggtcgatttagtactgttatttttgttaaaaccagggtgcttgacactaattttctgttatttttggatcgaacatcgggtgttagccaatggtttg

SEQ ID NO: 15401 - DNA, 1223 bp, Sorghum bicolor
  Clone ID: SORBI-28MAY03-CLUS49_299
ggccgggggacggaccgggaacggttccttcgggggccttccccgggcgtcgaacaaccgactcagaactggtacggacaaggggaatccgactgtttaattaaaacaaagcattgcgatggtccccacggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccctcgccgccgcgcgtagcaagcaggagcagccaggatgccggctggccacgggctgcgctcgcggacgcgcgacctcttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagatcaacaagcaggttaatggtcgcatcatcaggaagcgtatccacgtccgtgtggagcacgtgcagccgtcccgctgcacagaagagttccgcctgaggaaggcaaagaatgatcagctgaaggcggatgccaaggcacgtggtgaggtcatcagcaccaagaggcagccattgggtccgaagcctggattcatggttgagggcgccaccatcgagaccgtcactcccatcccgtacgatgtggtcaatgatctcaagggaggatactaggttgttttggtctatctaccagcagtaccaagttctccatctgtgttactcctgtgcgtacaattttgctcactctgagcagtagtatgaacccattgtgtgttcctgttgaaagatttcccattctaggtgcaaacctgagtttcgcaaaacgctttataccttgatctttgcttctcagaacaaagatgtgcctttttgaaccacttacagtgctaatatttatgttgtttgaatcatgcagtggaaactgggaggtgtcactgtaggttgtgaccttgaaagagtgaacgtagttaggattctagtggtattcctgtgctatattcaccgttgccatgattgttgtgagctgtcagccggccaa

SEQ ID NO: 15402 - DNA, 1301 bp, Sorghum bicolor
  Clone ID: SORBI-28MAY03-CLUS49_300
gcacgaggatcaccacccacctctcagttcaccccgtcgtcctcggcggtcggcgcgccaccctctccgcgtccaccggcgctactaccccgctccacggtccaaggaaagatggcgtcccatattgttggataccctcgcatgggccccaagagggagctcaagtttgccttggagtctttctgggatgggaagagcagcgccgaggatttggagaaagttgccactgacctcaggtctagcatctggaagcaaatgtcagaagctgggatcaagtacattcccagcaacaccttctcgtactacgaccaggttcttgataccacggccatgcttggcgctgtcccagagcgctactcttggactggaggtgagattggcttgagcacctacttctcaatggccaggggaaatgccactgtccctgctatggagatgacaaagtggtttgacacaaactaccactttattgtccctgaacttggcccaagcaccaagttcacatacgcttcacacaaggctgtttctgagtacaaggaggcaaaggcgctcggcattgatacagtcccagtgcttgttggaccagtctcatacttgctcctctctaagcctgccaagggtgtagagaaatctttctctcttctttcacttcttggtagcattcttcccatctacaaggaggttgttgctgagctgaaggcggccggtgcttcatggattcagtttgatgagcctacccttgttaaagaccttgatgctcatgaattggctgccttctcttcagcatatgctgaactagagtcagcattctctggattgaatgtgcttatcgagacctactttgctgacattcctgctgagtcctacaagaccctcacgtcattgagtggggtgactgcttacggtttcgatcttatccgtggagccaagacccttgatcttatcaggagcagcttcccctctgggaagtacctcttcgctggggttgtagatggacgcaacatttgggctgatgatcttgctgcatctcttagcactcttcagtctcttgaggctgttgctggcaaggacaaacttgtggtgtcaacatcctgctcactgatgcacaccgctgttgatcttgtaaatgagactaagctggatgatgagattaagtcatggcttgcgtttgctgcccaaaaggttgttgaggttaatgcccttgccaaggctttggcaggccaaaaggatgaggcttactttgcagccaatgctgctgctcaggcctcaaggagatcatcacccagagtgacaaacgagga

SEQ ID NO: 15403 - DNA, 1147 bp, Sorghum bicolor
  Clone ID: SORBI-28MAY03-CLUS49_301
gccggccgggccgggcctagccgcagcgcgctcatttccgcgttccccctcccgcctcgccgcgccgccgccgccaccgccggagaagatgggtcgtgtgatccgcgcgcagcgtaagggtgcggggtccgtcttcaagtcccacacccaccaccgcaagggccccgcccggttccgctccctcgacttcggcgagcgcaacgggtacctcaagggcgtcgtcaccgacgtcatccacgacccgggccgcggcgcgccgctcgccaaggtcaccttccgccaccccttcaggtgcaagcaccagaaggagctcttcgtcgccgccgagggcatgtacacgggccagttcgtctactgcggccgccgcgccacgctctccatcggcaacgtcctgccgctccgcgggatccccgagggtgccgtcgtctgcaacgtcgagcaccacgtcggtgaccgtggtgtcttcgccagggcctctggggactacgccatcgtgatcagccacaaccctgacaacggcacctcgaggattaagctaccctctggtgccaagaagattgtccccagcagctgccgtgccatgattgggcaggtcgctggtggaggcaggactgagaagccgatgctgaaggctggtaacgcgtaccacaagtaccgtgtgaagaggaactgctggcctaaggtgcgtggtgtggccatgaaccctgtggagcatccccacggaggaggtaaccaccagcacattggtcacgcctccaccgtccgccgtgacgctccccctggccagaaggtcggtctcattgctgccaggaggactggaaggctcaggggacaggctgctgccactgccgccaaggctgacaaggccacctagagttgttatcgtcgttcttgtttatctatctctctgctgtgctttagacggttaaaggacatgagtttcagtatgaatgtgttgttgcctagtactatggtgaaacattgtgtcagttttttgtggtcgctgtctggattttgcattatgcctaaagaagattacatggatgttttgatgctaaattatatttgcccgtcaggccctggccctctttgctttgtttcaattgttgtagaattgttgatttcaaacaaatgtaagttgtaactt

SEQ ID NO: 15404 - DNA, 650 bp, Sorghum bicolor
  Clone ID: SORBI-28MAY03-CLUS49_302
gccggccgggccgggctccgccgtcgcctctccactttcccccatccttctccgccgtcgccgtcgcggtcgcgtcccggtccgaagagcctccaactccgatggccaaccgctgggtccgacccgaggtgtacccgctgttcgcggcgatgggcgtggccgtcggcatctgcgggtttcagctcttccggaacatcaccggcaacccggaagtcagggtaaacaaggcagggagggcagctggtgtgcttgagaaccatgaggaggggaggcgttacgccatgcatggcctaagaagctttgtgcatgaaaagacccctgagatcatgcctgctattaacaagttcttcactgaccccaagtgaagcatgttgatggttctactgctacttgccattggggattgtacccttttctggcagttcgatgtgttgtgccgtccataaattggaagacatctcttactcttattaaaagtaccgtatgagtgcttggtaatggcttgctatatgtatgatggtgaatgagtttggtcgtccctctttgatgttcatactccagtcatctgtcatgtggatttgctgtgcttcaatgataaaactgtcagccaacgttcatttggataaaaaaaaaaaaaaaaaaggccccta

SEQ ID NO: 15405 - DNA, 1392 bp, Sorghum bicolor
  Clone ID: SORBI-28MAY03-CLUS49_303
gacaccctacacaccgtgcgtgcacgagacgactcgaaccccagttcaggaactgtaggagagaaggggagagagagatggagaacggcggcggcaaaggcgacgtccccgacgatgcgaacgagcattgccctggaacgcagtcggaggaggcggggaaggcggatgcctgcgctgggtgccccaaccagcagatttgtgccaccgcccccaagggccccgaccccgatgtggttgctattgtcgagaggttggctactgtgaagcacaaattgttagttttgtctggaaagggaggtgttggaaagagtacattctcagcccaactctcgtttgctctagctgaaatggaccatcaggttggccttcttgacatagatatatgtggccctagcatccctaaaatgttaggccttgagggacaagatattcatcaaagcaaccttggctggtcacctgtgtatgttgagtccaaccttggtgtgatgtcgattggtttcatgctgcctaatccagatgatgctgtcatatggaggggtccccgcaagaatggactgatcaagcagttcttaaaggacgttgattggggggagattgactatcttgttgtggacgctcctccaggaacatctgatgagcacatctcgatagtgcaataccttcaagccacaggaatcgatggtgcaataatcgtcacgactccgcagcaggtctcactgattgacgtgaggaaggagataaccttctgcaagaaggtcggtgttcctgtcctaggtgttgtggagaacatgagtggcctgaggcagccactttcagatcttagattcatcaagtcagatgaggcgggtgagacagatgcgacagagtgggccctgaactacatcaaggagaaagcccctgagcttctgtcggtcatggcatgcagcgaggtatttgatagcagcaagggaggagctgagaagatgtgccatgaaatgggggttcctttccttggtaaggtgcccatggatccacagctatgcaaggcggctgaggaagggaggtcatgctttgctgatcagaaatgcagtgccagtgcaccggctcttcagaacattgtgaagaagctgatcaagactgagtgataaaatagtgttgccctgctaggaatctggtagtgagaaatgagatgaaatgatatatgccagagttcttattaccaaatatactgtgtcatgcactgagtctttattagtgctattggatctgtaagcttttgttcatgaatcatcagtgagtggactgggtgcacaaactaccgcttaatttttgctctactcagtgaaatatgttttgaggtgctacctgaatgatgtttttttagtcgtacctgaatgatgcttgaatgctaaa

SEQ ID NO: 15406 - DNA, 1681 bp, Sorghum bicolor
  Clone ID: SORBI-28MAY03-CLUS49_304
attggatctccctttgttgccttacttttaaacatcatcatattgtttcgaaataacgtttggttgaggggaaaaaaggcacatttgtacatttgggaattctctcactgtatgtgcactgagttgggagttcggaacgtgggccgtgtgctgggcttggttgggctcatcagtcagcctgggaatagcctgtcaatagacctgggccttgcaaacatacgtgataccaacgtactggactgttaatagtgattgtacaatcggcaggcggcagctgtacctaagcttttccttcctatacacacacagtactctgcaacagattcccagctgagactgctacaaaccaattctagtagttgcaggcttcgcagtttgctatgctgtccggacagccacctttattctataggattcacaagctctgtagctccctgttcctttgtttatgcacttgatgcttctggaagtgtgatcacccgagactttgagtcatattccagctcagtactgcaatttgcacatttcactttgtttgttgtaccgccactagagactgacagtatagtcccaaagaaagaaaggttctcagtaccacaatttggacatggccccttgaggattataaagtcctggactatagccttagtcaataactgtgctaggaacaatattaggggcaaagcagcaaaccatgtgaaaatgaatccgaaaggctctggcagctggaacacattgatctcaaaaccagtcaattcatcaatgaaaaagaacagtcccagagctacagtggtggctggaacatttagcaggaacatctttaggtagtcaacattcaagtcgctgtacaccttatgactccttagactgcacctgggaccctccatcacaatgacactgccgtctgtctttaatttgagtttgagttggtcgaattcagcatcagacatgatggggctgccagcggcataggccatggaagcttccagaagcttttgctcatctatcgcttagcatgacgacgctgctcccctcccacatgagctcctccttgaggttgtcaaactcctcgttggacatgatggccttctggtcaaagtaaaaggcctgacaggcttgcaggaactcctgctccatctctccgagcgtcttcttctgcttcctgtcgatgttgcagtaggggaggatgttgctgtccaccacctcgtcgtcttgttcctgaacctggccttgctggtcggtggcgcgaagacggcggcggacgcgcagcagaggcagggcgccgcgagcagggcgggggcggggagagaagaaagaggcggttgtggtggcaggtgggttggagcggaagcgaggtggtgcgttggtggagagagatgggaggcgagacgccggcgatagccacacctcggacgccatgccaagcgcgttgcgatcgaggcaagcaagcgacagtgatgagcaggcgagcgagctagctggaggggagagagaatgtgtgtgtggtgaggtgaggtgaggtgaggtgtggtgtggtgtggtgtggagcagctggccggatggatgggcggaacggcgggataatgagagagtatgattggtgggaaggagctcactcctgcgactgcgaatgggatgtgtggaggaggaggagggaacaagaagaagatccatccccgct

SEQ ID NO: 15407 - DNA, 1715 bp, Sorghum bicolor
  Clone ID: SORBI-28MAY03-CLUS49_305
cctactgggtgcaaccccttgttttcgctcgctgcgccgtggtttgctgcccaaggtggccggaggatgcgaaaccgcacccggatccttcccatcgtttctcatctcttcctcctttagagcttagtatataatcagggctcttgtctcctgactcctcacaggttcgtttcggtttggattgattggtttgatcagtcgtggggtgagggtcttggagtcgattgatctgggatactgttagaggatttggggagggggcaatggcgaccgcggggaaggtgatcaagtgcaaagctgcggtggcatgggaggccggcaagccgctgtcgatcgaggaggtggaggtagcgcctccgcaggctatggaggtgcgcgtcaagatcctcttcacctcgctctgccacaccgacgtctacttctgggaggccaaggggcagactccggtgttccctcggatcttcggtcatgaggctggaggtatcatagagagtgttggagagggtgtgactgacgtagctcccggtgaccatgtccttcctgtgttcactggggagtgcaaggagtgcgcccactgcagatcggcagagagcaacatgtgtgatctgctcaggatcaacactgaccggggtgtgatgattggcgatggcaagtcacggttttcaatcaatggaaagcctatctaccattttgttgggacttcaaccttcagcgagtacactgtcatgcatgttggttgtgttgcaaagatcaaccctgaggctccccttgataaagtttgtgttcttagttgtggtatttctactggtcttggtgcatcaattaatgttgcaaaaccaccaaagggttctacagtggctattttcggtctaggagcagttggtcttgccgctgcagaaggtgcaaggattgctggagcatcaaggatcattggtgttgacctgaaccccagcagattcgaagaagctaggaagtttggttgtactgaatttctgaacccaaaagaccacaagaagcccgtgcaggaggtacttgctgagatgaccaacggaggggttgaccgcagtgtggaatgcactggcaacatcaatgctatgatccaagcatttgaatgtgttcacgatggctggggtgttgctgtgctagtgggtgtgccacacaaggatgctgagttcaagacccacccaatgaacttcctgaacgagaggaccctgaagggaaccttctttggcaacttcaaaccacgcactgatctgccaaatgtggtggagctgtacatgaaaaaggagctggaggtggagaagttcatcacacacagcgttccgttcacggagatcaacaaggccttcgacctgatggctaagggagaaggcatccgctgcatcatccgcatggagaactagatttcgctgtctggtttgtgatctgacctgggttgggttaataaaaggggcaatgctgagcctgcccgttcgatgcggtagatacaggaccacgcttgtgtgtcgcgttcagtttggctttgtcaatcagtagaacaggttcccgtgtcttgtaattatatatcggcatgagtcttatgaaccaccatcttttggcgtaatatatatatggtatgctaccactatgagtctatgagtttcagtctataaacttcttctggcccacttgcggtgatgttttagctattttgctgctgtttgtgttgaattttt

SEQ ID NO: 15408 - DNA, 1835 bp, Sorghum bicolor
  Clone ID: SORBI-28MAY03-CLUS49_306
cgtccgggcgacctcgatcccctcccctgttggttctgtctgttgacttccccccatcgagctagctagtcagctggtcccgttgccatggggaaggagaaggttcacatcaacattgtggtcattggtcatgttgactccggcaagtccaccaccaccggccacctcatctacaagcttggaggcatcgacaagcgtgtcatcgagaggtttgagaaggaggctgccgagatgaacaagaggtccttcaagtacgcctgggtgcttgacaagctcaaggccgagcgcgagaggggcatcaccattgacattgccctgtggaagtttgagaccaccaagtactactgcactgtgatcgacgctcctgggcaccgtgacttcatcaagaacatgatcaccggcacctcccaggctgattgtgcggtgctcatcattgactccaccactggtggctttgaggctggtatctccaaggacggccagacccgtgagcacgcactccttgctttcactcttggtgtcagacagatgatctgctgctgcaacaagatggatgccaccacccccaagtactccaaggctcggtacgacgagatcgtcaaggaagtgggttcctacctcaagaaggtggggtacaacccggacaagatccccttcgtgcccatctctgggttcgagggtgacaacatgatcgagaggtctacgaacctggactggtacaagggccccaccctccttgaggcgctggaccagattaacgagcccaagcggccctcggacaagcccctgcgccttcccctgcaggacgtgtacaagatcggcggcatcggcaccgtcccggtgggccgtgtggagaccggcctcattaagcccggcatggtggtcacctttggccccacgggcctgacgacggaggtcaagtcggtggagatgcaccacgagtcgatgcaggaggcgcttcccggcgacaacgtcggcttcaacgtcaagaacgtggcggtcaaggacctgaagcgtggctacgtggcctccaactccaaggacgaccccgccaaggaggctgccagcttcaccgcgcaggtgatcatcatgaaccaccccgggcagatcggcaacggctacgccccggtgctggactgccacacctcccacatcgccgtcaagttctcggagctgctcaccaagatcgaccggcggtcgggcaaggagctggagagcgcccccaagttccttaagaatggtgatgccggcttcgtcaagatgatccccacaaagcccatggtggtggagaccttctcggagtatcctccactggggcgcttcgctgttcgtgacatgaggcagacggttgcggtcggtgtgataaagagcgtggagaagaaggacccgacgggagccaaggtgaccaaggcggctgccaagaagaaatgatgatgatcctgcatatccatggttcctggtttcttgctggttggattatatacatgtcaaataagtgtccctattttgttgggtggtgctagtagtagttacaaaagaacaatttgatggttcagtgtctttacagtatgtgtcgacggttgtgttcgtgattgcctaccattataatatgcctaccattataatagtatttagaaaaaaaaaaaaaaaaaatttatgtacataatcagaccacaccaaggctaccgccttttcaccgacaggcaccggaattctcactcattttactttttaggcaccatttatcacttggtcaataaagacgtcgacctttggcaaagcctcaatcaagccaactcagctccttgataacttcaccacataacgtacacgca

SEQ ID NO: 15409 - DNA, 1292 bp, Sorghum bicolor
  Clone ID: SORBI-28MAY03-CLUS49_307
acacaccaaaccgaaggttaccctatcgcttctttcccgcctccacccaaccaccaccgctacaataacattatcatcgctctcttcttttcatccccaccttcttctctgcctcccatgacttttcttttcttttctttctttttggccaacgcttttcttcctcctcctcctcaaggtcatggatggtataattgtcaagaacagcgtgacaatgaataataaccaacaccctccatggatcgatcactttctaattttttatcttgtaacaataatagaaaaaaaaagaaaaacaaagcaagaaaagagagggaaaaaaaatagaagagaggagggaaggaattctagagggagatggaccgatccaccgaatctccgccgagatcaccaccgtgtgtcctccgcccgtccgtccggctccgatcgagacgccgccgccgctggttgtcgctccgagacgggaccacagatcagaacctgacgatcttggcggcgcgcacgacggggttctccctggcgatggcgtccctgccgacggccttgtagtcgaagcagcagtcgtggcggtccgagtagcggtgcgcgccgcagaagagctccccgcagcggcaccggaaccccgtcagcccgacgcgcttccggcagctggagcaccggttcacagcagacgacctcgccgccgtggccgccggagcggcggcgacgaccaccatagactggcccacggctgcggcatccgcagaggccagcagctccaccgctgctgcgtctacgagtgccgccggcctcggctgcgacaccgctgaagctgaggaagaggaggtaggggacgacggcgacgacgacctcgacgccgtggccgccgagaagcagctctggcacaggttctgcgtggccgggttccccgggaagccgcagttgttggcgcacagcgtgatctccggcgcccggagctccgtgggctcctccttcttgtcgcgctgcgccatgctcgtcgtgcacctggcaaaaggaacccgaacgaacaaccgtgcctgtgcctgtgtctgtgtctgtgtgtacgcgcgcgcgggcggcccggggccggaccttgcttttcggagggtgggggaaagacggaggaggaggggggggagcttgcgaattgggtggtgagcctgtgatccgcggggaggggagcgagttccgcgaggaatggacgagaggcgcgcccgggtttttatcggggggggaagtgggaagacggggacgcgtccccttccgcggacgcgcaagcgcagccctcgtgc

SEQ ID NO: 15410 - DNA, 849 bp, Sorghum bicolor
  Clone ID: SORBI-28MAY03-CLUS49_308
gccggccgggtccggccgggccggggaatattaaaaaaaactcccgttgggcgactccgcgtcgctcagatccatcagagatctctgcccaccccccctcgccacttcccgtgaaccacaaacctaacgcggagcggcgcgggccggccgccgggcgaggtgcgcgtagctgctgccatcgatcgtcgccgggtccatccaccatgggcggcggcaacggccagaagtccaagatggcccgcgagcgcaacttggagaagaacaaggggtccaaggggagccagcttgagaccaacaagaaggccatgagcatccagtgcaaagtatgcatgcaaacattcatgtgtaccacgactgaagtgaagtgccgggagcatgccgaggctaagcatccaaagacagatgtgtaccagtgcttcccccatctgaagaagtgaaaagcctctgaactagcaaccagtgccgtggtcatggagttgaggaaatgtgtctgttagctatgcggtttggtcacagtcagtacaggtcaggagctttgcctgtgcggagggtgttaattccgtgttgtctgccgtcaatcatgcgtcctgtcctatgttaacctatacataagaaagtgatgtgtccacttccagtgaaacctattgtctgccgttaaaacctggttggtttcagaacgatgattttcatgtccaaacagattgctggtccgtgagaattgtgccagtttgcatgttctaaatatgtctcctggccattgcaagaatccctttgcaaatacgatgtattgtagttttactccgaagatatgcctgacccatttacaaaaaaaaaaaaaaaaagccccta

SEQ ID NO: 15411 - DNA, 1638 bp, Sorghum bicolor
  Clone ID: SORBI-28MAY03-CLUS49_309
gcacgagggactaagcttgacagtgagattaagtcgtggcttgcatttgctgcccaaaaggtggttgaggttgatgctcttgcgaaggcattggctggtcaaaaggatgaggcttactttgcagcaaatgctgctgctcaggcatcaaggaaatcctctccccgtgtgaccaatgaagaagtccagaaggctgctgctgctctcaagggctctgaccaccgccgtgcaaccaccgttagtgctagattggatgcccagcagaaggagctcaacctccctgtccttcccacgaccacaattggttcgttcccacagactgtggagctcaggagggtccgccgtgagtacaaggcgaaaaagatctctgaggaggagtacatcagtgccatcaaggaggaaatcagcaaggttgttaagctccaagaagagcttgacatcgatgtgcttgtgcatggcgagcctgaggttagtgctcttgaaattattctgctagtttttgctgtgcatttgagataaattacgatatcataattgtgtagtcacatttaagtaactcttaattggcctatgttttacagagaaacgatatggttgagtactttggtgagcagctctctggttttgcattcactgccaacggctgggtgcaatcttatggatcacgttgtgtgaagccacccattatctatggtgatgtcagccggccgaaccccatgactgtgttctggtccaagacggcacaaagcatgaccgcccgtcccatgaagggaatgttgactggtccagtcacaatcctcaactggtcatttgtcaggaacgaccagcctaggtttgagacatgctaccaaatagctcttgcaatcaaaaaggaggttgaggatcttgaggctgctggtattcaggtgatccagattgatgaggcagctctaagggagggtctgccactgcgcaagtcagagcatgcattctacctggactgggctgtccactctttcagaatcaccaactgcggagtccaggacaccacccagatccacacccatatgtgctactccaactttaacgatatcatccactccatcattgacatggatgccgatgtgatcaccatcgagaactcccggtctgatgagaagctactgtccgtcttccgtgagggtgtcaagtatggagctggcattggccctggtgtctatgacatccactctcccaggattcccactaccgaggagattgcggaccgcgtcaacaagatgcttgctgtgcttgacaccaacatcctctgggtgaacccggactgtggtctcaagacacgcaagtacacggaggtcaagcccgccctgaccaacatggtttccgccaccaagctcatccgcacccagcttgccagcgcgaaatgagtcgtttgatagctccatggtttgttgaacacaaagccagcagggccatttgttttgaataatttgggtcttacccctgttccatggtgttaggttagcctcatgtggtgggatacgccgttacgcgatgtgttctaagtttggagtgtgtttcctttaggctgtttttctggggggtatgtcagtgtgctctggttataaacagaaatgaaatacgcagtcttcgaattgcatcacc

SEQ ID NO: 15412 - DNA, 1779 bp, Sorghum bicolor
  Clone ID: SORBI-28MAY03-CLUS49_310
cctactggaagctaaacagaattacagaagggatcaacagaggcaatatgagtttccgtgtgtcgctactcactttcctcctgttcgctgtgtttggaggtatgcgcccaaatttggcaacaacggacggccgcagtgctacagtgcccagtgctggttctgctatcattgcatactggcaaaaaatgctacctgactctaccatgccatcagctatacgtgaccttttgacccccaataataatgctgatgcaaacaaagacaacccttacccgataccggcgtcagccttttatgggaaagaagcaaacagcctaaacccaacaatcttctatgggaaagcaacaaatggggacgacaacccttacccgataccggccacagccttttatgagaaagaagcgaacaaccgaaacccaacaatctttgggaaaggaacaaatggggacgacaacccttacccgataccagccacagccttttatgggaaagaagcgaataacctaaacccaacaatcttctacaggaaagaaataaatcgggacgacaacccttacgtgccggtcttggcttttcatggaaaagaagtgaataacctgaacccagtgaacaacctgccgctctcggccttttgtgggaaagaagtgaacaatcttccggtctcagccttttccggaaaagcaacaattgggcccgtccatgtgtccaaaatgaacattgcagatgatgctgaccatcatgttcacgaacatcgccatatcgatggtggccatgaccatttcgattcgaggaacatcggcttcctcttcctagaggacgccttgacacctggatccaaggttgccccttatatcgacccggctagcagccgaggtgctcctttgctgcctcgtgatgtggccgattccatcccgatgtccacaaagagcttcacggacatcctcagaatgttttcaccggtatcacgcgccatggcggagagcatatggtactcgctagagctgtgtgagcaccctcgccctatcaagggcgagaagagggggtgtgtgacatccatcgagtccatggtcgatttcgcagcgtccatgctcgggacaagcgacctccgggccttttcatccccaagacgtccccgtcgaaggccgtaatgcttccaaggtttacaccgtgctggcggtgagggcgatcaccagcccgggagacaccatgacatgccatggcatcccgttcccatacaaggttttcctgtgccatgccctggtgccaaccaaggtgtactctgtgacggtagagagcgacgacgacgacggcgtggaggagaaagagaggatggaagaagcgctggtcgtgtgccacctcaatacggcggagttcgaccccatgaagatgccgccgcgtgtgaaacctggagacgccccagtctgccacttcctcaacaacgacgacgtcctctgggcgcccgctgcaactacacttgggacacagcaaggagcagccgaggacgtcgtcgtagctgcccagtagaggcagcagctaattaaaggatggtgcttgcatatatgcatgcacaccgtaccgcctacgcaagtattgttgttacatatgtgtgaaaataatacggctagctatcgatgcatgcacgcactcgcagtgtgattgagcttgctagctagctaatgtgattgtgcgggtgaaatttatgtatcgtatatgtaaagagcagcttgttgcatattactaataaatctgttttaaattataagacgctatgattttcct

SEQ ID NO: 15413 - DNA, 1748 bp, Sorghum bicolor
  Clone ID: SORBI-28MAY03-CLUS49_311
gcacgaggcccgcccgctctcctcttctcgggcagacgggcaccgcttcgccttctccgcgcaggcaagagcagccagccgcttcgggatcgggacgcggagaggggaaaggcgagtcgtcgtccgtccacggcagcttccctccctctcctctccgcccccgcttaccctaggccggccccgcctgcgccccgcccctctccccgccgccgcacgatgagcacctctcccgcctccgcctccgccgcagccgccgccgccgcgtcgcctcccgctgcagccgctgccgacgagggccgcgcgggcgacggagacggtggtggtcgacgagagggtcgcctcacacgtggacccgttcctcgtcgaggcgctcgacaaccctcgccatcgcctcatggttctacgaatggaactggatatacaaaacttcatgcagaaccctcagctgcaggagtttgaattccagaactatccgacttcttacctccgctgtgctgctcatcgtgttgcacaacattatggcttagagactatagtagcagatagtttagtagaaggctcagttagcaggattgttgcaagaaaaacaccagaaagcaggtatcctgcaattgctttatcagaagttcctagcagacaagcaagaaatgatcatgaagcggcagagaagcttaagtttgtcatctatcaaaggcccaaagcattccaaaatggaagcgctgattctagaaacatgaatggtgcaccaaaaactgttgaagagagaatagaggaatataataaagcacgagcacgcatcttcaatggttctatttctgcagattctgatgctgcaagtgttttgggaactctttccactggcagagatgaggcagtgaatgttgagccttctgttgatgaaatcaaaatcagcacaatgaacagccgctccagagttgctgttttcaaggatactgaaaaggatcgtagtgacccagactacgatcgaaactacacaaggtatgttaggaacccagtgcctgacttcaacttgagcccaggtgccttcaactttgttgtgccccagtttatgcagtacggtgttggttatatgcaatctcctggcatgtccacaaaccagcctactgtgtactttggccagcctgatctagcaatggggtcttcttctggagctactgtctacccacattggccaacgccagcaatgatgtatccccattgctatgataatgttggtccaatgatatctcaggttcctctgtaccaatctttcaaccatggttaggagattctttctgcttgctggaaagttgggaacactctctgttgaacttgctatgttgtgctgtcctatgttaagtggagttactttagattcgagccatttctattacaaaaaattcatgtagcgtcgaacgtagtctgtataaggagtcctaattcgttgaaactattatcgtgaactagtctggaactgtgatgcttgtctaatgtctagttctcgtctgcaatttgctctcggtttagggttcaccgcctggtcttgaactgtggtatggtcgtactggtacaaccaggttcaccgcctggtgtctttttatttttgacccccttttaatcatatattttaaaacaatcttccctaaaagttatctttagatctaataatccacttggttgtgccacaccacaatggcgacctaataaagttgttgtctcgtgtattgacacgataaagctatcaagtt

SEQ ID NO: 15414 - DNA, 2179 bp, Sorghum bicolor
  Clone ID: SORBI-28MAY03-CLUS49_312
gctgaacttaagcatatcaataagcggaggaaaagaaaccaacagggattgccctagtaacggcgagtgaagcggcaacagctcaaatttgaaatctggcccctccgggtccgagttgtaatttgtagaggatgcttttggtgaggtgccgcgcgagttccctggaacgggacgccacagagggtgagagccccgtctggctggccaccgagcctctgtaaagctccttcgacgagtcgagtagtttgggaatgctgctctaaatgggaggtatatgtcttctaaagctaaataccggccagagaccgatagcgcacaagtagagtgatcgaaagatgaaaagcactttgaaaagaagaagcgccagaagcaacacgatgagaatgtgcagaaggttgtgaagcggctcaagcagaggaatccaaagaaggatggtcttgtttgcacagccaggaagccctggattgctgttggcatgcgcaatgtggactacaagcgtgcgaggcatttcgaggttgacctttcttccttcaggaacatccttgagattgacaaagagaggatggttgccaaggttgagccccttgtaaacatgggtcagataaccagagctacctgcccaatgaaccttgcccttgcagttgtcgctgagcttgacgacctcactgttggtgggctgatcaatggttatggaattgaggggagctctcacctatatggccttttctctgacacagttgtcgcaatggaagttgttcttgcagatggccgggtcgttagagccaccaaggataacgagtactctgacctattctatggcattccctggtcccagggaacacttgggttccttgtctctgctgagatcaagctgattcccatcaaggagtacatgaagctcacctacattccagtgaaggggagtctgaaggaaatcgcgcaggcatatgctgattctttcgcgccaagagatggtgacccagcaaaggtccctgactttgttgaaggaatggtgtacacagaaagcgagggtgtcatgatgactggtgtgtatgcttcgaaagaagaggcgaagaagaagggcaacaagatcaactgtgtggggtggtggtttaagccctggttctaccagcatgctcagacggcacttaagaggggcgagtttgtggagtacatcccaacaagagaatactaccatcgccacacccggtgcctgtactgggaggggaagctgatcctgccattcggtgaccagttctggttcaggttcctgctgggttggctcatgccaccaaaggtgtctctgctgaaggcgactcagggtgaggctatcaggaactactaccatgacaaccatgtgatccaggacatgctggtgccactgtacaaggttggagatgctcttgagtttgtgcatcgcgagatggaggtgtatcctctgtggctgtgccctcaccgcctgtacaagctgcccgtgaagacgatggtgtaccctgagcctgggttcgagcaccagcacaggcagggcgacacaagctacgcacagatgttcacagatgtgggcgtgtactacgccccctggtgcagtcctaaggggagaggagttcaacggcgcggaggcggtgcacaggctggagcagtggctgatcgagaaccacagctaccagccacagtacgcggtgtctgagctgaacgagaaggacttctggcgcatgtttgacgcgtcccactacgagcactgccgccacaaatacggggcggtgggcacgttcatgagcgtgtactacaagtcgaagaaggggcgcaagacggagaaggaggtgcaggaggcggaggcggccatcctggagccggcctacgcggacgaggcctaagctgggaccaaccgttcagcggcagcggcagagtttgtttacataagactttgtgatgatgcgaatctggacgagatgagatgtttctctcgttttgcttaattaattagaacttgattatgtagtgtgtgtgtctgtccgtagtactcttaagctcgtggtcagtcagtgacttgtcgttgatgccccagtgttggggtttatttatctttttctctaatgggatttctcagattgattcgggacttgctacatggctctgcccttgtatgtgtacatgtgattgctagctcttatggtttttt

SEQ ID NO: 15415 - DNA, 1450 bp, Sorghum bicolor
  Clone ID: SORBI-28MAY03-CLUS49_313
tctcagatacatgttcgttctcaaggttctacaggagctctaacatcaaatacaatgctagaagttgttggcaccaacaatttggttattattcactcgaccgtacccaaataaaaaaccgtgacaccaaaacgataagtataatgtcatggaaatatctcgctagcacgttagtaggtgtagcccttctggaacatgcctttctttgcctcatcactctcaccctcaccagtgtagcgaccgagctgtgccagcgagttggcctttgcacgcgccagcagggccttctgcgctgcctccacgttctcagggcgcccttgccatgtctttagcaccgagttctgcagagcccgggcataggagaatgatacatgccatgggttcggagactggttcattgcattcaggttcagagttgcctccacctcggattgaccaccagaaaggaacatgattcctggaacagcgggaggtactctccttctgagcattgttagcgtatgctttgcaatggcttctggagaagccttctccttgtgctcagctccaggagtgaccatgctgggcttcagcaggataccctcaaacagaacattgttttcggccaagtagaagaacacctcagaccacactttctctgccacctcaagagttctttcgatcccatggtctccatcaagaaagatctctggctccacaattggcactaagccattatcctgagcaatagcagcatatcgggcaagtccccatgctgcttccttcactgctaatgcagatggaccacaagggatgctaacaacagtcctccactttgcgaagcgcgccccctgcttatagtactcagcacaccttgaagccaaaccatcaagaccttggcaccacgattcattgttggatccaggcaatggaaccaaacccttgtcaaccttgatgccgggcatgatattctgttccttcaagcagtcaacaaacttcttgccatctgtagttgattgataaagagtctcctcaaaaagaatagcaccagaaatgtattcaccaagaccagcagttgtcagcaaaagctgcctgtaagcctggcggttaggttctgtgttgtccaaaccaattgacgatagcctctttccgcatgttgcatttgactcatcaattgccagaataccacgcccaggcgaagcaacagatttcgcggtggagacgagctcgtcggagtaggagcctgcggcggcgcggatcaccgtcgcgcggcgggcgggcgcggatcgccgggtgcggccgccagcgagcaggctggtagccggggagctcagcttcgccgtcgccatagccatagagggttgtgtaggttggttcgtcgggcctgtgcgatcggtgtttggtttcacgacgcgaggcgagggcggagaataagaagcgtccaggaacaggggaggtggtggcctcgtgc

SEQ ID NO: 15416 - DNA, 1555 bp, Sorghum bicolor
  Clone ID: SORBI-28MAY03-CLUS49_314
gccggccgggctgggagatctctctcgtcctccgatctgcatctcacgcacgttggcttgctcccaccttttctttctttagcagagtaacagtctagcagaggcgcagagcgagcatgtcgtcgtcggcggagaacgaccccacggtgaccgagcgcggcgccagcagcaaggacaagcacgaggacggcgacaaggagcagggcggcggcgggttcattgacaaggtgaaggacttcatccacgacatcggcgagaagatcgaggaggcggtcgggttcggcaagcccacggccgacgtctgcggcatccacatcccgcacatcagccttcaccgcgccgacctcgtcgtggacgtgctcatcaagaaccccaacccggtgcccatcccgctcgtcgacatcgactacctcatcgacagcgacggccgcaagctcgtgtccggcctcatccccgacgccggcaccatccacgcgcacggccaggagaccgtcaagatccccgtctcgctcgtcttcgacgacatccggagcacttacaaggacattcagccggggagcatcatcccttacctcgtccgcgtcgtgctcctcgtcgacgtccccatcatcggccgcatcaagatcccgatccagaaggacggcgagatccccatcccgtacaagcccgacgtcgacgtcgagaagatcaagttccaccacttctccttcgaggagaccaccgccacgctccacctcaagctcgagaacaagaacgacttcgacctcggcctcaacctgctcgagtacgagatgtggctcggcgacgatagcatcgcctccgctgagctcacccagaccgccaagatcgagaagcaggggatcaccaggatgcaggtgcccttcagcttcaggcctaaggactttggatccgctgtctgggacatgatcaggggaaggggcacggggtacaccatcaagggaaagattgatgtcgacactcccttcggcaacatgaagctgcccataagcaaagagggtggaaccacctgcatcaagaaggacgatgacgacgatgacgacgatgacaactgaactgaggcaggactggagcgctgctgttacctttcacacaaaatgcagcaaagcagagaaggatgtggggatcgtcatccacctgatacccttagtgctagttaagctcgtgccttagcttatggtgtcttgttgttttgcatcgtttgaacatcctcacttcgtcagtgtacgttgtggtgccatgcggttgtccagtttgaggtttcctctgtgtagtctcctgggggaattccttctccaaactttgcggttggaactgaagaataagaataaaattccatgcccctccgggttcttttgtgggtctggttggaatagctcctggctgaattgtttgcgctgctgtgatggtcaagtgccaacagtattccggaaatgaactttacagccttacaggcatgttctttatccatacagaagctcacgggcaagtcatgaataatcgactcctgttttcaaaaaaaaaaaaaaaaaaaaaa

SEQ ID NO: 15417 - DNA, 783 bp, Sorghum bicolor
  Clone ID: SORBI-28MAY03-CLUS49_315
gccggccgggccgggaatctccttgcccgttcgtgtctgtctctgttcattcgttccccacctcgccctcgagccgtctcgctagggtttcgccgccgccgccgccgccgccgccatgcctcgccgcagctcaggaaggtctgccccacgcccggctccacgtgctgctccagtgaggaacccaccacagccagcacgccaggctcctcctccagctcctgttcgggatggtggtggctccattcttggaggaattgggtccaccattgctcaaggtatggcatttggtactggtagtgccatggcgcacagggctgttgatgctgtaatgggtccccggaccattcagcatgagactgttgtctcagaggcggctgctgctgcccccgctgctccagcgatgaacactgatgcttgtggcatccattctaaggccttccaagattgtctcaacaactatggcagcgacatcagcaagtgccagttctaccttgacatgctgaacgagtgccgccgtggtggtgtgtctgcctaagcacctctattgggactactcatgggttttcttttaactctcatggtatctcattaataagacaccgtgaaacttgaaccatctgcttgaaacgtatgtaccgtgacatcactggtccatcttgttgaagctatggttataccgtctttcctgggagtggtacattctgttatcccgtattgttggaacagacatctgtatctgtgtctctggtgatcataaatatttgaatgaaccagttatgttgg

SEQ ID NO: 15418 - DNA, 1720 bp, Sorghum bicolor
  Clone ID: SORBI-28MAY03-CLUS49_316
aaaaaaaaaaaaaaaaaccctaagacgcagtcggccgccgcacaccaggagaagccgacgcgccgccaccgtatccgcggatcagcggcgagccgtaaccacgccacactgcttgccgcccgacgagcagggtaacagtttccttcagccatggggaaggagaagactcacatcaacattgtggtcattggccatgtcgactctggcaagtcgaccaccactggccacctgatctacaagcttggcggtattgacaagcgtgtgatcgagaggttcgagaaggaggctgcggaaatgaacaagcgttcattcaagtatgcctgggtgcttgacaagcttaaggctgagcgtgagagaggtatcacaattgatattgccctgtggaagttcgagaccaccaagtactactgcacggtcattgatgcccctggccaccgtgacttcatcaagaatatgatcactggcacttctcaggctgactgtgctgttcttatcattgactccaccactggtggttttgaggctggtatctccaaggatggccagacccgtgagcatgctctccttgctttcacacttggagtgaagcagatgatttgctgctgcaataagatggatgccaccacacccaagtactcgaaggcccgttatgatgaaattgtgaaggaagtctcttcctacctgaagaaggttggatacaacccagacaagatccacttcgttcccatctctggttttgaaggtgacaacatgattgagaggtctaccaaccttgactggtacaagggcccaaccctgcttgaggctcttgacttgatcaacgagccaaagaggccttcagacaagcccctgcgtctcccccttcaggatgtgtacaagattggtggtattggaactgttcctgtcggacgtgttgagactggtatcatcaagcctggtatggttgtcacctttggtcctagtggccttacaactgaggttaagtctgttgagatgcaccacgaggctctccaggaggcccttcctggtgacaatgttggcttcaacgttaagaatgttgctgtgaaggatctgaagcgtgggtatgtggcctccaactccaaggatgaccctgccaaggaagctgcgagcttcacctcccaggtcatcatcatgaaccaccctgggcagattggcaatggctatgccccagtgctggactgccacacctcacacattgctgtcaagtttgctgagctcgttaccaagattgataggcggtctggcaaggagcttgagaaggagcccaaattcctcaagaacggtgatgctggtatggtgaagatggttcccaccaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgcccccaagaagaaatgaggtgtctggctgatcctttgttttctcgagggattacctagttggaacttaaaatattgtcattgctgttattgcgcgagcaactaaactgtgctggcaatgtttgtctggtcgatttagtactgttatttttgttaaaaccagggtgcttaacactaattttctgttatttttgtatcgagaacatccggtgatagccatatatggttatgagttttgttcctct

SEQ ID NO: 15419 - DNA, 1173 bp, Sorghum bicolor
  Clone ID: SORBI-28MAY03-CLUS49_317
gccggccgggcctggagtcgccgccgccgcctccccctccctcgcgtcgccgtcgtctcccgttcggaacgccaagctcccctccggcgaaatggccccgaagcgaggtggcagggcgcctgtgccggccaagaagaagacggataaagtggtgaaccctctgttcgagaagaggccgaagcagttcggcatcggcggcgcgttgccgcccaagaaggacctgcaccggttcgtcaagtggcccaaggtcgtgcgcatccagcgccagcgccgcatcctcaagcagcgcctcaaggtgccaccggcgctcaaccagttcacccgcaccctcgacaagaacctcgctaccaaccttttcaagatgcttctcaaataccggcctgaagacaaggctgccaagaaggagaggcttctgaagagggctcaggctgagactgaaggaaaaactgttgaagccaagaaaccaattgttgttaagtatggccttaaccatgtgacttacctcattgagcagaacaaggctcagcttgttgtcatcgctcatgatgtggatccgattgaactggttgtgtggcttccagccctgtgcaggaagatggaggtcccttactgcattgttaaaggaaaggctcgccttggatcgattgttcacaagaagactgcatcagtcttgtgtctgaccactgtcaagaacgaggacaagcttgagttcagcaagatcttggaggctattaaggcaaacttcaacgacaagttcgatgaggtgaggaagaagtggggaggtggtatcatgggctccaagtcgcaggccaagaccaaggctagggaaaagctgatcgccaaggaggctgctcagcggatgacctagattatccacttctgagtgtgcgctgtagttttgacgtggaagaactgataatcgttgtgcactcgtattgtggttttctgaatcaagtttcatatgtttctgtccaccagaccatgtttagaaactttgcaagacagagtttacagtgtttatgcgatgtctcagctagtatattattttgtgccccaggcaaccttgtttttatttgcctaagatcaactataatagtatctttatatctttatatattgatagagtgattttgataatgccctatgacagcttgtttaattatattttaaaat

SEQ ID NO: 15420 - DNA, 1424 bp, Sorghum bicolor
  Clone ID: SORBI-28MAY03-CLUS49_318
gccggccgggccggggcacaaacgcgtcgtttccgcacgctccacaggggatcctctgcgccaccgcaaccgtgtaaccccggccgtgccgccgccggcgatcccgatccgccgacccgacccgtcccgtccccccgctcgcagccatgtcgccgtcggagccgacgcgggaggagagcgtgtacatggccaagctggcggagcaggcggagcggtacgaggagatggtcgagttcatggagcgcgtggcgcgctccgcgggcggcgcggggggcggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcgcctaccgctccaagatcgaggccgagctcgcccgcatctgcgacggcatcctcgcgctgctcgactcccacctcgtcccgtccgccggcgccgccgagtccaaggtcttctacctcaagatgaagggcgactaccacaggtaccttgctgagttcaagtcaggtgcggagaggaaggatgctgcggagagcaccatgaatgcttacaaagctgctcaggatattgctcttgctgatttggcaccaacccaccccatcaggcttgggctggcactcaacttctcagtgttctactatgagattctgaactcccctgatcgcgcttgcaaccttgcaaagcaggcttttgatgaggcaatctctgagctagacagcctgggagaggagtcctacaaggacagcactctgatcatgcagctcctgcgtgacaacttgaccctatggacttcggacaccaacgaggatggcggcgacgagatcaaggaagctgctgccccgaaagagtccacagagggtcagtaagatggactcgatctcccgacctgatgcatttgctgatgttgggagaggggtgaccaggaccgctgtgcttgaattctgatagcttatcttctagtataccttgttgttgtcttccgtcatcacacgcaccggtgtatgcatgcgatggagctgctgccattgctgctgtttttaattaagcactctagatgtcgtcatgccgcgcgctttgttgtttcggttttttcaagtcgataaaatgatggctggatgctggttttcgtgctccaagccagccgccaccaaggagaaaagacctgctcatcttgtgttgcagctgttgtgttttagaatgaccccacgtacggagtatttgacttgacaggcctgctgccgagtggtattctgttatgatgatggcttttgcaaagctatttggcttaaatgtctcggaatgatctgaattggctccattggattttttttaagcattattgg

SEQ ID NO: 15421 - DNA, 2037 bp, Sorghum bicolor
  Clone ID: SORBI-28MAY03-CLUS49_319
gtttcgtcacggcttttagtttgctcgccagactgacttgattggtgggtgatttgccaacgctgcggcagcgccgtcgagcacggagcccgccgggaggctcctgcacctgccgctccagggtgcgctgaggccattgctcatctcctcctttgtggagcggagatcccacccgagcgccaattggtctcctctttcgttggcagcaggctgagtaacgtcaactcttgaaccaatgaggggctggggcttgctcgtgttatcgctacatgttctttcatgcctggttagtggtgttgcctctggtcgaacaagctcttacgtgcgcacagagttcccatctacagatatacctctagatagtgaatggtttgccattccaaagggatataatgctccacagcaggttcatatcacccaaggtgactatgatggaaaggcagttatagtatcttgggttactccggaagaacctgggccaagtgaagtgttttatggcaaggagaaacaatatgaccagaaatcagaaggaacaacaacaaattatacgttttacgattacaaatctggatacatacaccattgccttgttgatggccttgagtataacactaaatattattacaagattggtagcggagattcagctcgagaattctggtttgaaacacctccagcaattgatccagatgcatcatacacatttggcatcataggtgatctggggcaaacatttaattctctctcaactcttcaacattatgagaaaactggaggtcaaactgttctttttgttggggacttgtcgtatgctgatagatatgaacataatgatggcattcgttgggattcttggggtcgatttgttgagcgcagtactgcataccagtcatggatttggaatactggaaaccatgaaatagagtacaggcctgatctgggagaaacttctacattcaagccatatttgcataggtatatgactccatatttggcatcaaagagcagttctcctatgtggtatgctgtcaggcgtgcatctgctcatatcatcgtgttgtctagctactctccatttgtaaaatacactcctcaatggtggtggctgaagaacgaattcaagcgtgtggacagggaaaagacaccttggcttatcgttctcatgcattctcccatgtacaacagcaatgaggcacattatatggagggcgagagtatgagggctgcttttgagaaatggtttgtgaagtacaaggtcgacttggtatttgcagggcatgttcatgcttatgagagatcataccgcatttctaatgtcaactacaacataacatcgggaaatcgatatccagtgccaaacaaatctgctcccgtttacataacagttggtgatggaggcaaccaggaaggacttgcttcaaggttttatgacccccagccagactactcagcgttcagggaggccagttatggtcattcacttttacaactgaaaaacaggactcatgctgtctatcagtggaacagaaatcatgatgggaatcctgttccagcagacaccgtggtgtttcataaccagtattggacaagcagcacgcgccgcagaaggctgaagaagaaccatttccatctcgagaaccttgaagatctgatttccctattctaagaaagccagtctcgcagaatgtcacgcagcttgaactttgtggaaaaaacgcagcataacagcaccgttgctaagtgcccctgcttctcttggaagcagcagaaccagtcatcagactggcaatggcaagtccagctacctgatttcatgccaaaggagccatggggacctctgtggatctgaaattctgaatgctgtactcgtatgaaaatagtgcaaataatacggctgtatccgtacagatgtaacattttatacgtatacagtaaatacacatcagtttcttccaccgttatccgggaaccattttcgcctgtctgcattgtggccagtggaaatttgttatttgcggattaatatccctttcatcc

SEQ ID NO: 15422 - DNA, 1262 bp, Sorghum bicolor
  Clone ID: SORBI-28MAY03-CLUS49_320
gcacgaggagaaaatatccttcctcttgccctcgtcaatggctcctccagtcctcggtcctcctcgccctcgctgcctgccgatgccgctcgctgcccatctctaggcagcatggcggacaaatatcacgacgaacatcctcccacgtgcgacatccttcgcattctttcgcttgcaaggcagatcggcggcggctgccagatccgatggtggtttcggcgaggggccgaaggcaagaggcgggagcgtgggagttggcgctggcctcctcgtggccctctgtgccgccgtccacttcgccctctgccaacaacctcgccaggcccgtctcacgctctggcatcccacccagcatccacccgcgactcctccgaaccctagcgccggcgcctccacttcgcttcctcaccccatctccgctcagggtccggcggcggcgaagggaagggcaagatgtacaccgcgaggaagaagatccagaaggagaagggccttgagccctccgagttcgaggactccgtcgcgcaggcgttcttcgacctggagaacggcaaccaggagctcaagagcgacctcaaggacctgtacatcaacaatgctatccagatggatgttgccgggagcaggaaggctgttgtgatccacgtcccataccgcctgcgcaaggccttcaggaagatccatgtcaggctcgtcagggagctggagaagaaattcagcggcaaggatgtggtaattgttgccacaaggaggatcgtgaggccacccaagaagggttcagctgttcagcgccctcgcaccaggactctgactgctgttcatgatggcatcttggaggatgttgtctacccagctgagattgtggggaagcgtgtcagataccgtctggatggtgccaagatcatcaagatcttcttggacccaaaggaaaggaacaacaccgaatacaagctggagacctacactgcagtgtaccgcaggctgtgtgggaaagaagtggtctttgagtaccctatgaccgaaaatgcataaagatgatgccctggatatctccatttcatttcgttgaatctggatgttttgttggggtctcaactagtttgctccctatgtacttcaaaaaccatagttttgatgccaaagttgcctaggaattcggtactctggaatttgccgtggacgtgaacaatgttaagttttgagcatttaaattaaacctttgccccgttaacatgttgcgagttactatttaattggttgtc

SEQ ID NO: 15423 - DNA, 924 bp, Sorghum bicolor
  Clone ID: SORBI-28MAY03-CLUS49_321
gcacgaggcaacaactccagcacacacacacacacacacgtacagcagcctctcttagcttagcagctccagcaccggccggccggcaccacaacaatggccaccgtcctgagcagcctccgcgcgccggcctcgaccttcccctcctctctccgcgtcgcggcagcaccggcggcgccggccaccgtggcgctgctgcctgcggcgggcaacaaggtaccgggcatggccgcccgtggcgccaggctgcgcgcgcaggccacctacaacgtgaagctcgtgacgccggagggggaggtggagctgcagtgtcccgacgacgtgtacatcctggaccaggcccaggaggaaggcatcgacctgccctactcctgccgcgcggggtcctgctcctcctgcgccggcaaggtcgtcgccggcagcgtcgaccagtcagaccagagcttcctcgacgacgaccagatcgccgccggatgggtgctcacctgccacgcctaccccacctccgacgtcgtcatcgccacgcacttggaggacgagctcaccggctaatcatcatgtgttacatatgcatgcatgattgattaagcgcgcgcgtagtactgctgttgtttgttggttttgcatgcaactcatgtaagcgtggagttttcaaccgatcgatccgtggagagagcgagaggccctattacataccttgtgcgtgtatgcttattatatttgccgtacgtgttgagttgttgttaattaatatatggcctaattgtaatcttgttttataatttgctattttgtttcttttcgatctgtttatatataagcaaaatgactggttatatattgaatgtcttgaagtcaccaatatatcaagttgtttcattcgtttcttaattagtcatacagctcccaaatttcagactggtt

SEQ ID NO: 15424 - DNA, 850 bp, Sorghum bicolor
  Clone ID: SORBI-28MAY03-CLUS49_322
aaatccatacaaaatcctcagcacgatacgattccaccgaattaagtttgtgcacgtagtacgcactgggacaccagtgagcaacacaacagccagtgcgcgcgccatggcctccctcgccgccgccgtctccgtgcagcccgtggccgtgaagggcctctccggcagctccatctccggcaggaagctcgccgtcgccagcaggccgtcgtcgtcggcccgcgccgcctgccgctccacccgcagggccgccgtcgtggccaagtacggcgacaagagcgtctacttcgacctcgaggacatcggcaacaccaccgggcagtgggacctctacggctccgacgctccctcgccctacaacccgctccagagcaagttcttcgagacgttcgcggctccgttcaccaagagaggcctgctgctgaagttcctgctgctgggcgggggctccctgctggcctacgtcagcgcgtcggcgtcgccggacctcctgccgatcaagaagggaccgcagcagccgccgcagccgggcccgcgcggcaagatctaagctcatcgaccagctccggcctccatttgcgttgcatggtctagtagtagcttgctttgtactgctagctcccggtcggtcgcactctcaactcgccatggatcatcatccctgcctgttacgctgttcataactttggtatatttgtgatgctgatattgtgtactcttttggcacacaattaaaagagccttttagccgtgtgtcattataaaagaccacacaattccttctactatatactactgaaaaataaaaaaatggtgttgcatgcctttgtatattatgagcctaactgct

SEQ ID NO: 15425 - DNA, 2752 bp, Sorghum bicolor
  Clone ID: SORBI-28MAY03-CLUS49_323
tgttggcctacggcttcccataccgtaccactctccccgtttctctccggccggttcgtgggagggccgaagcttcgagaaaggaaaccctaacgctgttgggacttgggagtagcctccggcgatggctgcggcggcgatcctgccggagctggcgacgcaggtgctcatcccggtcgcggcggccgtgggcatcgcgttcgcggtggtgcagtgggtgctggtgtccaaggtgcggctcacccccgagcgccgtgcggacggcggagccgccaagagcgggcccagcgactacctcatcgaggaggaggaggggctcaacgaccacaacgtcgtcgtcaagtgcgccgagatccagaacgccatctctgaaggagctacatctttccttttcactgagtacaagtatgttggattattcatgggcatctttgcaatccttatattcctcttccttgggtccgtcgagggattcagcacgaagagtcaaccttgccactatagcaagggcaaaacttgcaagcctgcccttgctaatgccatcttcagtactatagcttttgtgcttggtgccgtcacctcactggtttctggatttcttggaatgaagattgcaacttatgcgaatgcccggacaactttagaggccagaaagggtgttgggaaggcatttattactgccttccgatctggtgcagttatgggctttctgcttgctgccagtggtcttttggttctttacattgctatcaatttgtttggaatttattacggtgatgactgggaaggtctttttgaggctattactggttatggccttggtggttcttctatggctcttttcggccgcgttggtggtggtatttataccaaggctgctgatgttggtgctgaccttgtgggtaaggtagaaagaaacattcctgaggacgatccaagaaacccagctgtcattgctgacaatgttggtgataatgttggagatattgctggaatgggatcagatctcttcggctcatatgctgaatcgtcatgtgctgctcttgttgtggcctcaatctcgtcttttggaatcaaccatgaatttactccgatggtgtacccccttcttgtcagctctgttggtattatagcatgtctcgtaacaacgctgtttgcaactgatttcttcgagataaaggctgtgagtgaaatagagcctgctctcaagaaacaacttataatatctactgttgtgatgaccattggcattgcgctcatcagttggcttggtcttccatacaccttcaccatttttaactttggagaacagaagacagtgcaaagctggcaattattcttgtgtgtggcggttggtctctgggctggcctagtcattggatttgttaccgagtactacacaagcaatgcctacagccctgtacaagatgttgctgattcctgcagaactggagctgccactaatgtcatttttgggcttgctttgggttacaaatcagtcattatcccaatttttgctattgcgtttagtatcttcctcagcttcagccttgctgccatgtatggtgttgctgtggctgctcttggaatgctgagtaccattgccacaggccttgccattgatgcctatggccctatcagtgataatgctggaggaatagctgaaatggctgggatgagccataggattcgtgagagaaccgatgctctagattctgcaggaaacaccactgctgcaattggaaagggctttgccattggctccgcagccttggtgtcccttgcactcttcggtgcctttgtaagccgggctgctatctccactgttgatgttctgactcctaaagtattcattgggcttattgtcggtgctatgctcccatactggttctcggcaatgaccatgaagagtgtaggcagtgctgcactcaaaatggtggaggaagtccgccggcagttcaacaccatccctgggctcatggagggcaccacaaagcctgactatgcaacttgtgtcaagatctcaacggatgcatccatcaaggagatgatccccccaggtgctcttgttatgctcacaccactgatcgttgggattttgtttggggttgagaccctctctggagtccttgctggtgcccttgtctctggtgttcagattgccatttctgcatccaacactggtggtgcctgggacaatgccaagaagtacattgaggctggagcttcagagcatgccaggacccttggcccaaaaggttctgaccctcacaaggcagctgtcattggtgacaccattggagatcctctcaaggacacgtctggcccctccctcaacatcctcatcaagcttatggcggttgaatcccttgtctttgcccccttcttcgccgcccatggtggcattctcttcaaatggctctaagccagcgagagtcgcaggataaaggccgtagttttgcaaggggagtagagcagtatgtcagctatacagcatatatggcatgtgctttgctccaccagttgatgagccccgttgtgtattttggttttcgttttcttgagtttttagttccagggtccgaccatgttttgatcccataaattctcctccggccttcgagcaactgagactatcttcgtaagtcatcagacccagccaatcactgaagcattggaaaactaaacagtttctagcgatatggtgatgattatgatgatgatgattaatctcagcatttttttcttcttg

SEQ ID NO: 15426 - DNA, 2188 bp, Sorghum bicolor
  Clone ID: SORBI-28MAY03-CLUS49_324
gccggccgggtcgggacgtccgcaaaccccttcacaacacgcagctgcgacccaacccgacccctcccgaggccgccagccttatcctctcctccgcctccgcgatcccctccgtctccaatccatccgcaagcgcagcaaggtagacatggcttcgacattcggtgccacttctacagttggccttatggctgctccagcagggaagaatgtgcgccttcagaggagggctaacttcagagtaaaagcagccaaggagctgtacttcaacaaggatggctcagctatcaagaagctccagactggagtcaataagcttgcagacctagttggagttacacttggaccaaagggaaggaatgtcgttttggagagcaagtatggctctcctaagattgttaacgatggtgttacagttgcaagagaggttgagctggaggaccctgtggaaaacattggagctaaattggtcaggcaagctgcagctaagaccaatgatctagctggagatgggacaaccacctccgtggtccttgctcagggactgattgctgagggtgttaaggttgtggcagctggtgctaatcctgttcagattactcgtggtattgagaaaacagcgaaagcactagttgaagaactacgtaagttgtccaaggatgttgaagatagcgagcttgcagatgttgctgcagttagtgctggcaacaactatgaaatcggtaacatgatagcagaggccatgagcaaggttggtcggaagggtgtggttacccttgaagagggaaggagttctgagaactttctctatgttgtggagggaatgcagtttgaccgtggttatatctctccctactttgtaacagacagtgagaaaatgtctgccgagtacgagaactgcaagcttcttttggttgacaagaagatcaccaatgcaagggatcttatcaacgttttggaagaagccatcagaggtgcatacccaatcctgataattgctgaggatattgagcaggaggctcttgctactcttgttgtcaacaagcttagaggatcattgaagattgctgccatcaaagcccctggttttggagagcgcaagactcagtacttggatgatattgccatccttactggagcaactgtaatcagggatgaagttgggctgtcacttgacaaggctgacaaatcagtccttggaacagctgcaaaggttgttcttaccaaagagtcgacaacaattgttggtgacggcagcacccaggaagaagttactaaaagggttgcgcagattaaaaatctgattgaggcagcagaacaagaatatgaaaaggaaaagctcaatgagaggatagcgaagcttgctggcggtgttgctgtcattcaggtgggagcacaaacagaaactgaactaaaagagaagaagttgagagttgaggatgccctaaatgcaactaaggctgctgttgaggaaggtattgttgttggtggagggtgcactcttttgcggcttgcagctaaagtcgatgccatcaaagatacactggagaatgatgagcagaaggttggagctgaaatagtaagaagggccctgagctacccacttaaattgattgctaaaaacgctggtgtcaatggcagcgttgtcactgagaaggtcctttctaacgataacttcaagtatggttacaatgctgctactggacagtacgaggacttgatggctgctggtatcattgaccccaccaaggtggtgagatgctgcttggagcatgccgcatcggtggccaagaccttcctgacatcagatgttgtggtcgtcgatatcaaggagccggaggccgcgcccctcgctaacccgatggacaactctggctatggatactgatgaagtgatgagatgatatggccaagccgcagttgccccatgggacgaaggtgatcaccatattattttttggtaggcgagacgtcgggtccaggtagtttcagataaaaatgtgagtttgttgtacggccaaaaggtgaaaataaggggaggatctgtagccccaaatctgtgatgtaaactgcatcaggacagcagctaaatcaagcagaaattgctgagagattttgtaactgattgcagctatgttgaatgaatgcagtttgcacacgactaaaacacaaatttaaaatgtgcctg

SEQ ID NO: 15427 - DNA, 1380 bp, Sorghum bicolor
  Clone ID: SORBI-28MAY03-CLUS49_325
ccgtgccattggctcagcctgctcggccgacgcgccgtagccggccgcctcgaagctcccttcctaacgggcggcgggctgaatcctttgcagacgacttaaaacgcgacggggcattgtaagtggcagagtggccttgctgccacgatccactgagatccagccccacgtcgcacggattcgtaccggaaggcgaaatccaatctagaagcggccctcctccctctcctccccatccgaaccaaatctaatcgacgcttccccgagatgggccgcaagttcttcgtcggcggcaactggaaatgcaacggaaccacagatcaggtcgagaagattgtcaaaaccctgaatgaaggacaggttccccctgcagatgttgttgaggtcgttgtcagccctccttatgtcttcctaactgtggtcaagagcctgctgcgcccagagttccatgttgctgctcagaactgctgggtgaagaagggaggtgctttcactggtgaagtcagtgctgagatgctcgtcaaccttggtgttccctgggtcatccttggacactctgaaaggagagctctgctgggagaatcaaatgagtttgttggagacaaggttgcttatgcgctgtctcagggactaaaggtcattgcatgtgttggtgagacccttgagcagagggaggctgggtcaacaatggaagttgttgctgcacaaacaaaagcaattgctgagaagatcagtgactggagcaacgtagttgttgcctatgaaccagtatgggccattggaactggtaaagttgccaccccagctcaggctcaggaagtgcacgcatccctgagggattggctaaagatcaacgtcagccctgaggttgctgaatctacaaggatcatctacggaggttctgtaactgcagcgaactgcaaagagctaggagcacagcctgatgtcgatggtttccttgtcggtggagcttctttgaagcccgagttcatcgacatcatcaacgcggccaccgtgaagtccgcttaagatgttccaacccttcaccctgatgcagagatatgctgaagaggaaggaacatacatttttttgtttaactgtgctatgtaagctagtagtaactttgcgctggagcatatactgttttccctcccccccagctttttgggaggctacagcttgagcttgctaataatgtttacctctggacatatcaataatggtgtttatgtagacctttttttgtggcgaattatgatggatccgtcatcagaaccatgggtttggtgtgtccgtgtgtgtcgtcagaaccatgggtttggtgtttgtgatactaagggtgcgtttgataggagaaacgtttcagttttgatgagaat

SEQ ID NO: 15428 - DNA, 2159 bp, Sorghum bicolor
  Clone ID: SORBI-28MAY03-CLUS49_326
gcacgaggccgtgatgtatagcgctagctgttgagttggagtagttgactagcttccatggcgtggtcgtcgggaggcgtggcggcgacgatggcggccgctctggtggcggcgctggttgcgttggcggggagagcaagcgcgtccccggcggagggcatccagccgctgtccaagatcgccgtccacaaggccaccgtcgaaattcagtcgtcggcgttcgtggaggcgaccccgtcgctgctcggcgagcagggagaagacacggagtgggtgacggtgaagtacggctggacagacccttccgacgacgactggatcggcgtcttctctccatctgaattcaactcgtcggctacgtgtcctaacccatggccagcagaagaaccctatctctgcacagcacccatcaagtatcaattcgccaactactctgaaaactacatcttctggggcaagggcagcatccggctgcagctcatcaaccagcgctccgacttctccttcgccctcttcaccggcggcctcgacaacccgaagctgatcgcggtgtcggagccgatcgccttcaagaaccccaaggcgccggtgttcccacgcctggcgcagggcaagtcccacgacgagatgaccgtgacgtggaccagcggctacgacatcagcgaggcctacccgttcgtggagtggggcgccttgttggtcgccgccgccggcgccgccgccccgccccagcagaccacgcgcgcgcccgccgggacgctcaccttcaaccaaggcagcatgtgcggcgagccggcgcgcaccgtcggctggagagaccccggcttcatccacaccgccttcctcagggacctctggcccaacaaggagtactactacaggatcgggcacgagctccacgacgggtccgtggtgtgggggaagccctactcgttccgcgcgccgccgtcgccggggcagaagtcgctgcagcggatcatcgtgttcggcgacatggggaaggcggagagggacgggtcgaacgagtacgcggcgtaccagccggggtcgctgaacacgacggacgcgctgatcagcgacctggacaactacgacatcgtgttccacatcggcgacatgccgtacgccaacgggtacatctcgcagtgggaccagttcaccgcccaggtggcgcccatcaccgcccggaagccctacatggtggccagcggcaaccacgagcgcgactggcccgacacggcggcgttctgggacgtggaggactccggcggcgagtgcggcgtgccggccgagacctactactactaccccgccgagaacagggcgaacttctggtacaaggtggactacggcatgttccggttctgcgtcgccgactcggagcacgactggcggatcggcacgccgcagtacgagttcatcgagcactgcctgtcgacggtggaccggaagcaccagccgtggctcatcttcgcgacgcaccgcgtgctgggatactcctccaacgcctggtacgccggcgaagggtccttcgaggagcctgagggccgcgagaacctgcagaggctgtggcagaagtaccgcgtcgacatcgcctactttggccacgtccataactacgagaggacctgccctatgtaccagagccagtgcatgaccagcgagaagagccactactccgggacgatgaacgggaccatcttcgtggtggccggcggcggcggctgccacctgtcgagctacacgacggcgatccccaagtggagcatctaccgcgaccatgacttcggcttcacgaagctcacggcgttcaaccactcgtcgctgctgttcgagtacatgaagagcagcgacggcaaggtctacgactccttcaccatccacagggactaccgcgacgtgctccggtgcgtgcacgacagctgcttcccgacaacgctcgccacctgataaagccattgttatgacactactagttttggcttggtcgtccaaataaaatgtgtcaaccacttagtataataatgtgctctgtgaaggcacactgtaactatattgatgcctaaactctatctaaataaaaaaaaatgataatgtaaatcatccaaacatcttccaagctagctagaaccagtggagctcacgtggtggttctgatt

SEQ ID NO: 15429 - DNA, 2323 bp, Sorghum bicolor
  Clone ID: SORBI-28MAY03-CLUS49_327
gcacgaggccgcgttgggccggagttgccgttctcgcctatatatactgccgcgtgactcgcgtgtcgtcgttcttcagggacgacggagcagttctgtgagtgacaagtcgcgcgcggcggccagcacgatctcccctctacctctaggcctctagctatagcattggcgcgcgacgcgcggggccatggaggtgaggcggctgctgtgcgtggtggcggtggtggtgagctgttgggcgctggcggcgccggtggcgcggtgcgacccgcaggtgccgtgctacttcatcttcggcgactcgctggtggacaacggcaacaacaactacatcgtgtcgctggcgcgcgcaaactacccgccctacggcatcgacttcgccggcgggccgtcggggcgcttcaccaacgggctcaccaccgttgatgtcatcgctcaacttctggggttcgacaacttcatcccgccgttcgccgcaacgagcggggaccagctcctcggcggcgccaacttcgcctccgccgccgccggcatccgcgccgagaccggccagcagctgggcgggcggatcccgttcgcggggcaggtgcagaactaccagacggcggtgcagacgctggtgagcatcctgggcgaccaggacacggcgtcggaccacctgagccggtgcatcttcagcatcggcatgggcagcaacgactacctcaacaactacttcatgccggccttctacaacacgggcagccggtacacgcccgagcagtacgccgactcgctcatcgccgactaccgccgctacctgcagacgctctacagctacggcgcgcgcaaggtggtcatgatcggcgtcggccaggtcgggtgcgcccccaacgagctcgcgcgctacagcgccgacggcgtcacctgcgtcgaccgcatcgacgacgccatccagatgttcaaccgccgcctcgtcggcctcgtcgacgagttcaacgcgctgcctggagcacacttcaccttcatcaacgcatacaacatcttcgacgacatcctcgccaacgccgcctcctacgggtttacggtgaccaacgccgggtgctgcggggtgggcaggaacaacgggcaggtgacgtgcctgccgtaccaggcgccgtgcgccaacagggaccagcacatcttctgggacgcgttccacccgtcggaggcggccaacatcatcgtcggacgccggtcgtaccgcgccgagtcacccaacgacgtctacccgatggacatcagcacgctcgcctccatctgatctcatctcatccgtccaaattataacagcagtttcagttcattcccctaatatagtccaccgtactcaccaatgcaaagggtgcaaacggggctcgaatattctttactgtacaagctcgtatatctgtaatttttgcaactcatactttggtatatttgcagcggatacttagaaaaaaataattgattcactttttttttcgattttatgctcatcatgcatgcatgcctgaattggcaaaagatcaaaacaggcacaattctcaaaaaaaaaaaaaaaaaaaagttcttcagggtcagggacggagcagttctgtgagtgacaagtcgcgcgcggccagcacgatctccctctacctctagctaggcctctagctatagcattggcgcgcggcgcgcggggccatggaggtgaggcggctgctgtgcgtggtggcggtggtggtgagctgttgggcgctggcggcgccggtggcgcggtgcgacccgcaggtgccgtgctacttcatcttcggcgactcgctggtggacaacggcaacaacaactacatcgtgtcgctggcgcgcgcaaactacccgccctacggcatcgacttcgccggcgggccgtcggggcgcttcaccaacgggctcaccaccgttgatgtcatcgctcaacttctggggttcgacaacttcatcccgccgttcgccgcaacgagcggggaccagctcctcggcggcgccaacttcgcctccgccgccgccggcatccgcgccgagaccggccagcagctgggcgggcggatcccgttcgcggggcaggtgcagaactaccagacggcggtgcagacgctggtgagcatcctgggcgaccaggacacggcgtcggaccacctgagccggtgcatcttcagcatcggcatgggcagcaacgactacctcaacaactacttcatgccggccttctacaacacgggcagccggtacacgcccgagcagtacgccgactcgctcatcgccgactaccgccgctacctgcagacgctctacagctacg

SEQ ID NO: 15430 - DNA, 1064 bp, Sorghum bicolor
  unsure (1)..(1064): unsure at all n locations
  Clone ID: SORBI-28MAY03-CLUS49_328
taggggccttttttttttttttttttctttaaagcaaagcacacttcgagcaggcaaaacaaaacaaatcatcggagcatcattgggagtacaaacatggcgggatatattaggggatagataaacgagtcatatgacagacaaaggtaccaaaccatactaaacaaggctaatgatgtccctcagcaatggcacagggtgccagagcatcacaagttccttaaaaagacttctttagtttactgctagggaaggcggagcatggcgcagcaaaagaggctctgcaacggctgcatctaggcgccaggaacgctgcctccagtctggtgaagcatggcgtcaatctcatcgccgtcttccatctccagctcatccggggtctgctcgccgcgaagcctgcggccatcaaacaggaatgcaatggcattcatatccacagactggcggtcacagtaggcgttcatcagcttcttcagctgggtggacctcttaatgcggaagaaaacctcattgccatcctgtcccttgaccttgagattgatgtgggcgccgcccgcctccgcgggcttcttgtcctcctcaccggctccagacatcgtcgacgaaggctccgaactcagcagcggcagaggtcagtttcccggcgatcgatcaatcggtggaggcggcggccggcgcgggtttggcgcccgccnccgccctcctcggcgccttcaacggcaaggcgccgctggcgtacgtgacgccgctgcaggcgtccggcggcgaggcgtacgtggtggagggctcgtacggcgcgcgggcgtgcgcggtgcgggacgcgcgcggggacgccgtggccgaggtgcgccggaaggagcgcgtcggggacgacgtgttccgcctcgtggccgggccacgcatcggcgcgccgctcgccatggcgctcgtcatcgccctcgacgagatgttcgccgccgccggctcggtgtcggcgcggcggccgtccctgctgcgccggacgtggtcggcgtagttttagtaactaataagctgccgccggcgacgccatgccatgctggtcg

SEQ ID NO: 15431 - DNA, 862 bp, Sorghum bicolor
  Clone ID: SORBI-28MAY03-CLUS49_329
ccgttcgtcaaggtgctcgaccaaaagttcggcatcatcaagggcaccatgaccaccacccactcgtacaccggcgaccagaggctgctggacgcgagccaccgcgacctgcgccgcgcgcgcgccgccgcgctcaacatcgtgcccacgtccacgggcgccgccaaggccgtctcgctggtgctcccaaacctcaagggcaagctcaacgggatcgcgctccgggtgcccaccccgaacgtctccgtcgtcgacctcgtggtgcaggtgtccaagaagaccctcgccgaggaggtgaaccaggcgtccggcgacgccgccgccaacgagctcagcggcatcctcgaggtctgcgacgtgccgctcgtgtccgtcgacttcaggtgctccgacgtctcctccaccatcgacgcctccctcaccatggtcatgggagacgacatggtcaaggtcatctcctggtacgacaacgagtgggggtactcgcagagggttgtcgacctcgctgacatttgcgccatcaagtggaagtgaggcgttgcattgtaatattttgtaactcaccctcgagagggctctgggattcgccccgaaatgaccgaatttcggtgaaattcacccatttcggtgaggtccgaaacaacattataccggccaaaaatctcgattaagttcgaatttttagtcaactttagagttgaaacaaacctacaagttcttcattcaatataggaatgtatacctatcaagccataattcatttgtttcctcttggtgcctcttgatcaaattatgaccaaaattcagccaaattttagttaaatctggacattttgacgggtaaaaactagtgaatcccagt

SEQ ID NO: 15432 - DNA, 1270 bp, Sorghum bicolor
  Clone ID: SORBI-28MAY03-CLUS49_330
gccggccgggccggggcacccccaattcgaacgccggagctcgacgaggacgacagcacgcagagatccggcctactgcaagttttgaaaaccgaactgtaagatggcatcagcagagctttcccgtgaggaaaatgtgtacatggccaagctcgcggagcaggcagagaggtacgaggagatggttgagttcatggagaaggtagccaagactgttgactctgaggagctcactgtggaggagcgcaacctcctgtctgttgcatacaagaatgtcattggagcccgccgcgcctcatggcgcatcatctcctccattgagcagaaggaggagggccgtggcaatgaggaccgtgtaacactcatcaaggactaccgtggcaagattgagactgagctcaccaagatctgcgatggcatcctcaagctgctcgagtcccaccttgtgccctcttcaactgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcacttaacttctcagtgttctactatgagattctcaactcacctgatcgcgcctgcagtcttgcaaagcaggcttttgacgaggccatctcggaactggacaccctgagcgaggagtcctacaaggacagcactttgatcatgcagctcctccgtgataacttgaccctatggacttctgacatctcggaggaccctgctgaagagatcagggaggcacccaagcgtgactcgagcgaggggcagtaaagccggctttacgtgcctagaaactagtagctagtgtttgctgctgtctaatgacactatgcaatgtgatctggaccctagtttcttgggtgcgacccttgtagccgtgttatgattattgtcgggaaaatttgggggctccccatatgagatgctgccgggcaaggcctcggtgtcccaccttgtttcaggcgggggcactggagccaggcctggttgggttgggaagccctttaaactgttgtcacttgcattttaccttttcatcgctgtttattgtgagtggtcctaaatcaatggctggtctctgtggtcttgcttttttgttctcttgattccttacagggtcagtgggacattcacatttgtctgttccatctc

SEQ ID NO: 15433 - DNA, 1634 bp, Sorghum bicolor
  Clone ID: SORBI-28MAY03-CLUS49_331
gcgaacgccatgccccgatgagtaggagggcgcggcggccgctgcaaaacccggggcgcgagcctgggcggagcggccgtcggtgcagatcttggtggtagtagcaaatattcaaatgagaactttgaaggccgaagaggagaaaggttccatgtgaacggcacttgcacatgggtaagccgatcctaagggacggggtaaccccggcagacagcgcgatctcgcgtgttgcccgaaagggaatcgggttaagatttcccgagccgggacgtggcggttgacggcgacgttaggaagtccggagacgccggcgggggcctcgggaagagttatcttttctgcttaacggcctgccaaccctggaatcggttcagccttgttttttaaaaaaaaaaatcttgattgatctagttgtttggtggctacagccagacaatttggcaatatgtatgtccctatggtagtggactagtggtggtgccgtggtgggctgttgcagaaaggacagttttgaaaactttcacatgatttactcttgtaattaactgcatttttctttacacgctacagtctatatgctggaggcgtgtaccatacatgttccgtttccaattaaacaatcttattatatcttgcacaagccaatcccacgtcagcatgtgcattatttccttatgcaaactgcttatctattacaggccatgaggcaaaaagttccttacttccagaaacataatagcttgaagcatttgtattgttttttgactactgcataagcataaataacatcaaaaagttgaggcatttgcatttcatttgtccttaatggatgcaaccttctcctatcagcattgctctttcttttgatggaatctcccttgaaaaagaagagcagccaagtaaatcgtgggaacgttttgtcttgtgtctgatgacaactgcaggtcgtcaaggcaatcgagaatgccattcccgtgcggcaagcgctgcccgtcgccgctgccgagagcagcgacccggcatgggaggaggagctgaaggccatggaggcgcagaaggcggagatcgacctcgccgcggcagcacaggtgcgccgggagctctggtgtgggctggtgtacttggtggtgcagacggccgggttcatgcggctcaccttctgggagctgtcgtgggacgtgatggagcccatctgcttctacgtgacgtccatgtacttcatggccggctacgccttcttcctccgcaccaagaaggagccgtcgttcgagggcttcttcgagagccggttcgcggccaagcagaagcgcgtgatgcgcgccaggggcttcgacctccgcaggtacgaggagctccggagagccggtggcggcgtgcccacgccggtgccgccgccgctccagcaggcccggaccaccccctgcgcgagtgcgggggcgcaggagagcggccattgccactcttactgccattgccattgatctcgttggtttcattcgttctttttctttttcgttttcatgcccatttggtggggatgatgattcgtgtacccttctgatgcgcggatgcaaaaagcatactgaattgagctgatgacgagccggattttaaacttggaaatactgagctaa

SEQ ID NO: 15434 - DNA, 1042 bp, Sorghum bicolor
  Clone ID: SORBI-28MAY03-CLUS49_332
gcacgagggtgacaacatgattgagaggtccaccaaccttgactggtacaagggcccaaccctgcttgaggctctggacttaatcaatgagccaaagagaccttcagacaagcccctgcgtctcccccttcaggatgtgtacaagattggtggtattggaactgttcctgtgggacgtgttgagactggtatcatcaagcctggtatggttgtcaccttcggtcctagtggccttacaactgaggttaagtctgttgagatgcaccacgaggctctccaggaggcccttcctggtgacaatgttggcttcaacgttaagaatgttgctgtgaaggatctgaagcgtgggtatgtggcctccaactccaaggatgaccctgccaaggaggctgctagcttcacctcacaggtcatcatcatgaaccaccctgggcagattggcaacggctacgccccagtgctggactgtcacacctcacacatagctgtcaagtttgctgagcttgttaccaagattgataggcgatctggcaaggagcttgagaaggagcccaaattcctcaagaacggtgatgctggtatggtgaagatggttcccactaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgccgctaagaagaaatgaggtgtctgctagctggttctgtgttttctcgagggatacctagttgaaacttaatatatcgtcattgctgttatcgcgtgagcaactaaactgtgctggcaatgtttgtctggtcgattgagtattgttattttcgttaaaaccagggtactattaagactcaatttctgttatttttgtatcgaacatcgggtgttggccatatgtggttatgagttttgttactacccttgttgaagtgtttgcctgtttacataaaaaaaaaaaaaaaaaaggccccta

SEQ ID NO: 15435 - DNA, 1425 bp, Sorghum bicolor
  Clone ID: SORBI-28MAY03-CLUS49_333
gcacgagggtcactcacacagcaccggtaccggagagagaggagaggagaggagaggagaggatgtcgtggttcgggcaccaccaccacaaccagccggctcccccggcgtcggggccgaaccaggtgttcaagatcttctgccgcgccaacgagaactactgcctggccgtccgcgacggcgccgtggtgctggccccgaccaaccccaaggacgagcaccagcactggtacaaggacatgcgcttcagcacccgggtcaaggacgaggaagggatgccggcgttcgcgctcgtcaacaaggccacggggctcgccatcaagcactccctcggccagtcccacccggtgaagctcgcgcctttcaaccctgaccaggaggacgcgtcggtgctgtggacggagagcaaggacgtgggcaagggcttccgctgcatccgcatggtcaacaacacccgcctcaacttcgacgccttccacggcgacaaggaccacggtggcgtgcacgacggcaccggcgtcgtgctctgggagtggtgcaagggcgagaaccagagctggaagatcctgccgtggggacccgaggcgaacgccgcggcgggggccaacggcggcgtgcacaccgtgcgcgtcttctgcaaggccggcggcgaggactactgcctgacggtgcgcaacgggacggcgtgccttgcgcccaccaacccgcgggacgagtaccagcactggatcaaggacatgcggcacagcacccgggtgcgggacgaggaagggtacccggccttcgcgctggtgaacaaggtcaccggggaggcgctcaagcactccacggggcagggccaccccgtgaagctggtgccctacaacccggagtaccaggacgagtcggtgctctggaccgagagccgcgacgtcggcaacgggttccgctgcgtgcgcatggtcaacaacatctacctcaacttcgacgccttccatggcgacaaggcacacggcggcgtccacgacggcaccgagatcgtgctctggaagtggtgcgagggcgacaaccagcgctggaagatcctcccatggtagaccaaggatcttccaaaggagctactagctgctactcctacctaataataattctgctggctgcggcgatccccaaataaaagagaccgggtgcgatagcgatgcatcgcggacttccgagtggagtggtgttttcgtcagactgtcagtcactgtatctgtatggctagtgttccaacatttgtcagcccgttttcgagcaaggggagtgacagagtcaggagaagggccgggccataagctgctgcatgtcttatgtctgtactctgaatgaactctgtatgagatgagatctcatctcctttctcctaccgaatgaatgaaccatttggctttgctttgcttcaaa

SEQ ID NO: 15436 - DNA, 1977 bp, Sorghum bicolor
  Clone ID: SORBI-28MAY03-CLUS49_334
ggatactcctccaacgcctggtacgccggcgaagggtccttcgaggagcctgagggccgcgagaacctgcagaggctgtggcagaagtaccgcgtcgacatcgcctactttggccacgtccataactacgagaggacctgccctatgtaccagagccagtgcatgaccagcgagaagagccactactccgggacgatgaacgggaccatcttcgtggtggccggcggcggcggctgccacctgtcgagctacacgacggcgatccccaagtggagcatctaccgcgaccatgacttcggcttcacgaagctcacggcgttcaaccactcgtcgctgctgttcgagtacatgaagagcagcgacggcaaggtttacgactccttcaccatccacagggactaccgcgacgtgctccgatgcgtgcacgacagctgcttcccgacaacgctcgccacctgataaagccattgttatgacactactagttttggcttggtcgtccaaataaaatgtgtcaaccacttagtatataataatgtgctctgtgaaggcacactgtaactgtaattgatgcctagctaaactctctatctaaataaaaaattgataatataaataaaaaaaaaaaaaaaaaaaaagtagacacgggagcccacgaccacgcagctcgcagccgcgcgcgctcgcctatacgactacgagtacacagcttcgatcctcagcgcgcgcgagtacgtggctgctgcgaattcctatctttctctgtgttcgcgtgttcggtgttcgtgagtaggcgcggtcagcacatatggcgcagtccatgctcatgtcgaccagcgtcaacggcggccgcgcgctgccgtcgctgcaggctggcaggccggcgccatacccgcggctaccgctgccgtcgtcgtcgtcgggctacaggcactccaagtccgtctccgtgaagaccctcgccctgttcggcaaatccaaggtcaagaccgcgccgtcgaagaaggctgctgcgcccaagcccaagcccaaggttgaggatggtatcttcggcacgtccggcgggatcggtttcaccaaggagaacgagctgttcgtcggccgtgttgccatgcttggttttgccgcatcgctgcttggagaggccatcaccgggaagggcatccttgcccagctgaacctggagacgggcatccccatctacgaggcggagcccctcctcctgttcttcatcctcttcaccctccttggcgccattggcgctctcggtgaccgtggtcgcttcgtcgacgaggaggtcaccggcctcgacaaggccgtcatccaacccggcaagggcttccgcggcgccctcggcctcagcgagggagggccgctgtttgggttcaccaagtcgaacgagctgttcgtggggcggctggcgcagctgggcgtggccttctccatcatcggcgagatcatcacggggaagggcgcgctggcgcagctcaacatcgagacaggggtgcccatcaacgagatcgagccgctcgtcatcttcaacgtcctcttcttcttcgtcgccgccatcaaccctggcaacggcaggttcatcatcggcgaggacgaagagtaggctgatgctgctgtcctcgaacctgatgagtgatgagtagtactgtgcgcttgggttacctgtgctgtgttgatcgatcagtgcgtctcgcagtgcgtgtgcgtacgtgctttgttgtgtattagtaagcgtgatgagacctcgaaaggtagggtgtcgtgttgagttgtcttgtagaaacaagagcttactcgtattgtagcttcaaatgcatgaccgtacacctgtcaaacatggacgaatcccgtcaaaaaaaaaaaacatggacgaatcccgtaaaaaaaacatggccggtataatcactgaccttcgtgcttcggtactgaactgcatttctcggaggcgccgggcgctctcttcgt

SEQ ID NO: 15437 - DNA, 1070 bp, Sorghum bicolor
  Clone ID: SORBI-28MAY03-CLUS49_335
gcacgagggagagactcatcaccagagaggagatcgaggaggtgacgtgaggtgaggtttgcagcttgcaagtcggtcggcgtcatggcatacaacggccgtgaccagcggtacggcggcggcatcgctacgccggggtacgcaccgccggtgccgtacgggatgtcgcaggtgaacatcgagggcaacgggtgcggtcggccgctgccgccgcagccgaccgtgaaggtgtactgccgcgccaaccccaactacgccatgaccatccgcgacggcagggtggtgctggcgccggcgaaccccaaggacgagtaccagcactggatcaaggacatgaggtggagcacgagcatcaaggacgaggaaggttacccggcgttcgcgctggtgaacaaggcgaccggggaggccatcaagcactcgctggggcagtcccacccggtgcgcctggtgccctacaacccggacttcctggacgagtccgtgctctggaccgagagccgcgacgtcggcaacggattccgatgcatccgcatggtcaacaacatctacctcaacttcgatgccctccacggcgacaagtggcacggcggtgtccgcgacggcaccgacatcgtgctctggaagtggtgcgagggcgacaaccagcgctggaagatccagccctactactgaaccaactgatcgatgatgagatctatcgatgatcatccatcgtcgcgtcgatcgatcctgtcgtcatgcatggagacgacgtgcatgtacgtatggcctatgtatatgtatctatatatgtacgcatgtatacgcactagcagaataactgagcctcgatcatctcctatgccgtctgctcgtctttctgcacgcatgtctgtcagcatgtgtgcatattagataaagcagcaggagcgagatgaggggtactcatggtcatgtatatgtaccttgcaacaataagtagcgatacaacacatacttattatggaagtactcctacatacataataaagttgctcgggtgtattaacatatacgtatatgcctattataattatgattcctcgtgc

SEQ ID NO: 15438 - DNA, 2105 bp, Sorghum bicolor
  Clone ID: SORBI-28MAY03-CLUS49_336
tactggatcgcatctcatcgcatcgcatcgcagcaactccccccttcgcaccgttaccccctttgcgctccctcccagcaaatcaccaccgcgccccgcgtctcgcccacgctccctctctcaccaggagggaggagaggagaggagaggagaccggggccgagacgcgaacgcgcggacccctcgagggcgaggacgcgcacgcagccaccggccaggcgactacggctcccggcggccaggttcgggctctgctcccggggaccggggagccgatcgtgcgcgccattgggcccgcgcggggaagcggcaggcgcgtgctgtcttgacccgctccgcacccctcccggcggcggcggcggcgggcgtggtgctcctttgcctttgcggcaggtgcctgcttgtctgtgattctcctcctgcgtcctcggcgccatggaggccggctactgcaaccgcaagaagaccgacggcatctgcgagggcgtctgcgacagcgagcttggttcaaagtcagtcctgagcatgtcaaggttgaagtgtgcactgcgaggatttgatctgagggttctcttgattctgctgattggtgtgccaattctgatctttgccatatatgtgcatggccagaaggtgacttacttcctccgaccaatctgggaaaagcccccgaagcccttcacaatacgccctcactactatcatgaaaatgtctcgatggccaacctctgcaagttgcatggatggaaagtcagggagactccacgccgtgtcttcgatgctgtgctcttcagcaatgagcttgacatccttgatatccgttggcacgagcttagcccatatgtgtcagaatttgtgctgcttgaatccaattcaaccttcactggcataaagaaggaccttcacttcaaggaaaaccgccaacggtttgactttgctgaatcacggttgacctatggtatgataggcggaaggtttgtgaagggagaaaacccatttgttgaggaatcatatcaaagggttgctctcgaccagctcattaagattgcaggcatccaagatgacgacctgttgatcatgtccgatgttgatgagatcccaagtggtcataccatcaacctcttgagatggtgtgatgacattcctgagatacttcacctccagctgaggaactatctctactcattccagtttttactcgatgacaagagctggagggcttcagtacacagatacagagctggaaagacgaggtatgcacatttccggcaaacagatgaacttctggctgattcagggtggcactgcagcttctgcttccgctacataaatgacttcatcttcaagatgaaagcctacagccacgtcgatcggatcagattcaagtacttcctaaacccgaagaggattcagcacgtgatttgcgaaggggctgatcttttcgacatgctccctgaagaatacacattccaagagatcattgccaagctggggcctattccaagtacattctctgctgttcatctccctgcctatctgctggagcagaatgatcggtacagatatctccttccaggcaactgcattagagagagtggctaggcagctgctactgtctgcatcatgaccctgaggcgcacagacgtcgctcgcggatgtcccccgcactggaggagcgccctgccgtggtggggttgtatttctcatccgattggctgacttagttgagtgatcgcttggctgatggtggagttcatatgagattttgtaccgtgtaatggaaaccatggaaggcctgacagcagcataggggcatgctttgatcgcagctgcgttcttgttttgcagaggagctcagcagtgtgtgtgtgcttttataccacctgagtttttattcattgcttccatgattgatatatgaactcaaactatttgtagatctcataccgagcgacattcagattctttcctctttttttttctttgctctcgcccttgtgatgtacattgccattcacttaccctagttacctcttacctgagtcatgtcatgtgtatgctttcattccaatttctgattattgattgacagcggctctatatca

SEQ ID NO: 15439 - DNA, 1348 bp, Sorghum bicolor
  Clone ID: SORBI-28MAY03-CLUS49_337
ccgggctcaccatccttaccctcgcgccgccgccaccgcaacccttgcagccccaatcccccacggcgaccatggccggtgcgcaggagtccctgtccctggtgggcacgatgcgcgcccacaacggcgaggtgacggcgatcgccacccctatcgacaactcgccgttcatcgtctccgcctcccgcgacaagtccgtgctgctgtgggacctggaaaacccggtccactccaccccggaatccggcgtcaccgccgactacggcgtccccaaacgccgcctcaccggccactcccacttcgtccaggacgtcgtcctcagctccgacggcatgttcgccctctctggctcctgggacggcgagctccgcctctgggacctctccaccggcgccaccacccgccgcttcgtcggccacggtaaggacatcctgtccgtcgccttctccgtcgacaaccgccagatcatctccgcgtcccgcgacaagaccatcaagctctggaacaccctcggtgagtgcaagtacaccatcggcggcgacctcggtggtggcgagggccacaacgggtgggtctcctgcgtcaggttctccgccaacaccttccagcctaccatcgtttccggatcctgggatcgcaccgtcaaggtctggaaccttaccaactgcaagctgcgctgcactctcgacggccacggcggctatgttaacgccgtcgccgtgagccccgacgggtcgctgtgcgcatctggcgggaaggacggtgttactctgctgtgggatttggctgaggggaagaggctgtactcgctggacgcgggctctatcatccactccctctgcttctcgcccaaccgctactggctctgcgctgcaacacaggactctgtcaagatctgggaccttgagtcgaagcacgtcgtgcaggacctcaagcccgacatccagatctccaagaaccagatcctgtactgctcaagcatgaactggagcgcggatggaagcaccctctacactggctacaccgatgggtctatcagggtttggaagatctctgcttatggctacgcaggctagatgttgaaaagccacttcaatgttgaaggtctaggcagtcttatttggcaaaaattgtaatgttgtcaagtttttgaagtcgtgagctatatcgtctgtttggtactttccagtcgcccaactatttaagcttagctttgttaatgagctaatcgtactatggaagaatctattttgcaccatggttctgttttgcttctgctttatgttacattatatatgcttcagtcatgcaaccaactgatttaaaagcctgttactgggttgagtgc

SEQ ID NO: 15440 - DNA, 3014 bp, Sorghum bicolor
  Clone ID: SORBI-28MAY03-CLUS49_338
ctactggatctctgctcacctcccccagtcacccatctctaccgcaccgcagccgccgcccgcccgcccccgcgcctgcgacgcgatccggcgccggcagcgagctctatctccggcgacgcccacggaataaatattggtattcgtagcgtgacctttataagaagtcaagatggtgaagttcacagctgaagagctccgtggtatcatggacaaaaagaacaacattcgtaacatgtctgttattgctcatgtggaccatggcaagtctacgcttacagattcccttgtggcagctgctgggattattgcccaggaagttgctggtgatgttcgcatgactgatactcgtgcagatgaagcagagcgtggtattacaatcaaatctaccggtatctctctttactatgagatgactgacgagtcactgaagaattacaagggtgagagagatggtaaccaatacctgatcaaccttattgactcgcctgggcacgttgatttttcttcggaagtcacagctgctcttcgcatcaccgatggtggctcttgtggtggttgactgtattgaaggtgtctgtgtgcaaactgaaactgtgcttcgccaagcccttggtgagaggattaggccagttcttaccgtgaacaagatggacaggtgcttccttgagcttcaggttgagggcgaggaagcttaccagaccttctcccgtgtcattgagaatgccaatgtcatcatggcaacatacgaagataagctccttggtgacgtccaagtgtacccagagaaggggactgttgctttttctgctggtctgcacggatgggcctttaccctcactaactttgccaagatgtatgcatctaagtttggagttgatgaatctaagatgatggagaggctttggggtgagaacttctttgaccctgccaccaagaaatggacaaccaagaacacaggctcccctacctgcaagagaggatttgttcagttctgctatgagccaatcaagcaaatcatcaacacctgcatgaacgaccagaaggagaaattgtggcccatgctgcaaaagctcaatgttaccatgaagtctgatgagaaggaattgattggcaaagctttgatgaagcgtgttatgcaaacgtggctaccagcaagcactgcactgctcgagatgatgatattccaccttccttccccggcaaaggctcaaaagtatcgtgtggagaacttgtatgaggggccccttgatgatgtctatgcaactgccatcagaaactgtgatccggagggccctcttatgctgtatgtttcgaagatgattccagcatccgacaagggcaggttctttgccttcggtcgtgtcttctcagggaaggttgctactggtatgaaggttcggatcatgggtcccaactatgtccctgggcagaagaaggatctgtatgtgaagagtgtccagcgtaccgttatctggatgggaaagaaacaagagtcagttgaggatgttccttgtggcaacactgttgctatggttggtctggaccagttcatcacgaagaacgctacactcactaatgagaaggaggttgatgcatgcccgatcagagcaatgaagttctctgtctcccctgttgtgcgtgttgctgttcagtgcaaggttgcctctgaccttcccaagctagtcgaaggtttgaagcgtctggcgaagtctgatcctatggttctctgtacaatcgaagagtctggtgagcatatcattgctggagctggtgagcttcatcttgagatttgcctgaaggatctgcaggaggacttcatgggtggtgctgaaattattgtttcccctcctgttgtgtccttccgggaaaccgttcttgagaagtcctgccgtactgtcatgagcaagtctcccaacaagcacaaccgtctgtacatggaagcacgccccttggaggagggtctcgctgaggccatcgatgatggccgcattggcccacgtgatgatcctaaggtgcgctcccagatcctctctcaggagtttgggtgggacaaggatctcgccaagaagatttggtgttttggacctgagaccactggcccaaacatggttgttgatatgtgtaagggagtgcagtatctcaatgaaatcaaggattctgtcgtggctggtttccagtgggcatcaaaggagggtgcactggctgaggagaacatgcgcggaatttgctttgaggtctgtgatgtcgttcttcatgctgatgctatccacaggggtggtggccaggtcatcccaactgccaggagggtcatctatgcttctcagctcacggccaagccaaggctgctggagccagtgtacctggtggagattcaggccccagaaaatgcacttggtggtatctacggtgttctgaaccagaagagagggcatgtgtttgaggagatgcagaggccgggtaccccgctctacaacatcaaggcttacctccctgtcatcgagtcgtttgggttctccagccaactgagggctgcaacctctggtcaggcgttcccccagtgtgtctttgaccattgggacatgatgggctctgatcctttggaggctggctcccaggctgctcagctggtgctggatatccgcaagaggaagggtctcaaggaacagatgacccctctctctgagtttgaggacaagctctaaatttttggttgtttgttctactgttacacctgctggtttaatcgtcaattcgtgtactgtaatgggaacgacttgaatattttgcttcgttttagttgtcgaatgcacctgtctctgaactatattggtcatcatgtagtttgtcaatctgtgctgagagcctgagacactattttgatatccgttttgatgtagcagatgaaacagaggtggtatctttggtttagtaattggttatatacttattttccgggtgtatttcttatatccactgtcttattaacgctgtgcatgatctgtcagccattt

SEQ ID NO: 15441 - DNA, 2070 bp, Sorghum bicolor
  Clone ID: SORBI-28MAY03-CLUS49_339
ctgttggcccactggagctatcgttgcaaaggcaaagcaagcgatccaaattctctccgtttttcttcagatctcgagttccgcgactagctttggatcccttctttcattcgagagagcgattctctggtggcaatggcgaagagcgagggtccggcgatcgggatcgatctcggcaccacctactcgtgcgtcggcgtgtggcagcacgaccgggtggagatcatcgccaacgaccagggcaaccgcaccacgccgtcctatgtcgccttcaccgacaccgagcggctcatcggcgacgccgccaagaaccaggtcgccatgaatcccaccaacaccgtcttcgatgccaagcggttgatcggcaggaggttctctgacccttcagttcagagtgacatgaagctgtggccattcaaggtcatcccaggccctggtgacaagcccatgattgtagtcaactacaagggtgaggagaagcagttcgctgctgaagagatctcctccatggtgctcatcaagatgagggagattgctgaagcctacctcggctctacgatcaagaacgcagtggtgaccgtgccggcctacttcaacgactcgcagaggcaggccaccaaggacgccggtgtcattgcgggcctcaatgtgatgcgtatcatcaacgagcccactgccgctgctattgcctacggtcttgacaagaaggccaccagtgctggcgagaagaacgtgctcatcttcgaccttggcggtggcacgtttgatgtgtcgctgctcaccatcgaggagggcatcttcgaggtgaaggccactgcgggtgacactcaccttggaggcgaggacttcgacaatcgcatggtgaaccacttcgtccaagagttcaagcgcaagcacaagaaggacctcagcggcaacccccgtgcactgcgccggctgcgcacggcgtgcgagcgcgccaagcgcacgctgtcatcgaccgcccagacgaccatcgagatcgactccctgttcgagggcatcgacttctactccacgatcaccagggctcgcttcgaggagctcaacatggacctgttccgcaagtgcatggaacctgtggagaagtgtctgcgcgacgccaagatggacaagagcagcgtgcacgacgtcgtgctcgtcggtggctccacccgcatccccaaggtgcagcagctgctgcaggacttcttcaacggcaaagagctgtgcaagagcatcaaccccgacgaggccgtggcctacggcgcggctgtccaggccgccatcctcagcggcgagggcaacgagaaggtgcaagacctgctcctgctcgacgtcacgccactgtcactcggtctggagactgcaggtggtgtcatgacggtgctcatcccgaggaacaccaccatcccgaccaagaaggagcaggtcttctccacgtactccgacaaccagccgggcgtcctgatccaggtgtacgagggtgagcgcgcgaggaccaaggacaacaacctcctcggcaagttcgagctctcgggcatccctcctgctccccgcggcgtgcctcagatcacggtcaccttcgacatcgacgccaacggcatcctcaacgtctctgccgaggacaagaccaccggccagaagaacaagatcacgatcaccaacgacaagggcaggcttagcaaggaggagattgagaagatggtgcaggaggctgagaagtacaaggctgaggacgaggaggtcaagaagaaggtggacgccaagaacacgctcgagaactacgcctacaacatgaggaacaccatcagggatctgcaaccccatcatcgcgaagatgtaccagggcgctggcgcgggcatgggcgatgctgctggcatggatgaggacgccccgtctggtgggagcggtgctggtcctaagatcgaggaggtcgattaagttgttttagtgtccgaggtttggtttggtgaagtacatctgaactctgaaggttcttcgtgacatggttagacgtggtgttgcagtactgtgataaaacttatcagaataagttttcgcttctaatt

SEQ ID NO: 15442 - DNA, 1415 bp, Sorghum bicolor
  Clone ID: SORBI-28MAY03-CLUS49_340
gcacgaggccggccttgccgggccgatccgggcggaagacattgtcaggtggggagtttggctggggcggcacatctgttaaaagataacgcacgtgtcctaagatgagctcaacgagaacagaaatctcgtgtggaacaaaagggtaaaagctcgtttgattctgatttccagtacgaatacgaaccgtgagcatgctctccttgctttcacacttggagtgaagcagatgatttgctgctgcaacaagatggatgccacgacacccaagtactcgaaggcccgttatgatgagattgttaaggaagtctcttcttacctgaagaaggttggatacaacccagacaagatccactttgttcccatctctggttttgaaggtgacaacatgattgagaggtccaccaaccttgactggtacaagggcccaaccctgcttgaggctctggacttaatcaatgagccaaagagaccttcagacaagcccctgcgtctcccccttcaggatgtgtacaagattggtggtattgggactgttcctgtgggacgtgttgagactggtatcatcaagccgggtatggttgtcaccttcggtcctagtggccttacaactgaggttaagtctgttgagatgcaccacgaggctctccaggaggcccttcctggtgacaatgttggcttcaacgttaagaatgttgctgtgaaggatctgaagcgtgggtatgtggcctccaactccaaggatgaccctgccaaggaggctgctagcttcacctcacaggtcatcatcatgaaccaccctgggcagattggcaacggctacgccccagtgctggactgccacacctcacacattgctgtcaagtttgctgagcttgttaccaagattgataggcgatctggcaaggagcttgagaaggagcccaaattcctcaagaacggtgatgctggtatggtgaagatggttcccactaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgccgccaagaagaaatgaggtgtctgtctggctggttctgtgttttctcgatggatacctagttgaaacttaaaatttatggtcattgctgttatcgacgtgagcaactaaaactgtgctggcaatgtttgtctggtcgatttagtattgttattttcgttaaaaccagggtactattaagactcaatttctgttaatttttgtatcgaacatcgggtgttggccatatgtggttatgagttttgttactacccttgttgcagtgtttgcctgtttacttgttttgctcgtccttgcctgt

SEQ ID NO: 15443 - DNA, 1489 bp, Sorghum bicolor
  Clone ID: SORBI-28MAY03-CLUS49_341
aaaaaaaaaaaaccttcaaaccctcagacgcagtcggccgccgcagaccgggagaagtcgacacgccgccaccgtatcctcagatcagcggcgggccgtaaccacgccactttgctgccgcccgacgagcagcgtaacagttgccttaagccatgggtaaggagaagactcacatcaacattgtggtcattggccatgtcgactctggcaagtcgaccaccactggccacctgatctacaagcttggtggtattgacaagcgtgtgatcgagaggttcgagaaagaggctgcggagatgaacaagaggtcgttcaagtatgcgtgggtgcttgacaagctcaaggctgagcgtgagagaggtatcacaattgatatcgccctgtggaagtttgagaccaccaagtactactgcactgtcattgatgcccctggacaccgtgacttcatcaagaatatgattacgggtacttcccaggctgactgtgctgttcttatcattgactccaccactggtggttttgaggctggtatctccaaggatggccagacccgtgagcatgctctccttgctttcacacttggagtgaagcagatgatttgctgctgcaacaagatggatgccacgacacccaagtactcgaaggcccgttatgatgagattgttaaggaagtctcttcttacctgaagaaggttggatacaacccagacaagatccactttgttcccatctctggttttgaaggtgacaacatgattgagaggtccaccaaccttgactggtacaagggcccaaccctgcttgaggctctggacttaatcaatgagccaaagagaccttcagacaagcccctgcgtctcccccttcaggatgtgtacaagattggtggtattgggactgttcctgtgggacgtgttgagactggtatcatcaagcctggtatggttgtcaccttcggtcctagtggccttacaactgaggttaagtctgttgagatgcaccacgaggctctccaggaggcccttcctggtgacaatgttggcttcaatgttaagaatgttgctgtgaaggatctgaagcgtgggtatgtggcctccaactccaaggatgaccctgccaaggaggctgctagcttcacctcccaggtcatcatcatgaaccatcctgggcagatcggcaacggctacgccccagtgctggactgccacacctcacacattgctgtcaagtttgctgagctggttaccaaggctgccgccaagaagaaatgatgcgcctctgtttgctcgtgggatacctagttgaaacttcaaaaatatatcgtcattgctgttgctgttatcgcttgagcaactaaactgtgctggcaatgtttgtctggtccatctagtactgttatttttgctaaaaccagggtgctgttgagactcaattctgttatttttgtatcgaacaacggggtgttagccatatatggttgagtttttgt

SEQ ID NO: 15444 - DNA, 1482 bp, Sorghum bicolor
  Clone ID: SORBI-28MAY03-CLUS49_342
cggacgcgtgggcaaatcctccacactgttcgatccacccaaccctccccaaaacccccgaccaaggagagtagagcgcgagaagatgttcggcttcgggcaccacggccaccaccacggcgagaacccgccggcgcaccctcctgcccacggcggcgtgcacccgcccaccttcaagatcttctgcaaggccgacgaggggtactgcctcaccgtccgcgacggcaacgtggtgctggccccctccaacccgcgcgacgagcaccagcactggtacaaggacatgcgcttcagcaaccagatcaaggacgaggaaggcaaccctgcgttcgccctcgtcaacaaggccactggcctcgccatcaagcactccctcggccagtcccacccggtgaagctggtgccgttcaacccggagtaccaggacgagtcggtgctgtggacggagagcggcgacgttggcaagggcttccgctgcatccgcatggtgaacaacatccggctcaacttcgacgccttccacggcgacaaggaccacggcggcgtgcacgacggcaccaccgtggtgctgtgggagtgggccaagggcgacaaccagagctggaagatcctcccctggggcgacgaggcctacgccggcggcagcggcggcgccgccgccaacgcgccgtacggccacggcgagccgacggtccgcatctactgcaaggcggacgacgggttcagcgtgaccgtccgcaacggcagcgtgtgcctggcgccgacgaacccgcgcgacgagtaccagcactgggtcaaggacatgcggcacagcaaccgcatcaaggacgaggaagggtacccggcgttcgcgctcgtgaacagggtcaccggcgaggccatcaagcactcgcagggcgagggccacccggtgaagctggtgccgtacaacccaaactaccaggacgagtcggtgctgtggaccgagagccgcgacgtcggccacgggttccgctgcatccgcatggtgaacaacatctacctcaacttcgacgccttccacggcgacaaggaccacggcggggtgcgcgacggcaccgccgtcgtgctctggaagtggtgcgagggcgacaaccagcgctggaagatcgtcccctggtaaatgtgcggtgctggggctgcattggtcatcacccaagatctggagatggagttggagagcacagccacctgtggtcagcagctgctgctgctgccgtgttgttagaataaagctggtgtgcgatcgatccgtggtgatggtgtgtctttgtgtgtgttcagtcgtgtgtcctcggagccagtcctgcttccgtgagagaggggtacttcctcggtgagcttatctcacaaagccttaccccatctgaagcttgttatgcagagagagttttcagaccttgagtgttaactctgtgttgtactcggttccttccctttttatctaagtgggttttatcaaaa

SEQ ID NO: 15445 - DNA, 921 bp, Sorghum bicolor
  Clone ID: SORBI-28MAY03-CLUS49_343
gcacgaggctcagaggtgggttggcttctcctccccctccggttcggttcggttcgggttcgtcaggttcttcgggggttccggttcgtgggtgagcggaagagatggcggcgtcggacgttgagtaccgctgcttcgtcggcggcctcgcctgggccaccgacgacaacgccctccactccgccttcagcacctacggcgaggtcctcgagtccaagatcatcctggatcgggagacgcagaggtctcgtggcttcggcttcgtcaccttctcgacggaggaggcgatgcggagcgccatcgagggtatgaacggcaaggagctcgacggccgcaacatcaccgtcaacgaggcccagtcccgcggcggccgtggaggcggcggcggcggcgggtacggcgggggccgtggagggcggtggcgggtacggccgccgtgatggaggtggtggtggctacggcggtggcggcggcggctacggcggtggccgtggaggctacggcggtggcggtggcggctatggcggtggcggcggcggctacggtggtggcagccgcggcggcggtggctacggcaactccgatgggaactggaggaactgagcggtggggcccgcgcggccaagttatcttgttcgctactgctaccatgttgtgttgttaccctagtccatagggtttatctatcatcttgttgttcgtcgtcgtcgtgtccgtgtgtttgttgttgttgcccatctgtgtttttgatcgcaagttgtgttagtgctgtgttcgtcctcgtcttgagccccgtgcatcaatcaagcatgaactgggctccagggatcgatggatgttgttgtcaagttatcagtcaatcaatgaaaagaaaaaaggtgcttcttggtgctagaaaaaaaaaaaaaaaaaaggccccta

SEQ ID NO: 15446 - DNA, 2189 bp, Sorghum bicolor
  Clone ID: SORBI-28MAY03-CLUS49_344
aaaaaaaagggtttccagtttccacgaaccaatctctctgcaaccgcaactgcaaccagggtttcgaaggaaggactagttgttttccgttcgtagaagaggaagaggagatggcgaagggagaggggccggcgatcgggatcgacctgggcacgacgtactcgtgcgtcggcgtgtggcagcacgaccgcgtcgagatcatcgccaacgaccaggggaaccgcaccacgccgtcgtacgtcgccttcaccgacaccgagcggctcatcggcgatgccgccaagaaccaggtcgccatgaaccccaccaacaccgtcttcgacgcgaagcggttgattggtaggaggttctccgacccgtctgtgcaaagtgacatgaagctatggccattcaaggtcgtggctggcccagctgacaagccgatgatagtggtcaactacaagggcgaggagaagcagttctccgccgaggagatctcctccatggtgctgaccaagatgaaggagatcgccgaggcctacctcggctccaccatcaagaacgccgtggtcacggtgcctgcctatttcaacgactcccagaggcaggccaccaaggacgccggcgtcatctccgggctcaacgtgatgcgtatcatcaacgagcccaccgcagctgccattgcctacgggctcgacaagaaggccaccagcagtggcgagaagaacgtgctcatcttcgacctcggtggcggcaccttcgatgtgtcgctcctgaccatcgaggagggcatcttcgaggtgaaggcgaccgccggtgacacccatctgggcggggaggacttcgacaaccgcatggtcaaccacttcgtgcaggagttcaagcgcaagcacaagaaggacatcagcggcaacccgcgtgcgctgcggcgcctgcggacggcctgcgagcgtgccaagcgcacgctgtcgtccacggcgcagaccaccatcgagatcgactcgctgtacgagggcatcgacttctacaccaccatcacccgcgcccggttcgaggagctcaacatggacctcttccgcaagtgcatggagcccgtggagaagtgcctccgcgacgccaagatggacaagagcagcgtgcacgacgtcgtgctcgtgggcggctccacccgcatccccaaggtgcagcagctgctccaggacttcttcaacggcaaggagctctgcaagagcatcaaccccgacgaggccgtggcgtacggcgcggctgtacaggccgccatcctgagcggcgagggcaacgagaaggtgcaggacctgctcctgctcgacgtcaccccgctgtccctgggcctggagacggccggcggcgtgatgaccgtgctgatccctcgcaacaccaccataccgacgaagaaggagcaggtgttctccacctactccgacaaccagcccggggtgctgatccaggtgtacgagggagagcgcgccaggaccaaggacaagaccaccggccagaagaacaagatcacgatcaccaacgacaagggcaggcttagcaaggaggagattgagaagatggtgcaggaggctgagaagtacaaggctgaggacgaggaggtcaagaagaaggtggacgccaagaacacgctcgagaactacgcctacaacatgaggaacaccatcaaggatgacaagatcgcctccaagctcccggcagaggacaagaagaagattgaggacgccgtcgatagtgccatcagctggctggacagcaaccagctggctgaggtggacgagtttgaagacaagatgaaggagcttgaggggatctgcaaccccatcatcgcgaagatgtaccagggcgctggcgcgggcatgggcgatgctgctggcatggatgaggacgccccgtctggtgggagcggtgctggtcctaagatcgaggaggtcgattaagttgttttagtgtccgaggtttggtttggtgaagtacatctgaactctgaaggttcttcgtgacatggttagacgtggtgttgcagtactgtgataaaacttatcagaataagttttcgcttctaatttgttttcttaaatcatgtgttgatcagcctatgagttgttcatatcgttgcctttcgtgttgaacatttgttttcttgccatactaatgagattcatctgcacaaactgtacgaagagaatcaa

SEQ ID NO: 15447 - DNA, 1195 bp, Sorghum bicolor
  Clone ID: SORBI-28MAY03-CLUS49_345
ccgggaaacacccatcaggcatcccctcctgcaaatctttctctgaattgtgggtctccggcaatggcgctcgctccatcgaagattctgggcacccagctcaacttcgccggctcctcccgctacgccaccgcagcgcccaccgcgggggctcagaagattgtctccctcttcagcaagaagcctgcccagaagccaaagcccgttcctgtatcgtcctcttctccagacatcagcgacgagctcgccaagtggtatggtcctgacaggaggatctacctgccagatggtctcttggaccgctccgaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgcggccctgaggccgtctggttcaagaccggcgccctgctcctggacggcaacaccctgaactacttcggcaacagcatccccatcaacctggtggtggccgtgatcgcggaggtcgtccttgtcggcggcgccgagtactaccggatcatcaacggactggaccttgaggacaagctgcaccctggtgggcccttcgacccgctgggcttggccagtgaccccgaccaggccgccatcctcaaggtgaaggagatcaagaacggccgggctcgccatgttctccatgctcgccttcttcatccaggcctacgtcaccggcgaaggccccgtcgagaacctcgccaagcacctcagcgaccccttcggcaacaacctgctcaccgtcatctccggcgccgccgagaggacgcccagcctgtgaggacgcacggacgccacgctggagagcgatgccatgtcatgcgctgctgagctgtatgtgagggtttgaagaatgtgccatgccccatgcgtgtaaattaccaagagggggaagaatccttttcattctgatctctgatatgattgatctgcttcaatttgtgcctgagatgtgctacttacttaagtttttggaagttaattagttcgtgcgcgtctgagacatgatacttagttaattttgtgcctgaaatatgctactaagtcccctcatttaaggttc

SEQ ID NO: 15448 - DNA, 2929 bp, Sorghum bicolor
  Clone ID: SORBI-28MAY03-CLUS49_346
cctactggatagatagatatcctcacaggcggtcgctagggttttagtgcttctctcccggcggcgcctccacatctcgtctctcagatcgggaggcgaaaccaaggaatacatatacatatttgtagttggatcttcaaaaaaagtcaagatggtgaagttcacggctgaagagctccgtggcatcatggacaaaaagaacaacattcgcaatatgtctgttattgctcatgtggaccatggaaagtccacgcttacagattcccttgtggcagctgctggtattatagcccaggaagttgctggtgatgttcgcatgactgatactcgtgcagatgaagtagagcgtggtattacaatcaaatccactggtatctctctttactatgagatgactgatgagtcactgaagaactacaagggtgagagggatggtaaccaatatttgatcaaccttattgactcgcctgggcacgtcgatttttcttcggaagttacagctgctcttcgcatcaccgatggtgctctggtggtggttgactgtattgaaggtgtctgtgtgcaaactgaaactgtactccgccaagcccttggtgagaggattaggccagtccttactgtgaacaagatggacaggtgcttccttgagcttcaggttgagggtgaggaagcttatcagacattctcccgtgtcattgagaatgccaacgtcatcatggcaacatatgaagataagctcctaggtgatgtccaagtctacccagagaaggggactgttgctttttctgctggcctgcacggatgggcctttaccctcactaactttgccaagatgtatgcatctaagtttggagttgatgaatctaagatgatggagaggctttggggtgagaacttctttgaccctgccacaaagaagtggactaccaagaacacaggttctcctacctgcaagagaggattcgttcagttctgctatgagccaatcaagcaaatcatcaacacctgcatgaacgatcagaaggagaaattgtggcccatgctgcaaaagctcaatgttaccatgaaggctgatgagaaggaattgattggcaaagctttgatgaagcgtgttatgcaaacgtggcttccagctagcaccgcactgcttgagatgatgatattccaccttccttcccctgcaaaggctcaaaagtatcgtgtggagaacttgtatgagggaccccttgatgatgtctatgcaactgctatcagaaactgtgatccggagggacctcttatgctgtatgtttcaaagatgattccagcatctgacaagggcaggttctttgcctttggtcgtgtcttctcagggaaggttgctactggtatgaaggttcggatcatgggtcccaactatgtccctggccagaagaaggatctgtatgtcaagagcgtccagcgtactgttatctggatgggaaagaaacaagagtctgtcgaggatgttccttgtggtaacactgttgcaatggttggtctggatcagtttatcacgaagaatgctacactcactaatgagaaggaggttgatgcatgcccaatcagagcaatgaagttctctgtctcccctgttgtgcgtgttgctgttcagtgcaaggttgcctctgaccttcccaagctagttgaaggtttgaagcgtctggcaaagtctgatcctatggttctctgtacaattgaagaatctggtgagcatatcattgctggagctggtgagcttcatcttgagatctgcctgaaggatctgcaggaggacttcatgggtggtgctgaaattatcgtttcccctcctgttgtgtccttccgtgaaactgttcttgagaagtcctgccgtactgtcatgagcaagtcacccaacaagcacaaccgtctgtacatggaagcgcgccccttggaggagggtcttgctgaggccattgatgagggccgcattggcccacgtgatgatcctaaggtgcgctcccagatcctctctcaggagtttggttgggacaaggaccttgccaagaagatttggtgttttggacctgagaccactggtccaaacatggttgttgatatgtgtaagggagttcagtatctcaatgaaatcaaggattctgttgtggctggtttccagtgggcatcaaaggagggtgcactggcagaggagaacatgcgtgggatttgctttgaggtctgtgatgtcgttcttcatgctgatgctatccacaggggtggtggccaggtcattcctactgctaggagggtcatctatgcttctcagctcacggccaagccaaggctgctggagccagtgtacctggtggagattcaggccccagaaaatgcacttggtggtatctatggtgttctgaatcagaagagagggcatgtcttcgaggagatgcagaggccgggtacccctctatacaacatcaaggcttacctccctgtcatcgagtcctttgggttctccagccaactgagggctgcaacctctggtcaggctttcccccagtgtgtgtttgaccattgggacatgatgggctctgatcctttggaggcgggctcccaggctgctcagctggtgctggatatccgcaagaggaagggtctcaaggaacagatgacccctctttctgagtttgaggacaagctctaattttctcgttttgctactgttacctggtttaattgtcggttcaactcctgtactgggaactactatcttgtttccttttagttgtcaaatgcatgtttctgaacatcattggtcatactgtagatggtagtgtgctgctgaggcactttttgctatccatcgtggtgtaacagatgaaacagttggtatatgctttgttaagtggaagtgttgcagtaaatgcttgtgccatcctgatttaatgct

SEQ ID NO: 15449 - DNA, 2969 bp, Sorghum bicolor
  Clone ID: SORBI-28MAY03-CLUS49_347
gcacgaggctaccacctcggcacctcacgcctgggcttagagcagctgctgccccctctatttattggttcctcttccgtcccggggaaagcctcctccattggactgctctccctgttgaccattgggtattgagtatcattgagccatggctgccaagttgactcgcctccacagtcttcgcgaacgccttggtgccaccttctcctctcatcccaatgagctgattgcactcttctccaggtatgttaaccagggcaagggaatgcttcagcgccatcaactgcttgctgagtttgatgccctgtttgatagtgacaaggagaagtatgcgcccttcgaagactttcttcgtgctgctcaggaagcaattgtgctccccccctgggtagcacttgctatcaggccaaggcctggtgtctgggattacattcgagtgaatgtaagcgagttggctgtggaggagctgagtgtttctgagtacttggcattcaaggaacagctggtggatggaaattccaacagcaactttgtgcttgagcttgattttgagcccttcaatgcctcgttccctcgtccttccatgtcaaagtccattgggaatggagtgcaattccttaaccgacacctgtcttccaagttgttccaggacaaggagagcctgtacccattgctgaatttcctcaaagcccataactacaagggcacgacgatgatgttgaatgacagaattcagagcctccgtgggctccagtcatcccttagaaaggcagaagagtatctactgagtgtccctcaagacactccctactcagagttcaaccataggttccaagagcttggcttggagaagggttggggtgacactgcaaagcgcgtacttgacacactccacttgcttcttgaccttcttgaggcccctgatcctgccaacttggagaagttccttggaactataccaatgatgttcaatgttgttatcctgtctcctcatggctactttgcccaatccaatgtgcttggataccctgacactggtggccaggttgtgtacattttggatcaagtccgtgctttggagaatgagatgcttcttaggattaagcagcaaggccttgacatcaccccgaagatcctcattgttaccaggctgttgcctgatgctgttgggactacgtgcggtcagcgtctggagaaggtcattggaactgagcacactgacattattcgtattccattcagaaatgagaatggtattctccgcaagtggatctctcgttttgatgtctggccatacctggagacatacactgaggatgttgccagtgaaataatgttagaaatgcaggccaagcctgaccttatcgttggcaactacagtgatggcaacctagtcgccactctgctcgcacacaagttgggagttactcagtgtaccattgcccatgccttggagaaaaccaaataccccaactcggacatatacttggacaaatttgacagccaataccacttctcatgccagttcacagctgaccttattgccatgaatcacactgatttcatcatcaccagtacattccaagaaatcgcagggagcaaggacactgtggggcagtatgagtcccacatcgcgttcactcttcctggactttaccgtgttgtccatggcattgatgtttttgatcccaaattcaacattgtctctcctggagcagacatgagtgtttactacccatacactgaaactgacaagagactcactgccttccatcctgaaattgaggagctcatctacagtgatgttgagaacgatgagcacaagtttgtgttgaaggacaagaacaagccgatcatcttctcaatggctcgtcttgaccgtgtgaagaacatgacaggcttggttgagatgtatggtaagaatgcacgcctgagggaattggcaaaccttgtgattgttgctggtgaccatggcaaggaatcgaaggacagggaggagcaggcagagttcaagaagatgtacagtctcattgatgagtacaacttgaagggccatattcggtggatctcagctcagatgaaccgtgtccgcaatgcggagttgtaccgctacatttgtgacacgaagggagcatttgtgcagcctgcattctatgaagcatttggcctgactgtcattgagtccatgacgtgcggtttgccaacaattgcaacctgccatggtggccctgctgaaatcatgtggacggggtgtctggtttacacattgatccctaccacagtgacagagctgcagatatcttggtcaacttctttgagaagtgcaaggcagacccaagctactgggacaagatctcacagggtggactgcagagaatttatgagaagtacacctggaagctctactccgagaggctgatgaccctgactggtgtatacggattctggaagtatgtgagcaacctggagaggcgtgagacccgccgctaccttgagatgttctatgctttgaaataccgtagcctggcaagcgcggttcccttgtcctacgactagtgtgggaaagaagaatcccaagccggagaaccatcgcctgcattatgattgttcaccgcaattcgcattgttagtcgtgtatttgagttatgtgtacttggtttccaagcactttggttcctttttgcgagtttttgggcagcgctggctggttcctattataggaattagctgtgacttttgcttcaaataaaagcctgctcgttctcctgtcttccagagttaaatgcaatgttttgttgcccaagtcttcattccgactgatggtgatgttatgttctgataattctgttaatcacctgtttaacgtggtaggctgatgcctgttcgttttatcaaaggttgctgtgccagacatgactacttatatgcttaaatagaagtgaaaaaaataatcatttaagtaaagctgc

SEQ ID NO: 15450 - DNA, 1760 bp, Sorghum bicolor
  Clone ID: SORBI-28MAY03-CLUS49_348
gcacgaggcaatgattagaggcatcgggggcgcaacgccctcgacctattctcaaactttaaataggtaggacggcacggctgctccggtgagccgtgccatggaatcgggagctccaagtgggccatttttggtaagcagtccggccgacgagatggcccaacgccgcctgctcgccctcgccgccgtcctcgccctcgccctcgcgggcaccgccgccgcggacaactccgacttcgccgactccaacacgatccgctccgtcaccgaccgcgcggcctccgcgctcgagtccaccgtcttcggcgcgctcggccgcacccgcgacgcgctccgcttcgcacgcttcgccgtcaggtacggcaagagctacgagagcgcggcggaggtccagaagcggttcaggatcttctccgagagcctccagctcgtccgctccaccaaccggaaaggcctctcctaccgcctcggcatcaaccgcttctccgacctgagctgggaggagttccgtgcgactcggctcggcgcggcgcagaactgctccgccacgctcgccggcaaccaccggatgcgcgccgccgccgtcgcgctgccgaagacgaaagactggagggaggatgggatcgtgagcccagttaaaaaccagggccactgtggatcatgctggaccttcagcactactggtgcacttgaggctgcatatacccaggcaactggcaagcccatctctctttctgagcaacagcttgttgactgcggaaaaccattcaacaatttcggatgtaacggaggccttccatcccaggcctttgaatacatcaaatacaatggtggccttgacactgaggaatcttacccatacaaaggtgtcaatggaatctgcgacttcaaggctgagaatgttggagtcaaggttttggactcggttaacatcaccctgggtgctgaggatgaactgaaggatgctgttgctttggttcgcccagttagtgttgcctttcaggtggtcaatggtttcaggcagtacaagagcggagtttacactagtgacagctgtggaaatactcccatggatgtgaaccatgctgttctggctgttggctatggcgtcgaaaatggtgtcccctactggctcatcaagaactcatggggcgccgactggggtgataagggttacttcaagatggaaatgggcaagaacatgtgcggtgttgctacgtgtgcatcataccctattgtcgcatgaggcccctacgaaatgttacagtctggcatcaataatgcatgtttaacctgagctcggtgatgggttatacagaacggaaagtctgctgtgaatagaaaatcgtgaagggaagggaattcgcccctgcttgtacgtctcccccgtatggttgtgtaggtagattgtcagttggggttccaaattagtcatacgtgtgtatggcattttatttgtgaaacaaaatacccattaatcatgatggtgcagcttgggacattttataataaaataatgtaccatttgcagattgcacattattatgtagtgttcccacctggtagatatgttaatgtagcccagaaatggctagtgttctcatgttcatgtctcaaagttatctttagggtagtggcggagccagaattttaaatttgggtattcctacttccacaaagttaatctataggttgaaaatatagtcaattgtactgcatttaaactaatatttgctttgtagaatatagacttctaattg

SEQ ID NO: 15451 - DNA, 1979 bp, Sorghum bicolor
  Clone ID: SORBI-28MAY03-CLUS49_349
tactgggcacttacacacaactcgtaggcagcgagcgtctctcctctcccacgcatcgcgccaaggaagagagagatcgccgctcctcttctcttcgtcgctggtgcgggtgcccgaggagatcttgctgcagttcttcgagatctgatcacagatctttctgacaagatggtgaagatctgctgcatcggtgctggctatgtcggtggcccgaccatggccgtcattgccctcaagtgcccagacattgaggttgtcgttgttgacatctccaagccccgcattgaggcctggaacagtgacaccctcccgatctacgagcctggtctcgatgatgttgtgaagcagtgcaggggcaagaacctcttcttcagcactgatgttgagaagcacgtcgctgaggctgacattatctttgtctcggtgaacacccccaccaagacccgtggacttggagctggcaaggctgccgacctcacctactgggagagtgctgctcgtatgatcgctgatgtctctaagtctgacaagattgttgttgagaagtccactgtccctgtcaagactgctgaggctattgagaagatcttgacccacaacagcaagggcatcaactaccagatcctttccaacccagagttccttgctgagggcactgctattgaggacctgttcaagcctgacagagtgctcatcggtggccgggagacccctgagggcaggaaggctgtccaggctctcaaggatgtgtacgctcactgggttcctgaggacaggatcctcaccaccaacctgtggtctgctgagctctccaagcttgctgccaacgcgttcttggcacagaggatctcctctgtgaatgccatctctgcgctctgtgaggccactggtgccaatgtgtctgaggtggcttacgccgtgggcaaggacaccagaattggccctaagttcctgaacgccagtgttgggtttggtggctcttgcttccagaaggacatcctgaacttggtgtacatctgcgagtgcaatggcctgcccgaggtggcccactactggaagcaggtgatcaagatcaacgactaccagaagagccggttcgtcaaccgcgtcgtgtcctccatgttcaacaccgttgccggcaagaagatcgccgtcctcggcttcgccttcaagaaggacaccggtgacaccagggagaccccggccattgacgtctgcaagggcctgttgggtgacaaggctcagatcagcatctacgacccccaggtgacggaggaccagatccagcgggacctggccatgaacaagttcgactgggaccacccgatgcacctgcagccgacgagccccacggccgtgaagcaggtgagctgcgtgtgggacgcgtacgaggccaccaagggtgcccacggtctgtgcatcctgaccgagtgggacgagttcaagaccctggactaccagaagatcttcgacaacatgcagaagcctgccttcgtcttcgacggtcgcaacattgtcgaccccgagaagctgagggagatcggcttcatcgtctactccatcggcaagcccctcgacgcctggcttaaggacatgcccgcggtcgcttaattccccctccctcatccgaggattgaattcggggaaggaagaggaactggttgaccattctttattacagtttgtttttgcaggctcccctacgattttctcttgtgtcaggcataaaagtaagttggtcggcgctgctagtattccgtgtttggttggtgtatttacatgttggagagacgtctgtagatgtaaaattcctcaggcccttgtgctctgcttgaggaaatttccttgtacggttgtaccctggacctgctatagcgcggttgattcttcaattgtatctcctaaaagttaaagttactatacgatcgaatatgtttttttttgcagaataacaatacttgtctcacgtttcatccttt

SEQ ID NO: 15452 - DNA, 2308 bp, Sorghum bicolor
  Clone ID: SORBI-28MAY03-CLUS49_350
gcacgaggatcatcaccattcaccaacgcaacgcccaaagctcccccaaacggtaggagacagacagcagcaggccgcaggactcctcctcctcctcctcctccctctacgcacccaccgagatccttcccggcttcctgtgcaaaggagaatctccagttcttcggccccggcctaagtttttgagtgttgcttgccctgccgccggagttttcctctaccccgaagtcgaatcggctaagaagttgatgggatcgggggaacacttggggaaggttgtgtgagatcgccaaggggaccgtgtgaattcctgagagggctgcggcgattcggctgcacggctgtatgaactgtttcgtgaacctgggactcaactcgaactcgaaccactacgtcgcctgcctcctcatcttcctgctgcatttctccccccagttgttaaatccatccaattctaattcaaattcaagtagtaattgtgaaggagaagaagaacagagcttcacagatggcgaacaacagttcattcggtgaaaatggtaggagaaagccacacacaccaaccgctattgttattggtggtgggtttgcaggtcttgctgctgcagatgcgctcagaaatgcctccttccaggttattcttctggaatcccgtgataggattggtggcagagttcacactgactactcgtttgggtttccagtcgatctgggagcatcttggcttcatggcgtctgtgaagaaaatcccttagcaccaataattggaaggcttgggcttccactgtaccgcacgagtggagatgattctgtgctgtttgatcatgatctggagagttatgcactctatgacactaatggacgtcaagtaccacaagagttggtagaaaagattgggaaggtgtttgagaccatactggaagagactggcaaattgagggaaggaaccaatgaagatatgtctattgcaaaagccattgcaattgttatggatagaaatccacacttcaggcaagaagggattgctcatgaggtccttcagtggtatttgtgccgtatggagggttggtttgccaccgatgctgattcaatttcactacagggttgggatcaggaggtgctgctgccaggtggtcatggcctcatggttcgtggatatcgtccggttataaatactctggcaaaaggcttagatatacgcctcaaccataaggttgtggaaattgttcgccacaggaacagggtagaggttactgtaagcagtggcaaaacatttgttgcggatgctgcagtggtcgctgttccgttgggtgtcctgaaagcacaaaccattaaatttgagccgaggctgccagactggaaagaagaagcaattagagaacttacagttggaattgaaaacaaaattgttcttcacttcggccaggttttctggcctaacgtggagttcctcggcgtcgtttcctctagcacgtatggttgcagctatttcctcaaccttcacaaggcaacaggccaccctgtccttgtttacatgcctgctggccgccttgctcgtgacatcgagaaaatgtcagatgaggctgctgcccagtttgccttttctcagttgaagaagatccttcccaatgcagctgagccgataaattacctggtgtcacactggggctcagacgagaactcacttggttcctacacgttcgatggggtgaacaaaccccgggacctgtacgagaagctgcgcatccccgtggacaacctgttcttcgcgggtgaggcgacgagtctcaagtacacgggcacggtgcacggcgccttctccactggtgtcatggcggccgaggagtgcaagatgcgggttctggagcggttcagggagctggacatgctggagatgtgccaccctgccatgggcgaagacagccccgtctctgtcccgctgctcatctcccggctgtaagcggatgagcagttgtcgttgtctattggatcggcatcggcacctgagagtaggctggacgtcccactgattgccggagggaagcaggcagttcatggagaaagagactcccccttgcctctcctcggcatgaggcatgtgctagcgttacttgtggcgtgccatatattattgaacttgtgtgtgtgtgggaacccttatgtatattgtgggtctgtgagactgttcatgtaacacgagttatcatgcccgtcttcgtaggaaaagataccgtatgtatgatgaacacttgtaataataatataatatacataatatatggaactcaactatttggagtataaaaaa

SEQ ID NO: 15453 - DNA, 1606 bp, Sorghum bicolor
  Clone ID: SORBI-28MAY03-CLUS49_351
gcacgaggcaggagtccggattcggtcgccacgcccgccgtggtttgctcctcacgaaggtggcgaaaccgcaccagcctcctccgcctttagagctcctatatatacacagggctctcccctcctcgctcctcacagattcgattcgatttgcatggtgtggtggcgttcttggagcttctggaattgggattcccgtagtgggatttgatttctagaggaaataaggcaatggcgaccgcggggaaggtgatcaagtgcagagccgcggtggcatgggaggctggcaagccgctgtcgatagaggaggtggaggtggcgccgccgcaggccatggaggtgcgcgtcaagatcctcttcacctcgctctgccacactgacgtctacttctgggaggccaaggggcagacacccgtgttccctcggatcttcggtcatgaggctggaggcattgtagaaagtgttggagagggtgtaactgaccttgcccctggtgaccatgtcctcccggtattcactggggagtgcaaggagtgtgcccactgcaagtcggcagagagcaacatgtgcgatctgctcaggatcaacactgaccggggtgtgatgattggtgatggcaaatcacggttttccatcaatgggaagccaatctaccattttgttgggacttccaccttcagtgagtacactgtcatgcatgttggttgtgttgcaaagatcaaccctgaggctcccctggacaaagtttgtgttcttagctgtggtatttctactggtcttggtgcatcaatcaatgttgcaaaaccaccaaagggttcgacagtcgctatttttggtctaggagctgttggccttgctgccgcagaaggtgcaaggattgctggagcatcaaggatcattggtattgacctgaacgccaacaggttcgaagaagctaagaagtttggttgcactgaatttgtgaacccaaaagaccacaacaagccagtgcaggaggtactcgctgagatgaccaatggaggggttgaccgtagtgtggagtgcactggtaacataaacgccatgatccaggcatttgaatgtgttcatgatgggtggggtgttgctgtgctggtgggtgtgccacacaaggacgccgaattcaagacgcacccgatgaacttcctgaacgagaggaccctaaagggaaccttcttcggcaactacaaaccgcgcactgacctgcccaatgtggttgagctgtacatgaagaaggagctggaggtggagaagttcatcacccatagcgtgccgttcacggagatcaacaaggccttcgacctaatggctaaaggagagggcatccgctgcatcatccgcatggagaactagattttgctttttttctctggttgtctggtctgggttgggttaaataaaaggggcagtgtcctctgtggatgtggagccacgcttgtgtgtatcacgtccagtttggccttgtccatcaggagaagtagcttgcacttttttttttcgtaaatacgcttgcgtatcattgtattaagaggatagaagttttaacattaataaaatacaagagtggccgttctcggcctgaccgaaa

SEQ ID NO: 15454 - DNA, 1401 bp, Sorghum bicolor
  Clone ID: SORBI-28MAY03-CLUS49_352
gcacgagggtccggcggcatctcgactcctccttcctccctctatttaacgggctcacatcacacactacagcatgcgccacttcgcctagctagcagagaatatagagagatagagagaagctagggcaataaggtcgtcgttgatggctccgatgaagctgtacggtgcgacggtgtcgtggaacgtgacccggtgcgtggtggcgctggaggaggccggcgccgagtaccagatcgtacctatcgatttcgccaccgccgagcacaagagccccgaacacctcgcccgcaacccgttcggtcaagttccagctttccaagatcgcgatctccacctatgggaatcgcgtgcgatttgcaagtacgttgcccgcaagaacaaggcagcagagctgctgagggaaggcaacctccaggagtcagccatggtggacgtgtggctggaggtggagtccaaccagtacaccgccgccctgaaccctatcctgtacgagtgcctcgtcagccctatgttcggcggcaccaccgaccagaaagtggtggaggagaacctggagaagctgaagaaggtgctggaggtgtacgaggcgcggctcgccaagcacaagtacctcgccggagacttcctcagcctcgccgacctcaaccacgtctccgtcacgctttgcctgctcgcgacgccccatgcttctgtgctcaacgcgtaccctcacgtcaaggcatggtgggatggcctcatggccaggccgtctgtccagaaggtcgccgcgctcatgaagccgtctgcttgaaattagtgatcgagtcttcgttcgttcactgcttggcttaatataaataagcccatcgacccctgtgtgtgtcctcgttctcgatcggcatgtgtcatccaggtgttgaataagctagctagccgatcgaggttgcatgcatgttttcgtgtctttgagaaataatattaagctatgtgtttggtataaaaaaccaaaaaaaaaaaaaaaaaacagtgggagctgataaagaggcgggaacctgatggtcatgttgtttgggaaagcttgtcatcagtagatcacacgcctcagacggcgccccgaaaaaccatggcatgccgaaatttgttgactatgcagcttccttgcaagagcagtgataattggaactgtgtcagtaagtaaatttattttatttgggagtactcatttgtgaaggatatcatttttcttacataattaccatcgctgtttgtcatctgaactggaagttctgctcatcatagttcctatttagtaacattctatgcagtcaaaggccaactctaattctctgtgttgagcagttatttagagtttcccttgtatttcattcctttagtaactagaagactagatttaggcct

SEQ ID NO: 15455 - DNA, 1847 bp, Sorghum bicolor
  Clone ID: SORBI-28MAY03-CLUS49_353
ccgggcctaagacgcagtcggccgccgcacaccgggagaagccgacgctccgccaccgtatccgcagatcagcggcgagccgtaaccacgccacactgcttgccgcccgacgagcagggtaacagttcccttcagccatgggtaaggagaagactcacatcaacattgtggtcattggccatgtcgactctggcaagtcgaccaccactggccacctgatctacaagcttggcggtattgacaagcgtgtgatcgagaggttcgagaaggaggctgcggaaatgaacaagcgttcattcaagtacgcctgggtgctcgacaagcttaaggctgagcgtgagagaggtatcacaattgatattgcgctgtggaagttcgagaccaccaagtactactgcactgtcattgatgcccctggacaccgtgacttcatcaagaatatgatcactggtacttcccaggctgactgtgctgttcttatcattgactccaccactggtggttttgaggctggtatctccaaggatggccagacccgtgagcatgctctccttgctttcacacttggagtcaagcagatgatttgctgctgcaacaagatggacgccaccacacccaagtactcgaaggcccgttatgatgagattgaaggaagtctcttcctacctgaagaaggttggatacaacccagacaaaatccactttgttcccatctctggttttgaaggtgacaacatgattgagaggtccaccaaccttgactggtacaagggcccaaccctgcttgaggctctggacttgatcaatgagccaaagaggccttcagacaagccactgcgtctcccccttcaggacgtgtacaagattggtggtattggaactgttcctgtcgggcgtgttgagactggtatcatcaaacctggtatggttgttacctttggtcctagtggccttacaactgaggttaagtctgttgagatgcaccacgaggctctccaggaggctcttcctggtgacaatgttggtttcaatgttaagaatgttgctgtgaaggatctgaagcgtgggtatgtggcctccaactccaaggatgaccctgccaaggaggctgctagcttcacctcccaggtcatcatcatgaaccatcctgggcagattggcaacggctacgccccagtgctggactgccacacctcacacattgctgtcaagtttgctgagcttgttaccaagattgataggcgatctggcaaggagcttgagaaggagcccaaattcctcaagaacggtgatgctggtatggtgaagatggttcccactaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgccgccaagaagaaatgaggtgtctggctgatcctgtgtttttttgagggatacctagttggaactttaaatattgtcattcctgttattgcgcgagcaactaaactgtgctggcaatgtttgtctggtcgatttagtactgttatttttgttaaaacccagggtgcttgacaccaattttctgttatttttggatcgaacatcgggtgttagccaatggttttgagttttgttactctcgttatgtttgcctgtttacatagctgtttctaaataggtgatgattcgctcgtctgtgcctacttttgtagtgtttgcctgttaacctatctagaaatattgttttgtctacgcttttaattgtgaaaagcattttttgctgattt

SEQ ID NO: 15456 - DNA, 1695 bp, Sorghum bicolor
  Clone ID: SORBI-28MAY03-CLUS49_354
gcacgaggccgggtcggatctgagacgagacgagccccccctcctcctcccgaacgaactgcttacccatcccactccgcctccgccggatctcgtcggactcggatccgcccgaccaccccgcgccgccgcagcagcagcagatcagagaagatggccgcagtcgacaccttcctcttcacctcggagtctgtgaatgagggacacccagacaagctctgcgaccaggtctcagatgctgttcttgacgcttgccttgctgaggaccctgacagcaaggttgcttgcgagacctgcaccaagaccaacatggtcatggtctttggtgagatcaccaccaaggccaatgtcgactacgagaagattgtcagggagacctgccgcaacattggtttcgtgtcagctgatgtcgggcttgacgctgaccactgcaaggtgcttgtgaacattgagcagcagtctcctgatattgctcagggtgtgcacggccacttcaccaagcgccccgaggagattggagctggtgaccagggacacatgtttgggtatgccactgatgagacccctgagctgatgcccctcagccatgtccttgccaccaagcttggtgcaaaactcaccgaggtccgcaagaatggaacctgcgcctggctcaggcctgatgggaagacccaggtgacagttgagtaccgcaatgagggtggtgccatggtccccatccgtgtccacactgtcctcatctctacccagcacgacgagacagtcaccaatgatgagattgctgctgacctgaaggagcatgtcatcaagcctgtcatccctgagcagtaccttgatgagaagaccatcttccaccttaacccatctggtcgctttgtcattggtggacctcacggtgatgctggtcttactggccggaagatcatcattgacacctatggtggctggggagcccacggtggtggcgctttctccggcaaggacccaaccaaggtcgaccgcagtggagcctacatcgcaaggcaggctgccaagagcattgttgccaacggccttgctcgccgcgccatcgtccaggtctcctacgccatcggtgtgcctgagcctctctccgtctttgttgacacgtatggcaccggcacgattcctgacaaggagatcctcaagattgtgaaggagaactttgacttcaggcctggcatgatcatcatcaacctcgacctcaagaaaggtggcaacgggcgctacctcaagacggcggcctacggccactttggaagggacgaccctgacttcacctgggaggtggtgaagcccctcaaggcggagaagccttctgcctaaggcaccctcactttttcagaagaagcttttggtctgctgcgctttatcatgttttatctggcttctatatgttgtgattcttgatctgccccttgcttatcatttgtacttgtactgtcctaataagtggtacttgtgagggtcttattgtgtctgcttatttacctagaggattatttctggttttactggttatgtaatgcttaaaacaatgaaagaagctacaggctacagccactttgagaagtaatgggacctcgtgcattttggttaaaaaaaaaaaaaaaaaaaaaaaaaaaaaaaaaaatacaacctgggattttgtaaaaaaaaaaaaaaaaaaggccccta

SEQ ID NO: 15457 - DNA, 1694 bp, Sorghum bicolor
  Clone ID: SORBI-28MAY03-CLUS49_355
gcacgaggggtgattgctggcctcaacgtcctccgtatcatcaatgagccaactgctgctgctatcgcctatggtcttgacaagaaggcaaccagtgttggcgagaagaatgtcctcatctttgaccttggaggtggtaccttcgatgtctccctcctcaccattgaggaaggcatctttgaggtcaaggccacagctggtgacacccatctgggtggtgaggactttgacaacaggatggtgaaccacttcgtccaggagttcaagaggaagaacaagaaggacatcactggcaacccgagggctctcaggaggctgaggactgcttgtgagagggcgaagaggactctatcttccactgctcagaccaccattgagatcgactctctgtacgagggcatcgacttctactccaccatcacccgtgccaggtttgaggagctcaacatggacctgttcaggaagtgcatggagcccgtggagaagtgcctgagggatgccaagatggacaagagcagcgtgcacgacgttgtccttgttggtggctccacccgtatccccagggtgcagcagctgctccaggacttcttcaacggcaaggagctgtgcaagaacatcaaccccgatgaggccgtcgcctacggtgccgctgtccaggccgccatcctgagcggcgagggcaacgagaaggtgcaggacctgcttctgctggacgtcacccctctctcccttggcctggagaccgccggaggagtgatgaccgtgctgatcccgaggaacaccaccatccccaccaagaaggagcaggtgttctccacctactcggacaaccagcctggtgtcctgatccaggtgtacgagggcgagaggacacggacccgcgacaacaacctgctgggcaagttcgagctctccggcatcccccctgcgccccgtggtgtgccccagatcacggtgtgcttcgacatcgacgccaacggcatcctgaacgtctcggccgaggacaagacgaccgggcagaagaacaagatcaccatcaccaacgacaagggccgtctgtccaaggaggagatcgagaagatggtgcaggacgcggagaagtacaagtcggaggacgaggagcacaagaagaaggtggaggccaagaactcgctggagaactacgcctacaacatgcgcaacacgatcaaggacgagaagatcgcgtccaagctggccggcgacgacaagaagaagatcgaggacgccatcgacgcggccatctcgtggctggacgccaaccagctcgccgaggcggacgagttcgaggacaagatgaaggagctcgagtcgctgtgcaaccccatcatcgccaagatgtaccagggcgcgggcgccgacatgggcggcgccggcggcatggacgaggacgcacccgcgggcagcggcggccctggccccaagatcgaggaggtcgactaagcggttcgttgtcaggtctgcaggttgcgctagtgggtggcagcttgcgagttatcgtcgtcgtcgtggcgtgtccgcgttattttagtaatgtttatctgtggttggttggaactttttgtggtggtggttaattaatttttggacctcgtgatggtcggttggttggtgaaccaatgttatcgtggcaagccgttaagtaatactacggtattattctggttcggtaaatg

SEQ ID NO: 15458 - DNA, 1827 bp, Sorghum bicolor
  Clone ID: SORBI-28MAY03-CLUS49_356
gcacgaggcacgggctcacggcgcctcctccgcggccacgacgctccggcagcgcaggcaggtagcacataaatacggagccggagcaccaccgtccggctcggttccgtctggctaccatcatccctcggcacccggcagcagcgcgccatggccacccacgcagctctcgccgcctcgcgcatccccaccagcgcccggctgcacagcagggcggcgtccaggcagagggtggacttcgccgacttctccgggctcaggccaggatcttgctccgtgagcactgccgcgagggaggtctccttctccgacgtccttggtgcgcagctcgtcgccaaggccactggagagaacgcggtgagggcgcccgctgaggcgaagctgaaggtcgccatcaacggcttcggccgcattggccggaacttcctccggtgctggcacggccgtgaggactccccgctcgacgtcgtcgtcgtgaacgacagcggaggcgtcaggaacgcgtctcaccttctcaagtatgactcgatgctgggcaccttcaaggctgacgtcaagatcgtcgacgacacgaccatcagcgtcgatggcaagcccatcaccatcgtctccagcagggaccctctcaagctcccatgggctgagctcggcattgacatcgtcatcgagggcaccggagtcttcgtcgacggccccggcgccggcaagcacatccaggccggcgcaaagaaggtcatcatcactgctccggccaagggcgccgacatcccgacctatgtcgtcggtgttaacgagggcgactacgaccacagcgtcgccgacatcatcagcaacgcttcctgcacgaccaactgcctcgcgccattcgtcaaggtcttggacgaggagttcggaatcgtgaaggggaccatgacgacaacgcactcgtacacgggtgaccagaggctgctggacgcgtcccaccgtgacctccggagggcccgtgcggcggcgctgaacatcgtgccgacgagcacgggcgccgccaaggccgtggcgctggtgctgccccagctgaaggggaagctgaacggcatcgcgctccgtgtgccaaccccgaacgtgtccgtggtggacctggtgatcaacaccgtgaagacgggcatcactgccgacgacgtgaacgcggcgttccgcaaggccgccgacggcccgctgaatggcgtcctgtcggtctgcgacgtgccgctcgtgtccgtggacttcaggtgctccgacgtgtcctccaccatcgacgcgtcgctcaccatggtcatgggcgatgacatggtcaaggtcgtcgcctggtacgacaacgagtgggggtacagccaacgcgtggttgatctggcgcacctggtggcggccaagtggccaggcgcggcggcggcgggcagcggcgaccctctggaggacttctgcaaggacaaccccgagaccgacgagtgcaaggtgtacgaagcatgatgaggcccccttgttgtaggccaggggccgccgtgtgctcagaaaattcactagctttgcctcgtgttctttcgatagagaatactatatacagattcgccgaaagagacgtagacgaaaatgtgccgttttctatgagttgtgtatgtaatcactgaactcgtacaggcttccgcttttcgatcatttcctgttgggactccctgtaattctgcggtgtgtgtttatttcatcaatcatgccgacatgatcgatccatcatatacttttatactaatataagtacatgtaaagatttcgtgtcaccagcattatctggtttggtataatcgctttgcttgc

SEQ ID NO: 15459 - DNA, 1093 bp, Sorghum bicolor
  Clone ID: SORBI-28MAY03-CLUS49_357
gcacgaggtaaaccagttgctattagtacgcgccaccacgctcgcacgcacacgcacacgcacagctagctcgcacccctacacactcaacagcaacagctaagcttctccaaccagacagcaacatggctgaggaggcggccaagaaggtggaggtggaggtcaccaaggacaaggagcccgaggcggcgcccgcggaggccgtgccggaggcggcggccaaggaggacgtcgccgaggagaaggccgtcatccccgcgaccgagccgccggccgccgaggagaagccgccggccgacgattccaaggccctcgccatcgtcgagaaagttgcagatgaacctgctccagagaagcctgctgctgagaagcaagggggttccaatgacagagatcttgctcttgcaagggtggaaacagagaagaggaactctttgatcaaagcatgggaagagaatgagaagacaaaagctgagaacaaggctgctaagaaagtatccgctattctttcatgggagaacacaaagaaagcaaacatagaagctcaactgaagaagattgaggaacaactggaaaagaagaaggccgaatatgctgagaagatgaagaacaaggttgcaatgatccacaaggaagccgaggagaagcgagcgatggtggaggcaaagcgcggtgaggaggtcctgaaggccgaggagatggctgccaaataccgggccaccgggcacgctcctaagaagctcatcgggtgcttcggagcctaagaaacattccaagtcacacccgagcaggaagtgaaaaacgtcaaccagtgattgcttggtcctctcgctctatcaagtgtgtagtgtgtcttcgaaagtgtgtaaagcctactgctgctctgtatatacagatgttgcttccaagacaggcgtttggtgggtgtacatgttgaatgcttgacgagaaacattcttatttgtagttaaggggtcacactgttgttgttgctgttgttgttgacatttaagcagacattttgttcttcgccctgctgttattgtttttgtccctgtctctttgttccttactgctgatttcagtttgtcta

SEQ ID NO: 15460 - DNA, 2885 bp, Sorghum bicolor
  Clone ID: SORBI-28MAY03-CLUS49_358
gcacgagggttcagtatatatacgaatagcagacaaagaagaaaatgttcggtttgtgcaatgaaagtgaatagaataatcaagattgaccaatttttgtagactaacggttgaagaatgcgagtaagagtatatctgctgagacccgaaagatggtgaactatgactgagtagggtgaagtcacgagaaatcgtgatggaggctcgaagggattctgacgtgcaaatcgatcttcaaacttggtcataggggcgaaagactcatcgaaccatcgagtagctggttccctccgaagtttctctcaggatagctggagcaagaagaaattagttagatcaggtaaagcgaatgattagaggtatggggaaagtaagtttcttcgcctattctcaaactttaaataggtcttttttttttttttaaaagaaaattaatttttccgaagaaaaaaaataataaataaaaatgctctttgtgggccaatcgtggtaagcatgactggcgatgtgggatgaaccaaacgtgaaagttaaaggtgccaaagtggatgctcatgtttagagaccagaaaaggtgtagcttgatctagacagaaggacggtggtcatggaagtcgaaaaccgctaagaagtgtgtaacaacttacctttcgaattaagttgccctgaaaatggatggcgctcaagcatcttgaaggaaaataacgacttagactttactatttattatggaaaagaataataaatatgtaggaggtatgcgtaaaaagatggtagtgaagctgattatctttgtgaaaagaagtggaactctttttcttttagtgcagatcttggctatagtagcaaatatttcaagtgaaaaccttgaagactgaagttttagagcaaggttccatgtcaatggcaatcaaacatgggtaagtcgatcctaaataatagtcaaatgatgttcaattggattgattatgaaagggaaaaaggttaaaattcctttaccatttaaatagataactttatttctttttgtaaaaaaaaagaaatgcaaacaattggtaacaataattaaaaaactttgataactattcattaatgaatattttagaaagagttttcttttctttttaactaaatatttaattaaagaagaagaatcttcttctttaaagaaaaattgaatggaataaatattgtattaagaaattcaaaaaaattagtaagaattttatcaaagaaaattattcgtcacagaataagaaaaaattgatagaatctaaattatattcaataatccttgaaaatcaaagtaaatcatgttcattatcagcgagttatcaatggtcgtactgatcaccgcatcaggtctctaaggtgaatagcctctagttgattagaataatgcaggtaaggaaagtcggcaaattcgatccgtaacttcgggaaatggattggctcataagttcttcaacaacgacgataaaacgcccgacgaagaacatttatgaactgatacgatcaaggggaatccgactgtttaattaaaacaaagcattgcgacactttgcaacagatgtatacgtaatgtgatttctgctcagtgctctgaatgttaacgtgaagaaattcaagcaagcgcgggtaaacagcgggagtaactatgactctcttaaggtagccaaatgcctcgtcatctaattagtgacgcgcatgaatggattaacgagattcccactgtccctacttgccatctagcgaactaacagccaagggaacgggcttggccaggtcagcggggaaagaagaccctattgagcttgactctagtctgaaattgtgaagtatttttatgggtgtagaataggtgggagttgtaaaaaaacaatcttgaaataccactaccgtaaataatattttacttatctatttaaatttatgaataatgttaaaaagttattgaattttttcaacttcttgattttttctaaagagaaaaactacttttctcttataaaaaaacttatagaaaacatttcagaaggggagtttggctggggcggcacatctgttaaatgataacacaggtgtccaaagatgagctcaacaagaacagaaatcttgtgttgaacaaaagggtaaaagctacatttgattttgttgattttcaagtaggaatacaaactgtgaaagcatggcctatcgatcctttatttattttcttttaaaaaaaaaatgtgtagaaaagccactacttggcgatagaggtgtcagaatagttaccatagggataactggcttgtggtggccaagcgttcagagcgacgtcactttttgattcttcgatgtcggctcttcctacactgctcgaagcagaattcggcaaggttcggattgttcacccgccaatagggaacgtgagctgggtttagaccgtcgtgagacaggttagttttaccctactgactaaaaaaaaaaagtcttcttctaataggtaattcgactcagtacgagaggaacggttgattcagataattggtgcccccgttggtcgataggcccccatgcggtcaagctaccatctgttggataaaggctgaacgcctcttaagtccgaatccatgctaaattattttctaagaagaagaagaagaaaaaccctgtgttttttttaaaaaagaaaaagaataagaaatcattcaaaaagaaaaaagaagaaaaaagaagaaaaatacaaaaaagaaataaattcaatttattttttaaatcaacttgtagacgacttgacttttttaccaagagtattgtaagtagttgagtatgctcaaaaagtattttttgaattgttcatacgatctattgagattcagctctaaaaaaaaaaaaaaaaa

SEQ ID NO: 15461 - DNA, 2749 bp, Sorghum bicolor
  Clone ID: SORBI-28MAY03-CLUS49_359
ggtgcttctccttctctctcttcctcctcacctatcatcgcctgctgcgcacgtctcctccgactctcccgtcgaaccggaaagatggcgtcccacattgttggataccctcgcatgggccccaagagggagctcaagtttgcccttgagtctttctgggatgggaagagcaccgctgaggatcttgagaaggttgctaccgacctcagggccagtatctggaagcagatggctgatgctgggatcaagtacatccccagcaacaccttctcctactacgaccaggtccttgacaccaccgccatgctcggcgctgtcccagaacgttactcatggactggaggagagatcgggttcgatacctacttctccatggctaggggcaatgccactgtccctgctatggagatgaccaagtggtttgacaccaactaccactttattgtccctgaattgggccctaacaccaagttctcctacgcttctcacaaggctgttaacgaatacaaggaggctaaggcgcttggggttgataccgtgccagtacttattggaccagtctcataccttttgctctcaaagcctgccaagggtgtggagaagggattccctcttctttcccttcttagcagcatcctccctgtttacaaggaggtcattgctgagttgaaggcagctggggcttcatggattcagtttgatgagcccactcttgtcctcgaccttgattctaacaaattggctgcgttctctgctgcatacgcagaactggaatctgcactttctggattgaatgtgcttgttgagacttactttgctgatgttcccgctgaatcatacaagaccctaacatctctgagcggtgtgactgcttatggttttgatcttgtccgtggaacccaaactcttggacttgtcacgagtgctggtttccctgctggaaagtacctctttgctggtgttgtggatggacgcaacatctgggctgatgatcttgctacatctctcagcactctccagtctcttgaggctgttgttgggaaggacaagcttgttgtatcaacttcctgctcactcatgcacaccgctgtggatcttgtgaacgagactaagcttgacagtgagattaagtcgtggcttgcatttgctgcccaaaaggtggttgaggttgatgctcttgcgaaggcattggctggtcaaaaggatgaggcttactttgcagcaaatgctgctgctcaggcatcaaggaaatcctctccccgtgtgaccaatgaagaagtccagaaggctgctgctgctctcaagggctctgaccaccgccgtgcaaccaccgttagtgctagattggatgcccagcagaaggagctcaacctccctgtccttcccacgaccacaattggttcgttcccacagactgtggagctcaggagggtccgccgtgagtacaaggcgaaaaagatctctgaggaggagtacatcagtgccatcaaggaggaaatcagcaaggttgttaagctccaagaagagcttgacatcgatgtgcttgtgcatggcgagcctgagagaaacgatatggttgagtactttggtgagcagctctctggttttgcattcactgccaatggctgggtgcaatcttacggatcaaggtgtgtcaagccaccgatcatctacggtgatgtgagccgccccaaccccatgaccgttttctggtcaaagacggcccagagcatgacatctcgcccaatgaagggaatgttgactggtccagtaacaatccttaactggtcctttgtgcggaatgaccagccaagatttgagacttgctaccagattgctcttgcgatcaagaaggaggttgaggatcttgaggctgctggtattaaggttatccaaatcgatgaggctgcattgagagaaggtctgccactccgcaaggctgagcacgctttctacttggactgggccgtccactccttcagaatcaccaactgtgaaatccaggacaccacccagatccacacccacatgtgctactccaacttcaacgacatcatccactccatcattgacatggacgccgatgtgatcaccatcgagaactcccggtctgacgagaagctcctctccgtcttccgtgagggtgtgaagtacggtgctggcattggccctggtgtctacgacatccactcccccaggatcccgtccaccgaggagattgccgaccgcgtcaacaagatgcttgcggtgctcgacaccaacatcctctgggtgaaccctgactgtggtctcaagacccgtaagtacgcggaggtcaagcccgccctaaccaacatggtctctgctgccaagctcatccgcacccagctcgccagtgccaagtgaggactgtcgtctccgccatggcctattcctttaattacaaggagggtgtcatcgaagccatttgtttccaataatcagggtcccctgttcccgttctgctccatctgtttttagattagtatttttcttggctcgatgatcgccccaggcaatacctgttttactccatttggtggttcagaggcaagttgcccgtgtacttgtattgtaaaactgagtggtatctttgcagtgtttcatctgccactccgaaggtgtgtcttactcaaggtaaagatctcgtatcgggaaagttaatatctaattgtgtttgcgctcaggttaattgtacactcccattctctttcaaaaaaaaaaaaaaaaa

SEQ ID NO: 15462 - DNA, 1185 bp, Sorghum bicolor
  Clone ID: SORBI-28MAY03-CLUS49_360
ccggaccaccgcatctcacacccctaagattgagcttagcttagctccacactccagctccaagcacacagtcgtggttagagggccgtgaaaatgccgatcagcaggatcgccgtggggacccaccatgaggtgtaccacccgggcgccctcaaggcggcgttggctgagttcatctccaccctcatcttcgtcttcgccggccagggttccggcatggccttcagcaagctgacgagcggcggcgcgacgaccccctcgggcctgatcgcggcggctgtggcgcacgccttcgcgctgttcgtggcggtgtccgtgggcgccaacatctccggcggtcacgtgaaccctgccgtgaccttcggcgcgttcgtgggcggcaacatcaccctgttccgcggcctcctgtactgggtggcgcagctgctgggctccacggtggcgtgcttcctgctccgcttctccacgggcgggctggccacgggcaccttcggcctgaccggcgtctccgtgtgggaggcggtggtgatggagatcgtgatgaccttcgggctggtgtacacggtgtacgccaccgccgttgaccccaagaagggcagcctgggcaccatcgcccccatcgccatcggcttcatcgtcggcgccaacatcctggtcggcggcgccttcaccggcgcgtccatgaaccccgccgtgtccttcggccctgccctcgtcagctgggagtggggataccagtgggtgtactgggtcggcccactcatcggcggcggcctcgctggcgtcatctacgagctgctcttcatctcccaaacccacgagcagctccccaccaccgactactaagccggccgccggcgaccccccaccaagcttgggttccgttccgtgcgcagctagcagatcatcaattctctcgatctctggatctccccctcgccgtttagtttctctcgtgcatgtgcatgcatcgtcgaacatctcaagctgctactgctgctgctgcgccggcgccgctcgatcgtcgcatcgtttgctttcttggacaagtctgtaaccgtgaattccggacccgtttgcttctgtaaaatttgtgcatttgcctgagtattcaccgagttccacgtagtagcagtagctctctttatgatcgtggaggaaaaaaaaaaaaaaaaaaggccccta

SEQ ID NO: 15463 - DNA, 1801 bp, Sorghum bicolor
  Clone ID: SORBI-28MAY03-CLUS49_361
gccggccgggccgggagacgcagtcggccgccacagaccgggagaagccgacgcgccgccaccgaatcctcagatcagcggcgagccgtaaccgcgccactctgctgccgcccgacgagcagcgtaacagtttcctgcagccatgggtaaggagaagactcacataaacattgtggtcattggccatgtcgactctggcaagtcgaccaccactggccacctgatctacaagcttggtggtattgacaagcgtgtgatcgagaggttcgagaaagaggctgcggagatgaacaagaggtcgttcaagtatgcgtgggtgcttgacaagctcaaggctgagcgtgagagaggtatcacaattgatattgccctgtggaagttcgagaccaccaagtactactgcactgtcattgatgctcctggacaccgtgacttcatcaagaatatgatcactggtacttcccaggctgactgtgctgttcttatcattgactccaccactggtggttttgaggctggtatctccaaggatggccagacccgtgagcatgctctccttgctttcacacttggagtgaagcagatgatttgctgctgcaacaagatggacgccaccacacccaagtactcgaaggcccgttatgatgagattgtgaaggaagtctcttcttacctgaagaaggttggatacaacccagacaagatccactttgttcccatctctggttttgaaggtgacaacatgattgagaggtccaccaaccttgactggtacaagggcccaaccctgcttgaggctctggacttgatcaatgagccaaagaggccttcagacaagccactgcgtctcccccttcaggacgtgtacaagattggtggtattggaactgttcctgtcgggcgtgttgagactggtatcatcaaacctggtatggttgttacctttggtcctagtggccttacaactgaggttaagtctgttgagatgcaccacgaggctctccaggaggcccttcctggtgacaatgttggcttcaatgttaagaatgttgctgtgaaggatctgaagcgtgggtatgtggcctccaactccaaggatgaccctgccaaggaggctgctagcttcacctcccaggtcatcatcatgaaccatcctgggcagatcggcaacggctacgccccagtgctggactgccacaccttcacacattgctgtcaagtttgctgagctggttaccaagattgataggcgatctggcaaggagcttgagaaggagcccaaattcctcaagaacggtgatgctggtatggtgaagatggttcccaccaagcccatggtggtggagaccttctctgagtatcctcctcttggtcgctttgctgtccgggacatgaggcaaacggtggctgttggagtcatcaagagtgtggagaagaaggacccaactggagccaaggtgaccaaggctgccgccaagaagaaatgatgcgcctctgtttgctcgtgggatacctagttgaaacttcaaaaatatagtcgtcattgctgttgctgttatcgcttgagcaactaaactgtgctggcaatgtttgtctggtccatctagtactgttatttttgctaaaacccagggtgctgttgagactcaattctgttatttttgtatcgaacaaccgggtgttagcccatatatggttgagtttttgttactaccggtgttgcagtgtttttctgaacttattttgctgtttctaaatagctgatgattcgctcgtcaaaaaaaaaaaaaaaaaaaaaggc

SEQ ID NO: 15464 - DNA, 1107 bp, Sorghum bicolor
  Clone ID: SORBI-28MAY03-CLUS49_362
agaccaatcacgatatttttttaacgttaacctctgcttacaccagaaggtagtaaaataatatttattttctttggattaggtgttacaagattgaacttgagattcccataggctaattagaaaaccccagaaaatccctggatatcaaatctgtggtcatatttattttctttgggcaccatcaatggacggagcgagctccgagcgtcctcatcctcccgtctataaattcccttccttttcttcctccatatatagggggcgccatccaagccaagaagagggaagagcaccaaggacttcccggcgcccgttcaggatccacatccttcccgagcgagttcttggttgacctcttcctcttcgaccacctcctaggctcttggtgtagcttgccactctcaccaatcaagttttcatgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggtcattcaactccagggtgatcagaggaagaacgtctctaatttccttgtccaggccggcattgtgaagaaggaacacatcaagattcatggtttctgagcaaccgccgggtccatagcaagccctgcatgcaaagcagctatatatctgaggtggagcatatctatctggctgtgtacaagcaggcctactactacgcctgcgcgttctcctatactacacataacacatagccccctccctgcgtgtatgcttgttaccgttgtgtcgaatcttgtacgaggctcccatcgaacttcgatggcttgcttctttatcagaacaagattgaataaacgatatttggtatgctgtgtgtcagaatgctttcgctgaactttgctttcattcagtttctgttgacttgttcacaaaaaaaaaaaaaaaaaaggccccta

SEQ ID NO: 15465 - DNA, 2828 bp, Sorghum bicolor
  Clone ID: SORBI-28MAY03-CLUS49_363
cttttccccttcacagccctgtaccagtagtgtactactatcccccgctaccgctagccgccgcgctgctcctctggtggcggctcgcctccctcctcccccaccccaacccgccgccgccgccgcctcctctcgctccctcctccttaccccgagcttaagctctacctatccgtaggagaggaagaggggagaagggccggtcggtcggtcgggggctctcggatctcgccgctgcctcctcgttccttcgttgggatctcgctcgtcaagcgctatggccgccgtcgcgccgcccccggctcccgcgcccgccgcgcctgcaccggctgctgctgctgctgctgctccggctccggctcctgccaccgtccctgtcgcggatcaaaccacggatctgctgcagaagctgtcgctggatccgcagcccaaggcggcggatgcaacagagcctactgctgctgccaagaagcagggcgctgtgacgagccagccgctaagtgtggccataccgccggagcggtccatcacaccggtgcttcaagactttatggatcccaacctattctatctaccagcgtattactatggaggctacgacagttccatgagcgagtgggatgattatccaagatatctaaattcagatggagtggagattgccccagcagtatatggagatatttatggatatgggtatgctccttatggggcatactctcctgccacttccccagctccaacggttgatggccagatgtttggtgcacagcattaccagtatgccaactgcgtattttcagcctcctacaccagttccttctaccactcaaagtgacctccagtcttctaacaatactgaaaagccagcagctaaagcagatcctgccaagacaactgctaacggtgttccaaatggtactgctcatagtaacagtggaactgtaccccttgcgtcaagccaacaaaattcatcactgacgcctgatggaacttatagggcgccattgctaggtggagttccttctgctggttacctggacatgacatatgggtatgacagcacaggggcacactttgcatggtatgatggctctgcttatgcaaatggtcagcaaagaacaactacaactaatcattatccatcctcaacattcagtggtaatggttcctcagcaagaaatcagaacaagagctccaccacgccgcagatgcagggtatgcagaacagaagacctacaactacatcagcaactcctacttataccaataggatgtaccctagctcccgaccatacacccagtatgggaattcaataaaaactggtcttccctacgggagtaacggttacgattccaggatatatggtcgatggggcgttggtatggataacaggtacaggcctaggggccgtaatggatactatggttatggcaacgagagtcaggatggaacaattgagttaaacagaggtcctagatctggccgtttcaagaaccagaaattgtatggtcatactgtcactattgctgtgaaagggcagagccttccttctggtgaaagcaagaatgatagtgccgtgcccgatagagcacagttcaatagagacgacttccctgttcagtatgatgctgcaaagttcttcgtcatcaagtcgtacagcgaggatgacatccacaagagtgtaaaatacaatgtgtgggcaagcacaaccaatggaaacaagaagcttgatgctgcttatcaagaagctcagtcaaagggctctgcatgccctatattcttgtttttctcagtgaatacaagtggtcagtttgttggtgttgctgaaatgactggtgctgttgattttgagaaaactctggagtattggcagcaggacaagtggaatggttccttctctgttaagtggcatattgtcaaggacgtgcctaacaatattctcaagcacatcatcctagagaacaatgagaacaagcctgtcacgaatagccgtgacacccaggagatacaccttgaacaaggccttcagatgctcaagatcttcaaggatcatgtcagcaagacatccatcctggatgactttaccttctatgagagccgccagaaattgatgcaggataagaggtcgaaacagcagcaggtccaaaagcaggtctgggacagtaggacccccatttctgtcaccagcgagcaacagcaggaagctgctaatgggaagcccaatccgtctgatgtaccaaatggtgtcactgcagaggtgaaggcggtgaaggctcctgcagagaaacccgtcctcgccaatggagtcaccaacggagtaaccaccactcccgctgtttcctatgcagctaaggtggcccaaacagcaacagggaaacccatcctcgccaatggagtcgccaagaccggttagctcgaccgccaccaatgcttccatagctagccgcaagcgaggttggatgtcctgacaactcgactgaggcgcaagggaaaatggtgtgaccaaccaaggcaggctgtggaactggcagcatggcccgaagagcgttgctgctccatctcatcgctactggagagcagttggctagttagcgtttttcctagtttctcttttcgctgtgttctccgtttgaagactcttttctacggtagtatcagaatgccagagacccgtggctggacaaaaggatttttgcgaaggccgtctggttggttgtgtgttgcgtcgtcggggtcgagtataccctgttctgttcgtcgttatattgagtggatctgaatgaaagtgggttagattggagcttttcttcttttcccccccgtc

SEQ ID NO: 15466 - DNA, 2205 bp, Sorghum bicolor
  Clone ID: SORBI-28MAY03-CLUS49_364
gcgaccccaggtcagtcgggaccacccgctgagtttaagcatataaataagcggaggagaagaaacttacaaggattcccctagtaacggcgagcgaaccgggaccagcccagcttgagaatcgggtggcttcgtcacctgaattgtagtctggagaggcgtcctcagcgacggaccgggcccaagttccctggaaagggacgcctgggagggtgagagccccgtccggcccggaccctgccgcaccacgaggcgccgtcaacgagtcgggttgtttgggaatgcagcccaaatcgggcggtaaactccgtccaaggctaaatacaggcgagagaccgatagcgaacaagtaccgcgagggaaagatgaaaaggactttgaaaagagagtcaaagagtgcttgaaattgccgggagggaagcggatgggggctggcgatgcgccccggtcgtatgcggaacggcttctgctggtccgccgatcggctcggggcgtggactgttgtcggccgtgccggcggcctaagcccgggggccctaggtgcctccggtcgccgtcgtcggcacggccggtctccgcgcgccgcaaggcgcgcccctcggggcgctgcgctgcaacggcctgcgagctccccatccgacccgtcttgaaacacggaccaaggagtctgacatgcgtgcgagtcgacgggttctgaaacctgggatgcgcaaggaagctgacgagcgggaggccttcacgggctgcaccgctggccgaccctgatcttctgtgaagggttcgagttggagcacgcctgtcgggacccgaaagatggtgaactatgcctgagcggggcgaagccagaggaaactctggtggaggctcgaagcgatactgacgtgcaaatcgttcgtctgacttgggtataggggcgaaagactaatcgaaccatctagtagctggttccctccgaagtttccctcaggatagctggagcccattacgagttctatcgggtaaagccaatgattagaggcatcgggggcgcaacgccctcgacctattctcaaactttaaataggtagggacggcacggctgctccggtgagccgtgccatggaatcgggagctccaagtgggccatttttggtaagcagaactggcgatgcgggatgaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatgggcgctgaagcgcgcgacccacacccggccatctgggcgaacgccatgccccgatgagtaggagggcgcggcggccgctgcaaaacccggggcgcgagcctgggcggagcggccgtcggtgcagatcttggtggtagtagcaaatattcaaaggagaactttgaaggccgaagaggagaaaggttccatgtgaacggcacttgcacatgggtaagccgatcctaagggacggggtaaccccggcagacagcgcgatctcgcgtgttgcccggctccacgtgctgctccagtgaggaacccaccacagccagcacgccaggctcctcctccagctcctgttcgggatggtggtggctccattcttggaggaattgggtccaccattgctcaaggtatggcatttggtactggtagtgccatggcgcacagggctgttgatgctgtaatgggtccccggaccattcagcatgagactgttgtctcagaggcggctgcttctgcccccgctgctccagcgatgaacactgatgcttgtggcatccattctaaggccttccaagattgtctcaacaactatggcagcgacatcagcaagtgccagttctaccttgacatgctgaacgagtgccgccgtggtggtgtgtctgcctaagcacctctattgggactactcatgggtttttttttaactctcatggtatctcattaataagacaccgtgaaacttgaaccatctgcttgaaacgtatgtaccgtgacatcactggtccatcttgttgaagctatggttataccgtctttcctgggagtggtacattctgttatcccgtattgttggaacagacatctgtatctgtgtctctggtgatcataaatatttgaatgaact

SEQ ID NO: 15467 - DNA, 4204 bp, Sorghum bicolor
  Clone ID: SORBI-28MAY03-CLUS49_365
gcacgagggtcgggaccacccgctgagtttaagcatataaataagcggaggagaagaaacttacaaggattcccctagtaacggcgagcgaaccgggaccagcccagcttgagaatcgggtggcttcgtcacctgaattgtagtctggagaggcgtcctcagcgacggaccgggcccaagttccctggaaagggacgcctgggagggtgagagccccgtccggcccggaccctgccgcaccacgaggcgccgtcaacgagtcgggttgtttgggaatgcagcccaaatcgggcggtaaactccgtccaaggctaaatacaggcgagagaccgatagctggagcccattacgagttctatcgggtaaagccaatgattagaggcatcgggggcgcaacgccctcgacctattctcaaactttaaataggtaggacggcacggctgctccggtgagccgtgccatggaatcgggagctccaagtgggccatttttggtaagcagaactggcgatgcgggatgaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgaacgccatgccccgatgagtaggagggcgcggcggccgctgcaaaacccggggcgcgagcctgggcggagcggccgtcggtgcagatcttggtggtagtagcaaatattcaaatgagaactttgaaggccgaagaggagaaaggttccatgtgaacggcacttgcacatgggtaagccgatcctaagggacggggtaaccccggcagacagcgcgatctcgcgtgttgcccgaaagggaatcgggttaagatttcccgagccgggacgtggcggttgacggcgacgttaggaagtccggagacgccggcggcggcctcgggaagagttatcttttctgcttaacggcctgccaaccctggaatcggttcagccggaggtagggtccagcggtcggaagagcaccgcacgtcgcgcggtgtccggtgcgcccccggcggcccttgaaaatccggaggaccgagtaccgtccacgcccggtcgtactcataaccgcatcaggtctccaaggtgaacagcctctgcgccaatggaacaatgtaggcaagggaagtcggcaaaacggatccgtaacttcgggaaaaggattggctctgagggttgggctcgggggtcccggccccgaacccgtcggctgccggcggactgctcgagctgctcacgcggcgagagcgggccgccgcggtgccggccgggggacggaccgggaacggttccttcgggggccttccccgggcgtcgaacaaccgactcagaactggtacggacaaggggaatccgactgtttaattaaaacaaagcattgcgatggtccccacggatgctgacgcaatgtgatttctgcccagtgctctgaatgtcaaagggaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagccctcgggcgcaagtgaaataccactacttttaacgttattttaattattccgtgggtcggaagcggggcatcgcccctccttttggctctaaggcccggccttgccgggccgatccgggcggaagacattgtcaggtggggagtttggctggggcggcacatctgttaaaagataacgcaggtgtcctaagatgagctcaacgagaacagaaatctcgtgtggaacaaaaggattgattcaggtttgtagatcaattggtgatgcttatctcaaaaagcaagagttcaacagggaacccctatatgcaaaattccgcctccgtgaaccttttaacaagccaatactaagttcagaaccatcaatatgtgtgcaaccgctacacccacacgaccagtttccccttttcctctgctattttctctctcccccttcgtccagacccagaaggagagggagacagagaggagacgaggagcagcagcgtggcgacgcccaaatcgagcgacctgatcgaggcccctcgcccctactcgcttaatcccaatccgagcccgccaattgggcgtcccgcccacgcaaaggacactgggaagaaaactactggcgtgctgacaaatccaactgcggttttcttggactacagatgaagcgggctcgaaggcgtgtgtgcaagagatgactgatgagggatgctagtgacattgatgaacttgttgcgggcgtgctggcgaccatcgaaccggcatgcccgaacaggctcagatgttaccggtaggcaggatggacttctatggtacaaggacgccgggcagcatgtcaatggggagttctccatggctgttgttcaggccaataacttacttgaggaccagtgtcagatcgagtcgggcccactgagttttctagattctggaccatatggcactttcgttggcgtttacgatggtcatgctggtgctgagacggcctgctatatcaatgagcatctcttccagaatctgaaaagatttgcatctgagcagaatgcaatgtctgctgatgtactgaagaaggcgtatgaagctacagaagatggattcttctctgttgttaccaaacaatggcctataaagcctcagatagcagctgtcggctcatgctgcctggtcggtgtaatttgtggcggcgtgctttatgttgccaatgttggggattcccgtgccgttttaggaagacatgttaaggccactggagaagttttggctgtccaactgtcagcagagcataatgtaagtattgagtcagtcagaaaagaactgcagtcaatgcacccagaagataggcacattgttgttctcaagcacaatgtttggcgtgtaaaaggattgattcaggtttgtagatcaattggtgatgcttatctcaaaaagcaagagttcaacagggaacccctatatgcaaaattccgcctccgtgaaccttttaacaagccaatactaagttcagaaccatcaatatgtgtgcaaccactacaaccacacgaccagtttctcatatttgcatctgatggactttgggagcacttaaccaaccaagaggctgttgatattgttcacagtagcccccgcagtggctgtgctaggaggctgataagagccgcactgcaagaggcagccaagaaaagagagatgagatactcggacctcaagaagatcgatcgcggtgttcgccgtcacttccacgacgacataacagtcatagtagtgttccttgactccagcctcgtaagtagggcgagcacgcaccgaggtcccactctttccctgcgaggtggtggcgccagcgctggcctgcgcagcaacacgcttgcacctacgtgactgtaaagtgcctggtggagaggaggctacagccctgactggaggaggttttctttcctcgtgtcgactgtgttatatatgtacttgtaccggccaagatcatccatcccccctcaatggtgtaaaggagaggcgcggaagctcctccccagtgtctttgaatgccctaaatggtgtcaaggtgtggactcaagttgatagctcgtcgctgttcttctgatgatgctctgtggaaagctcaaatcctttccacctgaaaaacaagtaatatgtcttccagtgctggaattaaccctagtgcatatatatatatatgaaataataataagccaaaaggaggagtaacttatttaactgatgctgtaaggtgtatggtatgttttgtatgtgtactgttttttactgctactgcatctactgttgttaattgaccgctggtaaagtgaaatcagtgatttggtctcactattatcagttgttcccagtattactgatttgactttcctcctc

SEQ ID NO: 15468 - DNA, 965 bp, Sorghum bicolor
  Clone ID: SORBI-28MAY03-CLUS49_366
gtgcggcgctcgagccggcctgctcggggtgctctctcagaggtgggttggcttctcctccccctcttaccaagtcctcgtcctcggtttagggttcgttagggtttttgtggaggggagatatggcggcggcggacgtggagtaccgttgcttcgtcggtgggctcgcctgggccaccaacaacgagaccctcgagcaagccttcgccaacttcggccaggtcatcgactccaaggtcatcaccgaccgggagacggggaggtcccgcgggttcggcttcgtcaccttctcctctgagcagtccatgctcgacgccatcgagaacatgaacggcaaggagctcgacggccgcaacatcaccgtcaaccaggcccagtcccgcggcggaggcggcggcggcggtggctacggaggcggtggcggcggctacggcggccgccgtgagggtggcggctacggaggaggcggcggcggctacggcgggcgccgcgagggaggaggcggctacggaggcggtggctacggtggcggcggcggcggctacggcggtcgccgtgagggcggcggcggctatggcggcggcggcggctacggtggcaaccgcggtgactccggcggcaactggaggaactgattgtgtgggcccaccctggcttcggccaagttatcctagctatctatctatctatctaatagtatcgtgttaccgttccgttggattctgagttacccatgtgttagtgtccgttgaacctttggattaggtgttggtacccccgtgttcgatgatgttactgtccgctttggttactttccgctatgaaatgagagaagagtgagcaaggtttttgttcgcatctactgatctgaaattgctctgttaccgtgtttgattgagctcgttaataactttggctgcggctttagtgctatacaaatatctgctgcctgaaattgctctgtt

SEQ ID NO: 15469 - DNA, 2146 bp, Sorghum bicolor
  Clone ID: SORBI-28MAY03-CLUS49_367
cttcagccgcacgcttcttgttgccaaagaattccctccccctagccgccgccgccgccgctcgtgtcgccgagagaaggtgacgagaccgaggaactcgccgagttcttggtagagaatcggttttgcttgtctcagcccggggtctgctgcgtcgggtggtggtgaaggggggaaattcgtgagatctgttccggatcacgcgtgcgcgctcgggaatcggggttcctcacatagcttcgtcgatttgaatttgatgtactaatggagtctaagggtggcaagaagtctagcagtagtcgttcaatgatgtatgaagctccccttggctacagcattgaggatgttcgacctgcccggaggcgtgaagaagttccagtctgctgcttactccaactgcgcaaagaagccatcctgatatcccttctggtttacttgttcttgtagtttaggatttcttttctgacactttgattctgaccaatccctctggcctgctgcttcctgataatcgaccagttccccagtcttgctccctgcactcctccctccaccgtcttcatctccagcattgtgttctgattcacctgctccaatggctgttctttctgctgctgatgctcccccggtctcagctatcgggtttgagggctatgagaagcgccttgagatcacattctctgaggcacctgtctttgccgaccctcatgggcgtggtttgcgtgccctctccagggcccagattgactctgttctggatcttgcacggtgcacaattgtgtccgagctctccaacaaggattttgactcctatgtcctctctgagtcaagcttgtttatctatcctctgaagattgtcatcaagacctgtggcactaccaagctcctgctcaccattccaaggatacttgagcttgctgaagagctgtctatgccacttgctgctgtgaagtactcccgtgggacgttcatctttcccggtgcacagccagctcctcacaggagcttctctgaggaagttgctgcgcttaaccgctactttggtggcctgaaatctggtggtaatgcttatgtgattggagatccagcaagacctggacagaagtggcacatctactacgccaccgagtacccagagcaaccagtggttaaccttgagatgtgcatgactggtctggacaagaagaaagcttcagtctttttcaagactaatgctgatggtaacacaacatgtgccaaggaaatgacgaagctctctggtatatctgaaattatccctgagatggagatctgtgattttgactttgaaccctgtggctactccatgaatgcgatccatggctctgcattctcaacaatccatgtgacgcctgaggatggtttcagctacgccagttatgaggttatgggctttgatgccactgctctgtcttatggtgacctcgtcaagagggtccttaggtgctttggccccttggaattttctgttgctgtgaccatcttcggcgggcgtggccaagctgggacgtggggaaagcaacttggtgcagaggtttatgactgtaacaacatggtggagcaggagctgcctggtggcggactcctcatctaccagagcttctgtgctgctgaagacgctgttgctacctcgcccaaatctgttcttcactgcttcgaaggtgtgaacatggagaatgctcctcctgtgaaggaccgcaaactggctaatcttctctgctgggaggaagtggatgccatggaggagaaggatggagtgcttgatgagtaagatgggcttctggtgtcgatttgcttctgagttgttttttttatctttgcaatttcgttgtcgtcgtttggttattctgtgaagcagccaagccaggctattagagtatgaaaaatgtcgtctgtaagcatgttttcctatgttgccacatgctgaatcaatttgaataagtattaatacagctctaggtggtcagctgcgtctaccacaatgagcatatatgtatggagaaatgtctgtccaagcattttatttaagaataataattttttttcgagttaaaaaaaaaaaaaaaaaactcgagactagttctctctcgctctagtcccattccaagtccccgctcccggattcccg

SEQ ID NO: 15470 - DNA, 2030 bp, Sorghum bicolor
  Clone ID: SORBI-28MAY03-CLUS1789_1
gccggacgcgtctacaacaatgcacaaaaaaatagcctctggatgtaagccacactcatctacacactgcacacttcactagccgaatcacaataatggatcccaccaagttccgtccgtcgagcagccacgacacgacggtgacgacgacgaacgccggagcgccggtgtggaacgacaacgaggcgctgacggtgggcccgcgcgggccgatcctgctggaggactaccacctgatcgagaaggtggcgcacttcgcccgggagcgcatcccggagcgcgtcgtccacgcgcgcggcgcctccgccaagggcttcttcgagtgcacccacgacgtggcgtcgctgacctgcgccgacttcctccgctccccgggcgtccggacccccgtcatcgtccgcttctccacggtgatccacgagcgcggctcgccggagacgatccgcgacccgcgcgggttcgccgtcaagttctacaccagggagggcaactgggacctcctcggcaacaacttccccgtcttcttcatccgcgacgggatcaagttccccgacgtgatccacgcgttcaagcccaacccgagatcgcatgtgcaggagtactggcgcgtgttcgatttcctgtcgcatctccccgagagcctccacaccttcttcttcctcttcgacgacgtcggcgtgccgacggactaccctcaccgacgaggaagcggcgttggtcggcgggaggaaccacagccacgccacgcaggacctctacgactccatcgccgccggcagcttcccggagtggaagctgttcgtgcaggtgatggacccggacacggaggaccagtacgatttcgacccgctcgacgacaccaagacatggccggaggatctgctgccactccagcccgtggggaggctggtgctggacaagaacgtggacaatttcttcaacgagaacgagcagctggcgttcggaccggggctggtggtgccggggatctactactccgacgacaagatgctgcagtgccgggtgttcgcgtacgccgacacgcagcgctacaggctggggcccaactacctgatgctcccggtgaacgcgccgcgatgcgcgcaccataacaaccactacgacggcgccatgaacttcatgcaccgggacgaggaggtggactactacccgtccaggcacgcgccgctccggcaggcgccgccggtgccgatcccggcgaggccggtggtggggaagaggcagaaggagaccatacggaagccgaatgatttcaagcagcctggggagaggtaccggagctgggacgccgatcggcaggagaggtttgtgcggcggtttgctgactcgctggggcatccaaaggttagccaggagctcaggtccatctggatcgacctcctctcaaagtgcgacgcatcgctggggatgaagattgccacacggctcaacatgaagccaaacatgtgagtgatatgatggcgaggatggagctgcagctggctgctactgctactgctagtagtgaacgaagtgaatatgaataagagtgtggttgagtgaggcgtgtccgagttgttcttcagtactaatcgtccaccgccgttcgtctttcgtcctttccttaccttgtcattgtcgtcaagtcaagaatcaagaaataagaagagcagcatgagcatgagacatacgtatacatgtcaagagctagtagactacgacaaaactgcacatgcgcatcagatggatgcatatcctcagcccaaactatagtccgtgtacgcgtgtccggatttgtctgtaacaatgcaagccaagcgaaatggctctctgttttcgttatcattacatgcatgtaccttgctacctgaacctgaatatgtatcgagttatcaaataaaagcagcaaaagttatattgcatcaaaaaaaaaaaaaaaaaaaaaaaactcgagactagttctctcccaacgctcggtcgatcaactgattagcttggcggtgtaaccctgtcgtgggcgatgagctcct

SEQ ID NO: 15471 - DNA, 774 bp, Sorghum bicolor
  Clone ID: SORBI-28MAY03-CLUS3050_3
ccgggatcaatccggcgaggagcctcggcgccgccgtcgtgtacaacaacagcaaggcctggagcgaccagtggatcttttgggtgggtccgttcatcggcgcggcgatcgcagcgctctaccaccagatcgtcctccgcgccagcggcaggggttacggctcccgctccttccggagctacgcctagggggacctcgtcttggtcagcttccacggctattccaggctgatcagttggtgttgtggtgtagcgagtggaagcttcgagctttttttttccccccgtttgcttgctgcgcaagaagaagggggacgagagaggagggcggcgatggcgaagaggctgctcccgtcgctgaaccgggtgctggtggagaagctggtgcagcccaagaagaccgcaggcggcatcctcctcccggaaacatccaagcagctgaatgctgctaaggtggtggctgttggccctggtgagcgcgacaaggcaggcaatctgatcccagttgctctgaaggaaggcgacactgttcttctgcctgagtatggtggaactgaagtcaagcttgcggctgataaagagtacctcctcctcagagagcacgacattttgggcacacttgttgactgattcgcgagcttgtcactagtcttcggttgaagtgtgagatgcttaggatctgatgctggcaaaatcgacgagaaagaactctgaactgtcgtgatgccatagagtttgtggtgaaacatcataaggataaaacttgttgcttacg

SEQ ID NO: 15472 - DNA, 2653 bp, Sorghum bicolor
  Clone ID: SORBI-28MAY03-CLUS3050_1
gccccctggcccacgcggacgccccacgcgccacgctctcatccattcccattccttgcaagcgtagccacctctcccactacactctctcgcagctgctaagcgaagcgatgggcacaggacgacgtgatcgagagcggcgccggcggcggcgagttcgctgccaaggactacacgggacccaccgccagcgccactgatcgacgcggcggagctgggttcctggtcgctgtaccgcgccgtgatcgccgagttcatcgcgacgctgctgttcctgtcacatcaccgtcgccaccgtgatcgggcacaagcacccgacggacgcgacggcgtcggtcgccgacgccgcgtgcggcggcgtgggcgtgctgggcatcgcgtgggcgttcggcggcatgatcttcgtcctcgtctactgcacggcggggatcgccggcggccacatcaacccggccgtcaccttcggcgtgttcctgtcgcgcaaggtctccctggtgcgcgcgctgcgctacatcgtgcacctcaaacacagcggcatcggccacaccgtctgtttcttcctgaaaaaacgtacagatatgattgagacatacagacacacggacacgtacgctggtgacactctacatacaacacgtaacaatagcatgtgcttccgcaccgggatatggccggtgggcacgccacacacacacacactcacacctaccagtcgttcgttcttatccgccagtttattacaccgcgatcgcgacagcgacgtcgttgccgccgttgaccgtgccgttcgcggcgccgtggccgccgttggccaccaccgccagcttaccgccgccggtgttgtcggtggcggagtcgtgggaggagatgaagcggccggaagggtcgttggaggccttccactgctccacccactcgatggccgcgggcgtgctgcaggcgatgctcggggccccacggcaccgtctccctcgccgagtcctgagggaacagcctctcgaatatcatccggtagtagtaggcctccttgttgacgtgtgcgttggacgggaccgtgtgggtagcttttcgcgtcatagcatctgtgacctgctgttcagtcaacttgttgtgacgatggtttggttgctcttgttccagcagctgcatttgtcgtgcgtggattttggtttcggtttcccatgtaatgatcaaccatcatcatcatcatgtgtcgtaatctgctgtccaagggattccgtctcctcctttcctctcctgctcttctagcctctactatttttctatttaattattgttattattatgtagcgacaagcatcatcaatcatcatcagtgagaacctcttgcttctgtctcgcaggcagtcgtactggtgcagggctttcaccttgcggcaggtctccttgtggaactcctccttgttgggagcgaagtggaagtagaggtagccgccgaggagctcgtcggagccctcaccggacagcaccatcttcacccccagcgacttgatcttgcgagccatcaggaacatgggcgtgctggcacggatcgtcgtcacgtcgtaggtctcgtcgtggtagatcacctcctcgatcgcgtcgatgccgtcctgtacggtgaaatggaactcgtgatggatggttccgaggtagtcggcgacctctcgtgcggccttgaggtcaggggagccctcgaggccgacgacaaaggagtggagctcggtcccgaacttctcggcggcctccgtcttgacgaggtggcgcttggtcacggaggcgacgagggaggagtcgagcccgccggagaggaggaccccgaacgggacgtcagtcatgagcctcttgataaccgccttctcgaaggcgtctctgaggacgagcggctggtacggcgccgtccggggcacctgctcctggaaccactgcgggttgtaccaccgccggaacccgccggcggcgctggagtagaggtggcccggcgggaagatctcgaaccgcacgcagtcctcgttcagggccttcatctcggacgagatccagacggaaccgtcactgccccagccgatgtagagcgggttcacgccgatggcgtcgcgcgctgccacgtaggtcctgtcgcgggtgtcgtagagcacgaacgcgaagactccgtccagcatgtcgacgaagttctcgccgtacttctcgtacagggggatgatgacctcgcagtcactgcccgtggtgaagttgtgcgtgccggtgaactgcttccggatgttcttgtggttgtagatctctccattggccacgacgacgacggtgcggtcctcgttgaacagcggctggtcgccggacaggggggagacgatggcgagccgctgctgcgccaggaagttgccctcgtgctggtagaggccggaccagtcggggcccctgtgcttcagccttctggcgcaggcgaggacgcgagccctcctggcctgagaccagtcggaacatccgagcacggcgaggatgccacacatgatgccgccggacagggggaggaagggagaaacgcgtgcagcaattaagcagctactagctttctgtgggagggagggagacgagacgagacggtgggtgctcgtgctgctgcctgctgggatgcagttttttgtttttcctg

SEQ ID NO: 15473 - DNA, 816 bp, Sorghum bicolor
  unsure (1)..(816): unsure at all n locations
  Clone ID: LIB5049-012-R1-XP1-H9
gccggccgggtcgggctcactccccccacctcacgctctcatccattcccattccttgcaagcgtagccacctctcccactcactctctcgcagctgctaagcgaagccatgggcaaggacgacgtgatcgagagcggcgccgccggcggcgagttcgctgccaaggactacacggacccaccgccagctccactgatcgacgcggcggagctgggttcctggtcgctgtaccgcgccgtgatcgccgagttcatcgcgacgctgctgttcctgtacatcaccgtcgccaccgtgatcgggtacaagcaccagacggacgcgacggcgtcgggcgccgacgccgcgtgcggcggcgtgggcgtgctgggcatcgcgtgggcgttcggcggcatgatcttcgtcctcgtctactgcacggcggggatctccggcggccacatcaacccggccgtcaccttcggcctgttcctggcgcgcaaggtctccctggtgcgcgcgctgctctacatcgtggcgcagtgcctgggcgccatctgcggcgtcggcctcgtcaaggcgttccagagcgcctacttcgacaggtacggcggcggcgccaactcgctcgcctccggctactcacgcggcaccgggctcggcgccgagatcatcggcaccttcgtgctcgtctacaccgtcttctccgccaccgaccccaagcgcaacgcccgcgactcccacgtcccggttctggctcccctccccatncgcttcgccgtgttcatggtgcacctggccaccatccccgtcaccggcaacggcatcaacccggccag

SEQ ID NO: 15474 - DNA, 503 bp, Sorghum bicolor
  Clone ID: LIB3476-051-P1-K1-H12
cccacgcgtccggcggcggcgagttcgctgccaaggactacacggacccaccgccagctccactgatcgacgcggcggagctgggttcctggtcgctgtaccgcgccgtgatcgccgagttcatcgcgacgctgctgttcctgtacatcaccgtcgccaccgtgatcgggtacaagcaccagacggacgcgacggcgtcgggcgccgacgccgcgtgcggcggcgtgggcgtgctgggcatcgcgtgggcgttcggcggcatgatcttcgtcctcgtctactgcactggtgcgcgcgctgctctacatcgtggcgcagtgcctgggcgccatctgcggcgtcggcctcgtcaaggcgttccagagcgcctacttcgacaggtacggcggcggcgccaactcgctcgcctccggctactcacgcggcaccgggctcggcgccagatcatcggcaccttcgtgctcgtctacaccgtcttctccgccaccgaccccaagcgcaac

SEQ ID NO: 15475 - DNA, 379 bp, Sorghum bicolor
  Clone ID: LIB3481-017-P1-K1-E11
cgtccgctcccactcactctctcgcagctgctaagcgaagccatgggcaaggacgacgtgatcgccgagttcatcgcgacgctgctgttcctgtgacatcaccgtcgccaccgagatcgggtacaagcaccagacggacgcgacggcgtcgggcgccgacgccgcgtgcggcggcgtgggcgtgctgggcatcgcgtgggcggtgctcctcgcggcctacgccgacgcggtctacggtgttccacctcggcggagacgagagcggactatgaaggggcgtgctctgctgtgcagttggagcggtcctgggtcttagacaacccgtctctttgaggactgtcattagaggaagatcaaggggtgcgcttaagggaaaaca

SEQ ID NO: 15476 - DNA, 1133 bp, Sorghum bicolor
  Clone ID: SORBI-28MAY03-CLUS1051_3
aaagaaaagcagtgttgtgccgcttgagtccaaacccttgaagaaaaccactggaattagtcagagcattggttctggtactgtgaagagtaaggtaccccaacttgatgactcctcaaaagatagtggaagtgttaaccaagctgaagataaggagcaatctcctatgacaaccgagccaactaccaaggtactggaggctgatcttgctcaaccagcacatgatgttgatgaaaatttagaaatttcgctcgataatgatttgaatattgaaaaaacagagaaaccggcctcgagtttaactgcaacaaaaaatggactccagtgtccatgttgtaccctctaccgatgaggtagatgaggccatacaacctcctgacgatgacatgggcatctcatcagctgcttgggtagaagtagagcatcaagaactagaagtcactgattcgggtgaaaatgtagtcgctgaggatgtaacttccccaggaattgcaccattgccatcatcaagcccaagagtgcgtcattcgttgtcacaaatgctgcaagcagatagcaatgaaccagaaattattgagtggggaaatgctgaaaacccacccgcaatagtttttcataaggattctccaaaaggattcaagaggcttctaaagtttgctcgtaaaaataagggagataataatgctaacggctgggcaagcccctcagtggtttctgaaggagaagatgaactagaagaaccaagaggcactagtgatagtgcaaattcgagcaggagaacttttgatggttcaaagactaatagcatcttatcagctcaatcaactaccggcagcttcaactctatgaactcggataagctacgggagagacctggagctgccacatcaaccaaagcatcaaggtcgttcttctccctctcaaacttccggagcagcagatcaaacgagtcgaagcttcgatagtgtatgccttgtttgcccagcggttacatggatatctccgctccattcaggacgtctagtagatgtaaaaatggtttgagatttgattgttcggacggagccaagcttgtgtgtttggctctagtcgccttgacgttggtatagcttctgtctatgagatgccatact

SEQ ID NO: 15477 - DNA, 614 bp, Sorghum bicolor
  unsure (1)..(614): unsure at all n locations
  Clone ID: SORBI-28MAY03-CLUS1051_2
agatatatagatcgcatatatatgcatgctggcgagccagatcgaaatacatagcagatagctagctcgtccttattgttcaaccatcagttacatacgtcacacacaataacacaattgcagagcactacatgtagtgtagtagctagtagtaccgtacgtcgccggcacaagatcgatgtcaccatcaaataagcagcagcatgcatatcgtcggtcttcgttccccatgtgtggtcgtcggtcgatcagcagttgcaggggttgcacttgcagctgtcaccgcagccgcagccgtgggaggtctcggcgccggactccgccgcggcctcgaactcggcagcagctgtcttctccggggcgacacccaggacgacggtggcctgcgccgcggtgctcttctcctccaggtcggggtacttcttgccgcacttgcagcttgagccgcagttgcagcttgatccgcagccgcaagacatcctgcttgtcttttggtgcaaaaacgaagaagctcaagaacaaatatnatcaaagggcgttgtcaaagtcgctttggttgagcttttttattttttctggcctccctcccgccgcgcggcctgagcgccgcacag

SEQ ID NO: 15478 - DNA, 2228 bp, Sorghum bicolor
  Clone ID: SORBI-28MAY03-CLUS1051_1
acaccgtcccagcttcctaagactatttgcgctccctgcatcagcaaaagacgggcacaaacacaaaacgcatgcacattactcatagcgagacagctagaaatacaatacggctacgaagcaagtcaaataaaccataccagttttatatataaatcaccctggacgaaatcatatcgtcattacgtacagagacacatagagatcgatgtatgagcacaagatggatacacagtacacacacatgcacataattaaatgcaagagcacaagactgacgccaaggccaataagcaaaagaggtatactctctctctcgatcaggcacacaagggcagatatatagatcgcatatatatgcatgctggcgagccagatcgaaatacatagcagatagctagctcgtccttattgttcaaccatcagttacatacgtcacacacaataacacaattgcagagcactacatgtagtgtagtagctagtagtaccgtacgtcgccggcacaagatcgatatcaccatcaaataagcagcagcatgcatatcgtcggtcttcgttccccatgtgtggtcgtcggtcgatcagcagttgcaggggttgcacttgcagctgtcaccgcagctgcagccgtgggaggtctcggcgccggactccgccgcggcctcgaactcggcagcagctgtcttctccggggcgacacccaggacgacggtggcctgcgccgcggtgctcttctcctccaggtcggggtacttcttgccgcacttgcagcttgagccgcagttgcagcttgatccgcagctgcaagacatcctgcttgtcttttggtgcaaaaacgaagaagctcaagaacaaatatctatcaaagggcgttgtacaaagtcgctttggttgagcttcccgtccgggaagaaactgcaactttattacgtgataatagctctgtagcgagtacaaaacgaacgtaaaacagcagcaagagtgcagaaccctgctccttggaggaagtacatctgatctgaatctcactagagcagagcagagcatccagcccacacacccaaacacacggcggcgaccacaggccgctctatctccttgtttgtaatggcaatctcccgtcggtcgtccgaccccagaggatccagcttcacaatcacaacacatcgcacagcgaccaaccgagagaaagaccaccctgctgctctccacgaccatgccgggcgtcacagagcgcgcgcggcgcgacgacgccgttcgccagacgacgaaccctgacacccccctgcacctcttcccaccctggtactggtaggtatacatacggtacgtcatacgagacgaggcggcggagcgggggggtcagggaggcgggggccgttcaggcccgggcgtaggagcgggcgaggtgcgcggcgcggaggtcggcggggtcgacggcggcggcccagttggcggggcggtagtggcccgtgacggggtcgggcacccacgagatctcggagctggcagcggcgcgcccgccggcctccctggcctcgcccgcaccagccgcgccctccgccgcggccgccgcgcgcctcatggccccggacgccgccgacgccgcgtagcccctgatgctggctgccctgggtgccagcgacgcgagcacggcgcgcgcggaggagagagcgacgagagccatcggaccagctgctggcctttctgctgcttgggcaggcaagcaaaaggatcggacggctggctgtggctggctggtggcgctctgctgctctctcccgtgctctgctttgcgctcgtgcccagtttcttccgtgcccgggcgaggtcccccaccccctcccctgcgccgggggcgctggcgcgggcacgtgctcctctggctctggttccttttccttctcttgctcttgcttcttcctctgtcaccgtcaccttggggttgccccctctccacgtgtgctctggccgcttctaggttctccactgcacgctttacacatggctacgagccggccctgcagaccgtcggtgtgtcgtcatcgataaccatatagctgtgtgaggttgaaaagttctaaaccttttaccgttgaggagaatggttttggcatacgaacaggcacaaggccacacagcgaagacattgccatcagatcgaccagtcttgtgtgttgaagccccatgggagccttgtttggcgcctctctgcacattggaac

SEQ ID NO: 15479 - DNA, 1425 bp, Sorghum bicolor
  Clone ID: SORBI-28MAY03-CLUS2186_1
agtttttgcgtgcgttcagtgacgtgggtatggaataataatgttttttccgtcccctactggatcggtgccattcgcggtagatcgtgagtcgcgctcgtctcgtgagagctagcagcgagggggtgcattccatttccatatggcttcctccaggatcccactcctgtgcctccttggcttgctgctagtagcttctcccgcaattgctgatgactcctccggtatctactaccagcttgctcttctgtggccaggagcatactgcgagcagaccaacgctggatgctgcaagccgacgaccggcgtctcgccggcgcgcgacttctacataacgggcctcaccgtctacaacgcgaccaccaacgctgcactgacggagtgcagcaatcaagctccttacaaccctaacctgattaccggcatcggcctggagcagtactggatcaacatcaagtgccccgccaacaacggccagagaagctggaagaacgcctggaagaaggccggcgcctgctccggcctcgacgagaaagcctacttcgagaaggccctctccttccgtagcaagatcaaccccctcgttcgcctaaaacaaaatggtatcgaggatgacttcgagctctacgggttgaaggcgatcaagaaggtgttcaagagcgggatcaacgcggagccggtgatccagtgcagcaaggggcccttcgacaagtacatgctgtaccagctctacttctgcgcgaacggcaacgggacgttcatcgactgccccgcgccggccaagtacacctgctccaattccgtcctcttccacccctacaagaagtggatgctcaagcagcagctcagcgacgagtccgccgacttctacgattcagccgaccctttcgtgctgcctggcctcgccatggacaactgatctctgatgcgatcgtcgatccctctgcattttcgtgagtttgcgtttcgtcgtcgccggagccaccgcccgccgacgatccatcatccatgatctacctcgtctttaatttcgtgagtttttgcgtgcgttcagtgacgtgcgtatggaataataatgttttctgccttgatcctcactcgctcgatctgggcaatgcacggtgatgcccagcgaataagtgtggcggctttgtttattcgaccttttttccacctgtatattaaggaaataaaccttgagagctacccggtggcctttccaatcgtctattctatttctatttcctataatattaaagagcgaaatgtttctttgttcataatcattatattatattctttggggatccatggaatcaatgtcgctctcctgtgcctatacatgtaagagtagtgtaatacgagtaagagaagtgtattagtccaattccaaaagaattgaaatacaaattgtttccatggtcc

SEQ ID NO: 15480 - DNA, 646 bp, Sorghum bicolor
  Clone ID: SORBI-28MAY03-CLUS59_4
taaggggcttttttttttttttttcagcatcagcttcaatgtgaagcatagcgatcggtgtgctcttcaacacagcaggacgctgtttctctgatgatttacagaaacaggccagataaaccagcaccaacaggcagattttttatttttgttaggggccttttttttttttttgctttttcaaacacaggaattacttaacaggtaggtagataggtaggtcgatattagcagcaaataaagctccatcataataggttcacaaaacagaccgagttgtcttagtgcaaaactctggatataactagaaccacgatagcctactgaagtgcaggtttccgagacaagccaattgacagatggcaaactgtgacagaacaccaggttcacgcctctccatgagcaaacgcatccgaagaaatgtatgtactcaagcatgccatcacgtccaccatccatctccaccagcttacttagatctctgcctcatctttcggcgcttcctcttcagcctcctcatgcgcttcttcttccacttggccctcatggtcgcctcctcgcgtgctctccttggcgcgtctcctcctcctgcggcggcggcggcggcgggttcacgataggggaggggaatcccggcccggccggc

SEQ ID NO: 15481 - DNA, 950 bp, Sorghum bicolor
  unsure (1)..(950): unsure at all n locations
  Clone ID: SORBI-28MAY03-CLUS59_3
gccggcgccgggctgctcgcggccgtcgtcatattcggacggttcaccggggccccgcctcggcctctccccctttcccagggccgccgcgtccgctccgtcccccacctcgcagtgcctccccaccgcccctcggcgccggccggccacgccccgatccagatccaggattcaaacaaaccagtacattaccaccatggttcttgattcattatcatctcctcacaggaggtcccaaaacacatccttcgtatcatctgcaaaaaagcctcagtcatctcgtgatgacagttggtctgcactggttgagcggcaccggttcctcctgacaacacttcttgtgcttgccttcctgtgcactatctatctgtactttgcagtaaccttgggggcatcagatgcttgcattggattggcaggggcagagaggattgagtgccaggcaagatcagtgctgcaacatggaaagttgaaattccgctgactttggagactcgttgatggaagaccaaattattgagttttatatgcactctggtcacaggtcttattcttcataccatgaatctgtatatttttggtggtgggtggtttgtattcacgctgatgttattggaccacaaatttactgtactggtagaggcaaatctaatagtgacagtgttgagtttgtggaaactggtatactggggtaggcctatatcgttcttttattaccatggtgtgctaaaaacatcatggcgcctgtaattcgtccaggagatcttggtattgtctcccgtgtgacatgtgactcacagttaatttgatactgtgctacctgagtacgctttgatcccttgattttggtagtgttcatcctaatttattaataatcaactgttcactgaagtttgnttnnnnnnnnnnnnnnnnnnnnnnnnnnnnnnnnnnnnnnnnnnnnnnnnnnn

SEQ ID NO: 15482 - DNA, 1441 bp, Sorghum bicolor
  unsure (1)..(1441): unsure at all n locations
  Clone ID: SORBI-28MAY03-CLUS59_2
gcacgcgcgcgcgccagaccgagaaacacgacggacgagcacacaagcacagctctagcttagcttagggagaatcttggtcttgagagaaattattaactaaccaccaaattaaagccgtgcagcatggagtacggtcagcagggacagcacggccacggcaccaccggccgtgtcgaccagtacggcaaccctgtcggcgccggaaccggtggcatggggaccgggaccggcggcatggggcagctgggtgagcacggcggcgctggcatgggtggcgggcagttccagccagcgagggaggagcataagaccggcggcatcctgcatcgctccggcagctccagctccagctcgtctgaggacgacggcatgggcggaaggaggaagaagggaatcaaggagaagatcaaggagaagctgcccggaggccacaaggacaaccagcacgccacggcgaccggcggcggcgccgcctacgggcagcaagaacacaccggcgccggaacctacggtaccgagggcaccggcgagaagaaaggcatcatggacaagatcaaggagaagctgcccggacagcactaatcgtccgtggctgcgttggctctctctggcgtgtgaaagccgtacttaatcactgtcgtcataataggatgatgagtccatgaataagtgtcccttatgtcgtgacatgcacggggacagtttatacttttgttgtgtggtgtgacttgcgagtgagagtttgtacgtacgaaacttgggtctgtgtactgtttacgctgcatcgtttgtcttcctgaaagtatatacagtacagcatgtgagtggctttatgagagtaattgtagttaatctgcagtgttacacggcaatgcaaaaacaaaagttcttgtgcttgctttcctgtgcactatctatcaatactttgcagtaaccttgggggcatcagatgcttgcattggattggcaggggcagagaggattgagtgccaggcaagatcagtgctgcaacatggaaagttgaaattccgctgactttggagactcgttgatggaagaccaaattattgagttttatatgcactctggtcacaggtcttattcttcataccatgaatctgtatatttttggtggtgggtggtttgtattcacgctgatgttattggaccacaaatttactgtactggtagaggcaaatctaatagtgacagtgttgagtttgtggaaactggtatactggggtaggcctatatcgttcttttattaccatggtgtgctaaaaacatcatggcgcctgtaattcgtccaggagatcttggtattgtctcccgtgtgacatgtgactcacagttaatttgatactgtgctacctgagtacgctttgatcccttaaaaaaaaaaatnaaataaaaaataatataatttattatataaata

SEQ ID NO: 15483 - DNA, 844 bp, Sorghum bicolor
  Clone ID: SORBI-28MAY03-CLUS59_1
gccggccgggtctgggaaaacccccgcagccagcaaccgaagagaggaggagggggggtctcttctccagttctcctttgcttgcgcctcccgtctgcgtgcgtgcgatcgacgcagaggcgggcgcgggcgctcgcaccaccccgatccgatggccttcatgcgctcccactcaaatgcatcttccggcatgggagttgctcctaacattagggagacatttgtcgagctccaaatgaagaaggcataccgatatgtcatcttcaaaatcgaagagaagcagaagcaggtggttgtggagaagacaggggctactactgaaagctatgatgactttttggcctctctcccagagaatgactgccgatatgctctctatgattttgattttgttactggggagaacgtgcagaaaagcaagattttcttcattgcctggtccccatcgacatcccgcatccgtgctaagatgctgtactccacctcaaaggaccgcatcaagcacgagctcgacgggttccactacgagatccaggcgaccgacccgacagaggtggacattgaggttctccgggagcgggctcactgaagctggttcgcctttgaagggacctgtggagggccgtgaaccttcggtcagatgcaaactctattatgaaatgatgaagctcccaccgtggtatttgttaataagttcctgtaagcatatcatttagtcgcgatgcatgactctagctggtgaagcgttattgaaagctgtatcggtatgaggtttggttgtcgatactgtaaacgaagcaagatttgcaaacttgttatattgtggtattgattatactggatt

SEQ ID NO: 15484 - DNA, 494 bp, Sorghum bicolor
  unsure (1)..(494): unsure at all n locations
  Clone ID: LIB5051-011-A1-XP1-F12
gccggccgggctccanatcccgttccctatcgtgaacccgtcgccgccgccgccgcaggaggaggagacgcgccaaggagagcacgcgaggaggcgaccatgagggccaagtggaagaagaagcgcatgaggaggctgaagaggaagcgccgaaagatgaggcagagatctaagtaagctggtggagatggatggtggacgtgatggcatgcttgagtacatacatttcttcggatgcgtttgctcatggagaggcgtgaacctggtgtgcagtcacagtttgccatctgtcaattggcttgtctcggaaacctgcacttcagtaggctatcgtggttctagttatatccagagttttgcactaagacaactcggtctgttttgtgaacctattatgatggagctttatttgctgctanaaaaaaaaaaaaaaaaaaaaaaaaaaaaaaaaaaaaaaaaaaaaaaaagaaaaaaaaaaaaaaaaaaggccccta

SEQ ID NO: 15485 - DNA, 464 bp, Sorghum bicolor
  Clone ID: LIB5047-002-R1-XP1-A11
gccggccgggctgggatcgtgaacccgccgccgccgccgccgcaggaggaggagacgcgccaaggagagcacgcgaggaggcgaccatgagggccaagtggaagaagaagcgcataaggaggctgaagaggaagcgccgaaagatgaggcagagatctaagtaagctggtggagatggatggtggacgtgatggcatgcttgagtacatacatttcttcggatgcgtttgctcatggagaggcgtgaacctggtgtgcagtcacagtttgccatctgtcaattggcttgtctcggaaacctgcacttcagtaggctatcgtgcttctagttatatccagagttttgcactaagacaactcggtctgttttgtgaacctattatgatggagctttatttgctgctaatatcgacctacctatctacctacctgttaaataaaaaaaaaaaaaaaaaaggccccta

SEQ ID NO: 15486 - DNA, 449 bp, Sorghum bicolor
  Clone ID: LIB3478-002-P1-K1-G5
tagatcgcgagcgggccgccctttttttttttttttaatccagtataatcaataccacaatataacaagtttgcaaatcttgcttcgttgacagtatcgacaaccaaacctcataccgatacagctttcaataacgcttcaccagctagagtcatgcatcgcgactaaatgatatgcttacaggaacttattaacaaataccacaaggggagcatcctcatcttcaagagcgacgccgagttcgaccgaaggttcacggccctccacaggttccttcaaaggcgaaccagcttcagtgagcccgctcccggagaacctcaatgtccacctgtgtcgggtcggtcgcgcaatgactgatgagctgcagcctgcagcatcagggcctaacataggaataacaccgggcagacagccgaccccagcgcgcgggcggatgcacaccgctggcg

SEQ ID NO: 15487 - DNA, 664 bp, Sorghum bicolor
  Clone ID: SORBI-28MAY03-CLUS22185_2
ccgggacgcacaggcaggcactggcacgctcgcacgcacgcacgcaccagcaccacatgcatggtggagcctagcacgggcagctagctatagctccccgccgccggcgacgaccaccaccaccacatgttgcatgagcagcaggcaccgccatcaccaccgccggaagtagaagcagcgccaccgcccgtgccatcggcgccgagcccggccaggaaccaccaccaccacgacggcgacggcgacgtccacgatgtcgaggtcacgacgttccgcgacatccaccctctgacgcccgacgtgccgacgccccccgcgcgcaccaggtcctgggacaccgccagccaccgctccttctcgtccgaggagcagttcatgacgatgagccgcgagttcacggccatggtcgccgccggggcgaccatgcagacaggcggcggcgccaacggtaacggcgggtacgacggcgaccagctcaccagcatcggcgaggacgagctggaggagaccaacccgctggctatcgtccccgacagccaccccatcgccacgcccgccaggtccagggcgtccgccgccgcctccgcctccgggctggaggtcgtgccggcgccgacgccgacgccgcagcagccgcccgcgcacgtggaggccagccaggtga

SEQ ID NO: 15488 - DNA, 1919 bp, Sorghum bicolor
  Clone ID: SORBI-28MAY03-CLUS22185_1
gcaccaggggcaggaacgcaggcgccggcacgcggcacaaagccaagaccaagagagaaacacatagagtcttcttggagggacgtgttaggatcgccagggagaacgagcgctccgctggcaggccctttgcgaccaccagccctcgagccatgggcgacatcgatacagacgtcgagtcaatgtaccacgattccgagcagaagcaagaccaagagcaaaactagagagtcttcttggcaagcattcatagcgtatccaccaaagggagtgcgctgagccgggctcctcaacccaccagcgctcgcaagctaggcggtggagatagagaggtcgagagagaatggcaagcacgccaaggtgtacccaccatgttcgccctgggattgcgcctcggcgtccttgcacctatcccacgaagtgatgaggccggtgtggtgtgctgcggcatgcgcggcgacagccgggcgccggcgcgcactgtgctgcgcatggacacgtccaacgtcattacggcaatgcggctgtgcgcaccgggccagggggcgctccgggcagtgggcggctcgggccttagagacaccgtcggcgccgccgacgacgtgcggtcctccatcgctggcagcccggcggcggcggcgtcgtgggtccgcaacaacatccaggcgtacccttccgtctccttccgctacgtgtgcgtgggcaacgaggtggccggcggcgcggcgcagaacctggcgcccgccatggagaacgtccacgcggcgctggcggcggcggggctgggccacatcaaggtgacgacgtcggtctcccaggccatcctgggcgtgtacagcccgccgtcggcggcgcagttcacggcggaggcgcagggtttcatgggccccgtgctgcagttcctgtcccggacgggctccccgctgatggccaacatctacccgtacctggcctgggcgtgcaacccgagcgccatggacattagccacggggccgtcgctgggccgggcaccgaaggccatgggcgcgcgtccgggtaccagcacctcttcgacaccggccgcgatgccttcgacgtcgccatgggcaggaacggaggctccggcgtgccgctggtggtgtcggagagcgggtggccgtccggcggcggcgtgcaggcgacgccggcgaacgccagggtgtacaaccagtacctggtgaaccacgtccggcgagggacgccgaggcacccgggcgccatcgagacgtacctcttctccatgttcaacgagaaccagaaggagagcggcgtggagcagaactggggcctcttctacccaaacatgcagcgggtctaccccatcagcttctagtctagtctagctcatcaacggaagctagctaggtagctggtgcctgctgctgggacgagagagatcgagccgtattacgtacgtatatacacggaccgccgtatatgtctgtaagtacgtatacgtatagcatgtatgtatatgtacggtatgtgtgtggggcttgctttgcgaccgctgggagtatatccaatcgatgctactcccagatgcgtacgccgtgagtgagtgagtgagtgagtatatgtatgtatacatcgaaaggggatcgatcggagacgtacgacgctctcgtaccgtagataataaatacggtacatcgtcgtcgtcaattgatgatctcccttcgtagctagtagtatatagatgaggttgggataagagaaagtgatacaggtgtacattattatcacgtaccgtataactagctatacggtttaattaatttggaatatgtaatttctccccggcctgtacgggtacactccttcagtccttcagaattaagctagctagctagtagataataataataataatatgtacagtttcacagtttccctgttt

SEQ ID NO: 15489 - DNA, 539 bp, Sorghum bicolor
  Clone ID: SORBI-28MAY03-CLUS535_3
gcgctttcacgtctttccggtttctcctctcgctcccctccgccggcggaggagctcatggcatcctcttccatggccgccgtcgcctgcgccaccggcaccgccctctcgccgtcgaccgcgacggcccagaggccgtctgtccagggccgcctcgtcttccccgccgcgccctcccgctcccactctctccggctccgcgccgccggccgccggtcaactcgggcatccaaggttgtggtggcagcgttggctgacccactcaaggtcatgatatcaggggctcctgcatctggcaagggcacgcagtgtgagctcatcaagaccaaattcggtttggtgcacatctccgctggagatttgttgcgggcggagatcgctgctggctctgacaatgggaaggcggccaaggatttcatggagaagggccagctcgtgcctgatgagattgtcgttaatatggtgaaggaacgtcttctgcaaccagatgctcaagaaaacggttggcttttggacgggtgcccaagaagctattcaca

SEQ ID NO: 15490 - DNA, 2547 bp, Sorghum bicolor
  unsure (1)..(2547): unsure at all n locations
  Clone ID: SORBI-28MAY03-CLUS535_1
ctcacttcctacgtcaaacacacaacagatctactccaccgcgtatgtctgtgtccatgtgcccactcgagctgactacatagcttcgcgagcggcgcgcgcgcgcgcgcgtgcgcacgacctgaggccagctcgctggctgccggccggtgccggactcttcggtctttccccttccgttccactcccaggctcccactctccccctaccggctacccacacacacacaaacagccactcctcacctcccccaccctccggttcatgtcctgctgctccccatgtcgcccccactcgagctcgactacataggcctctcgccgcagccggccgccgccgccgccgccgccgatgccgacgacgacctgaagggtaccgagctccgcctcggtctgccagggtccgggtcgccggaccgccgtgtcgcggctgccaccgctaccaccctggagctgctcccggccaagggcgccaagcgcgggttttctgacgaggcgcccccgccatctcccgctgccgctgccgggaagggaaagaaggtggcggaagaggaggacgacgacaagaaggttgcagcgacgccgcagccggccgcaaaagctcaggtggtgggatggccaccaatccgcagctaccgcaagaacacgatggctaccacccagctgaagggtagcaaggaggatactgaggccaagcagggccagggattcctgtacgtcaaggtcagcatggatggcgcgccgtacctgaggaagattgacctcaagacttacaagaactacaaggacctgtctactgcgcttgagaagatgttcagtggcttcagtactggcaaggatggcttatctgagtaccgcaaggatggtgaatatgttttgacttatgaggacaaggatggagattggatgcttgtcggcgatgtaccatgggagatgttcgctgactcttgccgcaggctcaggatcatgaaaggatcagatgcaattggacttgctccaagggcagctgataagtccaagaaccgcaactagaatggttgcttcctacagtccagagcaagagggagatccaatggctgtagggatctttatgaaaaccaaaaaagtctaacagttttaagaagaaaattctgccttatggtctgtactacatggtttgctgtcacgcaagtaaagaactccacgtctgtcatgttagttttgcaatatcgtctatggacaaaacactatttgattgttgttaagccttcgtacgagtgttattcgtgtaaatggtttggtacattgcgtgctgctactatgattgagcactcctacctagtttgcaaaatagtggccatgaactgtttgttgttcctctatataaatgttcaatgaagcttggaaatgtatggttcatctgtgtttcatgttctggttcttccgcgccgccggccgccggtcaactcgggcatccaaggttgtggtggcagcgttggctgacccactcaaggtcatgatatcaggggctcctgcatctggcaagggcacgcagtgtgagctcatcaagaccaaattcggtttggtgcacatctccgctggagaattgttgcgggccgagatcgctgctggctctgactcggggaaggcggccaaggattcatggaggggggggggctcgtgcctgatgagattgtcgttaatatggtgaaggaacgtcttctgcaaccagatgctcaggaaaacggttggcttttggacgggtacccaagaagctattcacaggccatggcgctggaaacccttgaaatccggcctgatactttcattctgttagatgttccagaggaactccttgttgaaagggtggttggaagacggcttgatcctgtaacagggaaaatatatcatttgaagtactctccaccagagaatgaagaaatcgcttcaaggcttacgcagagatttgatgatacagaagaaaaggttaagttgaggctgcagacttattaccaaaatatcgagtccttgctatcaacatatgaggaaattattgtcaaagtgaaaggagatcgcacagtgggcgatgtctttgctgagatcgagaagctgctggcttctagcctgaacaagaaaacagaaatggtgtccagctcatgagcaaggaaagaaaagattgggtgcaggtccgacaagttcatgtaatgtaagccatctcacatgataggaacttctccaagcggatgtagttgaagcataggccgacacatacatgtaatgtaagccgtctaacatgatggaaacttctccatgtggatgtggtcaatgcataggattttttttcctccaattgttaattgtacgtgaatggaagcagcagatcgttcgtaggttgtgagtgcttaacagatcgtgtgctgctgtacatgttttgttgctgtcttgtgaacatacatgtcatgttgtttttcaactggaggaatggtgttaatgcattgatttacagcananaaaaaaaaaaaaaaaaaaaaaaaaaaaaaaaaaaaaaaaaaaaaaaaanngggggcg

SEQ ID NO: 15491 - DNA, 640 bp, Sorghum bicolor
  unsure (1)..(640): unsure at all n locations
  Clone ID: LIB3481-042-Q6-K1-H7
ttctttcgaaaatatatcatttgaatactctgcgaggggggatgaagaaatcgcttcaaggcttacgcagagatttgatgatacagaagaaaagtacatgtttgtactggttattggtaagagtaatgtcaaatgcaattgccgggtctatcgttaaacaggatataattgcttatctaggtattaaagggggactgcaaagtgtctttctttggtcttctactaggcaagcaagatcagcatgctttatgatgcgcctgctggcgatatctaaactattcagtgcatatatgattatgttcaaatccactgacacatgcatttccatttgagaggtggaagcaccacatctatggttactgatataggatgatgtttcttcaactgtgtattgtgatggtttgcttacctctactggatcagatatttttcatcaattgcttggctgtttatgtatatcggaaaaatcagtgagcatggttttatgagaattcacttctgacatatcttgcttttgttgctttacaggttaagttgaggctgcagacttattaccaaaatatcgagtccttgctatcaacatatgaggaaattattgtcaaagtgaaaggagatcgcacagtgggcgatgtctntgctg

SEQ ID NO: 15492 - DNA, 428 bp, Sorghum bicolor
  Clone ID: LIB3478-009-P1-K1-F10
cacgtctttccggtttctcctctcgctcccctccgccggcggaggagctcatggcatcctcttccatggccgccgtcgcctgcgccaccggcaccgccctctcgccgtcgaccgcgacggcccagaggccgtctgtccagggccgcctcgtcttccccgccgcgccctcccgctcccactctctccggctccggttcgcacacagtgagcaaagatggcgcgccgtacctgaggaagattgacctcaagacttacaagaactacaaggacctgtctactgcgcttgagaagatgttcagtggcttcagtactggcaaggatggcttatctgagtaccgcaaggatggtgaatatgttttgacttatgaggacaaggatggagattggatgcttgtcggcgatgtaccatgggagatgttcgctgactc

SEQ ID NO: 15493 - DNA, 1384 bp, Sorghum bicolor
  Clone ID: SORBI-28MAY03-CLUS14368_1
cccctcccctcctcgggtcgcgtgggcagtcctcgcgcgctccgctcgcacgggcggacgagcgcgagcttcgttctcccaatctctctcccttctgccctgccctgccgccgcgcttagcttccttgccttcttcctctcctccttcctcctccgccaagaggggagcgggcgcgggcgcgggcgcgggcgcgagcggcgtcgttcagatggattcaggcgccgtgcagcacggctgcgcgcattacagccgtgggtgcagcgtcgtggcgccctgctgcggccaggtcttcgcccgccgccattgccacaacgacgccaagaactcgctcgaggtcgacccgcgcgaccggcacgagatcccccgccacgaaatcgaaaaggtggtctgttctctctgctccaaagaacaggatgtgcaacagaactgctccaactgtggggcctgcatggggaaatacttctgtgaaatatgcaaattctttgacgatgatgtctcaaagggccaataccactgtgatgggtgtggcatatgcagaactggtggcgtcgataacttttttcactgtgatacatgtgggtgttgctacagcaatgtcttgaaggattcccaccactgtatcgaaagagcaatgcatcacaactgccctgtctgcttcgagtatctgttcgactccacaaaggacatcagtgtgctgcaatgcgggcacacaattcatctggagtgcatgaacgagatgagagcgcaccatcacttctcgtgcccggtgtgctcgaggtccgcctgcgacatgtccgccacatggcggaagctcgatgaggaggttgcggcgacgccaatgcctgacatctatctgaagaaaatggtatggatcctgtgcaacgactgcagcgcgacctcgagcgtgcggttccacgtgctggggcagaagtgccccgggtgcagctcctacaacacccgggagacgagggccgcgtgccccaggacctgatcaggcgaacgaggcctaagtcgcaaacggcagggagatgctgtgttcaacgactagtggagatcatccagcaggacggtgacgagcgcgagaccaagccgggcagtccagtcttgagtttggtgctgtgcatttgcaatgtttcctgtactgtaatgcgtccgtgagtgctgacgaggcatacctgtggaggatggcccggcgcaagggccgtaggaaagctgcaggttaggcagattagcggggggctgttctctgttcacgtttacggcgcgaatgcaacaaaattccaacgtcggccgtgagttcggcgatgtaaccgaaccgattatttcgacaagtatatctattaatacaataacagttttctgttttattatcaaaaacacaaa

SEQ ID NO: 15494 - DNA, 1032 bp, Sorghum bicolor
  unsure (1)..(1032): unsure at all n locations
  Clone ID: SORBI-28MAY03-CLUS6402_1
tgtgcggcgctcgagccggccgggccgggcccctcatcccaagtgccagccgccaccagtctctccctctcctcccggctccggcgaagagcgcccaccagatcacttgttaatctttctcaaggggagatggcggtttctttcgcaaacgtcaactctgaggcagggctgaaaaagcttgatgagtaccttttgactcacagctacatcactggctaccaagcttccaaggatgatctggctgtctactcttcattttcggctgctccctcatccaagtatatcaacgtagcaaggtggtttactcacattgatgcactcttgaggctgagtggagttactgcagagggcctaggtgtcaaggttgagtcatcagcagttccttcagcctcaactcctgatgttgctgaggccccagcagctgacgatgacgacgacgatgatgttgacctttttggtgaggagactgaagaggagaagaaggctgctgaagagcgtgctgctgctgccaaggcttctggcaagaagaaagaatctgggaagtcttcagttttacttgatgtgaagccatgggacgatgaaactgacatggccaagctcgaggaagctgttaggagtgtccagatggaaggactgctctggggtgcttccaagcttgtcccagttggatatggcatcaagaagctgcaaatcatgatgaccattgtcgatgaccttgtctctgtcgacacactcattgaggaccatctgtgcgcagagccagtgagcgagtacgtccagagctgcgacatcgttgccttcaacaagatctaaatttgctagaggtgctggcgaaggtggttggcgggcaatgcaacaacctaatttatccatatttctgtgtctgctttgtgtggctagtgatattgccgtgaggtttttggatcctagtcgtgtcaaatgtaccagtaccagagttaatttgctttaattcgaaacacagtctggtggatttctgttaaaaaaaaaaaaaaanaaaaaaaaaaaanaatg

SEQ ID NO: 15495 - DNA, 1656 bp, Sorghum bicolor
  Clone ID: SORBI-28MAY03-CLUS676_1
gcacgaggctggacccggttcctgcgcggagagcgatcgggatcccgaaggcgacatcgcgggccttcccctttaccttccctggccgaccagggacatccggcaggcggtgggcagactggagcggcgcaacttccccgcggtcccgccccgattcccttgtcatctctagcaagtctttctccggtcgcccttccctctctcccagtcccagacgggcagcaattccgccataaataccggcgatcgagggcctcggacaacccagtcgacggagcagcgcggcggccggacgagggcaaacccttctcttctcaatactctactagtctgcgcctggatccccctccggaggaagataagacatgggtcaagcacttggtttggttcaagtggatcaatccacagtagccatcaaagaatcttttgggaagtttgacgaaatactagagcctggatgccacttcttgccatggtgcatagggaagcaaattgctgggtatctgtcactccgtgtgcagcagcttgatgtccgctgcgaaacaaagacaaaggataatgtctttgtcaatgttgtggcttctgtgcaatatcgtgcccttgccgataaggcatctgatgcattttacaggcttagtaacaccagggagcaaatccagtcatatgtctttgatgtcatcagggcaagtgttccaaagatgaacttggatgatgcctttgagcagaagaatgaaatcgccaaagctgtagaagatgaacttgaaaaggcaatgtcgatgtatggatacgagattgtgcagactctgattgttgatattgagcccgatgagcatgtgaagagagccatgaatgagatcaatgcagctgctaggctgaggttggctgccaccgagaaagctgaggcagagaagatactgcagatcaagagagctgaaggtgatgcagaatccaagtacttggccggtctaggtatcgcaagacagcgccaggctatagtggatgggctgagagacagtgttcttgctttctctgagaatgttcctgggacctctgcaaaggatgtcatggacatggttctggtgacccagtacttcgacaccatgaaggagatcggggcctcatccaagtcctcgtcggtcttcatccctcatggaccaggtgctgtcagagacatcgcagcgcagataagggatggtcagctccaggccagtctgctgtgagcacgttgatgcatacttttgacattcccatcagtaaagaagtacatatacctcatgagacaagtaaaacttattagggataatgtgagtactttcatatcagtagtgcttgttcgttctatctatctggtacgtgtgattatttattatcgagataaatgttatataggtttgtagaacaagatgagggccagttgctgtaaaaatttgtcatgccgtggtactgtttggaacttatctaagctattatggagcctgaggacactcctccatcaaactattttgtgataacctgcttctctgttatcgtgaatgagaatctcatctccattttctgtgcccagattaagtggaaattcggagatttgagtactgacgtgaatgcaacctgtgtgtaatttgtgagagtggatttgaaacttgggtatctcactcc

SEQ ID NO: 15496 - DNA, 596 bp, Sorghum bicolor
  unsure (1)..(596): unsure at all n locations
  Clone ID: LIB3481-043-Q6-K1-A7
gcgtccggagacgtgttcttgctttctctgnggatggtcctgggacctctgcaaaggagtcatggacatggttctggtgacccagtacttcgacaccatgaaggagatcggggcctcatccaagtcctcgtcggtcttcatccctcatggaccaggtgctgtcagagacatcgcagcgcagataagggatggtcagctccaggccagtctgctgtgagcacgttgatgcatacttttgacattcccatcagtaaagaagtacatatacctcatgagacaagtaaaacttattagggataatgtttgtagaacaagatgagggccagttgctgtaaaaatttgtcatgccgtggtactgtttggaacttatctaagctattatggagcctgaggacactcctccatcaaactattttgtgataacctgcttctctgttatcgtgaatgagaatctcatctccattttctgtgcccagattaagtggaaattctgagatttgagtactgacgtgaatgcaacctgtgtgtaatttgtgagagtggatttgaaacttgggtattctcacttccataaagtcgaatccatagacttaaaa

SEQ ID NO: 15497 - DNA, 2123 bp, Sorghum bicolor
  Clone ID: SORBI-28MAY03-CLUS404_1
actcgacgccctccgccgcttccacccgccacctccccttctaccccgttgttttgaggtctgctctgtcatacattaggggcgagggcaactggcaccgtgtcagcaagggtgctcccgagcagattcttgacctgtgccactgcaaggaggatttgaggcggaaggtacacggtattatcgacaagtatgctgagcgtggtcttcgttcgcttgctgttgccagacaggaagtgcctgagaaaaataaggagtcccctggtggaccatggcaattcgttggtttgttgcccctgtttgatccacctaggcacgacagtgctgagacaattcgcaaggctcttgttcttggtgttaatgtcaagatgattactggtgatcagcttgctattggtaaggagaccggaaggaggcttggtatgggtaccaacatgtatccttcctcagctttgctcggccaaaacaaggattctacgcttgaagcacttcctgttgatgagctcattgagaaggccgatgggtttgctggagtcttccctgaacacaagtatgagattgtgaagagattgcaagagaagaaacacattgttggtatgactggagatggtgtcaacgatgccccagctcttaagaaggccgacatcggtattgctgtcgcggatgctactgatgctgcaaggagtgcttctgatattgtccttactgagccaggtcttagtgtcattatcagcgctgtccttactagcagatgcatcttccagaggatgaagaattacaccatttatgctgtttccatcaccatccgtatagtgcttggatttatgctcattgctttgatctggaaatatgatttctctcccttcatggtccttatcattgccattctcaatgacggtactatcatgaccatctctaaggacagagttaagccatctcccttgcccgacagctggaagctgaaggaaatcttcgctaccggtatcgtgctcggaagctaccttgctataatgactgtcattttcttctgggctatgcacaagaccgacttcttctcggacaaattcggtgtgaggtcaatcagggacagtgagcatgagatgatgtctgcgctgtacctccaagtcagtattgtgagccaggctctgatcttcgtcacccgttcccgtagctggtctttcgtggagcgccctggtctgctcctggtcaccgcgttcctgctcgctcaacttgttgcgaccttcctcgctgtctacgccaactggggcttcgccaggatcaagggtatcggctggggctgggctggtgtcgtctggctctacagcatcgtgttctacttccctctggacctgatcaagttcttcatccgatttgtgctcagcggcagggcatgggacaacctcctcgagaacaagaccgccttcaccaccaagaaggattacggacgggaagagagggaggcgcaatgggccaccgcgcagaggacgctgcacggtctccagccgccggaggctgccaccaacactctgttcaacgacaagagcagctaccgcgagctgtcggagatcgctgagcaggccaagagacgagctgagatcgcgaggctgagggagctcaacaccctcaagggccacgtggagtcggtggtgaagctcaaggggctggacatcgacaccatccagcagaactacacggtgtgagagccgcctgctgcgatcgatgtcgacgaaaaaaacctttggcgcccgaccccgccttattgcgacggagtcatctctgattattacagacaaaaaaattttccggtgatgaattgaaaacaaaagaaccgtgtggctgatctgactgagcagccctagttgtaaagcgctataccaccagatactgctatatgatggtatggtttggtacccgtctttctagggagcttcttttttgttctcatattatgtttaaatcaatagtggagtgtgcgcttgttgtaatcattttacttgcgttttcccctaactagccggtgatctcgtggaaagcgaggtgaatgaagaaataatgcaacaaaaattttctgccaaaaaaattgtgttcctttctggcctgattgatgcagccggatccaagcttta

SEQ ID NO: 15498 - DNA, 539 bp, Sorghum bicolor
  Clone ID: LIB3480-042-P1-K1-D4
ctagttctagatcgcgggcggcccccttttttttttttttttttttttttttttgggcagaaaatttttgttgcattatttcttcattcacctcgctttccacgagatcaccggctagttaggggaaaacgcaagtaaaatgattacaacaagcgcacactccactattgatttaaacataatatgagaacaaaaaagaagctccctagaaagacgggtaccaaaccataccatcatatagcagtatctggtggtatagcgctttacaactagggctgctcagtcagatcagccacacggttcttttgttttcaattcatcaccggaaaatttttttgtctgtaataatcagagatgactccgtcgcaataaggcggggtcgggcgccaaaggtttttttcgtcgacatcgatcgcagcaggcggctctcacaccgtgtagttctgctggatggtgtcgatgtccagccccttgagcttcaccaccgactccacgtggcccttgagggtgttgagctccctcagcctcgcgatctcagc

SEQ ID NO: 15499 - DNA, 1998 bp, Sorghum bicolor
  Clone ID: SORBI-28MAY03-CLUS11622_1
gcacgaggccttcctctcgctgtccggccggcgtcgggcgtgcgccgctcgcttgaccgcggccgtcgtccccgcccctccctccccctgccccccgctttccggcgcccgcctgccggccgccccttgtttaacgccaaaccatctggcctttgcagccccgattcgccacgaaaccggccgcagtgtgagagagggacgccgcccgttgtccccggcgtatacgcaatccttccgtcgctgcgaagctgatccctcgtgttcgccttcgccatggcccctgcctccagcgtcgccgtggagaacctcaacccaaaggtcttaaaatgtgagtatgcagtccgtggggagattgtcatccatgctcagcgcttgcagcaacaactacaaacgcaaccagggtctcttcctttcgatcagatcctcttctgcaacattgggaatcctcaatctcttggtcagcaacctgtgacattcttcagggaggttcttgctctttgtgatcatccatgcctcttggaaaaagaggaaaccaaatcattgttcagtgctgatgctatttctcgagcaaagcagattcttgcaactattcctggaagggcaaccggtgcatatagtcacagccagggtatcaaaggactgcgtgatgcaattgctgctggtatcacctcacgtgatggattccctgcaaatgcagatgacattttcattacagatggagcaagtcctggggtccacatgatgatgcaattactgattaggaatgagaaggatggcattctgtgcccaattcctcagtaccccttgtactcggcctccatagctcttcatggtggagctcttgtcccctattaccttgatgaaaaaactgggtggggtttggagatctctgatcttaagaagcaactcgaagatgctcggtcaaaaggcattgatgttagggccttggtggttatcaatccaggaaatccgactgggcaggttcttgctgaagacaaccaatatgacatagtgaaattctgcaaaaatgagggccttgttcttctagctgacgaggtatatcaagagaacatctatgttgacaacaagaaatttaactctttcaagaagattgcaagatccatgggatacggcgaggatgatctccctctagtatcatttcagtctgtttccaaaggatactatggagagtgtggtaaaagaggaggttacatggagatcactggcttcagtgctccggtaagagagcagatctacaaggtagcttcagtgaacctgtgctccaatatcactggtcaaatccttgcaagcctcgtcatgaatccaccaaaggttggggacgaatcatatgcttcctacaaggcagagaaagatgcaatccttcagtctttagctcgtcgtgcaaaggcattggaggatgcattcaacaagcttgagggaatttcatgtaacaaggctgaaggagcaatgtaccttttccctcagattcatctgccacagaaggcaattgaggctgctaaagctgctgagaaagcacctgatgcgttctatgctctccgtctccttgaatcaactggaattgttgtggtccctggatctggatttggtcaagttcctggaacatggcacatcagatgcactatcctgccgcaagaagacaaaatccccgcggtgatcacccgcttcaaggctttccatgaggcgttcatggctgagtaccgcgactaaactgttacagtgtgaattaagatggagattcagtagaagagtccatcttttttcctccctttgttccccctttgtacttcttgtactgtgttttaatatattttccagtaggggctaaaaacccctccggttgtttcctaaaaaaaagtagaagagttcaatgacagagcaaaaaggggccagtgttagaaatcttatttcctccactggagcaacaattgtctgtcttcaatcaaaaacaaaaatttcgaactggcctaggcacttctc

SEQ ID NO: 15500 - DNA, 2582 bp, Sorghum bicolor
  Clone ID: SORBI-28MAY03-CLUS5865_1
gctcgtgggttcgtcgcacccaactccccaaaccattgttccacgcgctccccccctgcacgcacccccctcctcctccggttccatgctcgcccgggcacactcggtgagctggttaaccaaaacaccaaaccattgttcgacgcgctcccctcctgcacgcaacctcctcctcctcctccggatccaggatcgcccgcgcgccctcggtgagctgcgttcgttttgatttaccgggaaattctgtttgcttcatgttgcgcaggctcagatctgattgctggattcggcgtctttcgtcttgatgaatcgagcttggagcgcgtggatctgatcccggggatacaccaaacgcgcgcgcatgacgcgttggatccggcaccggtttcagatccggcgaaatcgcgacgttaccggtggttctgtctggagcgggtctgtggcgacggtggctgaaggaggcgtcggcggtggcgggatctattggtctgctccacctcgcgggatgattgtctctgcgctgataattattggatgaatttcgataattattagtagatctaagagatgtggccgccttgaagaggcgaggtaagatgcaacatgtaagagtcgagtcaagagtctctgcgtgcgtcggggaaaaaaagaggaaaaaaaagatgtgatgctagaggcctttgccatgatgggtgcgctcgcatggcaggccacggtgataataaaaaaaagatgattattgtgtcccgggggaggagatcgcacgggggttgaattttttggccccgggttctcctcccccatggtgttccctgtccttgcgtccgttgcttgcgttctccgctcgtgttggtcagctacacgctgggtttttgcatctactatcacggagatctacacaacacgtcggattttttttgcaactaatacggagatctacaacgaagctacagcgagaatcccaaggtacaatcgttaattaagttgaaacaatcttttaagtcgtttcgtgttccttctattccacacgaagcctatgttcttattctgcgcttgcatgttcaaaatatgctgaaacaaccatgaatagccatcgaactgaagatcctaaaacaccctaccaacaacttccactccatcaacttccactttgcccagctcagttgaagttagtcttctataattgaagactggcatgaactcaaagaagcacacgttattaatgattcaatgaacttcagaagtgtgtaaaagtttaggttgcatctgcaaattatatttctgctgttgagcctgataatatcattcgcgtattatctgtaaaacccttttgtctgatggcactgcgtttctatttcatttgtatattatattttctgcaattttgtctggcctaattgctttggacttcattagaaatttatctgtaagcaactctatgttcctgtatcttatcatgtctcggattttcgtttgtatttatcatatatatgtggtcaaatcggatatttgttcttttttgtaagcctgttagcgtggtttatgttcgtcaagccatagcaattgttgggcttgtgtagactagatggtcgcaaaattgcagtatgatggattccatttccatattataagagtttcttgaccatggggtgcctcaatcttggttatgctggagggcagtgctgatgcaactgatgggttatggtgtgcttaaatcgtggttatgctatggagccggtggctatgctgacggaatcgattggtgaagatttcgttccaaatggtccatcttgctgacggtggttgtgactgcccaggtgttccttctacttgtacgttgcttttttgacggcactgcacatggacagttggtcataagtttctttttgatggcactgtatatattgttgtacaatttatttcttggcagttgcagtagaagttcgaggggtatgagaacacaagtttaccaggagaccaatttgtttcaaagtttctcattattatattcatttgatggtttggaaatttcttgatgttgtggaagtttaggtaagttggcggcagaaggtaaaggtggttgggtagattagctctctctccatttccattctaaattatataagatattttaagaattctaaactataagccattttaagaattttggagtcagtattttaagttattaagttattaaaattatagaaagaattacaagatttatgacattaaataggtataatatgaaaatataattaatgaagaatttaatgatgcctgataaatgttattattttatcatataaattttggttagatagttttgactctttaaatatttttagaatgtcttacaattttggagcgaggggagtagctgagaaggtttttgattgagaatttgtttgcatcgcagaaagtaaccacaagcctgagatttctacccttggagttctattcatatcgttttgttcgagtttatcagtcaaatcattcagttattcaacagatatttgtttttataataaatcagttaatgtatttcctgctatggctcgtcagccaaaccagagtttttt

SEQ ID NO: 15501 - DNA, 574 bp, Sorghum bicolor
  Clone ID: SORBI-28MAY03-CLUS2631_2
gccggcgccggccgtaggcctcttcactcggtgcggtgcggacaccacaaataaacaccatatatccagctcgatcgatcgacgataaacaacaacacatggcgaagcagcagcaggcggtggcgctgctgatgatgctggtgctggctgcggagacggcgtcggcggcttcgtgcaacgcggggcagctgacggtgtgcgcgtcggcgatgttgtccggggcggcgccctcggcggcgtgctgctccaacctcaaggcgcagcaggggtgcttgtgccagttcgccaagaaccccgcctacgcgcgctacgtcaacagccccaacgcgcgcaagaccgtcgcctcctgcggcgtcgccctgccgcgctgctaattactcttacggtatatgggcgtatctgcgaggaataaaggatgggttattcgtccatgcactttgccgtctgcctggctgctcccatccctgcttatattatatatgctctcgtatatgcacgtttgtgtaatgtgtgcccatcgatataaatatatttatatatatatatataaaaaaaaaaaaaaaaaaggccccta

SEQ ID NO: 15502 - DNA, 675 bp, Sorghum bicolor
  Clone ID: SORBI-28MAY03-CLUS2631_1
ttgtgcggcgcgcgggccggccgcgaaaacctcttcactcggtgcggtgcggacaccacaaataaacaccatatatccagctcgatcgatcgacgataaacaacaacacatggcgaagcagcagcagcaggcgatggcgctgctgatgatgctggtgctggctgcggagacggcgtcggcggcttcgtgcaacgcggggcagctgacggtgtgcgcgtcggcgatgttgtccggggcggcgccctcggcggcgtgctgctccaacctcaaggcgcagcaggggtgcttgtgccagttcgccaagaaccccgcctacgcgcgctacgtcaacagccccaacgcgcgcaagaccgtcgcctcctgcggcgtcgccctgccgcgctgctaattactcttacggtatatgggcgtatctgcgaggaataaaggatgggttattcgtccatgcactttgccgtctgcctggctgctcccatccctgcttatattatatatgctctcgtatatgcacgtttgtgtaatgtgtgcccatcgatataaatatatttatatatatatatatatataccggtccagtttgtcacaaaaaaaaaaaaaaaaaaggcccctaaaaaaaaaaaaaaaaaaggcaactaaaaaaaaaaaataggcccctaggaaaacaaaataaaaagg

SEQ ID NO: 15503 - DNA, 1971 bp, Sorghum bicolor
  Clone ID: SORBI-28MAY03-CLUS1425_1
gcctcctgatctgttcacgaccagccgagttcgcagcagcactctcctcagtggagtccctcttggtcatcgtctcgtcgttatcccatcccatcccctccccggggattggcggcgtgggggagcatctatcggtcttctggagattgcctggtgctgcgttttttctgatctaagcccggcatgaagagctcagagcgtttgctgctgctgctgctggtggtgctggtggtggcatcatcgtcgttactgtccgccgtgattgccgagcagcagacttgccctgctgacctcgacagcaaatgcgatggtggcgcgtctgatgattgggagggggagttcttccccggcgtcccgaaaatcaagtatgagggtccaaccagcaagaaccctcttgcttataagtggtataataaggaggaagtgattctcgggaagaagatgaaggattggatgcgcttcagtgttgcgttctggcacacattccgtggtactggcgccgatccttttggtgcccctacaaaggcttggccttgggaggatggcacaaattcgttggccatggctaagagaagaatgagagctcactttgagttcatggagaagctgggagttgacaaatggtgcttccatgatagggatattgcccctgatgggaaaactcttgacgctttatgcatccacgttacatgcatggagctgctactagcccagaggttaaagtatatgcttatgcggctgcacaagttaagaaagctttggaggtcactcactacctaggtggtgaaaactatgtgttttggggtggaagagagggttaccaaactcttctgaatactgatatgaagagagaacttgaccatctggctaactttcttcaagctgctgttgaccacaagaagaagatcggattcaagggaacactgttgatagagcctaaaccacaggaacctacaaaacaccagtatgactgggatgttgcaactacgtttgcttttctacagaagtatggtcttacaggagagttcaagatcaatgttgagtgcaaccatgctactctatctggacatagctgccatcatgaactggagactgcacggattaatgggttgcttggaaatattgatgcaaacactggtgatcctcaagttggttgggacacagatcagttcatgacagacattgcagaggctaccttagttatgtcgagtgtagttaagaatggtggacttgcacctggtggtttcaactttgatgcaaaattgcggagggaaagtactgatgttgaggacatgtttcttgctcatatctctggaatggacaccctggctcgtggcctccgcaacgttgccaagctgattgaggatggttccctagatgatcttgtccgaaagaggtaccagagctttgacagtgagattggcgccttgattgaggctgggaaaggagactttgagacgctagaaaagaaggttctagagtggggtgagcccaccgttccatccggcaagcaggaactggcggagattctgttccagtctgctctatagatggtgccatgtccatagctccaggaataagcacaagtgtgtgccctccgaacacgcagtcgtcctcaccacaggaagttctagttccacgcgatgaactatgtacaatacagcgtggaactgaaataatttaggttgtagcctgtcagaatttccagaattgttgcctcctttgttcggagcggaatcaaactgaacttggttaagcttatcctgcattccatctttgatgtggtgatcgtgtttggtagtcaaggtttccttgatgctgtttcataatgtggcatcgatgctgctgttctgtagtacagcagaaaactgctacagagcccctttgctccctgtttggaacaaattagtttggccacgcttcaatttgaagctagattcttggtaagctagctttcctaggaaacttgtt

SEQ ID NO: 15504 - DNA, 455 bp, Sorghum bicolor
  Clone ID: SORBI-28MAY03-CLUS117_2
gacgggagaggctagtgcaggagtcggacattccgaagctcaactacgtgaaggcctgcatccgggaggctttccgtctgcacccggtggcgcccttcaacgtgccccacgtcgcgctcgccgacaccaccatcgccggctaccgcgttcccaagggcagccacgtgatcctgaggcggccacgcaaaagcaccaccaagtgcagcagcacaacgtgcgcctcgcccccggccggcgttggcaacccgccgctcccaccgggtcccgtgccgtggcccgtcgtcggcaacctgccggagatgctgctgaacaagccggcattccgctggatccaccagatgatgcgcgagatgggcacggacatcgcctgcgtcaagcttggcggcgttcacgtcgtgtccatcacctgccccgagatcgtgcgtgaggtgctccggaagcatgactccaacttt

SEQ ID NO: 15505 - DNA, 2264 bp, Sorghum bicolor
  Clone ID: SORBI-28MAY03-CLUS117_1
ggctcctggctcaagcaggagcacatacagctagctagctcatcgggtgatcgatcagtgagctctctctttggcctagctagctgctagcagtgcaggtagccaatcaaagcagaagaactcgatcgatcgatcatcacgatcgctgctagctagctagctgctcgctctcacactagctacgtgtgtttgttaatttgatatatatatataatggcgacaatggaggtagaggccgcggccgccacggtgctggccgcgcccttgctgtcctcctccgcgatcctcaaactgctgctattcgtagtgacgctctcgtacctggcccgagccctgaggcggccacgcaaaagcaccaccaagtgcagcagcacaacgtgcgcctcgcccccggccggcgttggcaacccgccgctcccaccgggtcccgtgccgtggcccgtcgtcggcaacctgccggagatgctgctgaacaagccggcattccgctggatccaccagatgatgcgcgagatgggcacggacatcgcctgcgtcaagcttggcggcgtgcacgtcgtgtccatcacctgcccggagatcgcgcgggaggtgctccggaagcaggacgccaacttcatatcccgcccgctcaccttcgcctccgagacgttcagcggcgggtaccggaacgccgtgctctcgccctacggcgaccagtggaagaagatgcgccgcgtcctcacctccgagatcatctgcccgtcccgccacgcctggctccacgacaagcgcaccgacgaggccgacaacctcacccgctacgtctacaacctcgccaccaaagccgccaccggcgacgtcgccgtcgacgtcaggcacgtcgctcgtcactattgcggcaacgttatccgccgcctcatgttcaacaggcgctacttcggcgagccccaggctgacggcggtccggggccgatggaggtgctgcatatggacgccgtgttcacctccctcggcctcctctacgccttctgcgtctccgactacctcccctggctgcggggcctcgacctcgacggccacgagaagatcgtcaaggaggctaacgtggcggtgaacaggctccacgacacggtcatcgacgaccggtggaggcagtggaagagcggcgagcggcaggagatggaggacttcctggatgtgctcatcactctcaaggacgcccagggcaacccgctgctgaccatcgaggaggtcaaagcgcagtcacaggacatcacgttcgcggcggtggacaacccgtcgaacgccgtggagtgggcgctggcagagatggtgaacaacccggaggtgatggcgaaggcgatggaggagctggaccgcgtcgtcggacgggagaggctagtgcaggagtcggacattccgaagctcaactacgtgaaggcctgcatccgggaggctttccgtctgcacccggtggcgcccttcaacgtgccccacgtcgcgctcgccgacaccaccatcgccggctaccgcgttcccaagggcagccacgtgatcctgagccgcacggggctgggccgcaacccgcgcgtgtgggacgagcccctgcgcttctacccggaccgacacctcgccaccgccgcgtccgacgtcgcgctcaccgagaacgacctgcggttcatctccttcagcaccggccgccgcggctgcatcgccgcgtcgctcggcaccgccatgagcgtcatgctcttcggaaggctcctgcaggggttcacctggagcaagcccgccggggtggaggccgtggacctcagcgagtccaagagcgacaccttcatggccaccccgctggtgctgcacgctgagcccaggctgccggcgcacctctacccgtccatctccatctgattaaacgtacggccggtcgtcattatattgtatgcatataattaaagacgagcgagcctgctggtcacacttgcattgcatgtatcatcagcagggggctatgcaataagttttttttttccgcgcttgatttcgtggtgctgtgcgtattctgcgcacaccgactgtacgtacgacggcgttcagctttgtattgtaccgagttaaaaagtattattattattatcatcgacaataataataattggagcttaatttgcttgagtgtatctatttatctgtctatccacccgtacatggttttttgttttgttttttttcaagtcatgtctattgaccgaaatttgacggggaaatatgtatgctctcaattc

SEQ ID NO: 15506 - DNA, 1483 bp, Sorghum bicolor
  Clone ID: SORBI-28MAY03-CLUS15429_1
ccctcggcagccagccactctcatttccccttccataccctgcaggcagcctcctcttgtccctcacacaccacactacactgctctgctgcagcaagaaaccaacaagagcttgctagccatggccaccaccgcggcgtctagcctcctcaagtcctccttcgctggctcccgtctcccgtctgccccgcgcgccccgtcgtccgtcgtcgtgtccaccggcggcgccccacgcacggccgccatctccgcgtccatctcctcctccaacccgccctacgacctgacgtccttcaagttcagccccatcaaggagtcgatcgtctcccgcgagatgacccgccgctacatgacggacatgatcacccacgccgacaccgacgtggtgatcgtgggcgccgggtccgcgggcctctcctgcgcgtacgagctctccaaggaccccacggtgcgcgtcgccatcgtggagcagtcggtgtccccgggcggcggcgcgtggctgggcgggcagctgttctcggccatggtggtgcgcaagccggcgcacctgttcctcgacgagctcggcgtcgcctacgacgaggccgccgacgactacgtggtggtcaagcacgccgcgctcttcacctccaccgtcatgagcgccgtcctggcgcggcccaacgtgaagctcttcaacgccgtcgccgtcgatgtccatgaaccacggcgcgcacgcgtgcatggacccaaacgtgatggaggcgctcgtggccgtcagccccggcgcccacgccggcccggtccccgccgccggcgtcaagaggctgcaggacatcggcatgatcagcgacgtgcccgggatggccacgggagtcaagaggctccaggacatcggcatgatcgccgccgtgccagggatgaaggcgctcgacatgaacgccgctgaggacgccatcgtgcgcctcacgcgcgaggtcgtgccaggcatgatcgtcaccggaatggaggtcgccgagattgacggcgcgccgaggatgggcccgacgttcggcgccatgatgatctccggccagaaggcggcgcacctggcgctgaaggcgctgggaaggcccaacgccgtggacgggaccatccccaaggtgtcgccggcgttgcgcgaggagttcgtgattgcgtccaaggacgacgaggtcgtggacgcctgatcgagtgatcgatcgacgccagcagcaagcagcgtctttatctgggacggacggacggggtttctttaatttgggactttcctttgccttgttgttgaatgaatgaattcccttcgatcgtgtagctttaatttctctcgtctcgttattagtgtgtcgtgttcatagcaccacctgccaccaccgcgccatgccatatgtgtgctcttcacgtgggggccactcgtggggtcctgctgccagaacgaataagagaagatggaattgatgaaacaataaaatgcacggttatcccc

SEQ ID NO: 15507 - DNA, 1529 bp, Sorghum bicolor
  Clone ID: SORBI-28MAY03-CLUS3119_1
ttttgtctgcgccagcaggtccgggagcgtcgactccacggcagcccttggcgaccaggagccttgtgtgtttctaggcttttagctttcagatttatgggttgtggcacacagtttgttttaatctgtgcgctgaacaaacaagtctcatatttgtgacttgtaggattgttacaatccaacacttgccttcattctgcaggttttagcaagcaggttgaaacaagcgtggccttcaagctggtaagaagcagattattatgttgcagtctgttctagttcagagttgcgccgtgaagatgttctcgtttgctttagcttgagattgtgaaagctttttctctcctacaacccaagctttcctgctacattctgtttccacccacaaaacccactttcctagctcgacgaagagccctcacctccagtcatgacggcgccccaagcagccatggccggtcagccagtgaatgccgccgcggtggatgagcgtctcctggtcgatcaggaggccaaccaccacccccaaccggagaacaatggtgataacagctgcttcccctggccgaccgttttgggtttcctcatcctcagcttcaacgcggcaatggccatcatccgatcccaaggcgatgtgatggccatcgccttcgtcggttttgcctatgccatcctcgtcgcgctttttgtctgcctgaggatgtacgagcgtgcccgtgctgggtcgtccaagagggagtggctcaagatcgctgtatggatactgactactctgctgacgttcagcttctcctacaaagttgccgccatcatgccagcgcccatggccgtggtcgtttggctgatggcctttgcgaccattgcaggaggcttcgtcgcgttctttgtctacaaagagaagtgatcatcggcttctcggtctctgaattaataaggcaattcaattgtcattgaggcggaatttctctatggcgaatcatcgactctttatccgactgtcttggaagaaattgctttgtagcaaatcatcaattctttatccgagccgtctttttgtgtgtagtcgattgtatgaacaatttatgccattgcagagccaaaaagcggaaacatcaggtttttgaacagtcagaacaagccttcttttgtaataatgtgttcagctctaaagactgagttagaactatgttagatccaaatcctattatttgtgtcaagtattgtgtcttgtatttatgaagtctgttacctatctagatgagaaccttgccagctcttcagatggggctgactgcgagttaaaatttctggcgcgcgtgaactttagtagcttccaatgtgttatatgttcctagagattgtaatagagcggttcatggattagctgctagtgggtatgaatgtgtgggcaggctcgagcaaattataagctccccccgtgaacatgtaatgtaattgtcgctgacgattgtcagcccaagagtaatgtagttgtacccaatttataaaaaaaaagagaacattttcgt

SEQ ID NO: 15508 - DNA, 520 bp, Sorghum bicolor
  Clone ID: SORBI-28MAY03-CLUS1238_3
ccgtccgaagaaaacacagatacactagtcgccgaagcaaccattaaccacaaccccaatctcccgcgtcacccaaaactcgaggcaacaaccgatccaccaacaatgtcgctgattcgccgtggaagcgcattcgaccccttctccctcgacctctgggaccccttccagggctttcccttcggctctggaagcagcagcctcttcccctcgttcggaggcaccaactcggagacggccgccttcgccggtgcccgcatcgactggaaggagacgccggaggcgcacgtgttcaaggccgacgtgccggggctgaagaaggaggaggtgaaggtggaggtcgaggacggcaacgtgctccagatcagcggtgagcgcaacaaggagcaggaggagaagacggacacctggcaccgcgtggagcgcagcagcggcaagttcctgcgcaggttccggctgccggagaacgccaagacggagcagatcagtgcgtccatggagaacggcgtgctcaccgtca

SEQ ID NO: 15509 - DNA, 773 bp, Sorghum bicolor
  unsure (1)..(773): unsure at all n locations
  Clone ID: SORBI-28MAY03-CLUS1238_2
cccacgcgtcagatcgcaacgcacagcgaaatcctccaatccacagattcacttcccagttcgcgctcacacccacacccaccgagcagctaaagctagcaatcagaagcagcaatgtcgctggtgaggcgcagcaacgtgttcgaccccttctccctcgacctctgggacccgttggacaacatgttccgctccatcgtcccgtcggccgcctccggcgactccgagaccgcggccttcgccaacgcgcgcatcgactggaaggagacgcccgaggcgcacgtgttcaaggccgacctccccggcgtgaagaaggaggaggtcaaggtggaggtggaggacggcaacgtgctcgtcatcagcggccagcgcagcagggagaaggaggacaagaacgacaagtggcaccgcgtggagcgcagcagcggccagttcacgaggcgcttccgcctgccggagaacgccaagacggaagaggtgaaggccggcgacgagaacagcgtgctcacggtcaccgtgcccaaggctgatgtaatgaagcgtaggatccagagcagaaggatgaggaatcgaagagctatgaacaagagacgagcgacgggaagaggagagtgagagctgcaaggatgattctacctggaagacggaagaactcgctcagagctattcgtcctacctcgctcagacctcacggagacgacggtgcgtgtgtggattggaggatttctggctggcgtggagtgtntgtggaagaagaagaagaggggattgtg

SEQ ID NO: 15510 - DNA, 1052 bp, Sorghum bicolor
  Clone ID: SORBI-28MAY03-CLUS1238_1
gcagcagcacgagcgcgaactccaacgccaccgcagagcagcacagcgaaatcttccaacccacagactcacttcccagttcgcactcagctagcatagcaaatcagaagcagtaatgtcgctggtgaggcgcagcaacgtgttcgaccccttctccatggacctctgggacccgttcgacaacatgttccgctccatcgtcccgtcggccgcctccggcgactccgagaccgcggccttcgccaacgcccgcatcgactggaaggagacgcccgaggcgcacgtgttcaaggccgacctccccggcgtgaagaaggaggaggtcaaggtggaggtggaggacggcaacgtgctcgtcatcagcggccagcgcagcagggagaaggaggacaagaacgacaagtggcaccgcgtggagcgcagcagcggccagttcacgaggcgcttccgcctgccggagaacgccaagacggaggaggtgaaggccggcctcgagaacggcgtgctcacggtcaccgtgcccaaggctgaggtcaagaagcccgaggtgaagagcatccagatctccggttgaagagccatgggggcggtgagagctcgcggcgtcggatctccggtttcagtttcagctacgcgacttgtgtgtgtgtgtgtgtgtcagtgcgtggttactctgagcttcggtatgtttggtgtgtactgttcagtgtttcatggtgcttcctagcagtgtctgtcgtgtactttgcctgtatgttgagctcggctcagtatgttttgggagtgaataaataaaaaaaaattaaccgcgaagaaaaaaaaaagagtaatgttatgattcatggttaaataaaccggtgttttgtgtgtgtgtgtgtcagtgcgtggttactctgagcttcggtatgtttggtgtgtactgttcagtgtttcatggtgcttcctagcagtgtcgtgtactttgcctgtatgttgagctcggctcagtatgttctgggagtgaataaataaataaaaattaaccagatattgtcgcgtgtacttagtatact

SEQ ID NO: 15511 - DNA, 972 bp, Sorghum bicolor
  Clone ID: SORBI-28MAY03-CLUS24509_1
gcacgaggcacggatccatcccactctcagctgatcgctcactctttcagctcgatcagtcttagctctagctctagctagccagctagccaatccttcgtgtagtcgtcatcagccttctcatcgtcaccaatggccaccgccgaggtccagaccccgaccgtggtggcgaccgaggaagcgccggtggtggagaccccggcgccggccgtcgtgcccgaggaggctgcccccgcccccgccgaggctgagccggccgtgccagaggaggctgcccccgccgaggaggccaaggtggtggaggagccagctgccccggcggagcccgagcctgtcgccgctgagcctgaggccgagcctgccgccgcggagccggaggcggcacctgctgcggccgcggcggaagaagaggcgccaaaggaggcggagccggccgcggtcgaggaggtcaaggaggaggaggctgcggcgcccgctgccgagacagagccggcggccgccgagcccgaggctgctgctcctgctcctgctgctgccgaggagcccgccgcggccgagccggccgccgaggagcccgagaaggccagcgagtgaggcctcctcggcggcggccaagggatcggagtgagatggctcatcgtgcgcgcgtacatgccacgggcttttgctgttgagtacgctacggttactggcgtttctctacgtacctagcagtggctgtgcgcgtggactgtccggtgcggactgcgagtgacgtgggctaaataaagtgagggtcgtgttcgtgtggcggggggaagtggggcccggtgtcagtggcgcggtgccccatggcctgccactgcagcttgtgtgtcttttgtgttgtgttggttcctgttctgtgttctctgtctatctatgctcatgtatgtaatggcagtttgggtatgatgagtatcaagcatgtctgcattctcgtcttttttggtt

SEQ ID NO: 15512 - DNA, 2012 bp, Sorghum bicolor
  Clone ID: SORBI-28MAY03-CLUS10217_1
gcacgacgctggttccctggagcctgctttgaagcctacaactgaagactagaaataacggattgcgatctcctcgtgcactccgccaaccgccgtcgccacagccgcccgccccgccaggcgccactgcctctctccaggtgacttaggcaggctgtgaggtcgctcggtgttgccgaatagtccggaccgccgccggccatggcatccaacggcatcgcccccagagatgtatgtgttgtcggtgttgcacgcacccctatgggtggttttcttggtgccttgtcttccttgcccgcaacaaagcttggctctatagcaattgaagctgctctgaaaagagcaaatgtggatgcggctctcgtgcaggaggtctttttcggaaatgtcttgagtgctaatttgggacaggctcctgcaaggcaagccgctctgggtgcagggataccaaacactgttgtttgcaccactgttaacaaagtctgcgcgtctggcatgaaggctactatgttcgccgcacagacaattcagctgggtatcaatgatattgttgttgcaggtggcatggaaagcatgtccaatgccccaaagtacattgctgaagctaggaaagggtctcgttttggacatgacacacttgttgatgccatgcttaaggatggactttgggatgtatacaatgactgtgccatgggaatgtgtgctgagctttgtgctgacaatcatgccctcacaagtgtagtccgggacacttttgctgtccaaagcaacgtgcgtggaattgcagcccgtgacagcagtgcgtttgcatgggacattgttccgtttgaagttcctgtcgggaggggacaaccacctgttctcatggagaaagatgaaagcctggataagtttgacccagcaaatctgagggatcgccctccaagtttagttctgatgagtgggcaggaggctcctgggcttggcccgagtataagtgatggggctgctgcattagttttggtgactcggccgccggcgcttgtgctcggcctgcccggccctgccaggaccagaggctatgccgatgcagcgcttgctcccgtactttttacaaccaccccagcacttgcgataccaaaggctatagcaaatgctggattagagtcatcccatgttgatttttatgagattaatgaagcattttcggctgttgctcttgcaaatcaaaagcttcttgggattccttcagaaaagactaatgttcatggaggagctgtatctttagggcatcctcttgggtgcagtggtgctcgcattttggtcacccttcttggtgttcttagggtgaagggtggcaagatcggggttgctggagtctgtaacggtggaggtggagcatcagctcttgttgttgagctcgcataagagatattgaacttcgctagactcgaaacagtgctgctgctatctgcataattcaaccgagcatgattgagcaatcattctgtcttgccgcttcggtcaccatagcaacatgacgtcgcaggcgcaatcattctagcaattagcaccagctccctgaggcggaccttgtactcttacgttgatgtatgtttagtgttgtagcttgctgaacattcttaagttaattcagcaataaagcgtggtgtgcttctgctacctgcatctgcaataagagaaatggagcagcctctgctcaattctatccatctgtacatcctatttggaggactccattgacgctgttttagaagtttgtgtgaactgaaattcatctactgaaactttgaagatgttcttttttctttgaaatctgaatatttgaagatgttacaatggagaagccggggtccagtccaggtagagcagggactggaacgggatgtcatggtgcaagtcagttatgcaaggtacttggaggctgcctgccttgagctctgttctgttctgagccttgtgcttgctctgcatctgctataacatgctctgctatctctttccttgtgttt

SEQ ID NO: 15513 - DNA, 404 bp, Sorghum bicolor
  unsure (1)..(404): unsure at all n locations
  Clone ID: LIB3478-011-P1-K1-F9
aagccttttcggctgttgcacttgcaaatcaaaagcttctcgggattccttcagaaaagattaatgttcatggaggagctgtatctttaggacatcctctcgggtgcagtggtgctcgcattttggttacccttattggcgttctcagggcgaagagtggcaagatcggagttgctggtgtctgcaacggtggaggcggagcatcagctcttgttctcgagctcgcataagaaatctagaccttgtaagattgaaaacgctgaatatatctcaactcaaatggattcttttactatatgggaaagtattaaaaaggtgctaaccaatatcagttgttattgtcaacttgtaatatgatngcatagtcagctgaacctaattggagtgatcctttctttttattt

SEQ ID NO: 15514 - DNA, 1318 bp, Sorghum bicolor
  Clone ID: SORBI-28MAY03-CLUS39808_1
atacctggactaccgaagacaccctccgcacagctaactcgcaccgggcctggggcacgccctctacagagttcacccgctcctggctagtcctcgacaccatttgagcaggcaactactagctagtaataagcaagcaagcaagcaaataatccagcaatggcggcgccggcgttcggaggacggcggaggccggcgtcagcagcagctctcctagccgtggcgacccttgttgttgtcttcctcgccgggccagccatggccgcggggaacaagaccggccaggtgacggtgttctggggccggaacaaggcggagggcacgctccgcgaggcctgcgactccgggctctacaccatggtcatcatgtcgttcctcgacgtctacggccccaacggcaagtaccatctggacctgtctggccacccgatcgccggcatcggcgacgacatcaagcactgccagttcgtcggcgtcccggtgtcgctctccatcggcggcttcggctccggctactcgctcccgtccaagcaggcggcgctggacctcttcgactacctctggaacgccttcttcggcgggtctaaacccggcgtccaccgccccttcggcgacgtatggctggacggcgtcgacctcttcctggagcacgggacgaacgccacggacaggtacgacgtgctggcgctggagctcgccaagcacaacatccgcggcggtcccgggaagccgctgcacctgacggcgacgccgcgctgcgagttcccgccggcggggtacctgaagcgggcgctggacacgggcatcttcgagcgcgtccacgtcaggatctacgacgacgccgactgcgaggcgtactggcacctggcctgggacaggtggacggcggcgtacccggccaccaggttctacgtcgggatgacggcgtcggagacgacgcacgggtgggtgcaccccaagaacgtctactacgacgtcgcgccgtcggtgcagaaggcggacaactacggcgggttcatgatctgggaacgctacgcggacacgctctccaactacaccagcatggtcaagtactatgcgtgattgatttctgatcgattcagttcagacatgaatgctgcgtcagcagcatcactagtggtgtctctgtttgtctggtacagtagtatgtataactgtataataatacagtcatcactgtggtggtgtgtagtgtgtttgcattttgcaagaaggaataaagtgacgaataaaagagagtaaaatacacagctgctacacaaatgatttttaagttacagaggcattttcctacttt

SEQ ID NO: 15515 - DNA, 1701 bp, Sorghum bicolor
  Clone ID: SORBI-28MAY03-CLUS28811_1
gccaccccaggcgaacacccccgtccccgtgagcgaccaacccacccatcccatctgctcttcccaccaacaacccccgacgagcggcgatgaccggcacggtgtccaagctagccgcgccccggccggcggcggcgccgctccgaccggcgtccctccgcaccgccgccctcgcgttcgccccctccccgcgccgggtcaccgtctccgttgccgggcgagccaggagccccatcattgcgatggcttctgccaaggaaggaaatggtgctccgaccaagaagaccgcgcttcatgatctctacgagctccagggcctgtccccgtggtacgacaacctctgccgccctgtcactgacttgctgccccttatcgccagcggtgttcgtggagtcaccagcaaccctacgattttccaaaaggctatttcatcgtccagcgcatatgatgatcagttcaagcagctcatttcgggtggaaaggacgcggagagtgcttactgggaactcgttataaaggatattcaagacgcgtgcaaactttttgagcctatctacaatgagactgatggggctgatgggtatgtctctgtggaggtgtctcctaggttggcaaatgacactcaaggaactgttgaagcggcaaagtggttgcacaaagtggtcaaccgccctaatgtctacataaagatccctgctactgcagaatgcgttccttccatccaggaagttattgctaatggcattagcgtcaatgtcacgcttattttctcgattgcaagatatgaggctgtgattgatgcttaccttgatggacttgaggcttctggcttgagtgacttatcacgagttaccagtgttgcatccttctttgtcagccgagtcgacagccttattgacaaaatgctcgagaagattggaacacctgaggcacttgccttgagaggaaaggctgctgttgcacaggccaaactagcaaatcagctctaccagaagaaattctctggaccaaggtgggaggcgttggccaagaaaggtgccaagaaacagaggttgttgtgggcatccaccggtgtcaaaaacccagcttatcctgacactctttatgtggacagtctcattggacctgacacggtcaacacgatgcccgaccaagctttgcaggcattcatagaccatggcactgtttcaaggacagttgatgcgaatgtgtccgaggcggaaggtgtatacagcgccttggagaagcttggcatcgactgggacgcggttggaaagcagcttgagctggaaggtgtggactcctttaagaagagctttgacagcctacttgtgagcctgcaggagaagggcaacagcctcaagacggcaagtgtgtaaaactgaaatgattgggtactggctggtggacgattactaaataaaatgctagcttgctggcgctcttagtttttttacgatgtacctttgctctcaattttctgaatcggctttgtattagaggcttgcctggccgtcattgtgtaaccaatgttcatggcttgtaactgctatgtgagtatccgataaataattttgatcaagttatttcttctgtccgtataagtcttgtttttttacggaattttgtttgagaatgtacagtttattttacccccgaccattatatgtggctcgtgaatcaccagtcgtggtttgatgg

SEQ ID NO: 15516 - DNA, 988 bp, Sorghum bicolor
  Clone ID: SORBI-28MAY03-CLUS6121_2
gttgagtccgatgttgtctggttatttgtgaacacttgctgctgtgcagcagtttggtcgaactatggaatgaagaataagtgaaccctgaagttgtggctaaaaaaaaaaaaaaaaaaaaaaaaaaaaggggcagccgctcgcgaccaaatcattgagtttttgaactccaagaataatgttggaagcgatggggacaacagaaatgaagacagtaaagctagacccccacaagaagtttcattgaatggcagcacttcggatgagcattcgaagaaaattaagttggaggatgtttcatgccctctctgtacggagatgttgtatcaacctgccgttcttaattgtggtcatgtgtattgggtatcctgtttgtcgtccttgaatgaggaaacactgaaatgccatgtttgtggaagtcctcacccgggagatttccctaatgtttgcctggaccttgatcatttcctggaagaatactttccagcagaatatgaatcgagagggcagaaagttcagtttaagaaggatcagtgcaatcgtgaagcatcatcttcaggtacttcagtcagaaaaggaagcactagggcactgcatgatgagggcatgttaaatattcacattggagtaggatgtgactcatgtggggtatatccgatacgtggtaagagatacaaatgccaggactgcactgagttaattgggtttgacctttgcgaagcctgctacaactccagttcaaagctcccaggacgctttaatcagcggcacacccctgatcacagaatggaagttgacaattcagcactcttgcgtgggatactgagacaccatggcatgcccgaggaaggccctgagggactgatgatggaagaagcggtggttgctcctggtgcattcttgcagatactcgttgatactcaaggaatggaggagggggcactattgtgggggcccaggagaggcggccattgaagaaccagttggt

SEQ ID NO: 15517 - DNA, 1780 bp, Sorghum bicolor
  Clone ID: SORBI-28MAY03-CLUS6121_1
gccggccgggccgggccggaatctccaatctcccaatccaatcccgtcgaaagaattctcctgcgagcgaaagcaaaggagcctgcctctcccgatcctctcaagatgcagatctttgttaagaccctcaccggcaagaccatcaccctcgaggttgagtcctcggacaccattgacaacgtcaaggctaagatccaggacaaggaaggcattcctccggaccagcagaggctcatctttgctggcaagcagcttgaggacggccgcacccttgctgactacaacatccagaaggagtccaccctccatctggtgctccggctcaggggaggcatgcagatcttcgtcaagaccctcactggcaagaccatcacgcttgaggtcgagtcttctgacacgatcgacaatgtgaaggccaagatccaggacaaggagggcatccccccggaccagcagcgtctcatcttcgcaggcaagcagctcgaggatggccgtacccttgctgactacaacatccagaaggagtcgacactccaccttgtgctcaggctcaggggtggtatgcagatcttcgtcaagaccctcactggcaagaccatcacgcttgaggtcgagtcctcagacaccattgataatgtcaaggccaagattcaggacaaggagggcatccctccggaccagcagcgtcttatctttgctgggaagcagctcgaggatggtcgcacccttgctgactacaacatccagaaggaatccacccttcaccttgtgctcaggctcaggggtggtatgcagatctttgtgaagaccctcactggcaagactatcactttggaggttgaatcctcggataccattgacaatgtgaaggccaagattcaggacaaggagggcatccccccggaccagcagcgcctcattttcgctggcaagcagcttgaggatggtcgtacccttgctgattacaacatccagaaggagtcaacccttcacctggtgctccgcctgcgtggtggtatgcagatcttcgtcaagaccctcaccggcaagaccatcaccctggaggtggagtcttctgataccattgacaatgtgaaggcgaagatccaggataaggagggcatccccccagaccagcagcgtctgatctttgctggcaagcagctggaggatggccgcactttggcagactacaacatccagaaggagtccaccctccacctggtgctccgcctccgtggtggccagtaagttctgctgggctgtgttgtccctgggttcacaagtgtggtgctggtgccttgtgggtctcctgagattaggagaccgtctgtcatcgtgttctgtggtttgagtcctggtcgagtcttggctcttgtttgcctgtctgatgcagagcccatgttgagtccgatgttgtctggttatttgtgaacacttgctgctgtgcagcagtttggtcgaactatggaatgaagaataagtgaaccctgaagttggggctatgctacaagtatgtgatgtgaaatggagggattgcacaagcttaggtatggctggatcggctttgttcatattcctgttctctagttactgccatctaatggccatatgattttattttcccctgcttctgtaaatccgtgcagttgtttgtttcaaaggaaaatgcaataaggatatgcagaactgtattggtaaatctgtacctgcttgcttcagtgggatgaactgcgtgaacgaaaataaattgccaactcgtcccggcggtaacgctttt

SEQ ID NO: 15518 - DNA, 2532 bp, Sorghum bicolor
  Clone ID: SORBI-28MAY03-CLUS10406_1
gcacgaggggtctttgccccatcgcctccctcccttccgccccccttcccctctcttcgcctcctccctccctcgtgcccgcttcgctctcgactcgcctcgcccctccgtctcgtctccaaggtcatggcaaagctggaacacggggggaaatagcaagtgggagataaacaggaagaccgagctaggtgattactacaagtagcagtacaaggaagagagtcaatctgcccgtgacctcgagtgaattagttgggtgtggagtttgttgaggtcacgatgatgggaggcgggctgatgatggatcagagcgtggtgttccctggcgtccacaacttcgtggatctccttcagcaaaacggtgacaagaaccttggcttcgggtcgctgatgccgcagacgtcctccggcgaccagtgcgtgatgggggagggtgatcttgtggacccgccgccggagagcttcccggacgctggggaggacgacagcgatgatgatgttgaggacatcgaggagctggagcgccgcatgtggcgcgaccgcatgaagctgaagcggctcagggagctgcagcagagccgcggcaaggattcgatagctggcggtgggggcctggctgacggctcgtccaagccaaggcagtcgcaggagcaggcccgacgcaagaagatgtctcgcgcgcaggacggcatcctcaagtacatgctcaagatgatggaagtgtgccgcgcacaggggtttgtgtatgggatcattccggagaagggcaagccggtgagcggcgcctccgacaacctccgtgcgtggtggaaggagaaggtccgcttcgaccgcaacggcccggccgccatcgccaagtatcaggccgacaacgcagtccctggtgccgagaacgagctcacctcgggcgctgccagccctcattccttgcaggagctgcaggacactacgctgggctcattgctctcagcactcatgcagcactgcgaccccccacagcggcgctacccgctggagaagggcgttcctccaccatggtggcctactggcgacgaagagtggtggccggaacttggcatccccaaggaccagggcccacccccatacaagaagcctcatgaccttaagaaggcctggaaggtgagcgtgctcaccgctgtcatcaagcacatgtcaccagacatagagaagatccgtcgccttgttcgccagtccaagtgcctccaggacaagatgactgccaaggagatctcaacctggctggcggtcgtcaagcaggaagaggagctgtacctgaagctgcaccccggcgcactcccaccagcatctactggtggcatcgccagtgccatatccttcaacaccagctcaagcgagtatgatgtggacatcattgatgagtgtaagggggatgaggccggcaaccagaagacaggagtcactgacccaaccgcgttcaaccttggtgctgctatcctaagtgacaagttccttgtgcagacgcccatgaaggaggagactgcggacgtcgagttcatccagaagaggaacgcccccgctgctgctgagccagagctaatgctaaacaaccgagtgtacacctgcaacaacgtccagtgcccacacagtgactacagctatggattccttgaccggaatacccgcaacagccaccagtacacctgtaagtacaatgaaccaatccctcagagcactgagaacaagccgccgccagcaccgccacagtcacaagccttccagccggccttcaaccaacccaatcagtcactgaacaatctggatttcagcctgcccatggacgggcagaggtccatcgctgagctgatgaacatgtacgacaacaacttcatgacaaacaagaacatgagcagtgacagcgtcaccatcatggagaggcctaatgcgatgccccagaggatccagatggatgagggtttctttggacagggcaatggagtcttcgacgatgtcaatagcatgatgcagcaacaacagcaggcaccagtgcagcagcagcagcagcagcagcagcagcagttcttcatccgtgatgacacgccatttgtgagccagatgggcgacatcaccagcacatcggagttcaggttcggttctggtttcaacatgtctagcaccgttgattacccaggcgcggcgcagaagaacgatgggaccaattggttctactgaagaataagcttgtaggtctgaaaaacctcgttataagctttggatttctccatggtgctccatggttctcctaagttgtcaagtctataggtctttgtcatataggttttgcagtagctgcaagacggctggaacttggaactggtttatacttgtatgtccgtccagccataaacctcttatggaaacttaatgttattcctagttttaattgttagttccaatgctgttcatatatatggctgtcaaaatgcttgtgcttgtttctgtatgtgatgttgtactacctgttatttggtgtctgaatgaagtgttgtcttg

SEQ ID NO: 15519 - DNA, 796 bp, Sorghum bicolor
  Clone ID: SORBI-28MAY03-CLUS588_1
gcacgagcaccgagaaagccaaaataactaagatcgtcatcttgtcttgatcctctcttgctgcctggtccgtggccatggcgtcgtcgtccatgctctccgccaccaccgtgccactccagggggccgccggcctgtccgagttctccgggctcaggagctccgcgtcgctgccgatgcgccggaatgccacctccgacgacttcatgtccgccgtctccttcaggacccacgcggtcggcacgagcggcggctcgaggcgggcgccgacggaggcgaagctgaaggtggcgatcaacgggttcggccggatcgggcgcaacttcctgcggtgctggcacggccgcggcgacgcctcaccactggaagtcatcgccatcaacgacacgggaggcgtcaagcaggcgtcgcacctgctcaagtacgactccacgctgggcatcttcgacgccgacgtcaagcccgtcggcgacaacgccatctccgtcgacggcaaggtcatcaaggtcgtgtcggaccgcaaccccagcaacctgccgtggggcgagatgggcatcgacctcgtcatcgagggcacgggcgtcttcgtcgaccgcgagggcgccgggaagcacatccaggccggggccaagaaggtgctcatcacggcgcccggcaagggcgacatccccacctacgtcgtcggcgtcaatgccgaccagtacgaccccgacgagcccatcatcagcaacgcctcctgcaccaccaactgcctcgcgccgttcgtcaaggtgctcgaccaaaagttcggcatcat

SEQ ID NO: 15520 - DNA, 268 bp, Sorghum bicolor
  Clone ID: LIB3481-001-Q6-K1-H6
cgtccgcccacgcgtccgcccacgcgtccgcgcacgcgtccggccatggcgtcgtcgtccatgctctccgccaccaccgtgccactccagggggccgccggcctgtccgagttctccgggctcaggagctccgcgtcgctgccgatgcgccggaatgccacctccgacgacttcatgtccgcgggggggttcaggacccacgcggtacgtgcctagctagctagctagctgctccgatcgtccgatcgatcaacatccatgcaatcgt

SEQ ID NO: 15521 - DNA, 1399 bp, Sorghum bicolor
  Clone ID: SORBI-28MAY03-CLUS12610_1
ccacgacgcgctccgctcttcgccccggcactctgcgagtctccatagaggtcaactagctccgctcttaaactccaagcagcagcgaagtccgagctagtgttgttggcaacaaagcggtagatctcgcgaggtcgagaagatgaagagcagcaccctcttgacgatcctagtgctccaggcccttctggtctctgcagctatggccaaaggagacgggccgaaggagccgtgctgcaaagagtgcaccagccggctcgggtgtctccaccttgcgacgacctcctgaccaagtgcgccgccacctgcaagcaatgcgtccccgtgtccacggacaagggcacccgctacaggtgccgcgacttcctccccgaaggctgcccctgcaagaccaactgatccatccatccatccacaccacgcatgcatggccacagccgatggatctatatgctccgtccgccttatatactactatatataaggcgcaaagattgttgttgtctttgcttgtttggaagatgtcccttctccatcgagatggaataaaataaagtcaggcgcactgatatggtgtgttactacggcaacgaagcaaaagaggagcgcgtcgacggcggcgaccacccggtcgtggtcctcaaaccggcggtggacgccatcgtggcggggctgcgcgccgccggctccaacccacgccggacgctcttcctggacgacagcgagaggaacatcaccgctgggaaagcgctcggcctccgcaccgccctggttggcaagagggtgaggagcaaggacgcagactacgcgctggagaacatcggcgcgctccggcgggtcatcccggagatctggggcgtcgtcgccggcggcgagagtgaacgatcggaccacagcattgacaagatgccgatgaggtccgacctggactccatcatccagcccacgtccatccaggcctaataacctcatcccacccaacttcataaataatcaatcagtcagaatcatgggatgccactaataaatcaaatctccatcgtctctctctctctcaccacctaatcgatcatcatgtacattattctgattcctgatgtgcgtccgtgcgcgcgtgtgtgtgtgaatatctatctgtacctatctagctgacaggcatgtacatacacatttctgatcagcaccggttgtcagtgcatgtaaagcagcaattcgccaaattccaagtgcatgacgagtcatcatctgtattatgataagaataacaagtcgtacttatgtaactatcgcgtgctctgttctccatatatatgtcccgatgtaaaaaataatcagagacgcagatggtggaagcaccaaaccctatcttgggtcattggtgaatgcgttttctcaaaaa

SEQ ID NO: 15522 - DNA, 599 bp, Sorghum bicolor
  unsure (1)..(599): unsure at all n locations
  Clone ID: LIB5047-009-R1-XP1-F2
gccggccgggccgggaaaactcagaagttagctagctccgctcttacactccaagcagcagcgaagtagctagtgttgttggcaacaaagcggtagatctcgcgaggtcgagaagatgaagagcagcactctcttgacgatcctagtgctccaggcccttctggtctctgcagctatggccaaaggacaagggccgaagaaggcgtgctgcaaagagtgcaccagctggtcgggtgtctacacctgcgacgacctcctgaccaagtgcgccgccacctgcaagcaatgcgtccccgtgtccacggacaagggcacccgctacaggtgccgcgacttcctccccgaaggctgcccctgcaagaccaactgatccatccatccatccacaccacgcatgcatggccacagccgatggatctatatgctccgtccgccttatatactactatatataaggcgcaaagattgttgttgtctttgcttgtttggaagatgtcccttctccatcgagatggaataaaataaagtcaggcgcactgatatggtgtgttagcatatttctcttctgcccatgntaaaaaaaaaaaaaaagggcccta

SEQ ID NO: 15523 - DNA, 1748 bp, Sorghum bicolor
  unsure (1)..(1748): unsure at all n locations
  Clone ID: SORBI-28MAY03-CLUS437_2
gcaccggccgcttcacgcctgcacctccctcgtttcggtgccgactagttcatctnctccgtccttcgtcgccgtgtgttgggaagcctgaactgggtgaatgtcgtcagacaggtcagtgcgattcgtgcgaggcagacggcgcagctcttgccggccgcgtcggcgatgcaggggcacctccgcacctacatgaacgcggggattcccaagcgtatcaaagaggatgaggagaatgaacagcttgcaaaagatgtcgcaaaatatctcttatcttgaaagaattcgctccatctattcctccgcctccccgtcacagcgacgttgttaatcagcggccaaccgctggccgggacgggatccccttcgctatccctttgttgccgccgcctccaaagccactcccaaacccccgcttccagaaccttctcgaagctcaccgcctcctcctcctcctcctcctccactcgctccgatggcgaaggacccgatgcgcgtgctcgtcactggcgccgcaggacaaattggatatgctcttgttcccatgattgcgaggggagttatgcttggtgcagaccagcctgttattctgcacatgcttgacattccgccagcagctgaagcccttaacggcgttaagatggagttggttgatgctgcatttcctcttctgaagggagttgttgcaacaactgatgttgtggaagcctgcactggtgtgaatgtggccgtcatggtcggtggattccccaggaaggagggaatggaaaggaaagatgttatgtcgaaaaatgtttcaatctacaaagcccaagcatctgcccttgaagcccatgcggcccccaactgcaaggttctagtggtagccaacccagcaaacaccaatgctcttatcttgaaagaattcgctccatctattcctgagaagaacgttacttgcctgacccgtctggaccacaacagggctcttggccagatttctgagagactcagtgtccaagttagtgatgtgaagaacgttatcatctggggtaaccactcatccacccagtaccctgatgttaaccatgccacagtgaagacttccacaggggagaagcctgttcgtgagcttgttgctgatgatgagtggcttaatggcgaattcatcacaactgtccaacagcgtggtgctgcaatcatcaaagcgagaaagctctccagtgctctctcagctgctagctctgcttgtgaccacattcgtgattgggttcttggaacccctgagggaacatttgtttccatgggtgtgtactctgatggctcatacggtgttccttctggacttatttactcattcccagtaacatgcagtggtggtgaatggaaaatcgttcaaggcctcccgattgacgagttctcaaggaagaagttggacgccactgcccaagagctgtcggaagagaagacgcttgcttactcatgcctcgagtaaattctaccataccccagaccacaattgctacccctatctttttgaataaaagaaactccagattctcactcagaactgctgcactgcgatgtgcaggcgtgtttgctggcttcgtccagcatgtatgtcgtatgaggcttgtagcttcttttttgcctgattgacttgcaggacatttattgaaaacttgcaattgaaccgcttgacgattgaagtggtagcatagttttgttgctttcctggtgcccaactatatcctcaagtttactgttac

SEQ ID NO: 15524 - DNA, 874 bp, Sorghum bicolor
  unsure (1)..(874): unsure at all n locations
  Clone ID: SORBI-28MAY03-CLUS437_1
ccggggtccatccggccggctccgcagcgactaacccgcagcccagcaccggccgctccacgcctccacctccctcgtttcggtccgacgagcccatcgcctccgccgcttcgtcgccgtcgaggtcgcaccaccatggcggcgctgctagcccggcaggcagcgcaggcgctccgcgcgaggcagacggcgcagctcttgccggccgcgtcggcgatgcaggggcacctccgcacctacatgaacgcggggattcccaagcggttcaaagaggatgaggagaaagaacagcttgcaaaagatgtcgcaaaagattggaatgctgtctttgaaaggagcatcaatacattgtttttgactgaaatggtccgtggcttgatgctaactctcaagtacttctttgacagaaatgttacaattaactatccatttgagaagggtcctctgagtccccgcttccgtggtgagcatgctctcagacgttacgaatctggggaagagcgttgcattgcttgtaaactatgcgaagctatatgcccagcacaggcaattacaattgaggctgaagaacgtgaagacggcagtcgccgaaccacaagatatgatattgacatgaccaaatgcatttactgtgggttctgccaagaggcttgcccagtcgatgctattgttgaggggcctaactttgagtttgctactgagacacacgaggaactactgtatgacaaggagaaactgcttgagaatggtgatcgctgggagactgagattgctgagaacttgagatctgagagcctttatcgctgaaatctgtctccattgtggttgataaactgggnntctccatntccatattttggtcactagctgatga

SEQ ID NO: 15525 - DNA, 1573 bp, Sorghum bicolor
  Clone ID: SORBI-28MAY03-CLUS25378_1
gctcgcgcacgaggctgcaacagccgagtgatcctagtgctaggaggttgcaagcagttgcaggatggcacagctcgctaagacgcttctccttgtggccctggtggccatgtcggcggtggagctgtgccgcgccatcgagttcgacgagcgggacctggcgtcggacgaggcgctgtgggacctgtacgagcggtggcagacgcaccaccatgtgcaccgtcaccacggcgagaagggccgccggttcgggaccttcaaggagaacgtgcgcttcatccacgcgcacaacaagcgcggcgaccgaccctaccgcctcagcctgaaccgcttcggcgacatgggccgggaggagttccgctccacgttcgccgactcccgcatcaacgacctccgccgggcggagtcccccgcggcgccggccgtgccggggttcatgtacgacggcgtcaccgacctgccgccgtccgtggactggcggaaggaaggcgcggtgaccgccgtcatggcgtcagcatggcgcggtgaccgccgtcatttctccacgccgctgcggcagctgctgggccttctccacggtggtggccgtggaaggcatcagcccgagccggaccgggtccccggtgtcgcggtcggagcaggggcccggcgccggcgcctggagaacgccttcgagttcatcaagtcctacggcggcgtcaccaccgagtccgcgtacccgtaccgcgcctccaacggcacctgcgacagcgtgcggtcccggcgccggcacctgcgacggctcgccagccacccgagggtgccgaccggcagcgaggacgcgctggccaaggccgtggcgaaccagccggtgtccgtggccatcgacgcgggtggccaggcgttccagttctactcggagggcgtgttcacgggcgactgcggcacggacctggaccacggcgtcgcggcggtcggctacggcgtcagcgacgacggcacggcctactggatcgtgaagaactcgtggggcccctcatggggagagggcggctacatccggatgcagcgcggcgccggcaacggtggcctctgcggcatcgccatggaggcgtccttccccatcaagacctcgcccaacccggcgcgcaagccccgccgcgcgctcatctccagggacacctcctcccagtgaggcagtggcagtgacagactgatccgatccatctcggcgtcgttctcttctcgtaccacgcacagcagcaactggcacgtaagtatacgttgccaggatgacttactactactgtttgcttgtactattatcgattgggttgtttgtactgatgatggtttgattgtgccggccggtctcaatcagagacgatatatacacactagaataaagtatagcagcgcgtgtgcgcgacaaagtaagattaggcgtgtgatatcaaagtttgtgcttgtaatgtaatgtaatacggtgtggcatatgcaccgggttatggtatatagaaggagaggcgccatgcgtaagctagcagttgttgcaaaaaaaaaaaaaaaaactgagactagttctccctcgtgc

SEQ ID NO: 15526 - DNA, 780 bp, Sorghum bicolor
  Clone ID: SORBI-28MAY03-CLUS1723_3
ccgggactgaacgctccgagcccttcttcctaccccgtccccgatccactcccggcttcccgctccgatcgatctgattcgccaccaccgcgcccatggcggaccagctcaccgacgaccagatcgctgagttcaaggaggccttcagcctattcgacaaggacggggatggttgcatcacgaccaaggagctgggaactgtcatgcgttcactagggcaaaaccctacagaggctgagctccaggacatgattaatgaggtcgatgctgatggcaacggcaccattgattttccagagtttctcaacctcatggctcgcaagatgaaggacacggactctgaggaagagctcaaggaggccttccgtgtgtttgacaaggaccagaacggcttcatctctgctgccgagctccgccatgtcatgacaaatcttggtgagaagctaactgatgaggaggtggatgagatgatccgtgaggctgatgtggatggtgatggtcagatcaactatgaggagtttgtcaaagtcatgatggccaagtgagccacagaaccataatctgaaggcggagaagattgggcattgcatattagtcaagatgcaactcttatttcatcgacttcctccagtgaaacattctgctagttgtagttgctgaaaggcgatgtagttcctgctttgttcttccctccagtgtgttttcagaaatgttgtttcatgtgaacttgtaatgattgccctccttgctgtgtcttgattgcagttgaaaccatatgta

SEQ ID NO: 15527 - DNA, 821 bp, Sorghum bicolor
  unsure (1)..(821): unsure at all n locations
  Clone ID: SORBI-28MAY03-CLUS1723_2
gccggccgggtcgcgaaananaannaaaaaaaaagccggccgggacaggacgggccgggatcttcctccattcgcggttcgcctctctgcctgcctgcttccctcccttcctccgtcagatcctcgctcgggttgcttgccatggcggaccagctcaccgacgaccagatcgccgagttcaaggaggccttcagcctcttcgacaaggacggcgacggctgcatcacaaccaaggagcttggaactgtgatgcgctcattggggcagaaccctactgaggctgagcttcaggacatgatcaatgaggttgatgctgatggcaatggaaccatcgactttcctgagtttctcaacctgatggcacgcaagatgaaggacactgactctgaggaggagctcaaggaggccttccgcgtgttcgacaaggaccagaacggcttcatctctgctgctgagcttcgccatgtcatgaccaacctaggtgagaagctgacggacgaggaggtggacgagatgatccgtgaagccgacgtggacggtgacggccagatcaactacgaggagttcgtgaaggtgatgatggccaagtgagatgctgcgcccgtttcgaagctagttcctctcctgatggtagtaactagtctagtgttggagactgactgcatgtggttatgccttattcctctccccgtgtcaatggacatatccgtttgttttctcccaagggattttactaccatatcggtaatttcgttcaaatttgtttgtggttgtattacatttgggttatcttggtacaatgatcatgcctttcccttccc

SEQ ID NO: 15528 - DNA, 933 bp, Sorghum bicolor
  Clone ID: SORBI-28MAY03-CLUS1723_1
ggcacgcggaacgctccgagctcgctccctgcctccggtcaccggtcgcctctcctcccttccgctcccctccccctgcctaatctctcctccggccaccgcgacaccgttggttcgctcgctagctccctcgccgcgccaagagacaagcctgcggagaccatggcggaccagctcaccgacgaccagatcgccgagttcaaggaggccttcagcctcttcgacaaggacggcgatggttgcatcacaaccaaggagcttggaactgtcatgcgttcactgggtcaaaacccaaccgaggctgagcttcaggacatgatcaatgaggtcgatgccgatggcaatggcaccattgactttcctgagttcctcaacctcatggcccgcaagatgaaggacaccgactccgaggaggagctcaaggaggcgttcagggtgttcgacaaggaccagaacggcttcatctctgcagcggagctccgccatgtgatgaccaaccttggcgagaagctgaccgacgaggaggtcgatgagatgatccgcgaggctgacgtcgatggcgatggccagatcaactacgaggagttcgtgaaggtgatgatggccaagtgagtgcgtccgcggtaatggtatactaccctactggaaggaggaaaccgttcattgcatattagtaaggcaatgcagctcttgtttccttcgtcttcccatgaagaaaccgtactagctgtagctgctaaaacatttgagtccctctgctgccacccttatcttccattgtgtcattgaacctccttgctccccctgtgtgaatctgtacggctttgcgtgttctggacactgattgcagttgaatccagtttgtagttctatttgttcatcgaatctgcccgacttctttggtactattcaacaggctgctgctttccgttt

SEQ ID NO: 15529 - DNA, 1689 bp, Sorghum bicolor
  Clone ID: SORBI-28MAY03-CLUS81_1
cctcctggacgcgcgctcctgctccggcgtacaaccagagaggctataatctcctccactccctcccctgtaggctgcagcccgttccactcctatccatccgtgctccagctccaccatgggcctctcaacggcttactccccggtcggatcgcacctcgcgccggcgcctctcgggcaccgtcgctccgcccagctccaccgcccgcgccgggccctgctcgccaccgtccgatgctccgtcgacgccgccaagcaggtgcaggatggcgtggcgacggcggaggcgccggcgacgcggaaggactgcttcggggtcttctgcaccacctacgacctcaaggcggaagacaagaccaagtcgtggaagaagctagtgaacattgctgtgtcaggcgcggctgggatgatatcgaaccacctgctgttcaaacttgcctctggtgaggttttcggacaagaccaaccaatagcactgaagttacttggttcagagagatcgtttcaagctctcgaaggtgttgctatggaactggaggactcgctatatccattgctgagggaagtcagcattggtatagatccttatgaggtctttgaagatgtagattgggcccttcttattggtgctaagccccgaggtcctggcatggagcgagctgcgttactggatatcaatggtcaaatctttgctgatcaggggaaagcacttaatgccgtggcctcgaagaacgtgaaagtcttagttgttggaaatccctgtaacactaatgcgttaatttgcttgaaaaatgctccagacataccagcaaaaaattttcatgcactgacgaggttggatgaaaatagagcaaagtgccagctagcactcaaagcaggtgtattttatgacaaagtatcaaacgtgactatttgggggaaccattcgacaactcaggttcctgatttcttgaatgccaaaattgatggaagaccagtgaaagaagtcattaaggataccaagtggttagaagaagagttcaccattacggttcaaaagcgtggaggtgcgctcatccaaaaatggggcagatcttcagctgcatcaaccgctgtatcaatagcggatgctattaaatccctggtaactcctaccccagaaggcgactggttctccacaggggtttatacgactggaaatccttatggcatagcagaggatatcgtgttcagcatgccatgcagatcgaagggtgatggtgattacgaactagctactgatgtgtcaatggacgattttctctgggaacggattaaaaagagtgaagctgaattgcttgctgagaagaaatgcgttgcccatcttactggagaggggaatgcatattgtgatgttccggaggataccatgctaccgggagaagtgtagtttagttacagagaagcaatagcaggggaatgcatttgtctatactatagctgagactcgagagaaacagctgcttgcaagatgcagcaactacttttacttatatatatatatattgtttatattctgtacccgctcaaagcgttgtgtgcacacgctgtgtgattccgggaccgtctttacgatcgttttgcttttttgggccataccgcttcgcttcccgtgttgcgcttccattattgagttattacaactctgttttatagtatttattactgccg

SEQ ID NO: 15530 - DNA, 932 bp, Sorghum bicolor
  Clone ID: 21181
ggggtctttcaagatgtagattgggcccttcttattggtgctaagccccgaggtcccggcatggagcgagctgcgttactggatatcaatggccaaatctttgctgaccaggggaaagcacttaatgccgtggcctcgcggaacgtgaaagtcttagttgttggaaatccctgtaacactaatgcattgatttgcttgaaaaatactccaaacataccagcaaaaaattttcatgcactgacgaggttggacgaaaatagagcaaagtgccagatagcactcaaagcaggtgtattttatgacaaagtatcaaacgtgactatttgggcgaaccattcgacaactcaggttcctgatttcttgaatgccaaaattgatgggagaccagtgaaagaagtcattcaggataccaagtggttagaagaagagttcaccatgacagttcaaaagcgtggaggtgtgctcatccaaaaatggggcagatcttcagccgcatcaacggctgtttcgatagtggatgctattaaatcccttgtaactcctaccccagaaggcgagtggttctctacaggggtttatacgactggaaatccttatggcatagcagaggatatcgtgttcagcatgccatgcagatcgaagggtgatggtgattaccaactagctactgatgtgtcaatggacgattttctgtgggaacggattaaaaagagtgaagctgaattgcttgctgagaagaaatgcgttgcccatcttactggagagggggatgcattttgtgatcttccggaagataccatgctaccaggagaaaattaatttagttacagaagcaatagcagtggaatgcatttgtttatgttagtacagttcctggcgaaaacacagaaactttgagagagacagctgcttgcaagatgcagcaactactt

SEQ ID NO: 15531 - DNA, 1588 bp, Sorghum bicolor
  Clone ID: SORBI-28MAY03-CLUS6325_1
cccaaccggagggaaaagagaggagaagcgaagcaaaagcaaagcagcaggcctcaagaacaagcgcccgcccacacacactagtgtgcttcaattggcggaagaaacggagaggagaagcgaagcaaaagcaaagcagcaggcctcaagaacaaggcaggggaggagaccggcgaaaggggagctagaggaagatggccggcgcactgcagccgccgccccagctgctgccgctgctgcttgcactcctcctcgtctctgctgccgcccctcaggttgttggagtgggggtcggagacaactccctgagaatcatccaggaggatattattgagacagtcaacaaccatcccagtgctgggtggacagcctcacgtaatccttacttttcaaactataccattgcgcaatttaagcacatacttggagtgaaaccagcaccaaagaatgtactcagtgatgttcctgtcaaaacttatccaagatcactggaacttccaaaagagtttgatgctagatctgcgtggtcccgttgcagcacaattgggaacatacttgatcaaggtcattgtggctcttgttgggcttttggtgctgtggagtgcctccaggaccgtttttgcattcacttcaacacgagcattttactttcagtcaatgacctactggcatgctgtggttttatgtgcggcgatgggtgtgatggaggctatcctataatggcatggcgctactttgttcaaaatggtgttgttactgatgagtgtgatccatactttgatcaggtcggttgcaagcatcctggatgtgaacctgcttatgatacacctaagtgtgaaaagaaatgcaaggtgcagaaccaagtttggcaggaaaagaagcattttagcattgatgcgtatagaataaattcagatccacatgacataatggcagaggtctacaaaaatggtcctgtagaagttgctttcacagtttacgaggatttcgcacactacaaatctggagtatacaagcacatcaccggtggcattatgggtggccatgccgtcaagttgattggatggggaaccagtgatgctggagaggattactggcttcttgcaaatcagtggaataggggctggggcgatgatggttacttcaagatcataaggggcacaaatgaatgtggcatcgaggaggacgttgttgctggaatgccatctacaaagaatatggttccaaacttcggcagtgcagttggaacagctgtagtttaacaattacgtttggcctcaaatgctgttggaattaactgaagtatttttaaaatggaattgttaaagagccaatatggtgtatgtagtttgtacactagctcattccaaaggtcgttatgttgctgatgccacatcactttgttcagagatggtggaataacattaataagaactagaatatgaatattatggtttcaagtccaaccaaatttgtgctcagatgatatctggccgccaaaccttgtaaaaatctctgttgtaaaataaaatcaagtcgagggaaagtacactgcaatgcaatgtctgcaatcagttcattttgccct

SEQ ID NO: 15532 - DNA, 403 bp, Sorghum bicolor
  Clone ID: LIB3478-039-P1-K1-F8
cccacgcgtccgcgcgagggccgccctttttttttttttttattttacaacagctgtagtttaacaattacgtttggcctcagatgctgttggaattaactgaagtatttttaaaatggaattgttaaagagccaatatggtgtatgtagtttgtacactagctcattccaaaggtcgttatgttgctgatgccacatcactttgttcagagatggtggaataacattaataagaactagaatatgaatattatggtttcaagtccaaccaaatttgtgctcagatgatatctggccgccaaaccttgtaaaaatctctgttgtaaaataaaaaatcaagtcgagggaaagtacactgcaatgcaatgtctgcaatcaaaaaaaaaatttacttattaaaatg

SEQ ID NO: 15533 - DNA, 940 bp, Sorghum bicolor
  Clone ID: SORBI-28MAY03-CLUS709_2
cggacgcgtggggccgcggcctaacacacccgcgcgctagctagtgtcatccacactctagctagctagtgtcatccacgcagcgcccagctgttcgtctgcaaggcccagcagaagcagcagcaggacgccgccgccgtggatcagagcgacgtctctcgccgcgccgcgctcgcgctcttcgccggcgtcgccgccgtcggcgccaaggtcagccccgccgccgccgcctacggagaagcagccaacgtgttcggcaagcccaagacgaacacggagtacatcgcgtacaacggcgacgggttcaagctgctgatcccgtccaagtggaaccccagcaaggagcgggagttcccggggcaggtgctccgctacgaggataacttcgacgccaacagcaacgtctccgtcatcatccagcccacctccaagaagaccatcaccgagtacggctcccccgaggagttcctctcccaggtcgacttcctcctcggcaagcaggccttcggcggcagcaccgactccgagggtggattcgagaccggcgcggtggccacggccaacgtgctggagagctccacgcccgtggtggacggcaagcagtactacagcgtctccgtgctgacaaggacggcggacggcgacgagggcggcaagcaccagctcatcacggccaccgtctccgacggcaagctctacatctgcaaggcgcaggccggcgacaagaggtggttcaagggcgccaggaagggcgtcgagaaggccgccgcctccttcagcgtcgcataataatgaaattgtgctgcatcggccgggattattatttctttgatggtttggcttcatcaggggatgcacaacgtagagagcatgcttgtgtatgtgttcctttgattgtacatgagaacaacaaagactaaggagagctccatttccatgc

SEQ ID NO: 15534 - DNA, 3670 bp, Sorghum bicolor
  Clone ID: SORBI-28MAY03-CLUS709_1
gcgtccgcgttaacacgccgcggccctacacacccgcgcgctagctagtgtcatccacactctagcttctagcagtccggaggccggcggcaaaagcaaagcaaagcaagcagcttggtagcgatggcgtccacctcctgcttcctccaccagtccaccgcccgcctcggcgcgtcgccgcgcgtcgcgtccgcgccacgcagcgcccagctgttcgtctgcaaggcccagcagaagcagcagcaggacgccgccgccgtggatcagagcgacgtctctcgccgcgccgcgctcgcgctcttcgccggcgtcgccgccgtcggcgccaaggtcagccccgccgccgccgcctacggagaagcagccaacgtgttcggcaagcccaagacgaacacggagtacatcgcgtacaacggcgacgggttcaagctgctgatcccgtccaagtggaaccccagcaaggagcgggagttcccggggcaggtgctccgctacgaggataacttcgacgccaacagcaacgtctccgtcatcatccagcccacctccaagaagacgatcaccgagtacggctcccccgaggagttcctctgcgccgtcgacttcctccgcggcgcgcaggccttcggcggcagcaccgaccaccacggtggatccgagacctccgccggcgccacctccatcgtgcaggagagcgccgccgacgaggtggacgccaagcaggccaagagcgtccccgtgaaggccgccgccgccgacggcgacgcagagggcgagcaccaggtcgcctcggccaggatcaccgaggggaaggtgaacatccgcaaggcgcaggcgcccgacaagaggtgcttgacggcctcctggtagggcggagagaagaagagcgccaccatcaccgaggagaaatcctgagcctggaatgcatcgaccgagattattacttctttgatggttggggtttattatttggtgtccaacgacgacagcatgcttgtggatagcatccatgaagaccacgtggacccgaacgcgctgacgaacttcaggatatcggagccgctgaggcagagcctcaggtccaaggggatcaaggcgctgttccccatccaggccaccactttcgacctcgtactcgacggcaacgacttggttggccgagcgcgcaccggtcaggggaaaactttggcttttgtcttgcccatattggagtctttggttaacggggcacacaaggcatctagacgaactgaacatggcaggaccccaagtgttattgttctgctacccacaagagagctggccaatcaggtgcatgccgactttgagttttatggtgcaacatttgggctttccgcatgttgtgtgtatgggggttctccttatcgtcctcaagaaatggctttgagaaggggtgtggacattgttgttggaactcctggtcgtgtcaaggatttcattgtaaaaggaactctcaatttgaaaaacttgaaattccgtgtccttgatgaagctgatgagatgcttaacatgggttttgttgatgatgtcgagctcattcttggcaaagtagaagatgctaccaaagtacagacacttctgttcagtgccactctgccagattgggtgaataagctctctatgaggtttctgaaagttgacaggaaaacggttgatcttgtcggtaatgagaaactgaaggccagtgcatctgttaagcaccttgctcttccttgtaacaaggcagcaagggcacaagttattccagacattatccgatgctatagccatggaggccgaaccattatcttcactgagacaaaggattctgcatcagagctttctggtttgattcctggatcccgtgccttgcatggagatgtcgtgcaagctcagcgtgaagtcattcttgctggattccgtggcgggaagttccaagttttggttgctacaaatgtggcggctcgtggtctggatattaatgatgtgcagcttatcattcagtgtgaacctccccgtgacgttgaagcttacatacaccggtcaggtcggacagggagagcaggtaatactggtgttgctgtcatgctttatgagcccagatataaatacagtgtcaacagactagaaagggagtctggggttaagtttgagcatatctctgcgccacagcctactgatgtagcacaatctgctggcagtgaagctgcagatgccatttcgagtgtgtcggatagtgttattcctgtcttcaggcagcaagcagagcagttgctaagctcttccagcctgtctgcagctgacttgcttgccaaggcacttgcaaaggcagttggttacacggacataaagaaaagatcattgttatctccatggaggattacactacattacatcttcaaactggcagaccgatgtggtcacctgggtttgcttttactatattgaaaaggttcatgccagaagagaaacttgcagatgtaaacggtgcaaccccgacggctgatgggacaggcgtggtatttgatgtccctgcagcagatcttgaagattacattcaagctcccggcaatcctgggcacgtcgcaattggtggaggcaagcaaacgcaaccctcgcctgtgcgtgagcaggcaccagccaactctggcgcaggacgctgcggccgtggaggtggtgggagactctcgggtggtggcgctcgaggccgctgcggtggtggcggcagaggccgacgtggtggcggcagagggttttctgggaggggaggcggcggcaacagatttaacaggaggaattagaagctgctgcatgggcgtttgagagaactatgttgtgtttgacgtagttttgaggaggggcgagagaatagtctcagttttggctgcaattgtatcggcttttgtttatttttttggtgttcgaatacgacactcacttttgccaacgcaagagtgtacgtttaaatctactcgaaaattacaatcgtgacttattaagtaaagctttatatgtattgtttcccagccagcccccccccgacgagcccacccccgaggccgactccaccgcggcgctcctcccccaggccacctcccggagcgccacccccgccttcggcgcccccgccgactccctcgcccgggtcgactcccgccccggcgccccggccttcggccgcggcaccgcctcccccgggggggtcggcacccgcgccgtcgccgccgccgtcctgccggggaccgccgcccccgtcgtgggcggcaagcaccacctcagcgccgccgccctctccggcgccgcgctcggcgtcggcggcgcccagccccgcctcatcacggcctccgtcgccgccggcaagcgcgtcgtctgcgccgcccccgccggcggcgtcgcgtggttctggggcgccgcggcggccgccgggatggccgccgcctcctgctgcgccgcatcaggggatgcacaacgtagagagcatgcttgtgtatgtgttcctttgattgtacatgagaccaacaaagactaaggagagctccatttccatgcatgcaaggactccaccgattttcttcagcaccgcaagctgtttaagaaatcttaattagcactaataatatttttctaaaaaaaaaaaaaaaaaaaagggcagccgctcgcgatctagcgc

SEQ ID NO: 15535 - DNA, 513 bp, Sorghum bicolor
  Clone ID: LIB3478-055-Q6-K1-A5
cggacgcgtgggcgagtacggctcccccgaggagttcctctcccaggtcgacttcctcctcggcaagcaggccttcggcggcagcaccgactccgagggtggattcgagaccggcgcggtggccacggccaacgtgctggagagctccacgcccgtggtggacggcaagcagtactacagcgtctccgtgctgacaaggacggcggacggcgacgagggcggcaagcaccagctcatcacggccaccgtctccgacggcaagctctacatctgcaaggcgcaggccggcgacaagaggtggttcaagggcgccaggaagggcgtcgagaaggccgccgcctccttcagcgtcgcataataatgaaattgtgctgcatcggccgggattattatttctttgatggtttggcttcatcaggggatgcacaacgtagagagcatgcttgtgtatgtgttcctttgattgtacatgagaacaacaaagactaaggagagctccatttccatgcatgc

SEQ ID NO: 15536 - DNA, 818 bp, Sorghum bicolor
  Clone ID: SORBI-28MAY03-CLUS55_2
gccggccgggccacgaacaaagcagcagctccacctacttgcatcagctaatcaaactagacctagctaggcaccgagccaaagctcatcgcagaccaccagccatggcttccaacagctggaccctcgagatcccgtcgccggtggccgcgccgcgcctgttccgcgccgccgtgatggactggcacaacctggcgcccaaggtcgcctctcacgtcgtcacaagcgcccatcccgtggagggcgacggcggtgttggcagcgtcaggcagttcaacttcacctcattcatgccattcagcttcatgaaggagaagctcgagtccctggacatggacaagtgcgagtgcaagtcgacgctcgtcgagggaggcggcatcggcgtggccgtcgagaccgcggcgtcgcacatcaaggtggagcccgcggccggcggcggcagcgtggtgaaggtggagtcgacctacaagctgctgccgggtgtggacgtgaagggcgaggaagtcaaggccaaggaggcagtcaccgccatcttcaagggtgccgaggcctacctcgtcgccaaccccgacgcctacaactaaatctgtggatggggatgcgattgcacttcacgggtggtcttatacatgttttgatatattcagagactggattttttttctttcatgttccttttttcgtacaaaataaataaagctgctctaagcagtgtgcggtgtgtggacttgagatgttatgagtggtatgtagcatgctgtcgttgtgcgattatgggtgttttcccctgctattctaaaaaatcttgggtttggtcc

SEQ ID NO: 15537 - DNA, 1026 bp, Sorghum bicolor
  Clone ID: SORBI-28MAY03-CLUS55_1
gcccaagcggagaagcggccaataccgaaaccccgcccaggcagcagcagcacccaagcagcagcggcaagcctaaaaccaccagcggcagcaccttcagctagcgcaagtttagtcgatcggctgatcactgaagcaatggcctccgcgaacagctcgaccctcgagatcccttcgccggtggctgcgccgcgcctgttccgtgccgccgtgatggactggcacaccctggcacccaaggtcaactcccacgtcgtcgccagcgcccaccccgtggagggcgacggcggcgttggcagcgtcaggcagttcaacttcaccctcattcatgccgttcagcttcatgaaggagaggctcgatttccgggacgtggacaagtgcgagtgcaagaacacgctcgtcgagggcggcaacatcggcgtcgccatcgagaccgcggcgtcgcacatcaaggtggagcccgcggcaggcggcggcagcgtggtgaaggtggagtcgacctacaagctgctgccgggtgtggacgcgaaggacgaggaagccaaggtcaaggaggcactcaccgccattttcaaggctgccgaggcctacctcgtcgccaaccccgacgcctacaactaaatctgtggattgggatgtgattccccttcctgaagttcgggtttaattttcttttactttcctggagttttcctctttttttcatacaaaataaaataaagctgctctatgcagtgtgtggtgtatggacacgagatgttataagtggtttgtgatgctttgtttgtgtgattatgtatagttgtataccctcatggttcttttctatgtgggaagaaaaagggcatacatagattatacgaggtactttgttttggaatcctatgcaagtttgactgtaagaaatgtttgctcatttcgaatagatatttggagacttttcattctgctaccttttgtgctcttgaaataaaagttggttttgtggatattgattgttggttttttgactattgacttatgta

SEQ ID NO: 15538 - DNA, 702 bp, Sorghum bicolor
  Clone ID: LIB5121-011-A1-PF1-A11
aactacgcaaaagcgcaatcctaaaaccacctgttgcagcacaagcacctaagcagcttcggctcgcacctagtttagtttatctcggccgatcactgaagtaatggcctccgccagcagctggaccctggagattccgtcgccggtggccgcgccgcgcctgttccgcgccgccgtgatggactggcacaccctggcgcccaaggtcgcctcccacgtcgtcgccagcgcccaccccgtggagggcgacggcggcgttggcagcgtcaggcagttcaacttcacctcatccatgccgttcagcttcatgaaggagaggctcgatttcctggacgtggacaagtgcgagtgcaagaacacgctcgtcgagggcggcggcatcggtgttgccatcgagaccgcggcgtcacacatcaaggtggagcccacggccgacggcggcagcgtggtgaaggtggagtcgacctacaagttgctgccgggcatggacgagaaggacgaggaagccaaggccaaggaggcactcaccgccattttcaagggtgccgaggcctacctcgtcgccaaccccgacgcctacaactaaatctgtggatggggatgcgattctacttcacgggcagccttatacatgttttgatatattcggagaatggttttctttcatgcccctttttcatacaaaataaataaaggttctct

SEQ ID NO: 15539 - DNA, 445 bp, Sorghum bicolor
  Clone ID: LIB5121-005-A1-PF1-H7
gcatccaagcagaagctgcaagtagcactgccacgcacagagcctagcaccgacgtctagcgcaagtttagtcgatcggccgatcactgaagtaatggcctccgccaacagctggaccctcgagatcccttcgccggtggccgcgccacgcctgttccgcgccgccgttattgactggcacaccctggcgcccaaggtcgcttcccacgtcgtcaccagcgcccaccccgtggagggcgacggcggcgttggcagcgtcaggcagttcaacttcacctcattcatgccgttcagcttcatgaaggagaggctcgatttcctggacgtggacaagtgcgagtgcaagaacacgctcgtcgagggcggcggcctcggtgttgccatcgagaccgcggcgtcgcacatcaaggtggagcccgcagctaacggcggcagcgtggtgaat

SEQ ID NO: 15540 - DNA, 1978 bp, Sorghum bicolor
  Clone ID: SORBI-28MAY03-CLUS7760_1
actgagcacgcccgccccccgcgcacccgacgcctgccgccccgccctcgtgtccgtgcctcgcgcgccgaccccggtcccctgcgccaccggcccgctgggccccgcccccccgccctcgccccctcgcgcgcccccggccctcctgcgatccccccgcccgcgggccccggctcctgcccctgtgcgtccctacgacgcgcaaatgtctgctccttgctccgcctcgtcgcgccgccccccccgcactgcacggattattactggtttcttattggcaaccagatcgaaaaaggggaggaattaatttgtggagtcgggtggtggtgagatctgatttagattggttgattagcccggttggtagcggtattaggctagcaccagcagtcggtggtggtgtggtggtgcaagagagcaaggccctgaccgactgcctcttgcctgcctgccggcactgcatctgctggatctctgttcgggtgcgggtgtgtgtgaagcgcgggctctataaatacgactcagatctggaggcacctcctcctcgtccgccccagtctaatccgattcaaaccgcccgttcctcgtgtccgtgccaagcaagccgagaccaatccccagagccagctgctcggtgctccacgcgatggcgcagaaggagaccaatggcagcaacggcgagcacatctccacccgcccgccgcccaccccctcgcccctccgcttctccaagttcttccaggctaacctgcggatcctcgtcaccggtggggcgggcttcatcggctcgcacctcgtagacaagctcatggagaacgagaagcacgaggtcattgttgctgataaccttttcactggttcaaaagacaacctgaagaagtggatcggccacccaagatttgagttcatccgtcatgatgtcacccagccgcttcttgtggaggttgaccaaatctaccaccttgcttgccctgcttcaccaatcttctacaagcacaatcctgttaagaccatcaagaccaatgtcattggtaccctcaacatgctgggacttgcaaagagagttggagctaggattttgttgacatccacctctgaagtttatggtgatccgcttgagcatcctcaaaccgaggcatactggggcaatgttaacccaattggtgtcaggagctgttatgatgagggtaagcgtgtagcagagacgctgatgttcgactatcacaggcagcatggcattgaaatccgaattgccaggattttcaacacctatgggcctaggatgaacattgatgatggccgtgttgttagcaacttcattgctcaggctgtgcgtggtgaacccctgactgtccagaggcccggaacacagactaggagcttctgctatgttgccgatatggttgatggtcttattaagctgatgaatggaaacaacactgggccgattaacttggggaacccaggtgaattcaccatgctggaacttgctgagaatgtgaaggagttgatcaacccagatgtaacagtgacgatgaccgagaacactcctgatgatccccgccagaggaagcctgacatcacaaaggcaaaggaagttctggggtgggagcccaagatcgtcctgaaggacggcttggtgctcatggaggatgatttccgggagcgcctggccgtgcccaagaaaaccaaggcctaaactgccctgcggttggcaaagaatatccacgggggagcatactcatagttgggttcgtcattattcgtggtcacatttcattacggaatttgagttccaataaacggaatatacctttgtcgttcaccttgaaggattgtattattagaattttcatacagggctggcagtttgagtctctgcctacgcagatcttgtggtacttgtgtttgtagccttatatgtactccctgagtcgattatagcaatgttgatgccattttgagctttttggtcaag

SEQ ID NO: 15541 - DNA, 602 bp, Sorghum bicolor
  Clone ID: SORBI-28MAY03-CLUS198_2
gccggcgccgggccgggagaagccatctgcctcctgcgcctccaccctcgtcgccgcctctctccttctgagtccgcagatccgtcaggtgagaggaagccgctcgcacccatggcctccggtgagctcgcctgcacctacgccgccctcatcctcagcgacgatggcatcgccatcaccgccgagaagattgccacgatcgtgaaggcggccaacatcaaggtcgagtcctactggccggcgctcttcgccaagctccttgagaagcgcaacgttgaggacctcatcctctccgttggatctggtggtggtgctgctccagttgctgctgctgcccctgctggtggtgctgcggctgctgctgcgccggctgccgaggagaagaaggaagaggttaaggaggagtctgatgacgacatgggcttcagtctgttcgactgaggagccccacactccaatagcaaattcgcttatgctgtccaagactatcttatgttatgtctctaggcttttgttacaagtactgaagttttgagtattttgagatgtggctatggcaatgtgatgatgaacccgaaaaaaaaaaaaaaaaaaggccccta

SEQ ID NO: 15542 - DNA, 734 bp, Sorghum bicolor
  Clone ID: SORBI-28MAY03-CLUS198_1
gcacgaggctgcctcctgcgcctccggccgcgccgggctagaagccatctgcctcctgcgcctccaccctcgtcgccgcctctctccttctgagtccgcagatccgtcaggtgagaggaagccgctcgcacccatggcctccggtgagctcgcctgcacctacgccgccctcatcctcagcgacgatggcatcgccatcaccgccgagaagattgccacgatcgtgaaggcggccaacatcaaggtcgagtcctactggccggcgctcttcgccaagctccttgagaagcgcaacgttgaggacctcatcctctccgttggatctggtggtggtgctgctccagttgctgctgctgcccctgctggtggtgctgcggctgctgctgcgccggctgccgaggagaagaaggaagaggttaaggaggagtctgatgacgacatgggcttcagcctgttcgactgaggagccccacactccaatagcaaattcgcttatgctgtccaagactatcttatgttatgtctctaggcttttgttacaagtactgaagttttgagtattttgagatgtggctatggcaatgtgatgatgaaccccaaaccatcttattagagtgaaacttgtttctatattgttccaaaaatcttagcaaaaaaaaaaaaaaacaaaaaaaacccctaagcctcaaatttaatgcatctggttgatgcgctgatctgttgagttgcttttc

SEQ ID NO: 15543 - DNA, 1251 bp, Sorghum bicolor
  unsure (1)..(1251): unsure at all n locations
  Clone ID: SORBI-28MAY03-CLUS533_2
ccctcaccaaccgcagcagcgagactgagaatggccgcggcgccgtcgtccctcgcgtcctcccacctctcccgcctcgccgacctccgccgcgccgcggcggtggccactcccgccgtcccacagcagcttcgcatcggctgctcgcgccgccgcgcccagcgcgtcgtcgccatggctggatccggcaagttcttcgtcggaggcaactggaagtgcaatggaacaaaggactccattagcaagcttgtttctgaattgaatgctgctaccctcgaaactgatgtagatgttgtggtggcacctccattcatctatatcgatcaggtcaagaattcactaactggtcgcattgaggtttctgctcagaatgtgtggattggaaaaggaggagcctacaccggagagatcagtgcagaacaattggtggacattggtgttcagtgggttattcttggacactctgagcgtaggcatattattggtgaagatgatgagtttattgggaagaaggctgcatatgcattgagccaaaatgttaagcttattgcctgcataggagagctcctggaagagagggaagcagggaaaacttttgatgtatgttttacgcagatgaaggcttttgcagatagtatttcaaactgggccgatgttgtaattgcatatgagcctgtttgggctattggaactggaaaagttgctactcctgagcaggcccaggaagttcatgccgctgtacgcgattggttgaagaccaacgtatcacctgaagttgcctctagcactcgaataatctatggaggttctgtgaatgcagccaattgtgcagagctagcaaagaaagaagatattgatgggtttcttggtggggtgccttcttgaaggcaccggatttcgccaccattggcaactcactctctccctctctctctacttggtgacggttcgtgttcttgttatgctgggtccgcgcttgcagcttgtcgctgtcgccataaagcatgagtcaggtagaggtagtgttcgacaggtcttctttgagagacacgggccgggcagcagctatcgcacggtgtgnagacgacagaaaataatgcaagatgtcatcatctttntttgttctcgtagaccttgtgtacgtgacgggagttcagttgtatgtgagcgatgtaagttgggaatattgtgttgtgtgtccttttntgtggaaaataatntgttatcattctcctcgacccacggcgtccg

SEQ ID NO: 15544 - DNA, 1902 bp, Sorghum bicolor
  Clone ID: SORBI-28MAY03-CLUS533_1
gggggcgtccacgcgcgcagcggtgcccgcgctggctaggggtctgttcgggcgtgcgccgcgtccttggcgcctcttccgtccccgcccggctcccggccctcgccggactaacgctgatcaggccaacttgttgagtgctatgtacagtggttttttattactagtactagtactcggcgattgcaatagcagcagcaaaagcatggggggctgtaggacaagagcaacaagaaaacagtctgtgtccttcacctcgggacaaaaacaccacactcatctctcatccaattttcacactcgactcaccaccaccagcagcaacaaagcagcaggaatctctctttttcccaagtttctacacccacccatggctccacggatctgatctggctggcgtcgaccacctccttgcccttccctcgatggcagggcaacacaggtgcgccgaccaacagatctcgggcgggtcttcaacttcatcagatccagcaatggcggaaacggtgcacggacatacagtacgtactagtactactagtagcctttacgtctcttggtcgcggacgggacgggacgaagaagatccacatactcagagatagatccaacagatcctcagatccgaacggaggcgacggagaagacgaagccggcgaactccggcggcgggcgcacgacggtccagctcttggtcttgacatcgaacacccacagtgcgtgccgtccaccaccgccctcgccatcaagcgcgcccgtcacaaccaccttctccccgccgccgacgcacaccgcgcgcgccgtgccagccttgagccccggcgggtacggcccgacctcgcgccacccgcggcgggtccccatccactccatgacggcgttgccctcgatgcaccagacgcgtcctttgacgaccacgtgcgcggcggagggcggcgcccggacgcgctccagcctccgccaggcgcgcgcggccgggtcgaaccactcggcgtcgcgctcgaacccgccctgccgcgccgtgcggtacccgctgacggccaggaaccggtcccccgcgaccgtggccatgccgtcgcactcgtcgcgctcctccgacatgtccgggagcgggtcccacgcgtcggcgcgggggtcgtaggcctccgccgtcttgagcgcgttcttgtgcctggcgtgcccgccggccacgtagatcttgccgccggcctcggcgcacgcgaagaaggaccgcgccgaccgcatcggcgcgcctcggcgccaccgccccgtcgcggcgtccaggacgtggacgtcggccacgggctcgaaggtgcgcgggtcccagccgccgagcacggccaggcgcgtccccaccgcggcgcactgcgcgaagacgggcaccacaggcggggcgccgcggtcacggcgccactcgccggtcgtcacgttgtagaccgcgacgccgtaggccggggtgttggcgggaccgtcgtcgcccttgggttcggcgtcgtcagcggcggcggacgggttgccgaactgcatgaggtagacgaggtcctcgttggcgtccgcctgcgcgcgggcggaggcgaaggctggggtggaagcggcgctccgccagccgcggcagacccggcgcatggcgcggtgggaggcgtgcgggacgcgcgccaggcagtccacggccacgtcgtcggggatacccgggatcaggtcgacgtgctggtcttggccgccggcgccgcggtagcagccgctgccgacgccccttgggctccgcatcttggatggctttttgtttcggcttgcgtgtgtctgcttttcttctcatggttcttcttctcctctctatgagatgggatggggggatgagaattgagaagaggggaatgggatgtgtgtttttttttttttttt

SEQ ID NO: 15545 - DNA, 1253 bp, Sorghum bicolor
  Clone ID: SORBI-28MAY03-CLUS1247_1
ccgagactcacaacaagccggagagccaagagcttcagctcaactgtgcccattcgtttcttcctctttgtttggtgtttgtcctccggccggcctctgttttctaacggaggtgtctcaccatagtcttgctaccaagggcactctctctagagctgagcaccatcttcctcaaggcagctagcgaccatggtctcccctgacaccatccgcacggccatcggtgtcataggcaatgggaccgccctggtgctcttcctctccccagtgcctaccttcatccgcatctggaagaaagggtctgtggagcagtactcgccgatcccgtacgtggcgacgctcctcaactgcatgatgtgggtgctgtacggcttgccggtggtgcacccgcacagcatgctggtgatcaccatcaacggcaccggcatggccatccagctcacctacgtcacgctcttcctcctctactccgcgggggcggtgcgccgcaaggttttcctcctgctcgccgccgaggtggccttcgtcggcgccgtcgccgcgctggtgctcaccctggcgcacacgcacgagcggaggtccatgatcgttggcatcctctgcgtcctcttcggcaccggcatgtatgccgccccgctctccgtcatgaaaatggtgatccagacgaagagtgtcgagtacatgcccctgttcctgtctctggcttccctcgtgaacggcatctgctggaccgcctacgcgctcatccgcttcgacctctacatcaccatccccaacgggctgggcgtgctgttcgcggtggcgcagctagtcctgtacgccatgtactacaagaacacccagaagatcatcgaggcacgcaagcgcaagacggaccaggtcgccatgacggaggtggtcgtcgacggcagcggcagggcctccaacaacaacacctactgatatatcgatgagtactttgtactacgtacgtgatgacaacaactagcaggtgaccaccaatacaagcaagagctggcgcccacaagtacgggggctacatatatacgccaacgtctgtgtgtgtatctagcattagcagcgtccttcttcctgatgaaaggatgatcgatgcatatgcatcttattaagctctcggtcgtcgtctcgtctatcaattactagcttttatactttccatgacatccatccttcctagtaacgaaacctttggccactaagctaattaatatatgctaaagcatgttttcgaa

SEQ ID NO: 15546 - DNA, 658 bp, Sorghum bicolor
  unsure (1)..(658): unsure at all n locations
  Clone ID: SORBI-28MAY03-CLUS4830_2
gcttcgccaacgccggcgagagctagggtttcgtgcgccaccgccaccgccacttccgcccgccatggccgagacccccacgtatcagatcctggtgcgtctcctcgacgggcgcaccagatgtctccgcttctccacgcccaccgtttccggcacggtgctcctcgacgccgtcgcgtggatctctcgcgtccccgctgacgccctccgcctcgtcaccggccgcatcgacgtctcgccctcctccgtgctcacctcggcagctgatggccagttcccctacgcgtccgcgctcctccgccttcgaggaggcaagggcgggttcggctccctcctcagaggggccgcctccaaggcggggcagaagaagaccagcaactttgatgcctgccgcgacatcaatggccgccgcctccgccacgtcaacgctgagcgccgcctcgaggaatggaaagccgaggccgccgaccgccagctagaaaagctcgctgagaactttatcaagaagaaggccaaggaggcaggccgcagcggcggaccctcagctgccgaggtggacaagtacctggagaagtaccgcanagatgctgagatctgcgtgaatgcgggtgaggaatccgtgcgtgcatctcttgggaagaggaagaccgctcctaag

SEQ ID NO: 15547 - DNA, 1752 bp, Sorghum bicolor
  Clone ID: SORBI-28MAY03-CLUS4830_1
cgaccctctccgtccctcgccccgcccccgcgagcgctagcgacggctccgcaaccgcacccccaccccccgtctctcgcgccgcccacgacggcgagagctagggtttcgtgccgccaccgccaccgcgacgtccgcccgccatggccgagacccccacgtatcagatcctcgtgcgtctcctcgacgggcgcacccgatgtctccgcttccccacgcccaccctttccggcacggcgctccgcgacgccgtcgcgtccgtctctcgcgtccccgctgacgccctgcgcctcgtcaccggcctcctcgacctctctcccccccccgtgcgcacgccagggcgtgttggcctcctcccccacgcggccgccctcctcggcctgccagaaggaaacgacgggctcggccgcctcctccgacaggcaccgtcccaggcggggccgcagcagcgcagagacctggatgcatgaagcgaaggccgaggccgccgaccccgacctagcaaagctcgccgacaactttagcaagaagaaggccaaggaggcggcccgcagcggcggaccctcgcttgccgcgttagacaagtgcctggagaagtaccgcaaagatgctgagatctgcgtgaacgcggttgaggaatccgtgcgtgcatctcttggaaagaggaagaccgctcctaagctgccctctggcgcagacgctaagaagcttaagatttggttgggaaagaacaaagtagaagaagatgaaagtgatagtgacagtgacattgacagtgatgtagatgatgagaacagtgaagatcatgagaacacagatgcaaaatctgtactagttgatgacgggaattgctcaaatggatccagcaaaaatgaaaagcttgaactgggttctgtttctgggtcacattcagaaggagagtccgccggccgggagggcctctcaacctacccttcccggcggcggcggcggcggcggcgcaggagcagcagcagcacgcgaagatggtgaagttcctcaagcccggcaaggccgtgatcctactccagggccggttcgccggcaggaaggcggtgatcgtgcgcgtgttcgaggagggcacccgcgaccgcccctacggccactgcctcgtcgccgggctcgccaagtaccccaagaaggtgatccgcaaggactccgccaagaagacggccaagaagtcgcgcgtcaagtgcttcatcaagctcgtcaacttcacccacctcatgcccacccgctacaccctcgacgtcgacttcaaggacgtcgccaccggcgggcccgacgcgctctccacccgcgacaagaaggtcgccgcctgcaagaccgccaaggctcgcctcgaggagaggttcaagacaggcaagaacaggtggttctttaccaagctccgcttctagatgcttggcgtccccaatagtgcctgctttagttgccgatttcttgtattggacactctctaagcttatctctgttttcgtattaccatgaagacttcgtgtttagatgcggggctctcaaagtatattttactatcatgtgctataaatccttggcttggcattgacaattaatgagatgactgtatgtacgtatatgttaaccgttacttggaagagccccaagtttggactggatttgtgatgccttaaaacttttttacaaaaaaaaagggggtatataaaccgttacttggaaattgaatgaagtttggcatttcgttgcctggtatat

SEQ ID NO: 15548 - DNA, 597 bp, Sorghum bicolor
  Clone ID: LIB5052-003-A1-XP1-C11
gccggccgggtccggctctcaacctacccttcccggcggcggcggcggcggcggcgcaggagcagcagcagcacgcgaagatggtgaagttcctcaagcccggcaaggccgtgatcctactccagggccggttcgccggcaggaagaaggtgatccgcaaggactccgccaagaagacggccaagaagtcgcgcgtcaagtgcttcatcaagctcgtcaacttcacccacctcatgcccacccgctctccacccgcgacaagaaggtcgccgcctgcaagaccgccaaggctcgcctcgaggagaggttcaagacaggcaagaacaggtggttctttaccaagctccgcttctagatgcttggcgtccccaatagtgcctgctttagttgccgatttcttgtattggacactctctaagcttatctctgttttcgtattaccatgaagacttcgtgtttagacccggggctctcagagataattttactaagatgtgctattgatgtgttaaatgttgtcatggatagatctggttttaattttgtttgaaatcacggcttgcgtgttcacaaaaaaaaaaaaaaaaaaggccccta

SEQ ID NO: 15549 - DNA, 668 bp, Sorghum bicolor
  Clone ID: LIB5049-006-R1-XP1-C12
gccggccgggccgggatttccgcagcctcccaaccctaccggcggcgcagcagcatcaccaccaccgcccgaagatggtgaagttcctcaagcccggcaaggccgtgatcctcctccagggccggttcgccggccggaaggcggtgatcgtgcgcgtgttcgaggagggcacccgcgaccgcccctacggtcactgcctcgtcgccggcctcgccaagtaccccaagaaggtgatccgcaaggactccgccaagaagacggccaagaagtcccgcgtcaagtgcttcatcaagctcgtcaacttcacccacctcatgcccacccgctacaccctcgacgtcgacttgaaggacgtcgcctcgggcgggcccgacgcgctctccacccgcgacaagaaggtcgaggcctgcaagaccgccaagtaccgtctcgaggagaggttcaagagcggcaagaacaggtggttctttaccaagctccgcttctagatgccgggcgtcccgcatagtgtctgctttagttgtcaatttactgtattgggaactccttaagctatctctgttttgctattgccatgaaggcatcgtgcttggtatggatctcggagaagattttgttaaaaacatgtcgatgatgtgttaaatgatgccaaaggatacatctggttg

SEQ ID NO: 15550 - DNA, 1365 bp, Sorghum bicolor
  Clone ID: SORBI-28MAY03-CLUS1076_1
ccccgaccgaaagccaaaggcatagaaaccagtcaagactcaagagcgagttccagtagctatagccgcgcctgttgggaaagccatctgtgtcggcgatcatggaggatgagaggaggaacagaaaccagtcaagactcaagagcgagttccagtagccgatagtatagccgcgcctgttgggaaagccatctgtgtcgtcggcgatcatggaggatgagaggagcacccagcagcaccagggcggtgaggtccaggagaacgccgccgaggtgaaggacaggggactcctcgacagcctcctcggcaggaagaagcacgaggaccaggacaagaagcaggaggaggagctggccactggcatggagaaggtcacggtggccgagcccgagaagaaggaggaggagcacgaggccgccggcgagaggaaagagagccttctcgccaagctgcaccgctcgagctccagctccagcccgtcgagcgacgaggaagaggaggtgatcgatgagaacggagagatcgtcaagaggaagaacacgcacgctcaccaccaccaggaggaagagcacaagccgcagcacttcccggccccggcgccacccccacacgtggagacgcacgtccaccagcatgaccacggcgtcgtcgtccagaaggtcgaggacgacgtgaagaccgagaccccacccccagcgccggaggaggagaagaaaggcctgctggacaagatcaaggagaagctccccggtggccacaagaagcccgaagacgctgccgctgccgcaccggccgtccacgcgccggcgccggcgccgcacgccgaggaggtgagcagcccggatggcaaggagaagaagggcttgctgggcaagatcatggacaagatacccggttaccacaagggcgaagaccacaaggacgccgccggcgagcacaagaccagctcctaaggtcgcccgcagcgtgtgtcctcctggccgggccatgatcgatcagaagcgttggcgtgcgttttgagttctggtttgcttttagcaagttaatttgtttcaaggtggatcgcgtggtcaaggtccgtgtgtgtgctttaagcccgaccggtggtactggcagtgaccagtgagtgttgatgcttgtgttggctttgggacgggctttagtttggttccaagtcagggtctggaactctggatgttgtgtacttgggtttgttgaattattatgagcagtttcgtattgtaattgggctgggttacctggacattggtatttgcattaataattgctttggttcctgcccagcacatatatattattgtcccgttgtgacgcttgtcaatttcatttggatgttggcattgt

SEQ ID NO: 15551 - DNA, 342 bp, Sorghum bicolor
  Clone ID: LIB3478-044-P1-K1-C6
ggaaaataataagttagacctggagagcacactgaaagaactgaataacaccattttaggaagaagcacgaggaccaggacaagaagcgaggaggaggagctggccaccggcatggagaaggtcacggtggccgagcccgagaaggaggaggaggagcacgaggcctgctgcgagaagaatgagagccttgtcgccaagctgcaccgctccagctgcagctccagctcgtcgagcgaccaggaaaaggaggcgatcgatgagaacggagagatcgtcaagaggaagaagaagaacggccttaaggagaagatcaaggagaagctgccggtgcaccacaagga

SEQ ID NO: 15552 - DNA, 1324 bp, Sorghum bicolor
  Clone ID: SORBI-28MAY03-CLUS705_1
agctaggttaagtcagtcagccagtcagtggatgagccgagagttcattcatgctgagactgagagggttattatttgtgatattttttctcttctttttttttcctgattttgtatattgtaatatccagctggatttccaatgaatcaacctgtataataccagtattaattatgaatcatgctacatgaatgagtgaatgaatgattatcttcaccaccaaaaaaaaaaaaaaagggaggcccgggccccccctcggattttttttttgtctttgcttggtttcgcttggctctggctcccgatcggcaactgggtggcggatctcgttcgccgtcggggtctagtcggcgccgggctagatcggtttatttgccttggctattttttctttttgggggtctgctgagttgagttgctgttgctaatgtcttgcaggcgacgagctcctctccgggtccggccgggcttggctgagccggccgggccgggctcgcaacgctgccgcgcctccgagagcctcatctcctccacccacttgcgagcgagctagggttccgagagccgccggcgccatgttggtctaccaggatctgctctctggcgacgagctcctctccgactccttccagtataaggagatctttgacggcgtcctctgggaggtcgagggcaagtgggtcgtcaaaggagctgtcgatgtggatattggtgccaatccatctgccgagggtggtgaagatgagggtgttgatgaccagactgaaagggttgttgacattgttgacaccttccgcctccaggagcaacccacatttgacaagaaaacatttgtgactaacattaagcgctacatcaagaacctcactggcaagctggagccagagaaggcagatgaattcaagaagggcattgagggtgccaccaagttccttcttagcaagctcaaagatcttcagttctttgttggtgagagtatgcatgatgatggaagcctagtgttcgcttactacaaggaaggtgccactgacccgacattcctctattttgctcatggtctgaaggagattaagtgctaggcgggcatgccctctttacctcatgttgcttgttatcatctttacctcatgtcgatggttatcatctatataatactatcctatttttgttctagtatggattatgtcatggatggttatggaaaaactgttttggaaaaaaactgttggaagaatggattcggattatgacgtgaaatgttttggaaaaactgagaagattggattggagttttccaataaaaaaaaaaaaatgcccgtcggc

SEQ ID NO: 15553 - DNA, 586 bp, Sorghum bicolor
  Clone ID: LIB3481-059-Q6-K1-D6
gttgagccctaaagtggcacgattgcaattgccgtttgcaattttaatcacttatcgacatattagaaagctacattctttcttaaatagtgtaatccttaaccgtcacaggttatatttcattttttcagaatttgctggcatgctttcttatgtgcccttcttttttatgaaaaaaactagtgaaatggaattgggagcaactatgccatattagatatctgcagcagtagaattgggattgggagcaactatgccatattaaatatctgcatcagtagagaagatggtgcttgatgtttgaagctctaataccaagggtagagaggacctactaactggtgcatcttgagtcgttggacatccagaaagagcaccaactaattgaagctttaaaggcaccttctgaagacagtggagtttgaagacatgaagccatcttgctgtttaggacttgcaatatcttattggggctttctgtttataactatactgcaggattgtagagctagcatgtgtgactaggtgatgtttgttatttgaaattgtttaaactgctttttgtctgaatcatgaatattttccc

SEQ ID NO: 15554 - DNA, 698 bp, Sorghum bicolor
  Clone ID: SORBI-28MAY03-CLUS181_2
tcgcgatcgatgaaaaattccccattcgttccccttctcgcctccacgagccttccacaaatcggcctccccgattttcctcctaatctcactcaaaccctagccgaatcccagatccatccccagctctagcgtccccccctctcgccggcgacgaccatgggcaacccggagaagctgatgaaccagatcttcgacctcaagttcacctccaagtcgctgcagcggcaggcgcgcaagtgcgagaaggaggagaaggagcagaagctcaagtgaagaaggcgatcgagaagggcaacatggacggcgcccgcatctactgcgagaacgccatccgcaagcgcaccgagcacatgaactacctccgcctcgcctcccgcctcgacgccgtcgtcgcacgcctcgacgcaggccaagatgcaggacatcggcaagtccatgcagtacatcgtcacgactcggcgccaccggacctacagaagcatggattgatcagcatgggggaccaggcctacttcatggaggcgccatggccggccctacctccctctccagcgcccgagaccgaggacaacagcctcatgcagcaggtcgccgacgactacgggctcgaggtctccgtctgtctgacacaggccgccgcccacgtcatccctgtcgccaaggataatgagaatgtcgatgaggatgacctctct

SEQ ID NO: 15555 - DNA, 1572 bp, Sorghum bicolor
  Clone ID: SORBI-28MAY03-CLUS181_1
gaaaaagcccgaataccgtggccctcacgcccgcccacacaaacccaatccttccaacccatttccctccctcccgttccgtccccgcccctgtctgtctcttctgcttcccccccgcgcgccgccgcccgctggtgatccccgtcgccgcggaccagcagcagcagcagcagcagccatgtcgtgctcccacctctccaccgcctggtcctcctcggcgctcgccagcagcgcctccaccacccagcggcgcggaagctccgccccgcgctcgggcctcgtggtgcggtgctccctccgcgagctccgcacccgcatcgactccgtcaagaacacgcagaagatcacggaggccatgaagctggtggccgccgccaaggtccggcgcgcgcaggaggccgtcgtctcctcccgccccttctcggaggcgctggttgaggtgctctacaacatgaaccaggagatccagacggaggacatcgacctgcccctcacccgcacccgccccgtcaagaaggtggcgctcgtggtcctgaccggcgagcgcggcctctgcgggagcttcaacaacaacgtgctcaagaaggcggaggcccgcatcgaggagctcaagcagctgggcctccagtacagcgtcatcagcgtggggaagaaaggcaacgcctacttccagcgccgcccctacatcccgctggagcgggacctggaggtgaacggcgtgcccaccgtcaaggactcgcagtccatctgcgacctcgtctactcgctcttcgtctcggaggaggtggacaaggtggagctgctctactccaagttcgtgtcgctggtgcgctccgaccccatcatccagacgctgctccccatgtcccccaagggcgagatctgcgacatcaacggcgtctgcgtggacgccaccgaggacgagctcttccgcctcaccaccaaggagggcaagctcaccgtggagcgcgagaaggtgaagatcgagacgcagcccttctcccccgtggtgcagttcgagcaggaccccgtgcagatcctcgacgcgctgctcccgctctacctcaacagccagatcctccgtgccctgcaggagtcgctcgccagcgagctcgccgcccggatgagcgccatgagcagcgccaccgacaacgccatcgagctcgccaagaacctctccatcgcctacaaccgacagcgccaggccaagatcaccggggagatcctcgagatcgtcgccggtgccgaagccctcgcctgagcccttgtgacttgtgtggtgcggggctcctgctatatataattctttttctcattttcctgctgtccactctgcctgtaattcctgattagcacaaacgcaacggagttccgtgttcctcgcgacatacagtacacaagaatttcaatccagagatgccaaaatgtataatctgagtattctaaaacttgccttgtcttgcgaatgtccacctagtttcgatgctttagctccatttgacacattatattagttgccctgtgcggctgtgcccagtctgaaactgaaatagaattgctgcatctagccct

SEQ ID NO: 15556 - DNA, 651 bp, Sorghum bicolor
  Clone ID: LIB5049-010-R1-XP1-B4
gccggccgggccgggtcgcctcccgcctcgacgccgtcgtcgcacgcctcgacacgcaggccaagatgcaggtcatcggcaagtccatgcagtccatcgtcaagtcgctcgactcggcgctcgccaccgggaacctacagaagatgtccgagaccatggacaacttcgagcgccagttcgtcaacatggaggtccaggccgagttcatggagggcgccatggccggctccacctccctctccacgcccgagaccgaggtcaacagcctcatgcagcaggtcgccgacgactacgggctcgaggtctccgtcggtctgccacaggccgccgcccacgccatccctgccgccaaggataaggagaaggtcgatgaggatgacctctctcgccgcctcgctgagcttaaggcccgcggctgagagtgcagccttttcgatgtgattcatgcttatgccgttgagccgcaattactcagtgtcctgtgggctgctactcatgttcggtagattcgtaaatactgttatatgcttgaaggcgtgtgttggcattgccatgtgggtctgtggacttgatggaaactttgctgtcatattgtactataaaaatgcataatttgcgcgattgtaaaaaaaaaaaaaaaaaaggccccta

SEQ ID NO: 15557 - DNA, 1496 bp, Sorghum bicolor
  Clone ID: SORBI-28MAY03-CLUS340_1
agaacagccagccaagaagcaacctactaagcaaacgcaaggcaggtgccccagctcgctccgggcttagttagcagccaggcagccatgaacttcggcggaaatggcaacgcgacgacgatccggtgcaagtactgcagcgcgtgcctgaccgtgatccccggcgagcgcgccatccagtgcgcgcaatgcaactgcgtgacgcgcatccggcgcggcgaccgcatcccgccggcgcggccgccggcgcacgtgccgccggcgttccagcgcgcccgcggcaagaagcgcgccgtcctgatcggcatcacctacgccggcatgcgccgcgggtgcggcgagctcagggggcccatcaacgacgtcaagtgcatgaggaacctcctctgccagcgcttcggcttccccagcgagtgcatcatcatgctcaccgatgaccagagggatccgttcaggctgccgaccaaggagaacatccggatggcgatgcactggctggtgcagggctgcagctacggcgactccctggtgttccacttctccgggctgggcgcgcaggtggccgacgacgacggcgacgaggcggacgggtacgacgaggccatctgcccgctggacgcgttccagaggggccccatcctggacgacgagatcaacgaggccatcgtgcgcccgctggtgcacggcgtcaggctgcacgccgtggtggacgcctgctacagcgccacggtgctggacctcccctacgtgtgccacatgtccaggaacgggttctggcagtgggaggacgagagccccccgtcgggcgcctggaagggcaccagcggcggccacgccgtgctcatcagcggctacagcgagggcaaaagcaacttcgccatgatgccggatgcgtacgcgtcggtgggggcaatgacgcacagcttcatccgggcgctggagtgcgagccgcgcggggtcacctacggccgcctgctgacctccatgagagccatcatgaagaaccgcggcgggggacacgatctgcagggccccatcggagcacccatccacacggtggccaacttcagcggcgtgcaggagccgaacctgtcctcgtcggagatgtttgacatacaccgcaagccgttcgtcctgtaaaacaccacacaccaggaccgcttgtacgcacaaatcactattactgctgcagttcaacaagaacacttaatgatcgccgtatcagaataatcagttatccatcgggttgagctatgatgcttcctagggtaaaccaagtgtaataatcagttatcctcccttagacttctagtgaacctcagtgtaataattaagtctgtcgttcatggtcctcttatatacgtatatatgtaaaccaagtgcaatatacatgcggcttcagcatgcagtttcagtgatcaaaatgcagtttatgcggcttcagcataataaggctattgtttctcttttacatgactctaaaatgaactaagtgt

SEQ ID NO: 15558 - DNA, 1132 bp, Sorghum bicolor
  Clone ID: SORBI-28MAY03-CLUS44_2
tgtgcggcgtcaggcggcgggctggattctagggttagcaccttcgcacacccgcgcagcgagctcgccgccgccgccatctttcgtccgctcgtgcccgcgaaggagccgtaggcaccgagcaagatggcgaggggtttgaagaaacatctgaagaggctcaatgctccgaagcattggatgcttgacaagcttggtggagcatttgcacccaagccttcacctggtccccacaaagccagggagtgcttgcctttgatcctcatcctcaggaacaggttgaagtatgccctgacctaccgtgaagtcatttcaatcttgatgcagcgacttgttatggttgatggaaaggtcaggactgataagacatatccatctggattcatggatgttgtgtcaattccgaagactggggaaaatttccgccttctctatgataccaagggacgcttccgtctccacagtatcagggatgatgaggccaagttcaagatgtgcaaggtgcggtctgtgcaatttgggcagaagggcatccctttcctgaacacctatgatggccgcacaatacgctacccagaccccctcatcaaggccaacgacaccatcaagatcgacctggagaccaacaaaattgttgacttcatcaagtttgatgttgggaatgtcgtgatggtgactggtggaaggaacactgggcgtgttggggtgataaagagcagggagaagcataagggcagcttcgagaccatccacgttgaggattcccttggccaccagtttgccacccgcatgggcaatgtgttcaccattggcaaggacaagaaaccgtgggtgtctcttcccaagggcaagggtatcaagcttagcatcattgaggaggcaaggaagcgcaatgctgaggctgctgctgaggcttgattctcacaacttagctacagataaaccattgctgtaagcattttccataggtgcagacatgagactaatggtacactagtgttatcatggagctgttttgaacaccgaagctgctggttcacatttctttttttcccccctttgtgatttggatactatatttatcatgagttttcgtttattgagcaaatgaaacattacaagtttggcgacc

SEQ ID NO: 15559 - DNA, 1149 bp, Sorghum bicolor
  Clone ID: SORBI-28MAY03-CLUS44_1
gagtctgccttggctctcgttatcccggcggcggcggcggactggaaggcgcaggaggaggaggaggagcagcagcaggcggcgccgaggagcggcttcccaccccgagcttgtaaccatggctaggggattgaagaagcatctcaagaggctcaatgcgcccaagcattggatgctggacaagcttggcggagcttttgcccccaagccatcttctggtcctcataagtccagagagtgcctgcctctgatcctcatcatcaggaacaggctcaagtatgctctgacataccgtgaggtcatttctatcctgatgcaacgccatgtacttgtggatggcaaggtcaggactgacaagacctaccctgctgggttcatggatgtcatttccatccccaagaccaacgagaactacaggctgctgtatgacaccaagggccgcttccgtcttcacccaatcagggatgaggatgctaagttcaagctctgcaaggttaggtctgttcagtttggccagaagggcatcccgtacctgaacacctatgatggccgcaccatccgctaccctgacccgctcatcaaggccaatgacaccatcaagattgatttggagaccaacaagattgtggacttcatcaagtttgatgttggcaatgttgtcatggtgactggtggtaggaacactgggcgtgttggtgttatcaagaacagggagaagcataagggcagctttgagaccatccacgtcgaggactctctgggccaccagtttgccacccgtatgggtaatgtgttcactattggcaagggcaacaagccgtgggtgagcctgcccaagggcaagggtatcaagctaagcatcatcgaggaacaaaggaagcgggatgccgctgcccaggctgctgccgcataaatcctcagaatgtgcttggagttttgcttatgtctagtttgtctgcaaggatatagaactctctgttgccagactatatcatgtttaagtttttgcctgatggttgttgattcgtgaacgatgtttgcagctagctctaatgctgtaacgcgactatctatcttattgaactgttgtcgactccgagcaaatgaaacattacaagttgggcgattgagcccatggtggttattgtt

SEQ ID NO: 15560 - DNA, 1442 bp, Sorghum bicolor
  Clone ID: SORBI-28MAY03-CLUS54610_1
cctcctcgcagcacacacatacagaagcactctagctaaaagtttgttgcacagagagcaatggcttctcaggcttccaatgttgtccgccctagcgacgccgagctgctgcaggcacaagccgacctatggcgggtgagcctctcctacctgacgcccatgtcactgaggtgcgccgtcgagctcggcatccccacggcgatccaccgccacggcggggctgcctcagccgccgacctgatcaccgcgctgtccctcccttcgaccaagctgccgttcctccgtcgcctgctgcgtctcttggccgtggcgggcgtgttcaccgtcgacaagaccaccgccgaggataggtactgcatcaaccccgtgtcctacctcctggtggacggcatccctcatgaggtgcacatcaaccacacctccctggtgctcacctgcacctcgacgcgctacctcgacgcggcgctggggttggcagagtggttcaagaaggacgtggtgacgccgccattccaggagctgcacggggcggctctgttccatgagagcatggagagcctcgacccggattaccacaacatggcgaacgaagccttggacgcccacgacaactttgggattgagatcgcgctgcgggagttcagggacttgtttgaggggattcagtccatgacttactgctgcggtacctgtggtgatgacaagtttgccagggccattgtccaggcctacccgcacataaaatgcactgtgctggcacctccaaagatgattgccaacaaaccggctgatggggtgatgataaactatgttgaaggtgacatgttcagtttcatcccacctgctcaaactgtgatgctaaagcttgtgctgcaccactggactgatgaggactgcgtgaacatcctggctgcatgccggaaggcgattccttcacgagaggatggcggaaaagttatcgtcggtgacattgtgattgattactctgggcctatgttggaaactcacctcttaatggacattggcatgatgaccatgacaaaaggacgccaacgggatgaaaatgaatttcgtgagatcttcatgaaagcagggttcagcgactataagattttaaagaaatttggagctcgtgttgccttcgaagtgtatccgtaagattgcacctggactttttatatattgtgggttttgtggcttggatatcctaaataaagagggtctgccttagagtattcatggatcaccgtggacctaagcagataatcttggttgctttcttaagattctcgtggatctttcatttggaagagtatggcaaataatatccgccatctagagttggcgttgaattctatgtactttgtacctgctttgttattttaagtgccataatatccggtatcatataatatattcttggttatatagcctgttcattt

SEQ ID NO: 15561 - DNA, 637 bp, Sorghum bicolor
  Clone ID: SORBI-28MAY03-CLUS7832_2
ctcatcgccgccgccggcccaaacccctctctctccccctataaaaccctccctcgcctcctcaaaaaacaaaacacaagctcgatcatctcgctccagctcatccgatcgagcaccttgcaaacctgcttgattgattgtttgatcctatttcaagctagtcattagtgtactctcgtgtctcttggttggttggttaggctgtagttgagtgaggagttctcgagtgatcgaccactactcacggtcatggcgtctcgtcgtgtgtccctgctgctgggcgtactgctgtcctactccgccgccgtcgccgtcgccgtggcggcggccaacttcaaccaggagttcgacatcacgtggggcgacggtcgtggcaagatccaggacaacgggcagctgctgacgctgacgctggaccggacctccgggtccgggttccagtccaggcacgagtacctcttcggcaagatcgacatgcagctgaagctggtccccggcaactcggccggcaccgtcaccgcctactacctgtcgtcgcagggcaacacccacgatgagatcgacttcgagttcctcggcaacgtcctcggcgagccctacacgctgcacaccaacgtgtttacccagggccagggac

SEQ ID NO: 15562 - DNA, 1483 bp, Sorghum bicolor
  Clone ID: SORBI-28MAY03-CLUS7832_1
ggcacgaggcctcacacaccagatcgaaacatctctcaagtgttcaagttccttcccagttcccacacactacacagaccccactgtgtcactagctagagctccggcagccacaaacacgagctagtagagctgccaacaagaacaagaagatgaggtcgacctcgcttgttgcgtgcgtggcttgggcgtgcgtagaggctgtcgctgacggcggagttttcgacagagcgaccgagatgacctggtcgtaaggccgtggcatggtggcgtacggcggggcggggctggacctaaccctgcagaggacctcgggctccggctgccggtccaagtccgactagctcttgggcaagatcggggtgcaggtcaagctgatgcccgggaacacgggcggcaccgtcaccaccttctagctctgctcgccaggcccgggctacgacgcgatcgccttcgacttcttcggcagcttctccggcgagcccaacacgctgcccgccaacgtgtccgccgccggcccggcccagcgcgagcacccgttgggcatctcccacgacgagatcgacttcgagttcctcggcaacgtgagcggagagccctacacggtgcacaccaacgtgtacagccaggggaaccgcgagtgggagcagcaggaggcccgcggggttggggttcccgcggacgcagccgatgcggctgtacgcgagtctctggaacgccgacgactgggccacgcagggcggccgcgtcaaggcggactggacgcaggcgccgttcgtcgcgtcgttccgtgggttcagcgctgacgcgtgtgtgtgggcgaatgggaagcagcagtgccctgtgggaaccatggcggcggcggcgacggggggacggcgcggaggccctggcagctggtggaaccagcagcttagtgacatgagctaccgccgcatgcgctgggtgcagaggaagttcatggcctccgactactgcaccgactgcccagcggcgccccggagggggtgcccgccgagtacaagctccactggggatgcaaccacggatcgaaggaggaatggacaaagacggaaccaccgtacgtgcactatccctcgtccatcaaccctaggccgtggtggaagcgagtgcgatccgagggctcgtttctgtactggcgaataatgtatggttttgccatcggcgttagcaccattgaaaatttggcccggatctcctcatgactcgtcgattgatctcttcaccggatcgagcaagacacatggcaagaaatatcatgagatggctgagggggcctcctctgtatggtaaataaataaggatttggcgaattgtaatgcagtacggagtactgctggtggtaaaattattgtggctgttctgtaaaccggaatcctcgcgccttcgccaccctgttcgtacgtgtatgtagtctactgttcgtgttcatgtctcatgtctgaatcatatagtctcctcc

SEQ ID NO: 15563 - DNA, 2395 bp, Sorghum bicolor
  Clone ID: SORBI-28MAY03-CLUS1359_1
aacgacagaacacagacagactcgactcgtcaaccagcagttcgaaaccaaaggatcgatccaggagcttccagaaggcgaggaggaggaggaggagagggcgcgcgcgcgcagcgttcaaggtggtgccggccatggatcgggttcgcggatccgcgttcctgctcggcgtcctgctcgcaggatccctgtttgcattttcagttgcaaaggaggagaccaagaagctcgggaccgtgatcggtatcgatcttggtaccacctactcctgtgttggtgtgtacaagaacggtcatgtcgagatcatcgccaatgaccagggtaaccgtatcacaccctcatgggttgccttcaccgatagtgagaggctcatcggtgaggctgccaagaaccaggcagccgtgaaccctgagaggaccatctttgacgtcaagcgtctcattggaagaaagtttgaggacaaggaagtccagagggacatgaaacttgttccctacaagattattaacaaggaaggcaagccctacattcaggtcaagatcaaggatggggagaataaggtcttcagccctgaggagatcagtgccatgattcttggcaagatgaaggataccgctgaggcgtaccttggcaagaagatcaacgatgctgtcgtcactgtccctgcgtacttcaatgatgcgcaggcaaccaaggatgctggtgtcattgccggcctcaatgttgctaggatcatcaatgagccaactgctgctgctattgcctacggtttggacaagaagggtggggagaagaacatccttgtctttgaccttggtggtggtacttttgatgtcagtatcttgaccattgacaacggtgtctttgaggtgctggccaccaacggtgacacccatcttggaggtgaggactttgaccagaggatcatggagtacttcatcaagttgatcaagaagaagtacagcaaggacatcagcaaggacaaccgtgctcttggaaagctgaggagggaagctgagcgtgccaagagggctctcagcaaccagcaccaggtccgtgttgagatcgagtccctctttgatgggaccgatttctcggagccgctgacccgtgccaggtttgaggagctgaacaacgacctgttccgcaagaccatgggccctgtcaagaaggccatggaggatgctggccttcagaagagccagatccatgagattgtcctggttggtggaagcaccaggattcccaaggtccagcagctcctgagggactactttgatggcaaggagcccaacaagggtgtcaaccctgatgaggctgttgcctttggtgccgcagtgcagggaagcatcttgagcggcgagggtggtgatgagaccaaagatatcctcctccttgatgtggcacccctcaccttgggtattgagaccgtcggtggagtcatgaccaagttgatcccgaggaacacagtcatcccaaccaagaagtctcaggtgttcaccacctaccaggaccagcagaccactgtctccatccaggtcttcgagggtgagcgcagcatgaccaaggactgccgtcttctcggcaagttcgacctctctggcattccaccagctccaaggggcactccccagatcgaggtgaccttcgaggtggacgccaacggtatcctgaacgtgaaggcggaggacaagggcaccggcaagtcagagaagatcaccatcaccaacgagaagggccgtctgagccaggaggagattgaccgcatggtgaaggaggcggaggagtttgcggaggaggacaagaaggtgaaggagcggatcgacgcccggaaccagctggagacgtacgtgtacaacatgaagaacacggtgggcgacaaggacaagctcgccgacaagctggagtcggaggagaaggagaaggtggaggaggccctcaaggaggcgctggagtggctggacgacaaccagtcggccgagaaggacgagtacgtggagaagctcaaggaggtggaggccgtctgcaaccccatcgtctcggccgtgtaccagcggtcgggcggcgcccctggcggtggtgactcggagggtggcgtcgacgacgaccacgacgagctgtagattggtggtggtggtgaggagtgccgggagccatgccaaattttgtaatggtgtttagggtggaggaggggtggtgggtttcatatgcggacaaaactaatcttcgtgctgctctgccattagacgtgctgagcgtagaactctttgtttttcttctctacttccttgtgattgttcttgttatagaggattcgcgttggaattttatgtgaaaaaagaagatgcacttttaaaacttgtgtgttggcccctgctattcctgtttcttttct

SEQ ID NO: 15564 - DNA, 1602 bp, Sorghum bicolor
  Clone ID: SORBI-28MAY03-CLUS2572_1
gccctggagcagcagcagcagcagcattcattcattcaccacacaacaaacgcaaaccagcaactccaactccaatcgagctccttcgtcgtcggcgaacgaccgcgacgacggcaatgcacggcagaggcacgatgaagaaggcggcggctgcgttcctggcggcgctgctcctgtggtcggcggtggcggccgtctccgggcagccgcagccggggccgaacaacaagcagacggcggacaacaacccgcggctgcagaaggcgtacgtggcgctgcaagcgctgaagcggtcgatcacggaggaccccaagaacctgacggcgaactggtgtggccccgacgtgtgcgcctacttcggcgtctactgcacgacggcgccggacgacccgcactcgcagaccgtcgccgggctcgacctcaaccacggcgacctcgcggggacgttcccggaggagctcggcctgctcgccgacctcgcgctcctccacctcaactccaaccgcttcgccggcggcctgccggagtcgctccccaagctgcgcctcctccacgagctcgacgtcagcaacaaccgcctcaccggcgggttcccgcagcacatcctctgcctgcccaacatcaagtacgtcgacctccggttcaacagcctctgcggcgccgtccccgccgcgctgttcgacaagccgctcgacgccatcttcctcaacgacaaccacttcgacttcgagctccccgacaacctgggcaactcgccggcgtcggtggtggtgctggcaaacctgcgcctgcgcgggtgcatcccggagagcatcggccggatggcgggcacgctcaacgagctcgtcgtcctcaacgccggcctgcggtcctgcatcccgcaggaggtcgggtggttgcgcgagctgacggtcctcgacctcagcttcaacgagctgcaggggatgctgccggagtccatggcggggatgcacgagctccagcagctcgacgtcgcgcacaacgagctgtgggggcatatccccgagggcgtctgcgcgctgccaagcctcaggaacttcacctactcgtacaactacttctgcaccgagccgcggcggtgcctcgacatccgccgcgtcgacgaccggcagaactgcatcgccggacggccggatcagcggccgacagaccagtgcctcgccttcctgcaccgcccgccggtgcactgcgacgagcacggctgcttcgggccgccgacgcactactagagagtggcggcggtgggagagacagagagagggagacgccgccgggcgcgtcgccggctcgccgcgccgggacttgtaaaattggttggtggtgggatgtgagaccaaccgaagagggtaaaattcgtaaacagaaaacgaccgtatatattatatacactgtaattcttctttttcctttctcctttcttttcttttcttttcacaggagtggtattgattggagtatatgttgggattgtagacagaaatgatagtgcattttacactgttaatttaattacccactgaccaataatctctgtactagtaccacttgagagtacaaatccttgtaacttttttccaccgc

SEQ ID NO: 15565 - DNA, 575 bp, Sorghum bicolor
  Clone ID: SORBI-28MAY03-CLUS845_2
gcagtacccgtacgccgggtacattcccaaccgtccgtcggtcagccggaagccgatgccggcgccgggcagcgaggagtacgcggagctggggaagaacccggagaaggtgttcgtgcgcaccatcacgagccagttccagacactcgtcggcatctcgctgctggagatcctgtccagccactcctccgacgaggtgtacctcggccagcgcgacacgccggagtggacgtcggacgccaaggcgcaggaggcgttccggcggttcggggcgcggctgaccgagatcgagagccgcgtgatgaccatgaacgccgacccaagtctcaagaaccgcaacgggccggccaagttcccctacacgctgctctaccccaacacctccgacaagaatggcgatgccgccggcatcaccgccaagggcattccaaacagcatctccatctgagttctgagttctgagcgcgaggtccatacggaagccgcaacagttgctcctctcagtcccccaataataaagttatcaattgtgttccatctatttttctcttaaataaccggagtatgcatcatca

SEQ ID NO: 15566 - DNA, 3016 bp, Sorghum bicolor
  Clone ID: SORBI-28MAY03-CLUS845_1
accagtctcacagccagcaacaccactgcaaaaacataaaaaggcggcagggcagggggagagagagcagagcagagctagttggagtagcagtaggacgtggtggtgtacattggcctgtgaagatgccgcgggacgggatcagtgcgcggctgacgggggcggaccaacatacgcgtcgccatcgcacggtggtgcatccgggcaagaccctcctccgccgcggcgaccctcggccagcgcgacacgccggagtggacgtcggacgccaaggcgcaggaggcgttccggcggttcggggcgcggctgaccgcgatcgagagccgcgtgatgaccatgaacgccgacccacgactcaagaacagcgacggaccggcctggctcccctacacgctgctctaccccagcaccgccgacaagactggcggggccgccggcatcacggcgaagggcgtgccgaacagcatctccatctccgttctgagttctgagcgcgaggtccatacggaagccgcaacggttgcgctccgcagtcccccaataataaagttattcgcatttgtgttccatcgacttttctcgtaactgacgcgagtatgtcatcatcaggcatgaccaacaaggttatgtaggagtatttcacaatgtgaaagggggaaatgaactgtattgtctcctgtttttaatcaaacaaaaaatcgggctggcggcggccgatgcgggtgcctaccaccgccgagtccgcggcgccggagatgaccgcggaaacctgcggcctgtcctcggcgaccccgctgttcccgcccgtccgcggcacctcacggcgggcgacacggtcaagaaactccaccgccacggggtaggccggcccgcgcgacaccaagaagaggacgacgggcgccggggcgagcgggtcggccacccggttctggccgccgctgggggacatcccataaaggccggagggcatgggaacatccccacggtgcgagcatccgtggaccgaggccccgggcagttccactcgtcccaggacctcagcctccgggacgagggcgggatcaacctgcccaagatccaggggctcgagcacatgcccatgcgtttcaccttccagctcgtcaaggacctcctcccggccggcgggcactacctgctcaacctccccatccccgcgatcatcaaagagagcaaggatgcgtggaggaccgacgaggagttcgcgcgggaggtgctcgccggcgtcaacccggtggtgatcacgcgcctcacggagttcccgccgaagagcacgctcgaccccagcaagtacggcgaccacaccagcacgatcacggcggagcacatcgagaagaacctggagggcctcacggtgcagcaggcgctggacggcaacaggctctacatcctggaccaccacgaccggttcatgccgttcctgatcgacgtcaacaacctggagggcaacttcatctacgccaccagggcgctcttcttcctgcgcgccgacggcaggctcgcgccgctcgccatcgagctgagcgagccgtacatcgacgacggcctgaccaccgccaagagcaccgtgtacacgcccacgtcgaccaccggcgcggaggcctgggtgtggcacctcgccaaggcctatgtcgccgtcaacgactccggctggcaccaactgatcagccactggctgaacacgcacgcggtgatggagccgttcgtgatcgcgacgaaccggcagctgagcgtgacgcacccggtgcacaagctcctgcacccgcacttccgcgacaccatgaccatcaacgcgctggcgcggcagacgctcatcaacggcggcggcatcttcgagctgaccgtgttcccgcgccagtacgcgctcgacatgtcctccgtggtctacaaggactggaacttcacggagcagggcctccccgccgacctcgtcaagcggggggtggcggtggaggacccgtcgagcccctacaaggtgcggctgctgatccaggactacccgtacgcgagcgacgggctggcgatctggcacgccatcgagcagtgggtgggcgagtacctggccatctactacccggacgacgccgcgctgcgtggcgacgaggagctgcaggcgtggtggaaggaggtgcgcgaggtcgggcacggcgacctcaaggacgcggcctggtggcccaagatgcaggccgtgtcggagctcgccagcgcctgcaccaccatcatctggatcgcgtcggcgctgcacgccgccgtgaacttcggccagtacccgtacgcggggtacctgccgaaccggcccacggtgagccggcgccggatgccggagcccggaagcaaggagtacgaggagctggagcgctacccggagcgcggcttcatccacaccatcacgagccagatccagaccatcatcggcatctcgctcatcgagatcctctccaagcactcctccgacgaggtgtacctcgggcagcgcgacacccccgagtggacctccgacgccaaggcgaaggcggcgttcaagcggttcagcgacgcgctggtggcgatcgagggcaaggtggtgggcgagaaccgcgacccgcagctcaagaacaggaacgggcccgccgagttcccctacatgctgctgtaccccaacacctctgaccacagtggcgccgccgctgggctcaccgccaagggcattcccaacagcatctccatctgagcgattggtacgagctggtacatgcatgaataagcagtcgtgtgcacgacgccatgtgtaataactactagtgtgtttttgtgtaatcgtgtggcccggtgaatcgaattactaccacgtatgtaataactgaagtgattgttgcaatcactagctagcctccccattttaagattcttgttcttggagttggagtactctcttcctagtctcgctgtacttcctcggtcacaactttgatttcacgtggtattcaatacgtatttctaactaaaatcttggaacaaa

SEQ ID NO: 15567 - DNA, 295 bp, Sorghum bicolor
  Clone ID: LIB3476-025-P1-K1-F9
cggacgcgtgggtgcggaagcagttcccgctcgagctcgtcaaggacgtcctccccgtcggcggcgactaccttctcaagctcgccatgccgcaaatcatcaaagaggacaagacaggttggatgaccgatgaggagtttggacgggagattctcgccggcgtcaaccccatgatcgtcaggcgtctcacggagttccctcccagaagcacccttgaccccagcaagtacggggaccacacgagcaccatcacggaggcgcaccttgagaacaagctggagggcgctaccgtgca

SEQ ID NO: 15568 - DNA, 279 bp, Sorghum bicolor
  Clone ID: LIB3476-057-P1-K1-F6
tgacgcacccggtccacaagctcctgttgccgaactaccgcgacaccatgaacatcaactccaacgcacgccagatgctcgtcaacgccggcggcctcttcgagacaaccgttttcccgcgccagtacgcgttcgagatgtccgccgtcatctacaagaactggaacttcaccgagcaggctctccctgacgacctaatcaagaggttaatctggcgtgtgtagttaactagcattgcgcacagtgacgctaacaacactaacgcacaaatgtgcaata

SEQ ID NO: 15569 - DNA, 703 bp, Sorghum bicolor
  Clone ID: SORBI-28MAY03-CLUS6866_2
tgtgcggcgctcgagccggccgggccgggccgggactcacccccacccgtcccttcccgcgccgccgccgcccccccacaggtaaggaggaggagcaggaggcgaggatgtctcaccgcaagttcgagcacccgaggcacggctccctcggcttcctccccaggaagcggtccccccgccaccacggcaaggtgaagtcattccccagggatgaccccaagaaggcttgccacctcaccgccttccttggctacaaggctggcatgactcacattgtgcgtgaggtcgagaagcctggatccaaactacacaagaaggaaacgtgtgaggctgttaccatcattgaaacccctcctctggtcattgttgggcttgtggcatatgtgaagactcctcgcggcctccgcacactcaacactgtttgggctcagcatcttagcgaagaagttaggagaaggttctacaagaactggtgcaagagcaagaagaaggctttctccaagtatgctctcaagtatgacaatgatgctggcaagaaggaaattcagctgcagcttgagaagatgaagaaatatgcttctgttgtccgtgtcattgcccatacccagattaagaagatgaagggtttgaagcagaacaaggctcatctcatggagattcaggtcaatggtggtaccattgctgacaaggtggactatggcta

SEQ ID NO: 15570 - DNA, 1660 bp, Sorghum bicolor
  unsure (1)..(1660): unsure at all n locations
  Clone ID: SORBI-28MAY03-CLUS6866_1
gccggccggctggctctgcccaccagcgccgccgccgcccgcgctcccctcaggtaaggaaggaggccggcgaagatgtcgcaccgtaaattcgagcacccgaggcacgggtccctcggcttcctccccaggaagcgatcctcccgccaccgcggaaaggtgaagtccttcccgagggatgacccaaagaagccctgccacctcaccgcatttgttggctacaaggctggaatgacacacattgtgcgtgaggtggagaagcctggctccaagctccacaagaaggaaacttgtgaggctgtgactatcattgagacccctccccttgtcattgtcggacttgtggcatatgtgaagacccctcgcggcctgcgaaccctcaactctgtctgggcccagcaccttagtgaagaagtgaggagaaggttttacaagaactggtgcaagagcaagaagaaggccttcaccaagtacgccctcaaatatgacagcgacgcaggcaagaaagaaatccagttgcagcttgagaagatgaagaagtatgcttcagttatccgtgttatcgcccacactcagattaaaaagatgaaaggtttgaagcagaagaaggctcaccttatggagatccaggtcaatggtggcactatagcagacaaggtggactatggttacaaattctttgagaaggaagttcctgttgatgctgtgttccagaaggatgagatgattgacatcattggagtcaccaagggtaaggggtatgaaggtgtggtcactcgttggggtgttacccggcttccccgcaagacccacaggggtctccgcaaggttgcctgtattggtgcctggcatccagctagggtgtcgtacacagttgcccgcgctggtcagaatggataccatcaccgtactgagatgaacaagaaggtttacaagatcggcaaggctggacaggagagccatgatgcctcaactgagtttgacaggactgagaaggacatcactcccatgggtggcttcccccactatggtattgtcaaaggtgactacctgatgatcaagggttgctgcgttggccccaagaagagggtggtgactctccgccaatctctgctgaagcagacctctcggctggctctggaggagatcaagctcaagttcatcgacacctcgtccaagttcgggcacgggcgcttccagaccacagacgagaagcagaagttctatggcaagcaaaaggcctgagctgctgctggtgtcactgtcaatggaaatggaattgtattacctgatagtattttgtttttcttcagttttgttggagatatcagaagaacatgtttgattttctagtctgagctacttccattgcggatgattgatattgatattattgcaaattctgaacccgagaacctttgtgatggcaatcatgcgtgacatttttagcttatggaatgaatcccgacgctttgcatgtagattctgaaactgggggtgattgtctagcactttcatttgttcgctgttctaagctgcctgctgctgggaatgtggaccattagtcatatttcctagtagtatctaatgatcaaatggcatttcggggatctgtatcctgaagaaccttatgcggccagaactttatgtgtggcttncc

SEQ ID NO: 15571 - DNA, 2163 bp, Sorghum bicolor
  Clone ID: SORBI-28MAY03-CLUS1085_1
ccgcagcgcgcgccgcagccgcgccgatcctcctccgtcccctcctcgcgctcctccccccagtctgtgggccggccgacgattcgctccccccccaccacgcctgccggctgtagtgctgcgcacgtcagttgctcctccaccttcccttcctcctgctcctgccctcggtttctgatcgcgaccatgggaacccgcggcatcgccctggtgctcctggcagcggcgctgctccaggccctgctccccgcgtcggcggcggcggagggcctggtgcgggtcgcgctgaagaagcagcccatcgaccagaacggccgcgtcgccgcgcgcctctccgccgaggagaggcagcgcctcctcctccgcggcgccaacgccctgggctcgggcagcgacgactgcgacgtcatcgcgcttaagaactacatgaacgcgcagtactttggggagatcggcgtcggcacgccggagcagaagttcaccgtcatcttcgacaccggcagctccaacctctgggtgccgtcctccaagtgctacttctcgatcgcttgctacttccactcgcgctacaagtcagggcagtcaagcacttacaagaagaacggaaaacctgctgccattcaatatggaactggttcaattgctggttttttcagtgaggatagtgttacattaggtgatctggttgtgaaggatcaggaatttattgaagctacaaaggagccaggccttaccttcatggttgcaaaatttgatggcattcttgggctaggctttcaggaaatatctgttgggaatgcgacaccagtatggtataacatggtaaaacaaggtctcatcagcgaccctgttttctccttctggtttaaccgacatgctgatgacggagaaggtggtgaaattgtgtttggtggaatggattctagccactacaagggtgatcacacgtatgtcccagtcactcagaagggatactggcagtttaacatgggtgatgtcctggttgatggagtgtccactgggttttgtgctggcggttgtgcagcaattgcagattctggaacttccttgcttgctgggcccacagccataattactgaaatcaatgaaaagattggtgctgctggtgtagtcagccaggagtgcaagactgttgtttctcaatatggacaacagatcctagatcttttactagctgagacacaaccagcgaaggtctgttctcaggttggtctgtgcacttttgatggcactcatggtgttagcgctggaattcggagcgtagtggatgatgaagctgggaaatcaaatggtggtctcaagagtgacccaatgtgcagtgcctgtgagatggctgtggtatggatgcagaaccaacttgcccagaacaagacacaggagctcatcctgaactacattaatcagctttgtgagcgtcttcctagtcccatgggagaatcagccgtggactgtgccagtcttgggtccatgcctgacattgcgttcaccatcggaggcaagaagttcaagctgaaaccagagcagtacattctgaaggttggtgaaggacaagctgcccagtgcatcagtggattcacagccatggatatcccaccgcctcgtggccccctctggatcttgggtgatgttttcatgggagtctaccacaccgtcttcgactacggcaagctgagggttggcttcgcagagtcggcctaaggatatggtttggcgcctcgtccagaggcgaacgcatgcgccgagagagaagcttagcttgtttttaacttgtgtctttatgcggccggcgatgtgtgtatatatgctactacatgtttagtgatgctttcagagaccagagacaacgcccatctgttttaacctggcgcaagaatatttctggatgtattggtcatcacgcttcggcctcttgtactgaattgttgccgtgcaccctagcaacgtgtactgaagaagtattttcactgtgttatgcgtgcgatatgtgcactgaacctggtatgcttttgtggcagcggttaatctgcgatatcgacgctttggctgttgtatgttacgtggatgaaacatatttccgaaattacaggcttacactctgtaatctgtatgcacagtggagtcatatagcgtcagcatcagaat

SEQ ID NO: 15572 - DNA, 399 bp, Sorghum bicolor
  unsure (1)..(399): unsure at all n locations
  Clone ID: LIB3480-043-P1-K1-B2
gaagttttccaagggcaccggcgacatcactgccataatcgtgacgcccgatggcaagttcaacaccgccggcgcgatcgtggccaagtctgagtgctggaccttgctcaagggtggagccacctcctacgccgaaggcaagagcgatctcttcttcgagagcaactccaccgcggagatcatggcggagagcatagcgctgcagggattcagctttgaagagtggaacgctcaccgcgaagaagtcgtcgccaaggaacgcaagaatatttctggatgtattggtcatcacgcttcggcctcttgtactgaattgttgccgtgcaccctagcaacgtgtactgaagaagtnnaanaaaaaaaaaataaaaaaaaaaaaaaaaaataaaaaaaagaaaa

SEQ ID NO: 15573 - DNA, 2316 bp, Sorghum bicolor
  Clone ID: SORBI-28MAY03-CLUS381_1
cttgtgctctccctgccctcccccgctataatatgcgccgcgccctcgtcgccatcgtcgccccaccaccactcctcctccctccctgccctctcactcccgatccctccaccaccaccgcttcctccgcgtcacccctctcgtcgcctcgcgcggcggccagcggcggatcgtccgcggcgcaaccatggggctcttcaccgtgacgaagaaggccaccacgcccttcgaaggccagaagcccggcacctccggcctccgcaagaaggttactgtattccagcagcctcattatctgcagaactttgtccaatcaacattcaatgcacttcctgcggaccaagtaaaaggtgcaaccattgttgtctccggtgatggccgctatttctcaaaagatgctgttcagatcataacaaaaatggctgctgccaatggagcaagacgtgtctgggttggactaaacagtctcatgtctactcctgctgtatctgctgtcatccgtgaaagagttggtgcagacggatcaaaggctactggcgcgttcatcttgacagcgagccataacccaggtggtcctacggaggacttcggtatcaaatacaatatgggaaatggtggacctgcccctgaatctgttaccgacaagattttctctaatacaacgacaatctctgaatacctcatctctgaagaccttccagatgttgatatttctgttgtcggtgtcaccagcttcagtggacccgaaggcccctttgatgtggatgtctttgactctagtgtagattacataaagttaatgaagacaatttttgactttgaagcaataaaaaagctgctgacttccccaaagtttacattctgttatgatgcgctccatggtgttgctggagcttatgccaaacacatctttgtggaagagcttggtgctgatgaaagttcgctgttgaattgtgtcccaaaagaggactttggaggtggtcatcctgatcctaacctcacctatgcaaaagagttggttgaacggatgggtcttggaaagtcatcctcaaatgttgagccccctgaatttggcgctgcagccgatggagatgctgatcgcaacatgattctgggtaaaagattctttgtgacaccatcggactctgttgccattatcgcagccaatgctgttcaatcaattccttactttgcttctggcctgaagggagttgccaggagcatgccaacatctgctgcccttgacgttgttgcaaagaatttgaatctcaagttcttcgaggtgcctactgggtggaagttttttgggaatttgatggatgctggaatgtgctcaatctgtggtgaagaaagctttggcactgggtctgaccatattcgtgagaaggatggcatctgggctgtgcttgcttggctttctattattgctttcaagaataaggacaaccttggaggagataagcttgtcagtgttgaagatattgtccgtcagcactgggctacatatggtcgccattattacacacgctatgactatgagaatgttgacgctggggctgctaaggagcttatggcaaacctagtaagcatgcagtcatcactttctgatgtcaacaagctgatcaaggagatccggtctgatgtttctgaagtagttgcagctgacgagtttgagtacaaggatcctgttgatggctctgtgtccaagcaccagggcatccggtacctcttcggagatggttcgcgactggtgttccgcctctctggaactggttctgttggtgccaccatccgtgtctatatcgagcagtacgagaaggattcctccaagatcggcagggattcacaggatgctcttgctccgctggttgatgttgcgctcaagctctccaagatgcaagagtacactggccgctctgcccccaccgttatcacataaatttttgaagagagattctttagaatgagctgaggcgcgtacacaaacttccattccggcctcttgttctatagtttttcttccttgttgcatctcaccgatgaataaaatgtatgtaccagactcgtctcgtttttttgcccatactgcagagtaagccgctggctcagcatgcggtaataatcttgtcagtgttgtaattgggagcgcgtttcttctaatcttgttggaagtgtttctggtttgtttgagcatttgcgtatcgttttttctttctgaagagtataaaaaatatgtactcacctgtataacctgtcactaaagttttgatggctgttcggtgaggcttggttatgaaccgtccgagaattgatccc

SEQ ID NO: 15574 - DNA, 1142 bp, Sorghum bicolor
  Clone ID: SORBI-28MAY03-CLUS3087_1
gtttcggcgccagccgaatctcccggccggccgggccgggccatttcgaagcccaccgaattccctgcctgcgattcctctcccctcgcctcctcgtcttcccctaggggatcgccggagaggaatcgcaaagagggccgtctcatccaagttaaggaagccatggagcacaaggagactggatgccaggcacctgagggacccatcctttgcatcaataactgcggcttcttcggcagcgcagctaccatgaacatgtgctccaagtgccacaaggagatgataatgaagcaggagcaggccaagctggctgcctcctctatcgacagcatcgtcaatggcaacgatgctgtcatggaaccagttgttgctggcaacacagtggtcgctgctgctccaatcgagttgcaaacaatgaacgtgcagcccgctgatgttgctggacctagcgagggggcggcggtgatctccaaagggaaggtagggccgaaccggtgcagcacttgcaggaagagggttggacttacaggattcaactgccggtgtgggaacttgtactgtgcactgcaccgctactccgacaagcacgactgcaagttcgactatcggactgctgctagggatgccattgccaaggctaatccagtggtgaaggcggacaagctcgacaagatctagggtttcctacggttggctcaaggaagattgcaacctgtggtacttcatcatgcggaattgctgcattgcccatgcctttccctttcatgtttgctgctacaatcttgttgttcggcattgcagtgcatggtgcgcacttccgcagcctgcctcaagaattctcgcctctgcatctggtcagttcaaatgatttgcatgttggctatgttgtgtaagcttttatttatggtcgtctcgctcagacggtatttggcttcgcatttagctagctatgtgatgtactattgtccctggtgtgttacactgcaaccagtaatagtaatctgcaactgtccgttaagtggtactgatgaccatttgcattctcagttattttactctatatataggtggtagtctcatggcactatactcttttttgttcataagttttttttggttgaatagcaaatttgaatgacttt

SEQ ID NO: 15575 - DNA, 462 bp, Sorghum bicolor
  Clone ID: SORBI-28MAY03-CLUS1601_2
gttttcacaagaagctcctctagtctagtgtatgacaaccagggggaggagaggcagaaacagaaggcgggggagcctctggtttcgtcgtcgtcgtctccctcagccccccgttcccccccacacatcactccactctggtcagcttcctgtatatatataagtaggtcacctggctgtgctatccatccatcgctgcaaccaaccatcggttcaaagagagattattgtcgatcgatcgactcgaatcgaagatcgaggctaggtctcgaggcagatcgatggagaggatgagctcgtcgctgcagtcgtgggtggaggaacacaagctctcaaccatcggagctgtgtgggcgacggcggtgggcgcgtccgggtcgttcagcctacgtcactcgccttcgcgacaaccaagcctgggccgttgtcacgccaggatgcttccacactaactttcgaaaa

SEQ ID NO: 15576 - DNA, 1417 bp, Sorghum bicolor
  Clone ID: SORBI-28MAY03-CLUS1601_1
gcacacacagccagcagcagcaggtagctagctaggacggccatctcactcagctagctcagctcagctcatacagcacacacccaataagcaagcaagcaatcaatggagggtaaggaggaggatgttcggcttggcgccaaccgttactcggagcgtcagcccatcggcacggcggcgcagggcccgggcgcaactcagaaagtcgcttcttctcgctctagctaaccacgctcggtggctgcaagaagctcatagtagccggcgcgcgacatggaggggaaggaggaggacgtccgcctgggcgccaacaagtactcggagcgccagcccatcggcacggcggcgcagggcaccgacgacaaggactacaaggagcccccgccggcgccgctcttcgagcccggtgagctcaagtcgtggtccttctaccgcgcgggcatcgccgagttcgtcgccaccttcctcttcctctacatctccatcctcaccgtcatgggcgtctccaagtccacctcaaagtgcgccaccgtcggcatccagggcatcgcctggtcctttggcggcatgatcttcgccctcgtctactgcaccgccggcatctccggcgggcacatcaacccggcggtgaccttcgggctgttcctggcgaggaagctgtcgctcaccagggcggtcttctacatcatcatgcagtgcctgggcgccatctgcggcgcgggcgtcgtcaaggggttccagcaggggctgtacatgggcaacggcggcggcgccaacgtcgtcgcgccaggctacaccaacggcgacggcctcggcgctgagatcgtcggcaccttcgtcctcgtctacaccgtcatctccgccacagacgacgacaagaacgccagcgaggcccatgtgccgatccttgctccgctcgccgccagctaccacgtggtcattatcagggccatccccttcaagagccgcgactaaggcgcatacatgcaatgcaagagatcaggctccaatataatcaagtcttgttaattatatgtgctagtgctgcgtgctcgctccttcttcgctgtcgtctcatcgatctacctatgttcgtgtgagctagctacgtactagctagtgtgtgatatgatgccaataaggccgcccggtgtttcttgattattgcgccttcccatgcatctgcagtgtgcaatgcacttgtgagttgtgtttagttttctcacttggagtttggtgaagtaaactaagcatgcatgcatatgtaaatttgtcgcctagctagctatttccctccttctatatgtatgctttgcgcaacatatatagacacagtctcgatcttcatcaactcaaattcaagtgtatgacaataataaaaaggaagaagaagactccctgtttatgggtcgcaccg

SEQ ID NO: 15577 - DNA, 415 bp, Sorghum bicolor
  Clone ID: LIB3476-048-P1-K1-F3
acagccggcgtcgggcgccggcgcgtgccacgagcctgcgcctcatccacgccaggatgcacgcgcaggcgctcaccctcgccgtccggggcggagccgcgctcgcgcaccactactgcggcagcagcgccgggaagcagcggcaggaggagctggactacggcttctactcccagctgccgcccgccaccgacgccgacggcaacgagaacgagcgctggagctggtagcaaggacaaggaggaggagaaggagcgacaagaaagaggaacaaacaacaataaattagtagcaataatgggtgggtggcctggttagcaatcatgcgtgacgtggcttcgtcctaatcctaatcctaatcctaatccccgcccgtggtttacattatccatccatccatccacatcaatgaatg

SEQ ID NO: 15578 - DNA, 1376 bp, Sorghum bicolor
  Clone ID: SORBI-28MAY03-CLUS5596_1
gcacggggcgctccctctcacgccgccacctccctgctccagctctctagcgcacggcgcagccgtcagaaacccagcttcggcagcgacgatggcggcggcaccggcaggcggcggcgcgcgggcgctgtcgcagcgggagcaggacatccagatgatgctcgccgccgacgtccacctcggcaccaagaactgcgacttccagatggagcgttacgtatacaagcgccgcactgatggtatctacattattaaccttgggaagacctgggagaagctacagttggctgcgagggtcattgttgcaattgaaaatcctcaagatattatagtacagtctgctaggccctatggccagagggctgtactcaagtttgcccagtacactggggctcatgccatcgccggcaggcacactcctggtacattcaccaaccagctgcaaacctcattcagcgagccgcgccttcttatcctgactgaccctaggactgatcatcagcccattaaggagtctgcacttggaaacattcccaccattgccttctgtgacactgactcccctatgcgctatgttgatattggcattcctgccaataacaaggggaaacagagcattggttgactgttctggctgcttgcaagaatggtcctccagatgcgtggtacaattcttccaggacacaagtgggacatcatggttgatctgttcttctacagagacccggaggaagcaaaggagcaggaggaagaagaggctctggttgctcctgactatggcgcagttgcagaatatactgctccagggggtgagaactggggtggtgccgactggggaactggtgaagctgcagcgccgcctgctggcattccagctgctggtgcagactgggctgctgctccagctcctcctgttgatggtgtctgggatgctgccgctcctcctccagcagccaccggatgggaagaaggcgctgctcctgtcgcggctcctacccctaactggggttaaggagtaaatcagcctggttgatggttcatagtagtcatcatcagaactcgttggtagacactgcttgagtagtagctttgaactttttacgttttacgtgctacgagatgggaatcaattttgtgttgttgactctgctgagacggtgagtgaaccgggcccctttttgctatttctactagagaactgctgttttatgctgcattatcatgacaaatggctcttcgttgctgcaactgactctcctgcttgtgtgttgttggatctaatctctgagttgtcggtgttgtaaatgtagcacacctccccccaaagatttgttgtcgcggtgcgctgagcgcttgaagctgactagttaagtttt

SEQ ID NO: 15579 - DNA, 789 bp, Sorghum bicolor
  Clone ID: LIB5052-011-A1-XP1-F6
gccggccgggctgcgaaaaaatgattcagagcacttacagatcttctttatcaaactttttacagcccattaaggagtctgcacttggaaacattcccaccattgccttctgtgacactgactcccctatgcgctatgttgatattggcattcctgccaataacaaggggaaacagagcattggttgcctgttctggctgcttgccagaatggtccttcagatgcgtggtacaattcttccaggacacaagtgggacatcatggtaaactgatataatctgaactagtttcattcgtaccaatttctgacctgtataaacaaagcatttaccttttgtcgcgtgttgaatgatatgcttgtttctcttctgcaggttgatctgttcttctacagagacccggaggaagcaaaggagcaggaggaagaagaggctctggttgctcctgactatggcgcagttgcagaatatactgctccagggggtgagaaccggggtggtgccgactggggaactggtgaagctgcagcgccgcctgctggcattccagctgctggtgcagactgggctgctgctccaggtccagatactcctcacataatacatgatttgcataaagacaaaatattgtaatctttgtagtagtattttgtttacacattcttggtttgtctatggtataatgtttaattgattgatagttgatgctctgttccaccttttgtgtgcctagaattagcttgatattgtgtctgaagctggtaggtgatttgagctgaaactttgatat

SEQ ID NO: 15580 - DNA, 1779 bp, Sorghum bicolor
  Clone ID: SORBI-28MAY03-CLUS147_1
gcacgaggcacatccccgtccgcatctcctccctcttgccggtcccgcaggacgagcagctccgcaaggtgcgcgggcaccaggcccgttcgcatcttctccctcttgccggtcccgaataaagagcagcagcgcaagaggttaatttatcgcccgagaagaagaaagcaatggcggctgagagcttcctcttcacctcggagtccgtgaacgaggggcaccccgacaagctgtgcgaccaggtgtcggacgccgtgctcgacgcctgcctcgcgcaggaccccgacagcaaggtggcgtgcgagacctgcaccaagaccaacatggtgatggtgttcggcgagatcaccaccaaggccaccgtggactacgagaagatcgtccgggacacctgccgcgagatcggcttcgtctccgacgacgtgggcctcgacgcggaccgctgcaaggtgctggtcaacatcgagcagcagtcccccgacatcgcgcagggcgtgcacgggcacttcaccaagcggcccgaggagatcggcgccggcgaccagggccacatgttcgggtacgccaccgacgagacccccgagctgatgccgctcagccacgtgctggccaccaagctcggcgcgcgcctcaccgaggtccgcaagaacggcacctgcgcctggctcaggcccgacggcaagacccaggtcacggtggagtacgtcaacgagggcggcgccatggtgcccgtccgcgtccacaccgtcctcatctccacccagcacgacgagaccgtcaccaacgacgagatcgccgccgacctcaaggagcacgtcatcaagcccgtcatcccggagaagtacctcgacgagaagaccatcttccacctcaacccgtcgggccgcttcgtcatcggtgggccccacggcgacgccggcctcaccggccgcaagatcatcatcgacacctacggcggctggggtgcccacggcggtggcgccttctccggcaaggaccccaccaaggtggaccgcagcggcgcctacatcgccaggcaggccgccaagagcatcgtggccagcggcctcgcccgccgctgcctcgtgcaggtctcctacgccatcggcgtgccggagcccctgtccgtgttcgtcgactcgtacggcaccgggagcatcccggacaaggagatcctcaagatcgtcaaggagaacttcgacttcaggcccggcatgatcaccatcaacctcgacctgaagaaaggcggcaacaggttcatcaagaccgccgcctacggccactttggccgtgacgacgccgacttcacctgggaggtggtgaagcccctcaagttcgacaaggcatccgcttaagattgggaagccaaattggacatgaagaagactgtgtgtctccgtgctgtatcttcctctggctctgctgatacctgctgcaagcattgctgctgctgctgctgctcctgctcctggatgtgtgtttgatcagtgactggctgctccatagaagagaagaaaagaaggctttggcaagcaagccatgtcggcgccgccggcttagggattggtataatttggtgtggcagcaaccaggattatgcgctgatctttatcttttagtttggtcgtccagtatttttttttcttccccttttcgagtctgtactgaaactgctgagagatttgcagtttttaatctatcaatattcgtatgttactgttaccctttaggtgccccctgtgtaaccaagcgcaattacaagttcacatttctccgtcc

SEQ ID NO: 15581 - DNA, 2654 bp, Sorghum bicolor
  Clone ID: SORBI-28MAY03-CLUS30850_1
gcaccggggtccaaccccccccgaggcacgggtctcccgcgcgcgccacccaccaccgatcgagctcagcagtgagcacgcacgacctggcgctttaactctcgctctctatcgtcgtccctgcccggcacacgtaacgtaattcgttccctggctgcggcgtgtctggcaggtagctaagccaagctaggtgtgactgtgtgagtgacggttgacgtgaggatggcaaccggcggcggcaaggcggcggcgctgctgctcgggctgctcctgctgctgtgcgtgctccggcatggggcggcgcagcggtacaacgccatctggagctttggcgactccatctccgacaccggcaacctctgcgtgggcgggggcccctcccgcacggccacagcgcagccgtccatcggcgaggcctggctcgggcgcccctccggcaaccctcccatccggcgcggatgcagctacctagcggccaggatctttgggtgagttgatcgtgtgttgtttgtttagggctaattgccatgtgcatcatcatcctctaggttcgtatacacagtgatgagtagtgatgggtttgttatttggttgtcaattattcatgggaggtaggtggtttcggtgtgctggggacaatgaataaatgtgtaatggacagctgtttgcaattttcttaacgcaaaaatactgtaggggagatccccaccgtggtgggcgagttcggcggcaacgactacaacgcggcgctcttcgccgggcggtccatggcggaggtgagggggtacgtgccccgggtcgtcagcaagctcgtccgcggcctggagacgatcgtcaggagcggcgccgtcgacgtggtggtgccgggggtcctgcccatcggctgcttccccatctacctcaccctctacggcacctccaacgccgccgactatgaccgcgacggctgcctccggagctacaacggcctctcctactaccacaacgcgctgctgaagcgcagccttgccagcctgcagcggacgtacccgcacgcccggatcatgtacgccgacttctacacccaggtcacccacatgatccgggcacctcacaacttcggtgagtaacctttcgcttttgtgtccttgctagaatatatcccagtgttggcgtgcgggagttgaagtctcagttatcacggaatgtgtagtgtagtgtagtgtagtgtagtaggcagcactgggatggaaagggatagatccaaagcatggattttgatagatgtagatgtaaagagagctatctacgtgcatgcatagtgagcatgtttaatttttttttctcttggattcttagcccaccaatgactcatccgggtcaattatgccctggggaccatgcatgaatgaccgttgtccaaacaatttgggaatcaataccctcctaattgatccagttggcatgcgtattatttatgcatcatacaaccaataattatgatgaaacatggatgaaagcctgtcatcgacaccgtggtggcatgcatgcatacatatcatcttataaagcactgtgtagtatatatactagtcacaaaagccgccacctgctgtaattgacaaagatactcccacatgtaacataacaattctttccatgcatggactgttttatcttaaaaatgttttcaaggctcattactgacttagttcacgtgactgggagcacgctagctagtgcgcattccaaggcggttttctttatgaactgtaatgtaatccatcagcctagctaatgagggcagccacaacgcagctactacaatcgtatgcctcgagaaaaaaatcacatgccatgtattccaagaggtaatgaagctaacaatctctcaacgcaggtctcttctcttatcataaacgtcactttcacctttttctctttatcctgacagacagaaataaagttgtatagagtttggtttcatccaccttcaacgcgtgttatttgggagcttctgcaaattgtcagctgaagcctacggtacctctgcaggcagcactgacacactgcggggctgctgttttgcgtgatctgtacatagcctgtatacgtggacgtcggggctacaagacagcgtgtagcgatggggaggcctgatagcgagtgtgatcatcgacactcttttgcagggctcaagtacgggctgaaggtctgctgcggcgccggtgggcagggcaagtacaactacaacaacaaggcgcggtgtggcatgtccggggccagtgcctgcgccgacccgggcaactacctcatctgggacggcatccacctcacggaggcggcctaccgctccatcgccgatggctggctcaagggcacctactgcaaccctcccattcagcactgatggagctagctagctagcagcattcatgcgtgagttgatcgtgtgttgtttgtttagggctaattgccatgtgcatcatcatcctctaggttcgtatacacagtgatgagtagtgatgggtttgttatttggttgtcaattattcatgggaggtaggtggtttcggtgtgctggggacaatgaataaatgtgtaatggacagctgtttgcaattttcttaacgcaaaaatactgtaggggagatcccccacagtgatttatattg

SEQ ID NO: 15582 - DNA, 1115 bp, Sorghum bicolor
  Clone ID: SORBI-28MAY03-CLUS1239_2
gccggccgggccccggggtacccgcgctgctcgttaacttgccggacctctctagatccatcctgatcctggtggctttgtgggtgaagaaagaaagaagatgctggacaagctgtgggacgacgtggtggcggggcctcacccggagacgggcctcgagaagctccgcaaggccgccactgcccgccccatcctcatcgacaaagacgcggatgccggagccgcggggagctacaagcggacgcagtcgatgccgtcgaccccgacgacgccggtgacgccgtcgtcgtcgtcgacgacgacgacgccgcggggcgccagcaacgtgtggcgcagcgtgttccacccggggagcaacctggccaccaagggcatgggtgccaacctcttcgaccgcccgcagccaaactcccccaccgtctacgactggctctacagcgacgagaccaggagcaaccaccgttagatcgatcggatgaggccgaggatgatgaagggcccggcgtctctgtcaggccatcatgtttgctggtccttgtggttatctaaaacgcatgcatgctctattattatagtacttctgcagttctgctgtcgctgttgctgataaagactttgccgtttaattgtcctttattatgtgttattatggagtgatgagtgatatgcagtcgctcctagtagtgagtagtgagtagtgagtatttacttggtatagtacttggtctggtcagttcctctgactcggcttggccattcaaggggagccctgttgttgctgctgttgtgtgtgtggtgtgtactggctgttctccatcatcttgtaaatattttgctttggccagggcgtgtactagtaactgtgcctgtttcttccattttaatttacaagtcttgatgtgtaataatcaccggcgcagcggcgctgaggacatgtattacaacaaaattactctgcatggacccacccggtcatcgacaaccgtgctcaacatcagggaggcgttctgcactgcgcaccactacttcatggacttctccatgatccgcgagatgcgcaagcagaacaagcgcgagctctccaggtccagcctcggctgcgactaggaccttct

SEQ ID NO: 15583 - DNA, 832 bp, Sorghum bicolor
  Clone ID: SORBI-28MAY03-CLUS1239_1
gccggccgggccgggacaccctctccttgacttgctcgctagcccataaatatatactcatcgccaccgagcatatattctctataacagaataaaccatggggctagcctactactaccaccaacggctcgtcctcctggccgtcgtggcgttcctatgtgctggcctcttcccgcaggcattagggaaggggcatggcggtgctgtcaacccggcggttgccggcatctgctctcgcaccccattccctgaggtttgcaagtccacagccgggaggcatgcgtccaagtacccggtcatcgacaacttggccgtgctcaacatgcaggtggaggcgttctccaagcgcactgcgcaggcgcggcagcacgtcgcgaagtcggcccgcactattccaccggcgcagaagcaggcccttacattctgcgacacaatgtacatgaacacacaggacaccatcggtgcggcgcagcgggccatcacgttcaaggacacgagcaccgcaaaaatcatgctgcagctcgccgttcaggacttcgactcgtgtgaccgtccgttcacccaggctggtatccccaaccccatggggaagttcgataaggaactaaaccagatggccaacaactgcatgacgcttgcaaacatgatatgaaccaggcatgcggagtcagttaggcatgcttgcaccccccagcgtgaggtggcaccgcatgcaggcaatgcttggacgagaggacttgatttttcacttaataactcactgaaatcatgagatatattgagcaacttttatgtatttgttccagacctacatttattcagtaagtcatg

SEQ ID NO: 15584 - DNA, 669 bp, Sorghum bicolor
  unsure (1)..(669): unsure at all n locations
  Clone ID: LIB5121-009-A1-PF1-A6
acnttacttaaaccgctttttataaccgacgtcttcttggcctgggacgctgctgctgctgacactgctcctcattgattgattcattgatttcctccaccattcagcagcgctcacaatcacaagacaagcttacaggcgaggggtagggagaggctcaccaggtgctcagcgttcatggagaaccgcaaggaggagcagcagggcgcggcggttgggtggatgaccgtgccggcgttcggggactgggacgtcaagaacggcgccgtgcctgactactccatggacttctccaagatccgcgagatgcgcaagcagaacaagcgcgagctctccagggccagcctcggcggcgacgaggacctcctccagcagcagcagcagcagcagagtagcaaggcgcagccgcccaagtcctccgccgtcgtcgccgacgaccaccaccgccggccgctgcacgacgactcccctacgggaaggaagaagttcctgagctatttccattgctgtatcagagcatgaggaattccaaaacttcctgcagtgtcacagcacataactcctgtgcaaatagctgttagatttcttctgtactgtaaagtctgcataattcgtaatcctcctctgcgtctgtaatcttgtcactcatgcgagcgatgaccagagcaa

SEQ ID NO: 15585 - DNA, 575 bp, Sorghum bicolor
  Clone ID: LIB5121-010-A1-PF1-A6
gtactcgcgctgctcgttaacttgccggacctctctagatccatcctgatcctggtggctttgtgggtgaagaaagaaagaagatgctggacaagctgtgggacgacgtggtggcggggcctcacccggagacgggcctcgagaagctccgcaaggccgccactgcccgccccatcctcatcgacaaagacgcggatgccggagccgcggggagctacaagcggacgcagtcgatgccgtcgaccccgacgacgccggtgacgccgtcgtcgctgactactccatggacttctccaagatccgcgagatgggcaagcagaacaagtgcgagctctccagggccagcctcggcggcgacgaggacctcctccagcagcagcagcagcagcagagtagcaaggggcagccgcccaagtcctccgccgtcgacgccgacgaccaccaccgtcggccgctgcacgacgactcccctacgtgaaggaagaagtgcctgagctatttccattgctgtatcggagcatgggggattccaaaacttcctgctgcgttacagtacataactcctgtgcaaatag

SEQ ID NO: 15586 - DNA, 1535 bp, Sorghum bicolor
  Clone ID: SORBI-28MAY03-CLUS1134_1
gcacgagcacgaggctcctctgctcccaagatctcctccccacccacctcccggtccggtccggtagcagagagcggagagggggcagagagatcgagatccggaggcgcgagcaccaccaccaccaccacgacctgcggcaatggcgggcacggtgacggtcccgggggcgtcggtcccctcgacgccgctgctcaaggacgagctggacatcgtgatcccgacgatccgcaacctcgacttcctcgagatgtggaggcccttcttccagccctaccacctcatcatcgtgcaggacggcgaccccaccaagaccatcaaggtgcccgagggcttcgactacgagctctacaaccgcaacgacatcaaccgcatcctcggccccaaggcctcctgcatctccttcaaggactcggcgtgccgctgcttcggctacatggtctccaagaagaagtacatctacaccatcgacgacgactgcttcgttgccaaggacccaactggcaaggatatcaatgctcttgagcagcacatcaagaacatcatgagcccatccaccccgttcttcttcaacaccctgtatgacccctaccgcgagggtgctgactttgtgcgtggataccccttcagcctcagggagggtacccacactgctgtctcccatggcctgtggctgaacatccctgactatgatgctcccacacagctggtcaagcctaaggagaggaacgagaggtatgttgatgctgtcatgacaatccccaagggaaccttgttccccatgtgcggcatgaacctctgcttcgacagggatctcattggccctgctatgtactttggtctcatgggtgatggccagcccattggtcgctacgacgacatgtgggcaggatggtgtgtcaaggtcatctgcgaccacttgagcctgggagtcaagaccggtctgccatacatctggcacagcaaggctagcaacccctttgtcaacttgaggaaggaatacaagggcatcttctggcaggaggacatcatccccttcttccagaacgtgaccatccccaaggattgcgacactgtccagaagtgctacatctacctctctggacaggtgaaggagaagctgggcacgattgacccctactttgtcaagctcgccgacgccatggtcacctggattgaggcctgggatgagctgaacccagctacccctgccaccgagaatggcaaggccaagtagatgggagttccaggggtgccttcactgcccactgaagtgaaaagaaagtatgattgggtcctgcctaggccccatagatatagctctttttgagagggaagagagattaattcagcagcagcttttataaattctttgttgttatgaagcaggtggttcttttgtagttgatgaaagggatttgtcgtcactatcatttacataattcagacaataatttatattgtgtaattttgagaatcaaagcactgtttgtgttatagcatctctatgaatgtgcactgctcccttttttttc

SEQ ID NO: 15587 - DNA, 448 bp, Sorghum bicolor
  unsure (1)..(448): unsure at all n locations
  Clone ID: LIB3476-034-P1-K1-C6
cgcgtccggaaagttgctaagnatggaatgaaagttcctcagctgaccccttcaaggatcaggctgctctcatgtaacagcacatcaagaacatggtgagcgcatccaccctgttcttcttcaacaccctgtatgacccctaccgcgagggtgctgactatgtgcgtggataccccttcagcctcagggagggtacccacactgctgtcttccatggcctgtggctgaacatccctgactatgatgctcccacacagctggtcaagcctaaggagaggaactagaggtatgttgatgctgtcatgacaatccccaagggaaccttgttccccatgtgcggcatgaacctctgcttcgacagggatctcattggcccttctatgtacctttggtctcatgggtgatggccagcccattggtcgctacgacgacatgtcggcaggatggt

SEQ ID NO: 15588 - DNA, 1738 bp, Sorghum bicolor
  Clone ID: SORBI-28MAY03-CLUS36731_1
ctcccgcacgcgcgagacacacacacacacagacggcaacaagccgacacggatagatcaatggccgcgtcttctcatgccatagcccccacggatgctgagctgctgcaagctcaagctgatctatggcgccacagcctctactacctcacgtccatggcgctgaaatgcgcggtcgagctccacatccccaccgccatacacaacctaggaggagctaccacactgccagacctggtaaccgcgctatccctcccgaagaccaagcttccattcctaggccggatcatgcggttgctggtcacgtcaggtatctttgcttctgacggcgccaatggcgatggagcggcggcggaggccgtgtaccgcctcaacccactctcctggctcctggtagaaggtgtggaatccgaggaccacacctaccagaagtacttcgtgctcgccaccgtctcccagcactacgttgacgccggcctgtctctggccgactggttcaggaaggatctgcctgagccgctgccatcgcctttcgagtgtttacatggcgtccccctcgcccatgagagcacaaagctcctggacgaggagcttgacaggattgtggaagaaggtgtcgccgcgcacgacaatctggcaatcggaaccataatacgggagtgcagtgatattttcagtggtcttcactcactgacttattgctgtggtagacagggaaacatcagtgccacggcgatcatcaaggctttccctgacatcaaatgcactgtgctaaaccttccgagggttattgagacagcaccagctgatgatgctgttagctctgtcacgggtgatttgttccacaccataccacctgctcaagctgtgatgctcaagcttgtactccacttctggagcgatgaggattgtgtgaagatcctggagcaatgcaggaaggcaattccttctagagaagagggagggaaggtgatcatcatagaaatacttcttgggccttatatggggcccataatgtatgaagcacagctgctgatggacatgctcatgatggtgaataccagaggcaggcagcgtactgaaaatgactggcgccagatctttactaaagctggtttctctgactataagattgttaagaaaataggagctcgtggtgtcatcgaagtctacccataaggctgcacacctctaaataaatatcgaccattatgctaataaatatgtgcttcagtatttgctggacgatgtgatgtcacgataatgtaaaataaatggagtgcgcctcgttttcgtatgcatagtctcatggatatgcagagaaggtgagctgtatgttcaactttattacttcgagatccatgttttttttgttttgaaatgtactggagcactctttgtgcttcccatggtggtatttttgatttggatgtctttgtggtacatctaataattaagaacatacttgatgtgtgttgcttgctgatgtttaagagatacacaaacacaacatgtatgcaacgtatttatcatgctatagcattgtatagcaccactataccattgatactacatctttattctgagggggaaaaaaggacacgaagagcttggccaccgtgttataagaacaatgtgaaattaccctaccccctctatttatagtgactactcttttgtacaaggcaagaaagcaggaaatgcaatcaaaattgatgaacttgtgacattttatttc

SEQ ID NO: 15589 - DNA, 627 bp, Sorghum bicolor
  Clone ID: SORBI-28MAY03-CLUS10950_4
gcggccgctttcgaggccggccgggcgtcggtgcaccaccggcccacaccaccacacatctgagccttcttcactctctccagtctccaccactcagctagatcaccaaagcaaagtgccatggcgaagcaggcggtggcgatgctcgtgtccgtggcgctgctggtcgtggtggtggtggcggtgacgagcgcgggcggggcgtcggcgcagcagtgcaacgtgtccctgctggcggtgtgcgcgccggcggtcatcagcgggtcggcgcccacggcgccgtgctgcgccaacctgcgcgcgcagcagccgtgcttctgccagtacgcgcgcaacccggcgtacagcagctacatcagcagccccaacgcccgccgcacgctcacctcctgcggcatcgccgtcccgagctgctaggcgccccggccggccggcggccgcgcgcgcgctttgcctctcgctctcgtctcgtggtgtagtgtggcgtctgaataaaatcagttgatcatcgtggtgtgcgtgccttatgaaccgactgaagatgcgcttatgcatgtcaatcggtctatttatttatatatatatatatcgtatttgtgcgaaaaaaaaaaaaaaaaaaggccccta

SEQ ID NO: 15590 - DNA, 676 bp, Sorghum bicolor
  Clone ID: SORBI-28MAY03-CLUS10950_3
cctgtgcggcgcgccggccgggccggggtgcaccaccggcccacaccaccacacatctgagccttcttcactctctccagtctccaccactcagctagatcaccaaagcaaagtgccatggcgaagcaggcggtggcgatgctcgtgtccgtggcgctgctggtcgtggtggtggtggcggtgacgagcgcgggcggggcgtcggcgcagcagtgcaacgtgtccctgctggcggtgtgcgcgccggcggtcatcagcgggtcggcgcccacggcgccgtgctgcgccaacctgcgcgcgcagcagccgtgcttctgccagtacgcgcgcaacccggcgtacagcagctacatcagcagccccaacgcccgccgcacgctcacctcctgcggcatcgccgtcccgagctgctaggcgccccggccggccggcggccgcgcgcgcgctttgcctctcgctctcgtctcgtggtgtagtgtggcgtctgaataaaatcagttgatcatcgtggtgtgcgtgccttatgaaccgactgaagatgcgcttatgcatgtcaatcggtctatttatttatatatatatatatcgtatttgtgcctcatcatatggacaatatataatatcaggtgtgatggtgtatttgtgtcaaaaaaaaaaaaaaaaaaaggcccctata

SEQ ID NO: 15591 - DNA, 735 bp, Sorghum bicolor
  unsure (1)..(735): unsure at all n locations
  Clone ID: SORBI-28MAY03-CLUS10950_2
gggccggggnaaacatccagaaacactcgaaacacaacaacaatccatacttcaacgcataccagcatggctgaccaatttatcctcggacgacccatcggcgaaggtgccccgggcgagcacggcgccggcactggactctctggcggacacggcatcgcgtctgccgccaacacccagtcgggcaagtacgccgaggaggagcgatcgggcttcaacgccggtctgggcggagagcacgcctcgggcggcatcccgcacggccactctggctcggcccaccccatcgccgacaagttcacctcgggctcgcactcgcacaccgacggctccggtctcactggcagctcgggcggaaagctcgacaacagcctcgacaactacggcggccaggccggctctggctcgcacggatcgcacagcggcgcccttggagccggcgcggctggtctcggtgctggtgcgctcggcgccggcgcggcgtctggtcaccgcggacaggaggccgtgagcggcgagtacgccggctcgggcaccaacgacgccctcactggcgagagccatgccacccgaacgggagccggcgttggacctctcggtgagaacacctctagcggagtcggagctggagccggagccggagccggcggcttggccactgccaagtcgggcgttgacaccaccggcgtcgacgtcgactctttcaagtacggcaccggtgttggcgcggccggc

SEQ ID NO: 15592 - DNA, 1382 bp, Sorghum bicolor
  Clone ID: SORBI-28MAY03-CLUS10950_1
ggccgctcgagccggcgggccgggtgtccaccggcccaccaccacacatctgagccttcttcactctctccagtctccaccactcagctagatcaccaaagcaaagtgccatggcgaagcaggcggtggcgatgctcgagtccgtggcgctgctgggcgcggtggcggcgccgtcgacgagcgccggccgggcgtccaaaaaaaaaaaaacgagcacgccggacccaccaccaaggcaccaagccaaaaagcaagcaaggagctgctcccctctgaaccagcaactgaagcagcttcctcgtctcatcatcgagaccagtagtacagtaagcacaatggcgactaatctcaagtgggctcctgttctggcccttctcctcgttgctgccatggttggcagcaccagtgctggcaatatcgccgtgtactggggccagaacggcaacgaaggcaccctagcggacacctgcaactccgggctgtacgcctacgtcatcctggcgttcctcacgaccttcggcaacggacagaccccggtcctgaacctcgccgggcactgtgacccgggctccggcggctgcacgggcctgagcagcgacatccagacctgccagtcgcagggcatcaaggtgctcctctccatcggcggcgccaccggcagctacggcctgtcgtccaccgacgacgccaacagcgtggccgactacctgtggaacagctacctgggcggcagcgacggctcgacacgcccgctgggcgccgccgtgctcgacggcgtcgacttcgacatcgagaacgggcagtcggcgcactacgacgacctggcgaccgcgctcaagggcaaagggagcgtgctgctgtcggcggcgccgcagtgcccgtacccggacgcgtcgctgggagccgcgctgcagacggggcagttcgacaacgtgtggatccagttctacaacaaccccgggtgcgcgtacgccaacggcgacgacaccaacctggtgaacgcctggagcacgtggaccagcagcgtcacggcggggagcttctacctcggcctgccggcgtcgacccaggccgccggcagcgggtacatcgaacccggcacgctgacgggcacggtgctccccgctatcaagggcgttggcaagtacggcggcatcatggtgtggaaccgcttctacgatgtgcagaacaactacagcgcccaggtgaaggacagcgtctgatgagcatacgaagccagcataggtagccatacatacagtggctattcattcgtcaagttactatcggactagataaaataagagcgcgcgtatcatacagtttgtgttatatatacccaatgaataaaacttgaccttgcaatataataccctcgggtc

SEQ ID NO: 15593 - DNA, 1711 bp, Sorghum bicolor
  Clone ID: SORBI-28MAY03-CLUS14178_1
ccagggacccgcctccattccatttccgcttccccacccgtcgaggatcgtctcccgtcggtcggcgtccttcgcgatcgtctcgtctcgtttctcctcgccttcgatctccaggaccaggccggcagaagctgatcgaatccgagtagggttgatacagtttgattcggtgggaggcatggcgtcggagaagcacttcaagtacgtcatccttggcggcggcgtcgcggcggggtacgcggcgcgggagttcgccaagcagggagttaagcctggggagcttgccatcatctccaaggaggctgtggctccttacgagcgtcctgccctcagcaaaggttacctctttcctcagaatgctgcaagactcccaggattttatgtatgtgtgggaagtggtggagagaggctattgccagagtggtactcagagaaaggtattgagctgatccttagtacagaaattgtcaaagctgatctttccaccaagaccctgactagtgcagctggagcaaactttacatatgagatcttgctcattgctactggctcctcggtcataaagctcactgattttggcacaccaggagctgattcaaacaacattctatatctaagggaaattgatgatgctgacaagctggttgcagctatccaggcaaagaagggtggcaaggcagtggttgttggaggaggttatattggccttgaacttagtgcagccctgaagatcaatgactttgatgtcactatggtgttccctgaaccttggtgcatgcctcggctcttcactgccgacattgctgctttctacgaggcttactatactaacaaaggtgtaaaggtcttgaagggcacactagctgttggttttgatgctgatgccaatggtgatgtcactgcagttaaactaaaggatggcacagtacttgaagctgatattgttgttgtcggtgttggaggcagaccattgactactctcttcaaaggtcaagttgctgaggagaagggtggaatcaagactgatgccttctttgaaacaagtgttcctggagtatatgccattggtgatgtggctaccttccctttgaagatgtacaatgagttgaggagagtggaacatgttgaccattctaggaagtctgcagagcaggctgtaaaggcaatcaagggcaaagagtccggtgaaccagttccggagtatgactacctgccatacttctactcccgatcattcgacctggggtggcaattctacggcgacaacgtgggtgaaaccatcctatttggcgacagtgaccccacctccagcaagcccaagttcggctcgtactggatcaaggacggcaaggtcttgggcgccttcctggaaggcgggtcaccggatgagaacaaggccattgccaaggtggcgaaaacccagccgccggtcgctaacctcgaggagctcaagaaggagggcctccagttcgccagcaagatctgagacgctccacgttccatgtacatttccgtgtcatcatttaggttgttcttctggagttctggtcatggttgcaatgttctgctacagatgttgccgtgcatacgtgactacatgatatatcggtttttctgattgtcgtgtctgtacgtgactacactcacacgtgagaaatttgaataaagtctgcagactcagggttcaaatagcacaaatttttttccgaaa

SEQ ID NO: 15594 - DNA, 1887 bp, Sorghum bicolor
  Clone ID: SORBI-28MAY03-CLUS120_1
tgaccgccaagccacagccctcactacagcatatacgcctcctccctgagctagagctcgctcccgccgctgcccccagtccgtccaccccgtcgccgccaccaatggccgcctccgccatggagctctcgctcctcaaccccgccgcgacgcaccgccaccttgggggcctgcccctcgcgcggcgctccgtggtccggttccgccgcgtgtccgcctcggccgcggccgcggcgccgcccaagtcgtcgggccccaagaagcggggcaagacggagatccaggagacgctgctcacgccgcggttctacaccaccgacttcgacgagatggagcgcctcttcaacgccgagatcaacaagcagctcaaccaggcggagttcgacgcgctgctgcaggagttcaagacggactacaaccagacccacttcgtgcgcaaccccgagttcaaggccgccgccgacaagatggagggcccgctccgccagatcttcgtcgagttcctcgagcgctcctgcaccgccgagttctccggattcctcctctacaaggagctcggccgcaggctcaagaaaaccaacccggtcgtggcggagatcttctcgctcatgtccagggacgaggcgcgccatgctgggttcttgaacaagggactgtctgacttcaatttggcgctggacctggggttcctgaccaaggctaggaagtacaccttcttcaagcccaagttcatcttctatgccacctacctgtctgagaagatcgggtactggaggtacatcaccatcttcaggcacctcaaagcgaacccagagtatcaggtgtaccctatcttcaagtacttcgaaaactggtgccaggacgagaacaggcacggtgacttcttctctgccctgctcaaggctcagccgcagttcctcaatgactggaaggccaagctctggtcacggttcttctgcctctcggtgtatgtgaccatgtacctgaatgactgccaacgcactgcattctatgagggaattggtctggacactaaagaatttgacatgcatgtgatcattgagaccaaccgcacaacagcgaggatcttccctgctgttctggatgtagagaaccctgaattcaagaggaagcttgacaggatggttgtgatcaaccagaagatcattgccatcggagaatctgacgacattcccctagtgaagaacctgaagaggattcctctcattgccgctctggtgtctgagatcattgccgcatacctcatgccccccatcgagtctggctcagttgattttgctgaatttgagccccagcttgtttactgattctgtagaaagatttctctccgaattattcccgaaagacaagttggtgctttcccctaaggggcctgaatggtgaaaacgctggacggttagaggatctgcatcttcttgtgttcgtctgtaaaatactgagactttggcaacataaagcttggcaagtttttgttgtgtggcatctccatgtaagtgacagtgaactgcatcagaagcaatagcatcagaagcgaccgttccagttttccaacagaagggaacgtccgaagttgttgtactgctaatgaagcaaaagcattcagacctttatatgatcaatcacatatggcctcagagcagttacttaaccatggaacgtcgaactagcatgatgaatgtatcaagcacatttggttgattgtgtaacactagaaaaccatttaacagcgtttggaggctgtaccatgtgaatttacatatctccttttattttagcaatgtcatgcatcataagtgacaattatctataagcatttgtaagaaaatcgtggtagaagattgtcgatactaaccggtccactctctt

SEQ ID NO: 15595 - DNA, 1053 bp, Sorghum bicolor
  Clone ID: SORBI-28MAY03-CLUS2355_3
tcaagatgggctgcggatcttcatatggtacagcacatcttcatgaagcttttatcggacgccaataaatcatagtacaagctaattacaaataaaatgactgcaaccaggcatctcgagtacattaaacaggtacacagctaatcttttctatctataggtacaatatataactcgacattaccaagaaacaaagaacaatctttcatgatgccttgagacccgttcttaaatgacaatgaaagaataatagtagcagacaagtccacatggacagccacattacattagacaatttaactagcgacataattttgccgtaggacaatagacaattcaactagcgaatagttcagccgtaggacaatagactaatcaattagcaaatagttatctgtttggatcacgattttataatattgtgtgaaactggaattgcccaaattttcagacatcacagttacataaactaaccagataatgaatacttcatcactaatttcatttatacttgatctctacatttcagatgctatccccaaaattatgcagttaaatgtctatcgtcgtcgaaatggtcaaatggtccataggctgacacctcccgcatttgttagtgctgtgttagtgctttatggcgtcatgggagacaagcgttggatgagtgaaaagtatggacggagcagtgtaggtgtgtaaagttagacgattggtgacgctttcgtgtaactttgggcagatgtacatacatggatttaaataaatttgtgcgttctaaattgcaactgtaaattgaaaatttagaatttagatccagttgtaccttgtgtgttgcgctgtagctccgttcaatttgcagcacgccgtgatgatgatgcgtaagacgagaagccaacaacatgaagcagggcacagggacacaaaggttgggagaacccagggatgaaaaacaactccctgtgcgatctcccacccagcacacgaaaccacatctttattatggtggcctgccatgcgagcgcacccatcatggcaaaggccttcagatgtcac

SEQ ID NO: 15596 - DNA, 897 bp, Sorghum bicolor
  Clone ID: SORBI-28MAY03-CLUS2355_2
caagaaacatactgatttgtctacttttgcttctcctcctcctactcctactcttcgtctcttcaataattcggtgtgcaatgcaaagatgctgagaagagaaccgtgaataccaattttgcaggtcactaaagatggatgcccaatcatcttccatgacaacttcatcttcacccaagaagatggtaaaatttcacagaagcgtgtgaccgatattcatctggaagacttcctccagtatgggccccagaatgagcaggggaaggttgggaagcccctgcttcgcaggctgaaggatggtaggatggtgaactggaatgtgcaatcggaggatgctctttgcacacttgaagaagcgttcgagaaggtcaatacaagattgggcttcaacgttgagctgaaatttgatgacagtcttgaataccaggaggaagagctcactcgcatcctccaggccatcctcaaggtgatttttgagcatgccaaggataggcctatacttttctctagttttcagcccgatgctgcacagctcatgcgtaaattgcaaggcacatatcctgtctacttcctgacaaacggagggacagagctatacaccgacgtgagaaggaactcgttggaggaggccgtcaatctttgcctcgcgagtggcatgcaaggaatagtttcagaagcccgcgggatattcaggcaccctgctgctgtaccaaagatcaaagaggctaacctctccctgctaacctatggaacattgaataatgtgccggaggcggtgtacatgcagcacctcatgggagtgaatggggtgatcgtcgacctggtgccggagatcaccgacgcagtctcggagctcattgccctgcccgagcctgacctggaagtggacaacttgag

SEQ ID NO: 15597 - DNA, 2428 bp, Sorghum bicolor
  Clone ID: SORBI-28MAY03-CLUS2355_1
gcaccaggccaaatcacaacttcggctgcgctagtgatttccacgccgaattccttggccgatccagcaaccaatagtaccatttgctatatacaaatcctaaataactttaataatcgctgccatttggtccagagcagcaaactagagcaaagcatcatatcctggcaaaatagagaaaacaacagatccatttgcagcgtatttagcagaataatttcttattccaagtctcatcccttctgcctctgcacagctgcgctactacaccagccgctgctaggtctcttcagggtatgaagaggtaggagtggttgctgctgcagcagcagcaatcgattccgagcaagctatatcaaagattcatgtcacacatgcaaaaatggagagaatccattctgtcataagggatccatttggtaccgctacttggggctattctaccttctgaccaatcaaattggctcacttgcacgaaacctagcttcatttcatcaaatggctttcaccaatacttgaaacctagcttcagctcagaagatctataataggcatactgaaatgaacattatcatgcaagttcagtaaactcttaatcagagttgatctaagtgtgcttgagcagatcagttctcaatgtccagtgaccaagaaagaaagcttggaagaccatagcaatttcataccgacaatgtataccgagcagtagatcttcacacagcatataaatactccaccacctccatggagacactgcagttgatcttcatagacatcatatacaaactctccatcgttaccatgtaggcacagcagttgatcttcatagacgtcatatacaaacaccatcaccctcaagatgggctggggatcttcatatggtacagctcatcttcatgaagctttaatccgacgaaaatatactgtagaacacgctaattacaaataaacagagttcaacaacgactctcgaggacattagacaggtacgccgctaaacctttccctctatagggacaatcaagaaatagacacagacaccagcggaatattcagccaccctgctgccgtaccaaagatcaaagaggctaacctctccctgataacctatggaacattgaataatgtgccggaggcggtgtacatgcagcacctcatgggagtgaatgtggtgatcgatgacttggtcccacatctctcagatctaataattatcgaaatttcatcgaataattatcaatacaaagagatcatcgacaggctcggtgcagaagatagatccagcaaacgggccacgcttcgacgccttccagtcgtccatcgggatccagatctcgccggaaacgggaacgtcccagctcaacatcagatccaacgcgccaatcacgcagatcaggatcctccgagcacgcaaaccgtgcggcctcgtctcgcttcaagccgattcgccatctcatcattcgaaccaactagctcgtaacctgcacatcatcatcaaaaaaaaaaaaacatccgtttccaacaaacaaataacagagccagattcaccgttgctcgatcgaaacaagcatgcaatccagaaaccacaaggctaggcatggagaaaggaataataagtaagttcaggctcagatctagacgagaaggggatttcatcaggcaaagggggaacgcggcgacttttcttctagaccagggcaagggagaacgaggggagggtaggcaaacaaggctaagggcgtcgggggcgacgatggtgaggagcggcggcggcggcgggggcggcggggggcggttctcggtgatcggggaccggggcaagggggtgaacgcgctggcgtcggcggccccgcgcatgcaggaggtgcgcgagaacacggtccggtccttcaacgacgccgcgcgcttccccgtcgactacgtcgagttcgacgtccagggtgaactaaacaaggcctaaacaaagccttaattagggtcgcggttaccgaggcgagcatctgagcttgtttgacggggacggcagatccaccggcggaagtggggacacgggtggcgtgcggttgcgatatctgtcacgtgactgggcaggccggtgtcacgtgccgtgccccaggcggtggtcgcctccactcgcttgctccatgtgccgcgtcgcgtcccgatctggcagtggctgccaccccatcgtcagcgctgccggaggctgcggacagtgtcgtgtcaactttgcaaaacaacgtgcccagaccagcgcagccccgccccggtttgttgtgcgccgccgcaccagacgtccagaccgggtcgtgacgtattagtctatctcgtacacatttaaatagggtgtcatatataaatataattgctgacttggtaggatcattaaatgaaggaatttcatcagaggagagagaagttttatctc

SEQ ID NO: 15598 - DNA, 2798 bp, Sorghum bicolor
  unsure (1)..(2798): unsure at all n locations
  Clone ID: SORBI-28MAY03-CLUS5466_1
gcccagatgaccggtattcctatcatggtgcttatcaagcctgattttggtctccttgctcattttggcattgagactgggacgatgctggacgccatcctgctctgggaggacgcttcgctctagttggaaggtttccagaaactccccccgcccccggctcgaggagatcgggacagagaggatgatgggagggcgcgcgctgctgctgctcctcgtctcggcgctgctcgttcagatccgcgcctccgatccgctgctgtacgagccgttcgacgaggacttcgaggggagatgggtcgtctccaagaaggacgagtaccaaggtgtgtggaagcatgccaagagtgatggccatgaagactatggcctccttgtcagtgagaaggcaaggaaatacgccataatcaaggagcttgatgagccagttactttgaaggatgggacagtggtcctgcagtttgaagtgaggcttcagaatggccttgaatgtggaggtgcctacattaagtacatccgccctcaggatgctggatgggatgccaaggagtttgataatgagactccatacacaattatgtttggtccagataagtgtgggtcaaccaacaaggttcatttcatccttaagcacaagaatcccaagactggaaagtatgttgagcatcacctcaaattcccaccttctgtcccatatgacaagctctctcatgtctacacggctatcttgaagccagacaatgaggtcagaattttggtcgacggggaagaaaagaagaaggcaaacttcctttctgctgatgattttgagccagcacttatcccatccaagaccattcctgaccctgatgacaagaagccagaggactgggatgagagagctaaaatccctgatccagatgcagtgaaacctgatgactgggatgaggatgcccccatggaaattgtggatgaggaagccaccaagcctgagggatggttggatgacgagcctgaggagattgatgatcctgaggcagccaagcccgaggactgggatgatgaggaggatggtgaatgggaggcgccaaagattgacaacccaaagtgtgaagaggcacctggatgcggtgagtggaagaggccaatgaagcagaatcctgcttacaagggcaagtggcatgcacctatgattgacaaccccaactacaaggggatctggaagcctcaggagatccccaaccctgagtactttgagcttgacaagcctgattttgatccaattgctgctattggtattgagatctggacaatgcaggatggcatcctgtttgacaatatcttgattgctgatgatgagaaggttgccacctccattctggagaagacctggaagcccaagtatgatgttgagaaggaaaaggagaaggctgaggaggctgctgctggtgcggatggtctttctgagttccagaagaagatttttgacgtcctgtacaagattgctgatgttccgttcttggcaccctacaagaccaagatcattgatgttatcgagaagggagagaagcagcccaacatcactattggcattttggtctccgttgtcatcgtgttcgttactgttctcttcaggatcctttttggtggcaagaagccagcggtacctgtgaaacccgcagctgaggcgaagaagcccaaagccacagagaccgacggtgctggaagcagtggtgacaaggatgagaaagaggacgaaaaggaggagacagcagccccacgtcggaggacccgcagggagacgtagagacctgtttttgatgtgtttggctgttctggcgcctgcttattttgagaactcttaatatttctgagtgtataataggaacttaagtcacctctgccgctccccctgctgctgatttgtttttacatggttagaccaggacccttcacgagctgtagaatttagttcttgttggtcatttgtgtgctgtgcctgacgggtataatcacttgttcaatcagatagaggtgatggttttttttgttctggtagatcaaatgaagaaatatttcatatgtttttttttgggagactgttcagttggatgaatgcctggttaaattcttgtttctggacgtcttaggatttaggatttggtgggtatgaatgcttgtcagcactcaccaggttgatgtcaatgttccatcgctaaggtcttgtttagttttcaaaatatttttggatttcctgtcacatgaaatcttaaaattttttggatttcttatcacatgtattgtaatttgcaaaacaatggaattcttggggcatatgaattgtaatttgtgagacgaattttataagtctccattcccagataaatatcatccttttgcatctgattgagctgtttctgtggctgtgcaagagaacattatttagttgtacacacaaacaaaaagtgggagtattttccagagtttagaagagggctgtttgtgagcactgaaggcagagaaaggcaaaaagctttagcagcggcaatgctctggtcaatggacccgcaggtgaccgtccatggngactgggtgtcagccgtggtgccgctgatgaagctgctgtgcctgacggtcatcggcctgctcctcgccaaccctcgggttcaggtcgtgcccagggccaccttcaagctgctgagcaagctcgtcttcgcgctctttcctccctggctcatcttcgtccacctcggcaagtcgggcaccataaacaacgtcctgcactggtggtcaatcctgtcaacgtgctcataagcact

SEQ ID NO: 15599 - DNA, 1382 bp, Sorghum bicolor
  Clone ID: SORBI-28MAY03-CLUS547_1
acgtccctggtccctctcctcctcctcctgccggcccacatctcactctcacctcccgataagagagggccctcggcttcccctccctcccctccgctccagctccagctcccctccatcctcggccaaaaatctgcggcgagctccgctccgatccgatccgatccgactgctccccacgccgttgaggccgagcgggggtccaggagaggagaggagaggcgcggcgccgcggctgccaccgtaccgccgccggaggagagaggggagaaggaagaggagccgtacccgtccgcttgctccgcttccgccggacctatcgacccgatggactcggagcactggatctcgcgcctggcggctgcgaagcgcttctacgcggcgcagctcggccacagcgatcgggcggggatggaggagctggacatggacgaggaggtcaggcccgagttcgcctgcccctactgctacgaggaccacgacgtcggatccctctgcgcgcacctggaggaggagcacccgttcgagccccaagccgcggcttgccctgtctgctctgagatggttacgaaggatatggttaaccatattactatgcaacatggatatttattcaagaatcgtcgccggttgcgcagattcatcattccaggcagccaggccctttctttactgagccgagatctacgggaagcccatttgcaggtgcttcttggaggcggacatagatcaagcaacaataacagcaccacaaatatttcagctgatcctcttctgtcatcattcggccttagcttccctacatcagatgcagagcaaacatccaaatcgactctttccattcctgatgatgctacgatgataaaagaaacgcctgctcaggcacggaagttaagtatcgattcgtccctcacaagtgaagaaagggagcagaaacggaagcaagccagcgtcagagccacattcgtgcaagacctgctgctctctactctattcggggactaataaatcaggatgagccaagttatcactggaagggtgcttcccggtgcaggtctgcagagactagcgtgctccacccaacttgctgaattcctcgacggaacatatgcgcgcatccggggtgctagcctttcgtcccttccagtgtggtgcagaatcgatgtgggcatgatgtgtcttctaagttattgtaagccggtctctctatcctcagttccttcataactgacgatcagcatgtgatatgcatgcaagtcgcggttgtgcgtgtacctcatctgtgtctgaactctgaagcattggtttgttgtaccaacataataataataatgttacaacagcggatggctatccatacactgcagcgttaggagcagatc

SEQ ID NO: 15600 - DNA, 680 bp, Sorghum bicolor
  unsure (1)..(680): unsure at all n locations
  Clone ID: SORBI-28MAY03-CLUS10057_2
cagaaagtccggtggcgcggacgacggcgagtacggtttctcccgggacgacgacgactcggagatgtacaggaaggaggagaaagagcacaagcacaaggagcacctcggcgagatgggcgccctcgccgccggcgccttcgccctgtacgagaggcacgaggcgaagaaggacccggagcacgcgcagcggcacaagatcgaggagggcgtggcggcggtggcggcgctgggcagcggcggcttcgcgttccacgagcaccacgacaagaaggaggccaaggacgcggcggaggacgccgaggaggagtccggacgcggcgaggggaagaagaagcaccacttcttcggctgatgatggagctgctgctgctcttcgctactccaacaagcagcatgcatgcttgcatgcatgcagcagccagctggagaataaaaaaactcagtgtatccgtttatgtatgtatgtatgatgatgtgccggtatcactgtgtagttatactgtgatggtgtgtctgtgtatgctgttagctttgtgcactgtggagagtacgtgtagtgtgtgtttatttggtgcatggttacggacttacggtgtgcatggctgcatgtgcatttgcctaataagttgtttttcactcctatgtggtatatatatgtaaatgttntaattttcaaa

SEQ ID NO: 15601 - DNA, 1342 bp, Sorghum bicolor
  Clone ID: SORBI-28MAY03-CLUS10057_1
gaactgccagcaaacggcggctggtccaaccgaaagtatagtgcaacaaacaactgcaagcaaagctctactatactcttcaatacacgactacgtgaacgatggctgacgagtacggccgcagcggctacggcaggtccggcgccggcgacgactacgacagcggctacaacagcaagtccaggactgatgactacggccgtggcgaaggtggctacaacgagtccggcggcgacgactacggccgccgcagtggcggcgatgggtacgacaggtccggcggcgacgactacggccgtggcaccggcggcggtgggtacaacaagtccggcaaggacgactacgacggtgggtacaacaaatcgggcaccaacgacgacgagtacggccgccgtggcaccggcggcgggtacaacagcaagtcctctggcgatgacgcgtacaccggcggcgccgggtacaacagcaagtcctctggcgacgacgacgcatacaccggcgtcgggtacaacagcaagtcctctggcgacgacgcatacaccggcggcgggtacaacagaaagtccgcttggggggacgaggggcggtagggtgcggcgggttcgcgttacacgaggaacacgtacagaaggagggcgaggacgcggcagaggacgccgaggaggagtccggacgcggcgaggggaagaagaagcaccacttcttcggctgatgatggagctgctgctgctcttcgctactccaacaagcagcatgcatgcttgcatgcatgcagcagccagctggagaataaaaaaactcagtgtatccgtttatgtatgtatgtatgatgatgtgccggtatcactgtgtagttatactgtgatggtgtgtctgtgtatgctgttagctttgtgcactgtggagagtacgtgtagtgtgtgtttatttggtgcatggttacggacttacggtgtgcatggctgcatgtgcatttgcctaataagttgtttttcactcctatgtggtatatatatgtaaatgttttaattttcacttgtgcatgcagcagccagctggagaataaaaaaactcagtgtatccgtttatgtatatatgtatgtatgtatgatgatgtgccggtatcactgtgtagttatactgttatgatgtgtctgtgtatgctgttagctttgtgcactgtggagagtacgtgtagtgtgtgtttatttaatttggtgcatggttacggacttacggtgtggctgctgcatgtgcatttgcctaataagttgttttttactcctatatggtatatatatgtaagtgttttaattttcacttaattttctttttccaagac

SEQ ID NO: 15602 - DNA, 494 bp, Sorghum bicolor
  Clone ID: LIB3478-054-Q6-K1-B3
gccaccgccacgccatggctctcttcctcaagtccaagcaccactttcccgccaccggccgcatcgtcttcctgcgccatctctgcgagggctcaccgagcccgtcgcccccaacggacacggacccgtcgcccccgcccctgacccgcgacgactacgacagcggctacaacagcaagtccaggactgatgactacggccgtggcgaaggtggctacaacgagtccggcggcgacgactacggccgccgcagtggcggcgatgggtacgacaggtccggcggcgacgactacggccgtggcaccggcggcggtgggtacaacaagtccggcaaggacgactacgacggtgggtacaacaaatcgggcaccaacgacgacgagtacggccgccgtggcaccggcggcgggtacaacagcaagtcctctggcgatgacgcgtacaccggcggcgccgggtacaacagcaagtcctctggcgacgacgacgcatac

SEQ ID NO: 15603 - DNA, 2104 bp, Sorghum bicolor
  Clone ID: SORBI-28MAY03-CLUS25_1
gcacgaggcgcaacgccctcgacctattctcaaactcttgatagggcggccgcctccgccgcgcccgtatccccaaccgaaccgacattgttttcttccccttctggcttctggccttctccttctacacagtctagaggcgtctgctcccccaatcccttccgcccgccccgcctgctcgacgcgatcccgccggcggccatggatccgtacaagcaccgcccttctagcgggagcaactccagcttctggaccaccaactccggcgcccccgtctggaacaacaactccgcccttaccgtcggacagcgaggacccatcctccttgaggattatcatctaatcgaaaagcttgctcagttcgacagggaacgtatccctgaacgtgttgtgcatgcacggggagccagtgccaagggtttctttgaggtcactcatgatatctctcaccttacatgtgctgattttctccgggctcctggggtccagacacctgttattgtccggttctctacagttgtgcatgagcgtggaagccccgagaccttgagggatccacgtggttttgctgtcaagttctacaccagagagggtaactttgaccttgtgggtaacaacatgcctgtgtttttcatacgagatgggatgaaattccctgatatggtccatgctttcaagccaaacccaaagaccaatttgcaggagaactggagaatagtagatttcttctctcaccacccagagagcctgcacatgttcaccttcctctttgatgatgttggcatcccactcaactacaggcacatggagggctttggtgtcaatacctacaccttgatcaacagggatggaaagcctcaccttgtgaaattccattggaagcctacttgtggcgtgaaatgcttgcttgatgatgaagctgtgactgttggaggtacctgccatagccatgcgacaaaggatctatatgattccattgcagctgggaattaccctgaatggaagctctacatccagactatcgatcttgaccatgaggataagtttgacttcgacccgcttgatgtcaccaagacctggcctgaggatatcatcccactgcaacctgttggacggatggtcctgaacaagaacattgataacttctttgcggagaatgaacaaattgctttctgcccagcgattattgtccctggaatccactattctgatgataagctgctccagacgagaatcttctcctatgctgatacccagaggcaccgccttggtccaaactatctgatgcttcctgtgaatgcaccaaaatgtgcccaccacaacaaccaccatgaagggttcatgaacttcatgcacagggatgaagaggtgaactacttcccttcaaggtttgatcctacccgtcatgctgagaaggtccctattccttcccgtgttctaacaggctgccgcgagaagtgcatcatcgagaaggagaacaacttcaagcaggctggtgagagatttcgatcctttgaccctgccaggcaagaccggtttatccaacgatgggttgacgcactgtcagaccctcgtgttacccatgaacaccatacgatttggatcaactactggtctcagtgtgatgcctctcttggccagaagctggcttctaggctgaacctgaagccgaacatgtaagattgacaaggaagaaagcaggcgccggtggccgaggatgcaacatggagcgtgatgcaacacatgttggatcgtgcgatgttgagaacggctgttacacctatataatcgaataaacagggatgtgcgcgttgtagtatgctgatgatcggtggtggttatatatcctggaacttttggtgtacacatcttttctggaaagacgtaataataaagaagaatgtgtcaatgtggtgggcaacagtagcagacgatgtagtttacggtggcgttgtttttgtcgcctgtaatgcaaaaccctgctgtgtgctcgcctgtctattacaaacagtgatgagttgtggcggtatgtttttgacagtttatttactagtgagtacatctctgattgatcacgttcgcctagaaccaaagaacggaagga

SEQ ID NO: 15604 - DNA, 881 bp, Sorghum bicolor
  Clone ID: SORBI-28MAY03-CLUS497_10
ctcaaatcgacctagctagcgaatccctccgtccccgcagcctcacccccacagcatcgatggcgcccaaggcggagaagaagccggcggcgaagaagcccgcggaggaggagcccgcggccgagaaggccccggcggggaagaagcccaaggcggagaagcgcctccccgcgggcaagtctgccggcaaggagggcggcgacaagaagggcaagaagaaggccaagaagtcggtggagacctacaagatctacatcttcaaggtgctcaagcaggtgcaccccgacatcggcatctcctccaaggccatgtccatcatgaactccttcatcaacgacatcttcgagaagctcgccgccgaggccgccaagctcgcgcgctacaacaagaagcccaccatcacctccagggagatccagacgtcggtgcgcctcgtcctccccggcgagctcgccaagcacgccgtctccgagggcaccaaggccgtcaccaagttcacctcatcttagattagtttggcggtactgtgtggtgtaggtagatgtgggtctgtttatctggtattgctagcggtagcagtagctggtggtgtttggaatggatggatggtggtctgtgtgtggttgaattgcggtggtgcttttgggatcctgttccattatccagaatagtcacggtgcttgatcagcatgtgatttctgtcaggatggatgctgttactgtgtagttgtcatgttgctggcagtgaactgataattcaatgtgcaaacctatatgtcaagtgtgttctgcatttgatagttgctacttgccaaaaaaaatataggtatggggctcccctgttgattcggtccaaaaaaaaaaaaaaaaaaaggccccta

SEQ ID NO: 15605 - DNA, 721 bp, Sorghum bicolor
  Clone ID: SORBI-28MAY03-CLUS497_9
ccgggacacagccaaaagccacgagcacttgccgcctcccaccagcaaattcgcaatccgccgcttcccacctcgcgttcgccgctccatttgatcgattacggatggcgcccaaggccgagaagaagcccgcggagaagaagccgccggaggagaaggccgagaagaagcccagggcgggagaaacgcgtccccggcaagggccggcccgagaaaagacacagccaaaaagccacgagcactgtccgcctcccaccagcaaattcgcaatccgccgcttcccacctcgcgttcgccgctccatttgatcgattactgatggcgcccaaggccgagaagaagcccgcggagaagaagccggcggaggagaaggccgccaagctcgcccgctacaacaagaagcccaccatcacctcccgggagatccagacgtcggtgcgcctcgtccttcccggcgagctcgccaagcacgccgtctccgagggcaccaaggctgttaccaagtttacttcctcttaggctgccgctgcatggtgctacggtcttgtttcgtttcctcgtgtgtttaggccagtgctgggtcgctcgtgaaacagtgtagaatttgttgtatctgctgaatgacgactcggttacctttgtcgaagtttctaatatattgcaattgctaatacaatttgcttcaaatcttgatgaaaaaaaaaaaaaaaaaaggccccta

SEQ ID NO: 15606 - DNA, 748 bp, Sorghum bicolor
  unsure (1)..(748): unsure at all n locations
  Clone ID: SORBI-28MAY03-CLUS497_8
gccggccgggttccggcgcaccaacaacaacagcaaacacatctcctcgctcgcatttctccccaacccaatcaatccccctcgcccccgaaccccagctcgcaccgcatcgatggcgcccaaggccgagaagaaacccgcggcgaagaagctggcggaggaggagcccgcggccgagaaggcgccggccgggaagaagcccaaagcggagaagcgtctgcccgctggcaagtccgccggcaaggagggcggcggcgagggcaagcggggccggaagaagggcaagaagagcgtggagacgtacaagatctacatcttcaaggtgctgaagcaggtgcacccggacatcggcatctcctccaaggccatgtccatcatgaactccttcatcaacgacatcttcgagaagctcgccgccgaggccgccaagctcgcgcggtacaacaagaagcccaccatcacctcccgcgagatccagacctccgtccgcctcgtcctccccggggagctcgcgaagcacgccgtctccgagggcaccaaggccgtcaccaagttcacctcgtcctaggctgcgcggncgccgccgccgcttgcaggcttctctcgtttgttcatcatcggccttgctgtagttagattagatgttggtggtttctaatgtgtctgttctccttctgtagtaaccgcgntatctgatgtaatcgtaatggtgctagtttaacccagctacctgtttatttgtgcaccc

SEQ ID NO: 15607 - DNA, 748 bp, Sorghum bicolor
  Clone ID: SORBI-28MAY03-CLUS497_6
tcgaggccggccgggtccagaaaaatcgaaatcgaccggcgaaagcgaatccctccccgccgcagcctcacatcgcacgccaccgcgaaaccccagcagccgcatccatccatggcgcccaaggcggagaagaagccggcggcgaagaagcccgcggaggaggagcccgcggccgagaaggcgccggcggggaagaagcccaaggcggagaagcgcctcccggcgggcaagtcggccggcaaggaggggggcgacaagaagggcaagaagaaggctaagaagtcggtggagacctacaagatctacatcttcaaggtgctgaagcaggtccaccccgacatcggcatctcctccaaggccatgtccatcatgaattccttcatcaacgatatcttcgagaagctcgccggcgaagccgccaagctcgcgcgctacaacaaaaagcccaccatcacctccagggagatccagacctccgtccgcctcgtcctccccggcgagctcgccaagcacgccgtctccgagggcaccaaggccgttaccaagttcacctcatcttaggttggtggcagtagctactgggtggcgttggtagatgtcgcccagtttatctagtactgatagtggtagcagtagtggttggatgttggagctgggaatggattgatggtctgggtgcagttgggttttggtaagaattgtggtgaacttttggtgcttttgaaaaaaaaaaaaaaaaaggccccta

SEQ ID NO: 15608 - DNA, 857 bp, Sorghum bicolor
  Clone ID: SORBI-28MAY03-CLUS497_5
cccacgcgtccgccgcaacttcacaacacagatcatcgtcttccaatcgagcaaaccctccttcggtttagagaatccgtgcggcgctcgagccggccggtttttggacagccaacgaaatctcccgtcccaaatcgaccgagcgaattcaccacagcctcaccgtcccgaatccgcaccaccgatggcacccaaggcggagaagaagccggcggcgaagaagcccgcggaggaggagcccgcgaccgagaaggcggagaaggccccggcggggaagaagcccaaggccgagaagcggctccccgcgggcaagtccgccggcaaggagggcggcgagggcaagaaggggaagaagaaggcgaagaagtccgtggagacctacaagatctacatcttcaaggtgctcaagcaggtgcacccggacatcggcatctcgtccaaggccatgtccatcatgaactccttcatcaacgacatcttcgagaagcttgcggccgagtccgccaagctggcgcgctacaacaagaagcccaccatcacctcccgcgagatccagacctcggtgcgcctcgtcctccccggcgagctcgccaagcacgccgtctccgagggcaccaaggctgtcaccaagttcacctcttcttaggttcgtagtagtgatggctgggtggtgctggtagacatggctcggtttatctggtagggcaagcgatggatgttggtgatgatgatctgcgtgtaattgtgttgttaagaattgtgaaacactgttccacattaattgaggaccaccttacggaagagcccatcaacgagtacgttcagagttgcgacgttgtcgctctctacaagatcta

SEQ ID NO: 15609 - DNA, 666 bp, Sorghum bicolor
  Clone ID: SORBI-28MAY03-CLUS497_4
ccgggacgaatcctctgcaacctcccatcccatcctcgaattcagattcccatccgagcaaaccctaccgcccttttccactcaccctagaggacccgatggcgcccaaggcggagaagaagccggcagcgaagaagcccgtggaggaggaatccgcggccccggcggagaaagcccccgcggggaagaagcccaaggcggagaagcgtctcccggcgggcaagtccgccagcaaggagggcggcgagaagaggggtcggaagaagggcaagaagagcgtggagacgtacaagatctacatcttcaaggtgctgaagcaggtgcacccggacatcggcatctcctccaaggccatgtccatcatgaactcgttcatcaacgacatcttcgagaagctcgccggcgaggccgccaagctcgcccgctacaacaagaagcccaccatcacttctcgggagatccagacctccgtccgcctcgtcctccccggggagctcgccaagcacgccgtctctgagggcaccaaggccgtcaccaagttcacctcgtcttaggcgtttgcgatgtgtagttctagtaggtcggagccttggtgtcgtgtaagtgctacggtggcttttgaccgatggaatggaatggaatggaatggaatgctattgttatttc

SEQ ID NO: 15610 - DNA, 769 bp, Sorghum bicolor
  unsure (1)..(769): unsure at all n locations
  Clone ID: SORBI-28MAY03-CLUS497_3
gccggccggngcgggaccaagcacaagccatcctcaagtccccaagcacccaccacctccccgagaacccagcctcgatcctcatccccatggcgcccaaggccgagaagaagcccgcggccaagaagccggcggaggaggagccatcgacggagaaggcagagaaggccccggcggggaagaagccgaaggccgagaagcggctcccgtcgggcaagtccgcgggcaaggaaggcggcgagaagaagggaaagaagaaggcgaagaagtcggtggagacgtacaagatctacatcttcaaggtgctgaagcaggtgcacccggacatcggcatctcgtccaaggccatgtccatcatgaactccttcatcaacgacatcttcgagaagctggcggcggaggcggccaagctggcgcggtacaacaagaagcccaccatcacgtcccgggagatccagacctccgtccgcctcgtcctccccggtgagctcgccaagcacgccgtctccgagggcaccaaggccgtcaccaagttcaccagctcctagatggggcctcgtcgtctcccgtctcgctcgggcttcggttccgttcaggaagtagtagggtggtcgtgtgttgcagtggcggtagttgcccctgcgtcgatctccactgtagtcgtctgatgatttgtgtaagaagtagtgtggnttgtggtaatgttgctggtcatnncttgcattttctgatgcaaatatatgagaaatccatcctgggtatttgacag

SEQ ID NO: 15611 - DNA, 848 bp, Sorghum bicolor
  Clone ID: SORBI-28MAY03-CLUS497_2
ccgggcaaggggaaggaagaaaggaaggaaggaaggccggccccatggaaatttcacgccaagaaaagcctcctcctgagtctcgaaccaaccgcatcgtcccccgtctccttcccccttcgtccccgacatccccgacccgatggcgcccaaggccgagaagaagccagcggagaagaagccggccgccgaggagaaggcggagaaggcgcccgcaggaaagaagcccaaggccgagaagcgcctgcccgcctccaagtcctccggtaaggagggcggcgagaagaaggggaagaagaaggccaagaagagcgtggagacctacaaaatctacatcttcaaggtgctgaagcaggtgcaccccgacatcggcatctcctccaaggccatgtccatcatgaactccttcatcaatgacatcttcgagaagctcgccggcgaggccgccaagctcgcgcggtacaacaagaagcccaccatcacctcccgcgagatccaaacctccgtgcgcctcgtcctccccggagagctcgccaagcacgccgtctccgagggaaccaaggccgtcaccaagttcaccagcaactgagcgacctgcagcgtccacggatttgttaggtctccctttctaggagggttcttcgttgtgtcctctcctcctccctccccctatgtatgtgctcagaagtcgttgatgttctcctcgggaacaaagactaatagctagcttccctgctttataaatcgtgccggattgtaatgcctctcttagatttgctgcccccgttgtggaatatagttgtatcggtgccttctccgcttgcgaaaaaaaaaaaaaaaagccccta

SEQ ID NO: 15612 - DNA, 1134 bp, Sorghum bicolor
  Clone ID: SORBI-28MAY03-CLUS497_1
cgctcacggccggccgggccgggctctccgtctctagggtttgagattttagccgccgccgcagctcatctcacttccccgagaagtcgcagccgacgacgtactcctcgccgatacgatggccgtcttctccgacctccacaccgccgacggcctcaagaccctggaggcgcacctagcgggcaagacctatgtttcaggtgatgcgatcactaaggatgacattaaggtctttgctgcggtgccatcaaagcctggcgctgagtttcctaatgctgcccgctggtacgagaccatctctgcggctgtagcctcaagattccctggtaagcctgttggtgtaaatctgcctgcgggatcagctcctgcagcagctgctcctgctgctgaggctgaggatgatgatgaccttgatcttttcggggatgaaaccgaggaggacaagaaggctgctgatgagcgtgccgctgccaaggcctcttccaaaaagaaagaaagtggtaaatcctctgtccttatggatgtcaaaccatgggacgatgaaactgatatgaagaagctggaggaggctgttcgtagtgtccagatggagggtctcacttggggagcatcaaagcttgtgcctgttggatacggcatcaagaagatgactattatgttgacgattgtcgacgatcttgtgtccgtcgacagcctaattgaggaccaccttacggaagagcccatcaacgagtacgttcagagttgcgacattgtcgctttcaacaagatctagagttccaatcactgagattgggcaatggccggcagcgcttaaaagtttgtgctgggatgcgagactttatcccttctagttaccttgttatagaaatgttggttggagtttattgttgagtggtgccagatttttgaatacctgtttatcttaaaaacagcggaactgctgggcaatgttctatgtctaaagttaatgagttttcaatggttctgcatctaaagttaagttttctttgcaatgcttatttttgatcttctaatctataccagctgtgctaaatgtcgcggggttttaactaaaatggtgtttttcaacccgtcctgtactctgtatcgatattatatctatatttgata

SEQ ID NO: 15613 - DNA, 838 bp, Sorghum bicolor
  unsure (1)..(838): unsure at all n locations
  Clone ID: LIB5050-008-R1-XP1-B7
ctgtgcggcgctcaggcggcgggcgggaacagatctcgtcttccatcgagcaaaccctccttcggtttagagaatccgagcggcggcatcgatggcgcccaaggcagagaagaagccggcgtcgaagaagcccgcggaggaggagccctcggagaaggcggctccggcggagaaggcccccgcggggaagaagcccaaggcggagaagcggctcccggcgggcaagtcgtccgccggcaaggagggcggcgagaagaaggggaggaagaagggcaagaagagcgtggagacctacaagatctacatcttcaaggtcctgaagcaggtgcacccggacatcggcatctcctccaaggccatgtccatcatgaactccttcatcaacgacatcttcgagaagctggccgcggagtccgccaagctcgcccgctacaacaagaagcccaccattacctcccgcgagatccagacctccgtccgcctcatcctccccggggagctcgccaagcacgccgtctccgagggtaccaaggccgtcaccaagttcacctcctcttagattagatggacgtcaatggtgtgtctgcttctcaagcacgcactgtgatgtgctgcttctcctggtagtagtggttggctggctggtgtggtgtagttaagtgctgcagtgccttttgcctgtattatgaatagtcatggtggtaatggaatgatctggttatctgaatgttgaccagggatcttatgcgtgcttacccatatgntctcagttgttacactgcttgaagtgccgtaccctgtgtttatgtgatgctcaaaaaaaaaaaaaaaaggccct

SEQ ID NO: 15614 - DNA, 249 bp, Sorghum bicolor
  Clone ID: LIB5051-006-A1-XP1-E12
gccggccgggttccctttatctggtagggcaagcgatggatgttggtgatgatgatctgcgtgtaattgtgttgttaaaattgtgaaacactgttccactcactcggtccttgttctacatgttattatctctatcaggatggatgctcttactgcagaactgtgcccagcagtgagccgctttatataggcaaacctataccaaatatctgaaacaagtttgaaaaaaaaaaaaaaaaaaggccccta

SEQ ID NO: 15615 - DNA, 400 bp, Sorghum bicolor
  unsure (1)..(400): unsure at all n locations
  Clone ID: LIB3476-025-P1-K1-C3
cagcgaactccgcgaaatccccccgaccccgaacccaaccgagcaaagcgcgaagccccccacctcgaatcaagccgcagaatcgatggcgcccaaggcggagaagaagccggcggcgaagaagcccgcggaggaggagcccgcggccgagaaggcggagaagaccccggcggggaagaagccgaaggcggagaagcgcctccccgcgggcaagtccagcgccggcaaggacggcgagggcaagaagggcaagaagaaggccaagaagagcgtggagacctacaagatctacatcttcaaggtgctcaagcaggtgcacccggacatcggcatctnctccaaggccatgtccatcatgaactccttcatcaacgacatcttcgagaagctcgccggcgag

SEQ ID NO: 15616 - DNA, 596 bp, Sorghum bicolor
  Clone ID: SORBI-28MAY03-CLUS155_2
tcccgggaccctcccttttttttttttttttttcggaaccacacatccaaattccaataccagtcaaatcacaactcacaacaagtatccatggttaaggcagaacacctgcctcaagacctggggcggccagccggagaaggtgacggcggcgcaggacgcgctgctgctccgcgccaaggctaactccctggcgcagctcggcaagtacacctccgacggcgaggccgccgaggccaaggagggcatgttcgtcaagaactacagctactaatcgcccggccggccggccggccgcggccatcaccggaataccgccgacgaccctctccgagatacgtgtactgatgatcatggttaagcacgtactccgatccatctccccgtgaaagccatgatatgatccatggacgaccattgcatggtgctgatcaatgtgccgtgtcctgttacataaatacatatactagtagtattactgctagtcgtttactgcaaagatcaagctcgctactgccaagtctgggataatgtatgcgtggcggcgagatctgagggaaaataatatatgtttcgagatggctccttataataat

SEQ ID NO: 15617 - DNA, 1725 bp, Sorghum bicolor
  Clone ID: SORBI-28MAY03-CLUS155_1
gctcgaggctcgcgcacccccggacgcgtgaagaagacggctgctgtgaagtagtgtgaacctgaaccttgtctgaggtcactgagtgagctagctagctagctaagctccgatcgatcctagctagcatacaataccactagtcttcttcacaagtgtaagagacgacagcaacacgagatggtcgctgctagccttctcaagtcctccttccttcccaagaagtccgaatggggcgccacccggcaagccgccgcctccccccggccggccaccgtctccgtcgtcgtccgcgcctccgcctacgccgatgagctcgtcaagaccgccaaaacgatcgcgtcgccggggcgaggcatcctggcgatggacgagtcgaacgcgacgtgcgggaagaggctggcgtcgatcgggctggagaacacggaggcgaacaggcaggcgtaccggacgctgctggtgacggcgccggggctgggccagtacatctccggcgccatcctgttcgaggagacgctgtaccagtccgccgtcgacggccggaagatcgtcgacatcctggtggagcaagggatcgtgcccgggatcaaggtcgacaagggcctcgtcccgctcgccggctccaacaacgagtcctggtgccagggcctcgacggcctcgcctctcgcgaggccgcctactaccagcagggcgcccggttcgccaagtggcgcaccgtcgtcagcatccctaatggcccctctgagctcgccgtcaaggaggccgcctggggcctcgctcgctacgccgccatctcacaggacaatgggctggtgccgatcgtggagccggagatcctcctcgacggcgagcacgggatcgagcggacgttcgaggtggcgcagaaggtgtgggcggagacgttctacgcgatggcggagaacaacgtgatgttcgagggcatcctactgaagccatccatggtgacgccgggggcggaggccaaggacagggcgacgccggagcaggtggcggagtacacgctgaagctcctgcaccgccggatcccgccgtccgtgccggggatcatgttcctctcgggaggccagtcggaggtggaggcgacgcagaacctcaacgccatgaaccagggcaccaacccgtggcacgtgtccttctcctacgcccgcgcgctgcagaacacctgcctcaagacctggggcggccagccggagaaggtgacggcggcgcaggacgcgctgctgctccgcgccaaggctaactccctggcgcagctcggcaagtacacctccgacggcgaggccgccgaggccaaggagggcatgttcgtcaagaactacagctactaatcgcccggccggccgcggccatcaccggaataccgccgacgtacgaccctctccgagatacgtgtactgatgatcatggttaagcacgtactccgatccatctccccgtgaaagccatgatatgatccatggacgaccatgcatggtgctgatcgatgccgtacgtgtcctgttacataaatacatactagtagtattactgctagtcgtttactgcaaagatcaagctcgctactgcaaaagtctgggataatgtatgcgtggcgcggcgagatctgagggaaaataatatatatatgcatgtttcgagatggctccttataataataattaaatacataccgcgtgtcctatttttgcctcgctggcggctta

SEQ ID NO: 15618 - DNA, 3022 bp, Sorghum bicolor
  Clone ID: SORBI-28MAY03-CLUS445_1
ccactaccgcgcgacgaactcatcactggtggtgctccgcagagtgaagcgaagcgaggcgagacgacgatgcgcaagtgggcgctctcctccgcgctgctcctcctcttcctcctcaccaccctccccgacccagctaagaagctacaggtgaatgccgaggagagcagagatgacttagctaacccaccgaaggtagaggagaagcttggtgctgtccctcatggtctgtctaccgactctgatgttgcccagagggaagccgagtctatctctaggaagactctcaggagctcagccgagaagtttgagttccaagctgaggtgtccagactcatggacatcatcatcaactcactctacagcaacaaggatatctatttgagggagctcatctccaatgcctctgatgctttggataagattaggttcctttcccttactgataaggaggttctgggcgaaggtgacactgcaaagcttgagattcagattaagttggacaaagagaagaagatcctctccattcgggataggggtattggtatgaccaaggaagatcttattaagaaccttggaaccattgctaagtctggaacttcagcttttgtggaaaagatgcagtccggaggtgacctcaatcttattggacagtttggtgttggtttctactctgtgtacttggttgctgactatgtcgaagtggtcagcaagcacaatgatgataaacaatatgtctgggaatcaaaagctgatggatcatttgctatctctgaggatacatggaatgagccccttggccgtggaactgagataagattacatctgcgagatgaggccaaggagtacttggaagaggataagctaaaggatttggtgaagaagtactctgagttcatcaacttccctatctatttgtggtcgacgaaggaggttgatgttgaagtgccagctgatgagggtgagacaagtgatgaagaggattcaaccccagaaactacagaggaagagacagaagaagatgaagagaaagagaaaaagcccaagacgaagacaataaaggagactacttctgaatgggaacttctgaatgatgtgaaggctgtatggcttcgcagcccaaaggaggttactgatgaagagtactcaaagttttaccactcactagcaaaggacttcggtgatgacaagcctatgggttggagccacttcactgctgaaggagatgttgagttcaaagctttgctcttcattcctccgaaggctccacatgatctctatgagagttactacaacagtaacaagtcaaacctcaagctgtatgttagaagagttttcatctctgatgaattcgatgaccttcttccgaagtatctcagctttttgaggggtattgttgactcagacacactgcccctgaatgtgtcacgagaaatgcttcagcaacatagcagtctcaagaccatcaagaagaagctgatccgtaaagctcttgatatgattaggaaacttgctgaagaagaccctgatgagtacagcaacaaggataagacagatgaagagaaaagtgaggtggaagagaagaagggccagtacgccaagttctggaacgagtttggcaaatcaatcaagctgggtatcattgaagacgcaactaacaggaaccgccttgcaaagcttcttagatttgagagttccaagtcagatggcaaacttgcctcccttgatgagtacatttcaaggatgaagccagggcagaaagacatcttctacatcacgggaagcagcaaagaacagctggagaagtctccattccttgagaggctaaccaagaagaattacgaggttatcttcttcactgaccctgtggacgagtacctgatgcaatacctgatggactacgaggacaagaagttccagaacgtgtcaaaggagggcctcaagctgggcaaggactcgaagctcaaggagctcaaggaatcgttcaaggagctatccgactggtggaagaaggctctggagagcgagaacgtggactcggttaagattagcaaccggctgcacaacaccccctgcgtcgtcgtcacctccaagtatgggtggagcgccaacatggagaagatcatgcaggcgcagaccctgtcggactcgagcaagcaggcgtacatgcgtggcaagagggtgctcgagatcaaccccaggcaccccatcatcaaggagcttcgtgacaaggtcgcccaggacaacgagagcgaagagctgaagcacacggcgaggctggtgtaccagacggccctgatggagagcgggttcaacctccccgaccccaaggagttcgcgtccagcatctacaagtcggtgcagaagagcctggacctgagccccgacgctaccgtggaggaggaagacgaggccgaggagcagcccgagatcgaagagaaggagtccaccaaggaggagtcggagccgtcctacgacaaggacgagctgtaggcgttgtctcgtctgccggatttgtgtttgaagtctagctagctcccgcttaggatgatgtgatattggggagttccactcactgccagtgtttaggaatgtgatgttctgagggacgacgcccatttttcccatgcaacgtgatacgggatttttgtctgtctttgtacctatacaaactttagttcagcctaattagtggtttgcatttaccttaccttgccatcccactccgtctggtgtggtcaggtgaactatctctgtctggttactgagctgaccgatagagtggcgcaccaaatttatttatactccctccgttctaatttaagttcttaacttttattcaggtactaaaaacatgaagccatattagttaaatcgtcatgactcatagatctatatgttacttgttgcaagtttgatgtttgcgggtattttggtatctcttaatcatcttttgctgctctgtaaactcttggatgctgtatttctgttgtttttaagggaaatggagaggttctcgtaa

SEQ ID NO: 15619 - DNA, 1822 bp, Sorghum bicolor
  Clone ID: SORBI-28MAY03-CLUS21_1
accacccccaccccttcggtcatctcctcctccccaagacacccaccaaccccgtccagccgccggctgtctcggccgccgccgccgccgccctctcccggtccctgaggcgcgccaggtcggccatggcgttcaacaagatccaggtcgccaaccccgtcgtcgagatggacggcgatgaaatgaccagggtgttctggaaatctatcaaggacaagcttatcttccctttcgtggacctggacatcaaatactttgacctcgggcttccatatcgtgatgaaaccgatgacaaagtcacagtcgaggctgcggaggccacactcaagtacaatgtggctatcaagtgtgccaccattacaccagacgaagcaagggtgaaggagtttggcttgaaggccatgtggaagagcccgaatggcacaatcaggaacattctgaatggcactgtgttcagagaaccaatcatctgcaaaaacatcccaaggcttgttccaggctggacaaagcccatttgcattgggaggcatgcatttggtgatcaataccgggcaactgatgcagttataaagggacctggcaagctcaaattaatgctagtttttgagggaaaagaagaacagattgatctggaggtgttcaacttcactggtgctggaggagttgccttgtctatgtacaacactgatgagtcaattcgagcttttgccgaggcttctatgacaactgcttatgagaagaaatggccactctaccttagcaccaaaaacacaatcctgaaaaaatacgatggcaggtttaaggacattttccaggaggtctatgaagctggctggaaatcaaaatttgaggctgctggaatatggtatgagcatcgtcttattgatgacatggttgcgtatgcgcttaagagtgaaggaggctatgtgtgggcttgcaagaattacgatggagatgtgcagagtgatttcttagctcaaggttttggctctttgggtttgatgacatcagtgttggtgtgccctgatggaaaaaccattgaagctgaagctgcccacggcacagttacccgtcatttccgtgttcaccagaaaggaggtgaaaccagtacgaacagcattgcttcaatctttgcatggacaagaggacttgcacacagggcaaagctggatgacaatgctaggctactcgacttcgctctcaaactcgaggctgcttgcgtcggaactgtggagtctgggaagatgactaaagatcttgcacttcttgttcatgggtccgccagcgtcacaagaagccattacctgaacactgaagagttcatcgatgcagttgctactgagctccgatcaagattgggagccaattgagcttacaagaaactttgtgcatggcgacttgaatgcttcatcaccgatctgctccagtcatttctgttacattggtactgccagtcatgcttccgtgatgaattgaatgtgcgtcatcgcaatgcaatttcgatcgaagctgattaaagatgatggtgtcacgtgagcgcccataataaaggatatatagaacaactgtggcagatgattaaaatacttttatgttagctatatctgatacatttcaataaagtccttgttttctccttttctgtagttcacaaatcacgcagttcgttcggtttggtttgcccattccgtagttcgccgataaccgtatgcactcggtttttccatcatcatcaagtaaacagatgccttccgttaaaaaaaaaacccaaaaaactatgtatatgctaatctttcgatgttaccttttggcccacaaagga

SEQ ID NO: 15620 - DNA, 848 bp, Sorghum bicolor
  Clone ID: SORBI-28MAY03-CLUS1644_2
gccggccgggtccggggcattcgatctcttggttctagctagcttagcatatatatccacgagcaactcgatcgtggatatatagctatatatatatatatctacctgagtcctgagagatcgatctctagctagctcggcaaccatggcgaggcaacaacaagttgcttccatgctcgcagctgctctgctcgttgcaacgtttgcgtccattcctacaagcgtgcactccatcggcgtctgctacggcatgctgggcaacaacctgccgtccagcagcgacgtggtgcagctctacaggtccaagggcatcaagggcatgcgcatctactcgccctcccagtccgcgctcgacgccctccgcaactccggcctcgccgtcatcgtcgacaccggcaacggcaacgagctcagccagctcgcgaggagcgcctcgtacgcggcgtcgtgggtgcagagcaacgtgaagccctactaccccgccgtcaacatcaagtacatcgccgtcggcaacgaggtgcagggcggcgccacgcagagcatcctcccggcgatccggaacctggacgccgccctggcgcgcgccgggctctcggccatcaagtgctccacgtcggtgcgcttcgacgtgatcgccaactcctacccgccctccagcggctcgttcgcgcaggggtacatggcggacgtcgcggggtacctcgccggcaccggcgcgccgctgctcgtcaacgtgtacccgtacttctcgtaccgggacaacccgcgggacatcagcctgggctacgccacgttccagccgggcaccaccgtcagggacaacggcaacgggctcacctacaccaacc

SEQ ID NO: 15621 - DNA, 1358 bp, Sorghum bicolor
  Clone ID: SORBI-28MAY03-CLUS1644_1
cgggctgcaggaattcgggacgaggggttcatagctattcgtggatatatagctggcattcgatctcttggttcatagctatcgtggatatatagctatatatatatctacctgagagatcgatctctagctagctcggcaaccatggcgaggcaacaacaagttgcttccatgctcgcagctgctctgctcgttgcaacgtttgcgtccattcctacaagcgtgcactccatcggcgtctgctacggcatgctgggcaacaacctgccgtccagcagcgacgtggtgcagctctacaagtccaagggcatcaagggcatgcgcatctactcgccctcccagtccgcgctcaacgccctccgcaactccggcctcgccgtcatcgtcgacaccggcaacggcaacgagctcagccagctcgcgaggagcgcctcgtacgcggcgtcgtgggtgcagagcaacgtgaagccctactaccccgccgtcaacatcaagtacatcgccgtcggcaacgaggtgcagggcggcgccacgcagagcatcctcccggcgatccggaacctggacgccgccctggcgcgcgccgggctctcggccatcaagtgctccacgtcggtgcgcttcgacgtgatcgccaactcctacccgccctccagcggctcgttcgcgcaggggtacatggcggacgtcgcgcggtacctcgccggcaccggcgcgccgctgctcgtcaacgtgtacccgtacttctcgtaccgggacaacccgcgggacatcagcctgggctacgccacgttccagccgggcaccaccgtcagggacaacggcaacgggctcacctacaccaacctgttcgacgccatggtggacgccgtcgtcgccgcgctggagaaggccggcgccggcggggtgaggatcgtcgtctccgagagcggctggccgtccgccggcgggtccggggcgagcgtggacaacgcgaggaagtacaaccaggggctcatcaaccacgtcgggcgcggcacgcccaagaggcgcggaacgctggagactttcatcttcgccatgttcaacgagaaccagaagaccggcgaccccacggagaagaacttcgggctgttctacggcaacaagcagcccgtgtacccgatcagcttcaactaagactgacagatcggaggaagaagagacaaaacatatagtacatcttgatcaatcaactagcctactaataattctccatgaataataagctgctgcgtgtgaagcggtgcaaataaaagtgtaaccgtgtgcacgtacgtactctctatctatctatatatatgatgaataaaaagagagaaaattctgatgcttcatct

SEQ ID NO: 15622 - DNA, 560 bp, Sorghum bicolor
  Clone ID: LIB5121-012-A1-PF1-E1
tcttgcttctagctagcttagcatatatatccacgagcaactcgatcgtggatatatagctatatatatatatatctacctgagtcctgagagatcgatctctagctagctcggcaaccatggcgaggcaacaacaagttgcttccatgctcgcagctgctctgctcgttgcaacgtttgcgtccattcctacaagcgtgcactccatcggcgtctgctacggcatgctgggcaacaacctgccgtccagcagcgacgtggtgcagctctacaagtccaagggcatcaagggcatgcgcatctactcaccctcccagtccgcgctcaacgccctccgcaactccggcctcgccgtcatcgtcgacaccggcaacggcaacgagctcagccagctcgcgaggagcgcctcgtacgcggcgtcgtgggtgcagagcaacgtgaagccctactaccccgccgtcaacatcaagtacatcgccgtcggcaacgaggtgcagggcggcgccacgcagagcatcctcccggcgatccgtaacctggacgccgccctgacgcgcgcc

SEQ ID NO: 15623 - DNA, 1875 bp, Sorghum bicolor
  Clone ID: SORBI-28MAY03-CLUS4020_1
gacacctcctcgcgcgcactccctccgctcgtctgacatctgctcccgtcctttcctttcggagcctcgcgaaccccgacgacgatggccgctgccgccgctgccgcggtgtcggtcgacgagaagctcgacaagcttcgcgccgaggtcgccaagctcgaccagatcagcgagaacgagaagtccgggttcctcagcctcgtgtcacgctacctcagtggggaggcggagcagatcgagtggagcaagatccagaccccgactgatgaggtggtggtgccgtacgataccctcgcgtcgcctcccgaagatctcgaggagacgaagaagctgctggacaagctcgttgtgctcaagcttaacggagggctcgggacgaccatgggctgcactgggcccaagtctgtcattgaagtccgcaatgggttcacattccttgatcttattgtgatccaaattgagtccctgaacaagaagtatggatgcagtgtccctttacttctgatgaactctttcaacacccatgatgacacacagaagattgttgagaagtattccaactccaacattgaaattcatactttcaatcagagccagtatcctcgcattgttaccgaggacttcttgccacttccaagcaaagggaactctgggaaggatggctggtatcctccaggccatggtgatgtgttcccctctctgaataacagcggaaaacttgacatcttattggctcagggcaaggagtatgtcttcgttgcaaactcagacaacttgggtgctatagtcgacatcaagatcctaaaccatctgatcaataaccagaacgagtattgcatggaggttactccaaagacgctggctgatgttaagggcggtacactcatctcttacgaaggaagagttcagcttttggagattgcccaagtacctgatgagcatgtcaatgaatttaaatcaatcgagaagtttaagatattcaacactaacaacttgtgggtgaaccttaaagctatcaagagactcgtagaggctgaggctcttaagatggaaattattccaaaccccaaggaagttgatggtgtaaaggtccttcaactcgaaactgcagctggtgcagctattcggttcttcgacaaagcgattggaattaatgttccccgctcaaggtttctcccagtgaaggctacatctgatttgttgcttgtgcagtctgatctttacaccttggttgatggctttgtcatccgcaacccagccagagcgaatccagctaacccttcgattgagcttggacctgagttcaagaaggttgccaatttccttgctcggttcaagtccatccccagcatcgtcgagcttgacaacttgaaggtttctggtgatgtctggtttggctctggaattacactcaagggcaaggtgacaatcactgccaagtctggagtgaagttggagattccagatggagctgtacttgagaacaaggatgtcaatggccctgaggatctttaagcgatgcttggcgtcaccagtttttcccaaggacatgtcacaggagctggcaaccctaatcacccccactgagctctatcttttgtaattttcttgtgcattccgcttccgttgtgagggttctgtgagcccgctagagaataattgtgatctttggtgcgtctgtacttctgtttttggtgcaccagggacgtatattttgctgaaatgatctttgctgtatggcgtcttaccgggagtccgggaggtccgtgcggtatgatgatgtcttatcgggaggtctcgtgtagatgcctaggtggtacatgcatggtgctcgagaatattgttagggaaaaaagcaaaaagtaaagggcaaaa

SEQ ID NO: 15624 - DNA, 469 bp, Sorghum bicolor
  Clone ID: LIB3476-030-P1-K1-H7
ctgtccgatgtggtcttgtatatggtcattccactccatactcgttgagttgtggcatctgtgttactgaatagtgcctgattcttgttcaaaaaaaagaaagaaaagtgcctgatgcatattgttggtgctatctctagggcaaggtgacaatcactgccaagtctggagtgaagttggagattccagatggagctgtacttgagaacaaggatgtcaatggccctgaggatctttaagcgatgcttggcgtcaccagtttttcccaaggacatgtcacaggagctggcaaccctaatcacccccactgagctctatcttttgtaattttcttgtgcattccgcttccgttgtgagggttctgtgagcccgctagagaataattgtgatctttggtgcgtctgtacttctgtttttggtgcaccaagcgacgtatattttgctgaaaaaaaaaaaaaaatattcctaa

SEQ ID NO: 15625 - DNA, 1507 bp, Sorghum bicolor
  Clone ID: SORBI-28MAY03-CLUS37056_1
ccggcagcaggcgccagcttgctgctcgaccgaccgcccccccacgcatggatagataccgaccgccatgtacagctagctggcttttcatcatgaactccagtatacgaacatcgaagctgccgcagagacctttctccttaagcaagtagcttcaccgagtgtgcaggttgccatggcggctcctaccttgatgcaatgcttggtcgccatttccctcctctcctgtgtcgcccacgcacagctctcgaccacgttctatgcatcctcctgccccaacctgcagagcatcgtgcggagggcgatgatccaggccctcagcaatgaccagaggatgggcgcctctctgctcaggctcttcttccacgactgctttgttcaaggttgcgacggctcgatccttctcgacgccggaggggagaagacggccggccccaacgccaattcggcgcgcggctttgaggtcatcgacaccatcaagaccaacgtggaggccgcgtgccccggcgtcgtgtcgtgcgccgacatccttgcccttgccgcgcgagacggaaccaatctgctcggcgggccgacctggaacgtgccgctgggccggcgggactcgacgacggcgagcgcgtcccttgccaacagcaacctcccgcagtcgacggcgagcctgggtacgctcatctcgctgttcagcaggcagggcctgtcggcgcgcgacatgacggcgctgtcgggcgcgcacaccatcgggcaggcccggtgcaccaccttccgcagccgcatctacggcgacaccaacatcaacgcctccttcgcggcggcgctccggcagcagacgtgcccgcagtccggcggcgacggcaacttggcgcccatggacgtgcagacgccgacgaggttcgacacggactactacaccaacctgctgtcgcaacggggcctgttccactcggaccaggagctcttcaacggcgggtcgcaggacgcgctggtgaggcagtacagcgccaacccctcgctcttcaacagcgacttcatggcggccatgattaagatgggcaacgttggggtgctaaccggcaccgccggacagatcaggcgcaactgccgagtcgtcaacagctagatgccgatatggatcggatatacttctagcttagctatagctagcttgctgatcgaccgaccgaccgcccatggatgggtcgaaaccgaccgacatgtacagctagctagcttttcatcatgaactacagtatacgaatatggctatagatagaaatcatcagtacggagtatatagtagaataagtggtgaacgaccacgcaaggagtgaccgaagcagtgtcacttacatggccaggttaccgaaacgattcacctgaccttttccattggatattttgaaaggcaactatatataaacaccatccatgcgtgtttactatggtcctgatgtcatgtttccaacttcgaagcagtgaaggcacactggggaagaaaatccctcat

SEQ ID NO: 15626 - DNA, 2001 bp, Sorghum bicolor
  Clone ID: SORBI-28MAY03-CLUS803_1
accccggccccccctgcggcagcccaccgcctgtgctcccctcccacctgtgtcgtcgcctcgcctatccgatctgccacctcctcgccgtctcgcacgttccttccccaactccgcagcgtagcctctccgcgccgcgatccagatccaggttgttcagcatgggtctggtgaaggaaggcgtcgacatggaggagggaaccctggagatcggcatggagtacaggactgtatctggtgtggccgggcctttggttatcttggataaagtaaagggcccaaagtaccaagaaattgtaaacatccgacttggagatggcaccactcgccgtggtcaagtcctggaagttgatggcgaaaaagctgttgtgcaggtctttgaaggaacttctggaatagacaacaaatacacaactgtgcagtttacaggcgaggttttgaaaactcctgtatcacttgatatgcttgggcgcattttcaatggttctggaaaacctattgacaatggccccccgatattgcctgaagcctacttggacatctctggaagttctattaaccccagtgagagaacctatccagaggagatgatccaaactgggatatccaccattgatgtcatgaactccattgctcgtgggcaaaagattcccctattttctgctgctgggctccctcacaatgaaattgctgctcaaatttgtcgtcaggctggccttgtgaagacattggagaaaggaaagcatgcagagggtggtgaagatgacaactttgctattgtgtttgctgctatgggagtgaacatggaaacagctcaattcttcaaacgtgattttgaagagaacggttccatggaacgggtcaccctttttctgaatctggctaatgatcccaccattgaacgtattatcacccctcgaattgctctaacaacagcggaatatttggcgtatgaatgtgggaagcatgtacttgtcatcttgacagatatgagctcttatgcagatgcacttcgtgaggtttctgcagcccgagaagaggtgccaggtaggcgtggttatcctggatatatgtatactgatttggcaacaatatatgagcgcgctgggcgtattgaaggaagaacaggctccattacccaaattcctattttaacaatgcctaatgatgatatcacccacccaactcctgaccttactggatacattactgagggacagatatacattgataggcagctccataacagacagatttatccacctattaatgtcttgccatctctctctcgattgatgaagagtgctattggagagggcatgacacgtcgtgaccactcggatgtgtctaatcagctttatgccaactatgcaattggaaaggatgttcaggccatgaaggcagtcgttggagaggaggcactctcgtctgaggatctgctttacttagagttccttgacaagtttgagaggaagtttgtgacacaaggagcatacgacacacggaacatcttccagtcacttgatcttgcatggacattgcttcgtatcttccctcgcgagcttctccaccgtatcccagcaaagaccttggaccagtactatagccgagatgcctcccactgaatcactgattgttgatcagtgttccaatattttggcaagggcagctttgaataattgaacagattggccttatggcccattttcctgtatttatctgtagtcaggtccaattcttttctgttggtgagcgcaagttatttgtagatgactctcggtcacggcaatatctgtaatattatgtcatgtatcgttaaatttcagttatttggtctgtttcacctgccagaactgttagcaagagcattccggaccaggatgctcgaacacaactggttgtatctacatttgtgaatggtgaataaaggaggggcaataaaccgcagcgaattatatgctgcctgacactgttgaaaaaattctctgttttgctgttttg

SEQ ID NO: 15627 - DNA, 890 bp, Sorghum bicolor
  Clone ID: SORBI-28MAY03-CLUS579_2
tgatgttgtttgctgtttagtaatgtcaaggcatagattgaatagtaatgcaaattcttgttttttttctacaggttggggcccctgcccgtgttggtctggttgctccagttgatgttgttgtgccccctggcaacactgggctggatccctcccagacctctttcttccaggtgcttaacatccccaccaagattaacaagggtactgtggaaattatcacccctgtggagctgatcaagaagggtgacaaggtgggctcatccgagtctgccctgcttgccaagctgggtatccgtcccttctcatacggtcttcaggtcaccaatgtctatgaggatgggtctgtgttcagtcctgaggtgcttgacctttctgaggaggacccgcgtgagcgtgggggatcggtctgtgttcagtcctgctctgcttgacttttcttctgaggacctgattgagctgtttgccactggtgtctccatggttgcctctctgtccctggcaatctcatacccgacccttgctgctgtgccccacatgctgacaagatcaaggagtacctaaaggacccgaacaagtttgctgttgctgcccctgtcgccggtgcggactctggtgctgcagctgctcccaaggaggaagagaaggctccagagcctgaagaggagtcggacgaggaaatgggcttcagcctgttcgacgactagagctgctattatcgtcaatctgctgcaagttttggcattttcttatgatggacaacagtactatttccagttatcttagcgcattgtgttttattagtagacaaaactgtgttggtgtccacctatagtgtgtaatcgacaatggtatctccttaatgtcatgtacctgttgttgtgttaaaa

SEQ ID NO: 15628 - DNA, 1787 bp, Sorghum bicolor
  Clone ID: SORBI-28MAY03-CLUS579_1
catgacgcgccccgtcgcccattttccccccggctcgcgcccgcacggggtcccgcagcgcccccggcgtcctcgccctcgccgccccgcctccccgtccgcgcgctcgcgcccctgccgctcccctgctccgtgcgcgccctccggggcctgggggcggcccccccgggggtggcgccgcctccctgttcggccacttgacctccgcttgccgtcgcgcccctgcctggtgtcccctttgcttatcacgcgcacaccactgcggccgggccccttagccccctctcgctctcttctcgccgcctcgctccgcgcccctgctctccccctctcgtcccgttcctcgcgccgtcgtagcggcgcctcccgcccggcggcgcgccccctacgcgcaaaaaaatcatagaagagcaggacggaggttaaagcgacgccgccgccgcaagccgtccgccttgcccttcacgaaggcttggtcctccttgtaccaccaccacctcccccgccacagatctgtttccctctagttagggttagcgttcctctgcagcggcgatggcgatcaagcggaccaaggcggagaagaagatcgcgtacgacaagaagctctgcagcctgctcgatgagtacaccaaggtgctcatcgccctcgccgacaacgtcggctccaagcagctccaggacatccgccggggcctcaggggcgactcggtggtgctcatgggcaagaacacgctcatcaggcgctgcatcaaggcctacgccgagaagaccggcaaccacacctttgacccgctcatggacctcctcgtcggcaacgtcggcctcatcttcaccaagggagacctcaaggaagtgcgtgaggaggtcgccaagtacaaggttggggcccctgcccgtgttggtctggttgctccagttgatgttgttgtgccccctggcaacactgggctggatccctcccagacctctttcttccaggtgcttaacatccccaccaagattaacaagggtactgtggaaattatcacccctgtggagctgatcaagaagggtgacaaggtgggctcatccgagtctgccctgcttgccaagctgggtatccgtcccttctcatacggtcttcaggtcaccaatgtctatgaggatgggtctgtgttcagtcctgaggtgcttgacctttctgaggaggacctgattgagaagtttgccactggtgtctccatggttgcctctctgtccctggcaatctcatacccgacccttgctgctgtgccccacatgttcatcaatgggtacaagaatgttcttgctgttgctgtggagacggactactcgtacccacatgctgacaagatcaaggagtacctaaaggacccgagcaagtttgctgttgctgcccctgtcgccggtgcggactctggtgctgcagctgctcccaaggaggaagagaaggctccagagcctgaagaggagtcggacgaggaaatgggcttcagcctgttcgacgactagagctgctattatcgtcaatctgctgcaagttttggcattttcttatgatggacaacagtactatttccagttatcttagcgcattgtgttttattagtagacaaaactgtgttggtgtccacctatagtgtgtaatcgacaatggtatctccttaatgtcatgtacctgttgttgtgttatttgctcgtctcggttttgagttatttttgtgggtatttgcatgttcttagatttgcttgttgctgtttacctatcgtactagaattagttt

SEQ ID NO: 15629 - DNA, 381 bp, Sorghum bicolor
  Clone ID: LIB5047-010-R1-XP1-C2
gccggccgggcccgggaaactcgtacccacatgctgacaagatcaaggagtacctcaaggacccgagcaagtttgcagttgctgccccggttgccggtgcggactctggtgctgcagctgctcccaaggaggaagagaaggctccggagcctgaagaggagtcggacgaggaaatgggcttcagcctgttcgacgactagagctgctattatcgtcaatctgctgcaagttttggcatttgattatgaaggacacagtactatttccagttatcttagcgcattgtgtttcattagtagacaagtgtctaatcgacaatggtatctccttaatgtcatgtacctgttgttgtgctaaaaaaaaaaaaaaaaaaggccccta

SEQ ID NO: 15630 - DNA, 2307 bp, Sorghum bicolor
  Clone ID: SORBI-28MAY03-CLUS9654_1
gcacgaggccacaacccggtcgggtgccccgggcccccggcggccgggcacgcgcgcctgctggatgggttgaactatgcgtgtgccaacggcgcggactgcagcaccatccagccgggcgcgccgtgcttcgagcccaacaccatggtcgcgcacgcctcacacgcgttcaacagctactaccagcgcaaccgtcgggcaagcgggacgtgcgacttcgccggcgccgcctccgtcgtctaccgggcaccaaagtacggaaactgcgtgctcccatcaaaggcttcgagcacgaagaaggcttccacctcccaacccttggcagctgcatgcagcatatcatggcgttcactcgcctcctcgttgtcctcctcggcgctgcatttccgctgctcttattattctcccctgcagtggcgagtgaattgggcgtgagctacgggagggtggcgaacgacctgccggacccgtcgtcggtggtgaagctgctcggagacaacggcatcaccatggtgaggatctacgacgccaactccaacgtgcttagttcgctggccaacacgggcatcaaggtgatggtgatgctgcccaacgagaacctggcggacgccgcctccagctcagacaaagcgctccagtgggtgcagaacaacgtggccgcatactacccggccaccaacatccatggcgtggcggtgggcaacgaggtgttcaacagcaagcccgaccagaacttgaacctcgtcccggccatgaccaacatccagaaggcgctggcgcagctgaacctggccgacgccataaaggtgaccacgcccatcgcgttcaacgcggtggccgtgtcctggccgccgtcgtcgggcgcgttcggcgacgacatcgcgcagctggtgatgaagcccatgctccagttcctgcagcagacgggctcctacctctccgtcaattactacccttacttgacttacatggcccagccagacactttcaacctcgactacgtcctggggaacaaccccaaccccggcgcggtagaccccgacacccagttcaagtacaacagcctcctggacgcccagcgcgacgccacgtactacgccatggacaagctgggggcatcgtactccaatatggccgtgcaccacacggagcacggcgcgccttcagggggcagcctcagaggcggcggcggcggccacaggaggcttttacaggccggaggagtggccaccatagctaacgctcagacctacatcaacaacctcatgaaccgcgtgctgtccggaaacaccggcacgccgcaccgcccgaacgccgacatgaacgtgtacatcttcgcgctgttcaacgaggaccagaagggcaccggcgctggtgacgtcgaacagcacttcggcctcttctaccccaacatgcagaaggtgtacgagttcgacttccgcggcggcggcgttccgccggcgccgggggcggagagctggtgcgtggcaaacgcgtcggtcggggaatcgtggctgcaggcggcactcgagtacgcgtgcggccacggcgccgactgcagcgccatccagcccggcgcggcgtgcttcgagccggacaccgtggtcgcccacgcctcgtacgcgttcaacagctactaccagcggaacggccggagcaacgggacgtgcgacttcaacggcgccggttacatcgtctaccaagaaccagctggcacctgcgacccgaacgcgagctggtgcgtggcgaacgcggaggtcggggacgcgcggcttcagaatgccctggactacgcatgcggcaacggcgcggactgcagcgccatccagcccggcgggcagtgcttccaacccgacaccaagccctcgcacgcctcgtacgcgttcaacagctactaccagcacaagggacgggctagcggaacttgcgacttctctggtgccgcctccgttgtataccagcaacccaaagtcggaaactgtgtgctcccatcgagtggttgatgatcaacggaagaagcagcaacgatacaaaaagcgaggtcctgaagacgatgatcgatatgctactatacctaataggtatacagggatatgaggataattttattctgtattaagacgaagaagtatagataataaagcccggaaaccggcaaatcgaccgagcgcgggtcctccttactcttaaaaccctctgaaagagcagtgtaagacatcatgtcaacgttgaacgtcactgctaataataatgctgtacaaccgttcaatcatcagttgctttcttattattttcctgtggattgta

SEQ ID NO: 15631 - DNA, 2043 bp, Sorghum bicolor
  unsure (1)..(2043): unsure at all n locations
  Clone ID: SORBI-28MAY03-CLUS103_1
cccacgcgtccggccgcccttttttttttttttttttatcaacttatcgtccgccttgaataatcgagagcaaaatggaagctacagagtaataacactgattgttttcgcccacttcgctaaacattgaacgcatcatttaactgtccccatgaaaaataaacaacagacaaactgaacagctaactacatgacctttgaaagtcgtttattgatgttgctcaagcctatcatcatctatattacatgaataaaggaacaaaggggtacgggacgagggcagagtctgaatccatgtgtcatcatgcagacaccttagacgctagaactgaactttgcctgaattgaccgggaccccagcgtgcaggccgggccgggacacaaactcagcctgcctgcctcactgactgtcaagctgcaacccacagcgatcgagctagtgagagtgagagacgagagttagagagcgagatggcagccacggcttcgttcccggtggtgaacatggagaagctggagaccgaggagaaggccacggccatggagatcatccgcgacgcctgcgagaactggggcttcttcgagctgctgaaccatggcatctctcacgagctgatggacgaggtggagcggctgaccaaggcgcactacgccaacttccgggaggccaagttccaggagttcgcggcgcggacgctggaggctggcgacaagggtgccgacgtcaaggacgtggactgggagagcaccttcttcgtccgccacctcccggcctccaacctcgccgacctccccgacgtcgacgaccactacaggcaagtgatgaagcaattcgcatcggagatccagaagctgtcggagaagctgctggacctgctgtgcgagaacctgggcctggagcccggctacctcaagtccgccttcgctggctccaacggccccacgttcggcaccaaggtgagcgcgtacccgccgtgcccgcgcccggacctcgtcgacggcctccgcgcgcacaccgacgccggcggcatcatcctgctgttccaggacgaccaggtcagcggcctgcagctgctcaaggacggcgagtgggtggacgtgccgcccatgcgccacgccatcgtcgtcaacatcggcgaccagctggaggtgatcaccaacggccgctacaagagcgtcatgcaccgcgtgctcacccgccccgacggcaaccgcatgtccatcgcctccttctacaacccgggcgccgacgccgtcatcttcccggcaccagcgctcgtcggcgccgccggcgccgaggaggagcgcgccggccaggccacgtacccgaggttcgtgttcgaggactacatgaacctgtacgtgcgccacaagttcgaggccaaggagccacggttcgaggccatgaagtcggccatcgccaccgcgtgatgaacaaacacactgctgccttcaattctgctccttgtcccttcgtgtcctgcattatgctttgagcttgaagccttgatgaggctgcaatgaacagtgtccatgtgcttatatgtagtttggcacggtggttatgcgtgtatcgtggaacggcgtaatgtattttggttgtctcggatctatatgtatgtacgtatatattgagtactgtatgtaaagtgtgtgtagcatctgatccaatgtatgagcagtgtgtacgtgaccaggacctgatgtgctgctattactaccacctcaagtggagggaacatgaattattagtagttctcaaaaaaaaaaaaaaaaaagtggccaacttcgcgagtggcggggtggggagcgacgagacggcggagacgagacggcggagaggcgggccgcgggcggacggctccaagggggagaggctgatgaagganatcgaaagcaacagaccatagtcttctgggtctacgttccagtgatcatntgattcgtcccagtgcattagttcgttgaatcactcttgctcctcagatctttggggctaccagttgcaatgcgatagaagtaaaagcctgctaccaccggacg

SEQ ID NO: 15632 - DNA, 453 bp, Sorghum bicolor
  unsure (1)..(453): unsure at all n locations
  Clone ID: LIB3476-019-P1-K1-F5
tgatggacgaggtcgagaagctgaccgaggaccactacaagcgggtgcgcgagcagaggttcctcgacttcgccagcaagacgctcgcggacgccaaggcggcggagaacctggactgggagagcaccttcttcgtccgccacctcccggactccaacctcgccgagataccggacctcgacgacggctaccggcgcgtgatgaagcggttcgccagcgagctggaggcgctggcggagcggctgctggacctcctctgcgagaacctcggcctcgaggggggctacctcgcgcgggcgtttccggggcgcagcacgggcgcnntcgcgttcggcaccaagtgagcagctacncgcgtgcccgcgcccggacctcgtgagcggcctcgcgacacaccgagccggcggattattctgctgtcaggcgaccgcgtagggggctcagctgtaaggc

SEQ ID NO: 15633 - DNA, 824 bp, Sorghum bicolor
  Clone ID: SORBI-28MAY03-CLUS929_2
cccacgcgtccgaagagcacatatgagtccatcaccaaaggaaatcctatgtggaatgagctctcagtctcaacaagcactctctacccctgggatccaacatctacatacatccatgagcctccttacttcaaggatatgacaatgactcctcctggcccgcggccagtgaaggatgcatattgccttctgaactttggagacagtatcacaactgatcacatctcacctgccggaaacattcacccagacagcccagctgcaaaatatctgaaggagcgtggtgttgaaaggaaggacttcaactcatatggtagccgaagaggaaatgatgagatcatggctaggggaacctttgccaacattcgtcttgtgaataagttcttgaagggtgaggttggacccaagacaatccatgttccatctggggagaagcttgcagtttttgatgctgctatgaaatacaagaatgaagggcatgacactattatcctggctggtgccgagtacgggagtggaagctctcgggattgggctgcaaagggcccaatgctgcagggagtgaaggctgtgatagcgaagagctttgagaggattcaccgcagcaatcttgctggcatgggaatcatccctctatgcttcaaagcaggggaggatgcagacaccctgggcctaaccggccatgagcgctacacagtccaccttccaaccaacgtgagtgagataaagcctggccaagatgttactgtgacaactgataatgggaagtcattcacttgcacactcaaattcgacactgagggggagcttgcttactaccacca

SEQ ID NO: 15634 - DNA, 3153 bp, Sorghum bicolor
  Clone ID: SORBI-28MAY03-CLUS929_1
cctcgaggctggagtcctcccggtccggaaacccctcaagcctccaaccctagccgccgcctcctccaagcttcggagttcaggaaccatggcgacggacacggagaccttcgcctttcaggccgagatcaaccagctgctctccctcatcatcaacaccttctactccaacaaggagattttcctccgcgagctcatctcaaactcatctgatgcgttggacaagatcaggttcgagagtctcacggacaagagcaagctggatgcgcagccagagctattcatccaccttgtccctgacaaggcctccaacactctctccatcatcgacagcggcatcggcatgaccaagtccgacctcgtcaacaacctggggaccatcgccaggtccgggaccaaggaattcatggaggccctcgctgctggtgctgatgtgtccatgattggacagttcggtgtcggtttctactccgcctacctcgtcgctgagagggtcgtcgtgaccaccaagcacaacgacgacgagcagtacgtttgggagtctcaggccggtggatcgttcactgtgactcgtgatacatctggagagcagcttggcaggggtactaagatcaccctcttccttaaggacgatcagttggaattcgctggtgccgagtgccggagtggtagctctcgggagtgggctgcgaagggcccaatgctgcacggcgtgaaggctgtgatagcgaagagctttgagaggagtctcgatccgaaaacccctccaaccctagccgcctcctgcaagctccagagctcaggaatcagggcgccatggcgacggacacggagaccttcgcttttcaggctgagatcaaccagctgctctccctcatcatcaacaccttctactccaacaaggagatcttcctccgcgagctcatctccaactcatccgatgcgttggacaagatcaggttcgagagcctcactgacaagagcaagctcgatgcgcagccggagctgttcatccacattgtcccagacaaggcctcgaacacgctctccatcatcgacagtggcatcggcatgaccaagtccgacctcgtcaacaacctcggtaccatcgccaggtccgggaccaaggagttcatggaagcccttgctgccggcgctgatgtgtccatgattggccagttcggtgtcggtttctactctgcctacctcgtcgccgagagagtcgtcgtgaccaccaagcataacgatgacgagcagtacgtctgggaatcccaggccggtgggtcgttcactgttacgcgtgacacatccggggagcagcttggcaggggtactaagatcacactgttcctcaaggacgatcagctggaataccttgaggagcgtcgcctcaaggatctggtcaagaagcactctgagttcatcagttaccccatctccctgtggactgagaaaacaactgagaaggaaatttctgatgatgaagatgaggaagagaagaaagatgctgaggagggcaaggttgaggatgttgacgaggagaaggaagagaaggaaaaaaagaaaaagaagatcaaggaggtttctcatgagtggtcgttgatcaacaagcagaagcccatttggatgaggaagccagaagagatcacgaaggaagaatatgctgccttctacaagagcttgacaaatgactgggaggagcatctggctgtgaagcacttctctgtggagggtcagctggagttcaaggctgttctctttgttcctaagagggccccctttgatctctttgacaccaagaagaagcaaaacaacatcaggctacatggagacagggtgttcatcatggacaactgcggggagctgattggctggctacatgtcgagcaaaaagactatggagatcaacccagagaacccaatcatggatgagctccgcaagcgtgcagaggctgacaagaatgacaagtcagtcaaggatctcgtgatgctgctgttcgagacttctcttctgacctccggcttcagcctggaagaccccaacaccttcggcaccagaatccaccgcatgctcaagctcggcctgagcatcgacgaggatgagtcggctgaggctgacgctgagatgcccccgctggaggacgacgccggcgagagcaagatggaggaggtcgactaagcctgccggctgccattctatccgtcctctgttggacgcttttggcccgtatcgattttgtgttgccagctacgggaatgtggatcagctttttatccgtgttagtatcagagtgtggtatcttttgaacagtttttcggtgctcgtaatgcaattacaatatcttttggttggttaactaatataattgagggtctgaagcttgacgagaccgaggacgagaagaagaggaaggaggagctgaaggaaaagtttgaggggttgtgcaaagtcatcaaggaggttctgggtgacaaggttgagaaggtggtggtgtctgaccgtgttgtggactcaccgtgctgtcttgtcactggtgagtatggctggactgccaacatggagaggatcatgaaggcgcaggctctgagggactcgagcatggcgggctacatgtcgagcaaaaagactatggagatcaacccagagaaccctatcatggatgagctccgcaagcgcgctgaggccgacaagaatgacaagtcggtcaaggatctcgtgatgctgctgttcgagacttctctcctgacctctggcttcagcctggatgaccccaacaccttcgggacccggatccaccgcatgctcaagctcggtctaagcatcgatgaggacgagtctgctgaggctgaagctgagatgcctccactggaggacgacgccggtgaaagcaagatggaggaggtcgactaagcccggatgcttgtcgtttatccctagttacttgtgataatcttgagcctgacctgtgataatctttcgaggattttggcatgttatcggttgtcctgctggccaggctatggtttaggcgtttagctgttatggtactctggtttaacagtttgtcgttatccgtaatgctactagtatagtacatgttcaacgtgccgccctgtcttgccgtttttttactatgtttttttcgcgcgtcc

SEQ ID NO: 15635 - DNA, 436 bp, Sorghum bicolor
  Clone ID: LIB3476-056-P1-K1-H7
aagagcggtgatgagctgaccagcctcaaggactacgtgaccaggatgaaggagggacaaaacgacatctactatatcactggtgagagcaagaaagcagtggagaactcccccttcctggagaagctgaagaagaggggctacgaggtcctgtacatggttgatgccattgacgagtatgctgttggtcagctcaaggagtttgagggcaagaaacttgtctctgccaccaaggagggtctgaagcttgatgagaccgaggacgagaagaagaggaaggaagagctgaaggagaagtttgatgggctttgcaaggtaattaaggaggttctgggcgacaaggttgagaaggtggtgtgtctgaccgtgttgtggactcaccatgctgccttgtcaccggtgagtatggctggactgccaacatggagagaatcat

SEQ ID NO: 15636 - DNA, 1528 bp, Sorghum bicolor
  Clone ID: SORBI-28MAY03-CLUS2666_1
ctcgggcgctccgttgtcgtcagcgcctgccgttgggtggtgggttaggtcccgcgccgtccggcgccctcgtgcacaaggcccactctggggttggcaccgtcaacgctcgggtggaggcggtgggtgcaccggctcgtatgcagtataattatcctgtcacgccgggcgttgcggcgagcttatcgcttatcatccgcggcttgtgcatctcctccgcctccgcttgacccatccaagtcagggatcgccatgtcggactcggaggagcaccacttcgaatcgaaggccgacgctggtgcgtccaagacttacccgcagcaggctggcaccgtccgcaagaacggcttcctcgtcatcaagggccgtccctgcaaggttgtggaggtttctacctcaaagactggtaagcacggccacgccaaatgccactttgttgccatagacatattcaacgggaaaaagcttgaagatattgttccttcttcacacaactgtgacattccgcatgtgaaccgtactgagtatcagctgattgacatatcagaggatggatttgtgagccttcttacttcagatggcaacactaaggatgatcttagactcccaactgatgagactcttgtggcccagattaaggaaggttttgaaagtgggaaggatcttgttgtgactgtccagtctgctatgggggaggagcagatctgcgccctgaaggatattggccccaagtaacttccctgccttggaagacggaactactgtatctcaaaacttaaatggaaaaagaagtgtatcaccaaaggattgctactgagacgttcacctggcttgagctggcttttgctatagcaaacacaagtgcagggattgctgggtgtcgcaccgtatctgactttcattatctgtggttacattctggaccctgtattttctatgattttatgccacctactttttagtattaagtatcaataaattggtttggaacggttgaattgcatccaattcatgaggtttcttgttgtttgtcctgttattgtcgtataagctctagaacttccgagacatctgtattagaggcgtagtagctggttgaatgcgatggttttggatgaaactcgaatctgttcccgtgcaattataatgcatgtgtgatgagatcctaaaaatctgtaactcccctttaagtacccttttccttttttccatgcaacaaagacaggtgtcgtaacaagcagaaggaactgatactctctctgcggtgcctatttattagacaatgatgtattcagaccattttggtacgaggcttgtaagctgtgtttgtcctgttattgtcgtataagctctagaacttccgagacatctgtattagaggcgtagtagctggttgaatgcgatggttttggatgaaactcgaatctgttcccgtgcaattataatgcatgtgtgatgagatcctaaaaaaaaaaaaaaaaaaaaaaaaaaaaaaaaaaaagaaaaaaaaaaaaaaaaaaggccccta

SEQ ID NO: 15637 - DNA, 392 bp, Sorghum bicolor
  Clone ID: LIB3481-031-P1-K1-H6
cgtccgcccacgcgtccgcccacgcgtccgcccacgcgtccgcccacgcgtccggtgcatctcctgcgcctgcgcttgacccatccaagtcagggatcgccatgtcggactcggaggagcaccacttcgaatcgaaggccgacgctggtgcgtccaagacttacccgcagcaggctggcaccgtccgcaagaacggcttcctcgtcatcaagggccgtccctgcaaggttgtggaggtttctacctcaaagactgggaagcacggccacggccaaatgccactttgtgccatagacatattcaacggggaaaaggcttgagatattggtcctttttcacacaactgggacattccgcatgtgaaccggactgagtatcaactgattgacata

SEQ ID NO: 15638 - DNA, 876 bp, Sorghum bicolor
  Clone ID: SORBI-28MAY03-CLUS121_5
gccggccgggccgggaccgctccgcctggactcgtctcgcccgcggccgatcgccgcgcgcgccgcaacccggaggccggaggagactgcgctcagtcgagcactacctggggcggccagcatcctcgcgaccatctccggcacggcgtccgccctctgcagcctccggtgtccctgcgaccgtcgctgctgtcctacttcgccaccggccactttgcccggcgacgagcaccaccacaacactaggcctccagcaaaggtcccaatctcgagaacggaggatggagaactgtaacaacggaccggcggctgccgacaatttcaaggtggtggtgccggagcatccactgatcagccactgggtctcagtgctccgcgatcgcttcaccccttcccatgccttcaggagtgcgatgggagagttagggagattgctaatctatgaggcaactcgggattggctgccgacagtaacacgggagatccagacaccagtgggaactgcggttgttgaatctgtcagtgagatggagccaatcatgattgtacctattcttagagcagggcttgctcttgcagatcttgcaacatcaattttgccatcaactaaaactttccatttaggtatgtccaatgagacaacgctgctgccctctgtttacttaaataagctacctgatagattcccaaaaggatgtcatatgcacaccttctggatcctatgctagcaacaatgtctgaaccttcactgcagcagttgatctgtcaagagcgcagagattcaagcagctgagcaagattcatctcaacgtgttgctgctacgccctgcatcagaagctcatctctgtgttcacagtccgcttcttctacgtgct

SEQ ID NO: 15639 - DNA, 862 bp, Sorghum bicolor
  unsure (1)..(862): unsure at all n locations
  Clone ID: SORBI-28MAY03-CLUS121_3
gccggccggttcgggaccgcctggagtcgtctcgcccgcggcggacctattctcctcatccgctcgccgcgccgcaacccggaggccggaggagacttgcgctcagtcgagcaccacctggggctggggcccagcatcctcgcgaccatctccggcacgacgtccgccctctgcagccccggtgtccctgcgaccgtcgctgctgtcctacttcgccactggccagtttgccccggcgactagcaccaccagaacgaacactaggttttatcttttggcaatgatgatttggtgtattttcgtgggctaaagttgactcgtacctccagtaaacttttcatcatggatgaactggatgaacgggagttagtttttgcatgggaagataaagacaccatcattgatcagcttagaaggatcgacatatctgacagggatgaccaaggaccatctcaggaaggaggctcattaacgaggtctccagatgcagcaattggtattcttatgcgcatcctacagaatgcccctggcctcagggaaaggctactactgccaggccctagtgccccggttcctcaagaaccttcactccagagggtagtgaccgaggaacatggcagcagtgcatcaagctctacaggggtgccttccgttcttctgaggtcaaggacagcggcggatgcgctggaggagctgaacaagtacaaagagattagagaatcgatactgaaccgcagncaagggcattcctgcagcaccaagctgctggaggagaaacccgcggatggagatccatagcatacagtatgatgacgaaagcgcgctgtgtatatataagtagtagaaggtagatgactatcct

SEQ ID NO: 15640 - DNA, 520 bp, Sorghum bicolor
  Clone ID: SORBI-28MAY03-CLUS121_2
ccgcgaccgatctcctccatccgctcgccgcgccgcaacccggagaggagactgcgctcgatcgagcaccacctggggcccagcatcctcacgaccatctccggcacggcgtccgccctctgcagctccggtgtccctgcgaccgtcgctgctgtcctacttcgccactggccactttgcccggcgacgaacaccaccaggacactagggagtaaaactaaaatatggctgccttgccattggccaccgctgaagtatgtgatgctaatcctcatctgattatgaacggcgagctccgtgctctccagcccatcttccaaatctatggaaggcgccaagttttcgccggccctattgtcacactgaaggtctacgaggacaatgttctgatccgcgagttccttgaggagaaaggccacgggagagtccttgtggttgacggtggtgggagcatgcgctgtgccattcttggtggcaaccccgttcagcaagcacagaacaatgggtgggctgggtatct

SEQ ID NO: 15641 - DNA, 1798 bp, Sorghum bicolor
  Clone ID: SORBI-28MAY03-CLUS121_1
gcacgaggctccccctccgctcgccgcccccccccccgccccccgccgtcgcccctccccccccccgcccccccccccccccccccccgccccccgccgcccgcgggccagcccgcggccccccgcgccccgccgcgccgcgccccgccgccgcgccgcgtccgcccgcgccgccccccgcccccccgcccccggcgcccccgtcctccgctccgccgcccccctccgccaggcgcccagccccccggctaccaccgccacggtgaccccagttttacctgtcagatgggaaggtcggggcgcgacactcgcctgtcgcagctggtccgcggcgaaagcggagatcaccacaaggacactgtgatcttgagccagcagtccatcatccgggaactaactaggcactactcggtcctgatagaatgcgatatggaagagaagtaatttttcgaacgggagcgttaatcaaatggcaaagctatgggaaaatacgcatgtataggggtcatggacgaagtcgaggctataattttcgtggaaacacacttattatttctaggtacagtgggggaacaggtatggataatcatgttgactaatgggacaacagagggttccatggggctaactggacatatggatgctcttggcgcagtggctttgagttcaaatgagaagtggttggcttacggacttttgcatgggaaaataaatggtaggaagactgacaagggaactgtgatgtgctcccttgcgggttctgtgttggattttgagtctgttaagtggcatccttggggtcatttgataatcgtgtgattagaagtatgtattgtatggatgtgaaatggagtccttgtggccattctatatacctttgaaagacacagtaaccaagtaacatttggtgatatttcaccaaatcttaaactgatatatacagaattggcgaatgcatctttaatgatacgggaaccatgaagttcacataggtgacagggtgtttgaacccattgctgtcatcctgatcgattgtcaagcttataaatacactcggcttcacaattgtttgtgagcgcctcctagttcattcttgtgcacattatgactgtaaagtcaggactgatcgttggcttattactaggccacaccaattccattgagtgcgttggtatctcgtcaagctatggctgggtagctacagggagcatggatcaaaagctgatcatctgggacctcacacgccaatccagccgatgcatttgtgaacatgatgagggcgtgacatcactggcatggctaggttcgtcaaggtacgttgcgtcaggatgcattgacggcaaggtgcgcatctgggacagcctctctggggactgcgccagggagttcagtgggcatgcagatgtagtgcagtcactggctatcactgccgacggcaacaccatggtctccgcctcatcagatggctccgcccgtgtgtttgacatctccatgttcaagtgaaggaaacaattgggacggagtatgtagatggttgctgtgtatgctatggcttgtttgtgctgcatgaatgatgatggcatgtcatcatggtaaaatgcgattgtactcatggcctcaaggtgtcaaatgcttgtagaagtggtcattaaattcatatccgtctgctgatgctcaggttgtgtggcgtactgtgggacagatgatactgctgtgtacttgcaggtgaactttctagttgatactcctatataccatgaacatcatttcttcttgttctgagttgcagtgctgtaaa

SEQ ID NO: 15642 - DNA, 409 bp, Sorghum bicolor
  Clone ID: LIB3476-017-P1-K1-E10
cctaccgtcgccgccgcctgccagatcctactcctgcggatcctccaccccacgtccccactgcactccatttccgccgctcccctcccctcccttctccgatccgtttgtgcttattttggagtgatactataaaatatggctgccttgccattggccaccgctgaagtatgcgatgctaatcctcatctgattatgaacggcgagctccgtgctctccagcccatcttccaaatctacggaaggcgccaggtttttgccggccctattgtcacactgaaggtctacgaggacaatgtcctgatccgcgagttccttgaggagaaaggccacgggagggtccttgtggttgaccgtggtgggagcatgcgctgtgccattcttggtggcaaccccgtccagcaagcac

SEQ ID NO: 15643 - DNA, 214 bp, Sorghum bicolor
  Clone ID: LIB3478-024-P1-K1-B6
cccacgcgtccgcttgatgacattagtaatgaaatggctaggatatattcagccttcctatttaccattaccagaactagtggaaggtgccttttttgcgaacctgtcgattgttgggatgaatgtaagtttgatgtggaactccgctggattctatcagattgcaaagttgtgtatcattccagtcttgtgcattctggaaatcatattctac

SEQ ID NO: 15644 - DNA, 598 bp, Sorghum bicolor
  unsure (1)..(598): unsure at all n locations
  Clone ID: SORBI-28MAY03-CLUS1324_9
cctgccgactctgtancgaccctcaccgtcctcccctccgtcccgccgtcgccgaggaatgtaggagntcggaaagggtggtatgggctgggaaaggggggagggaaatgttatcggaagggnctccgcgacaatctagggcatgaactcggcgatccggaggctggagaggaggggcggcgtgaagcgcatctcggggctcatctacgaggagacccgcggcgtgctcaagatcttcctcgagaacgtcatccgcgacgccgtcacctacacggagcacgcccgccggaagaccgtcaccgccatggacgtcgtatacgcgctcaagcgccagggccgcaccctctacggcttcggcggctaggctgctgatggctttggctcccccttctgcagctgcgacgttgtctggccgtgcccacaagtcttgcggtcaagaaagtttcaggaactcttggtagttcatctctggctgtagtaggtttatctgaattgtaagactgtagcaggcatgaagcagtaatgaaattatgtgcatctaatgttggaaaaaaaaaaaaaaaaaaaaaaaaaaaaagggcggccctcgcgatctaga

SEQ ID NO: 15645 - DNA, 620 bp, Sorghum bicolor
  Clone ID: SORBI-28MAY03-CLUS1324_8
tgccggcctcggccgggccgggcggaaatccccaatcttcctcgccccaaatccactcaaacctccgctcctccgagcagctcccccgttcgtcgtcatgtcgggccgcggcaagggaggcaagggcctgggcaagggcggcgccaagcgccaccggaaggtgctgcgcgacaacatccagggcatcacgaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggattcggcggctgagcgtggctccgtcctcgtccctccgcccacgtggggatagctagggttcctgatggattagctgagtttgtgacttttgtgttgtctgcactgtgtttaacttgttaggtgtttatggttgtatggagattggaaccttaccaattgaagcaatggatgtcttatttatctgtgttctcgaaaaaaaaaaaaaaaaaaggccccctagggc

SEQ ID NO: 15646 - DNA, 712 bp, Sorghum bicolor
  unsure (1)..(712): unsure at all n locations
  Clone ID: SORBI-28MAY03-CLUS1324_7
gcgccggccgggctcgggaactcatctcttcccacccaccaaatccccaattccaaacctcacctcccagttcgagcgaccatgtcggggcgcggcaagggcggcaaggggctgggcaagggcggcgcgaagcgtcaccggaaggtcctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtcacctacacggagcacgcccgccggaagaccgtcaccgccatggacgtcgtatacgcgctcaagcgccagggccgcaccctctacggattcggcggctgagaggtgcccccgccgctggtggccgtggcaaaagtcttggggtcgcggtcaagaaatcgagggaggcgagagtattctggcccatgtgcttagtttcgtagtcttatcggtagtgcttattgttacaggttgttgggttcgatcactctagagccactgtaccgcatttccccgtgttctgaacttccgatatatgaaatgtggattcacttgatatctaaaaaagaaacaaattaagtcgtctttaatttttgtacaaagtttctggatcttggcagttcgtgttgctccctanaaaaaaaaaaaaaaaaggccccta

SEQ ID NO: 15647 - DNA, 809 bp, Sorghum bicolor
  Clone ID: SORBI-28MAY03-CLUS1324_6
gcattgcttatgtattgtagaaatcatacatgatcttccatgaaaaaaaaaaaaaaaaaggtgcgggctcgccggccggggccggcgacaagtcttcatctccaaaatccacctccacaatctcctctcgacttcgagctcctcgctctcagccatgtcgggccgcggcaagggaggcaagggtctgggcaagggcggcgcgaagcgccaccgcaaggtgctccgcgacaacatccagggcatcacgaagccggcgatccggaggctggcgcgcaggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggtttcggcggctaagctcggtccgcccccaatctccgctccggcggcatctctggttcctggtcgccgtgcgcgtcggtggtgctatgtttagcagctgttagggtttcgtgtcgtctggtgtctgtgctatctggctgtcttgtgcaaagttatctgtcctgttttgtgtgtattggaacaatgctagatgaatgaaatggatctgtgttttagttaaaaaaaaaaaaaaaaaaagcccctactaggcactgaaaaaggccccttgtggacatgttcagacctgtaccatggctccgatttttttcatcgccgctcgcggaattttgcgccctttgaatatggggccctgttagcc

SEQ ID NO: 15648 - DNA, 660 bp, Sorghum bicolor
  Clone ID: SORBI-28MAY03-CLUS1324_5
gccggccgggttccggaatccatcggttcccaagctcccccgcacaccagaaaaaaaaattccccaattgtttgtctctgtcagtgaagaggtcgcggcggcggcggcgatgtcggggcgcggcaagggcggcaaggggctgggcaagggcggcgcgaagcgccaccggaaggtgctccgcgacaacatccagggcatcaccaagccggcgatccggaggctggcgcggaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgccagggccgcaccctctacggcttcgggggctaggatgggctgggcgccctctcctcctttgagtctgtttaccggtccgaaacgactgaaatgttagctgatttatcgcgagagaaaatactattggttgacataaaaaatacggctgaaaagaaaagcaaacggcctcaagttgaagtgaactgtgttacgttccatctagatttctatatttataatctgtttaaatttgtgttgatgtttattacgatcaaaaaaaaaaaaaaaaaagg

SEQ ID NO: 15649 - DNA, 667 bp, Sorghum bicolor
  Clone ID: SORBI-28MAY03-CLUS1324_4
gccggccgggccgggtgcatgtggcccggccggcgaaggaattcgcaagctcacccgcgccaacagcaaaccgatcgaaaaatccccaatcctatctccgcggcgaagatgtcggggcgcggcaagggcggcaagggcctgggcaagggtggcgcgaagcggcaccggaaggtgctccgcgacaacatccagggcatcacgaagccggcgatccggaggctggcgcggaggggcggcgtgaagcgcatctcggggctcatctacgaggagacccgcggcgtgctcaagatcttcctggagaacgtcatccgcgacgccgtcacctacaccgagcacgcgcgccgcaagaccgtcaccgccatggacgtcgtctacgcgctcaagcgccagggccgcaccctctacggcttcggcggctaggctggccgcgcctcgcccctctcctcgcactgcctgtcagcctgtgtcgccgtcgctgtggttgtagtgttgctgcaattcgttagttgtgtctggctgtgggaaaaacgctttactgtggcaagtatgttgcatatgttgtctgtttctgattgagtgttattctgaagaaatatggcaacgatgacttgctcaagatttaagcaaaaaaaaaaaaaaaacacaccaaaaaaaaaaaaaaaaaagg

SEQ ID NO: 15650 - DNA, 687 bp, Sorghum bicolor
  Clone ID: SORBI-28MAY03-CLUS1324_3
ggccgctcgaggccgccggccgggccgggaagcaccaccaatctggcctccactcctgcctgcaatctactcctccgaggaaatccaccacccaccctagcgggaaggagccatgtctgggcgcggcaagggtggcaaggggctcggcaagggcggcgcgaagcgccaccggaaggtgctgcgcgacaacatccagggcatcaccaagccggcgatccggcggctggcgaggaggggcggcgtgaagcgcatctcggggctcatctacgaggagacccgcggcgtgctcaagatcttcctcgagaacgtcatccgcgacgccgtcacatacaccgagcacgcccgccgcaagaccgtcaccgccatggacgtcgtctacgcgctcaagcgccagggccgcaccctctacggcttcggcggctaggctgatggctttggctcccccttctgcagctgcgacgttgtctggccgtgcccacaagtcttgcggtcaagaaagtttcaggaactcttggtagttcatctctggctgtagtaggtttatctgaattgtaagactgtagcaggcatgaagcagtaatgaaattatgtgcatctaatgttggaaatcaagcgtgttgtgcatcctgtcactcttcaatgcaaatgaatgtagtattctggtaaaaaaaaaaaaaaaaaaggccc

SEQ ID NO: 15651 - DNA, 696 bp, Sorghum bicolor
  unsure (1)..(696): unsure at all n locations
  Clone ID: SORBI-28MAY03-CLUS1324_2
gccggccgggtccggaggagaggccggggcaacaaccacccacgcaattcctccttttctttcgcttcctcctaatccgtattccaagttctagcagcagcgcagctctcggttttcggcgatgtcggggcgcggcaagggcggcaaggggcttggcaagggcggcgccaagcgccaccgcaaggtgctgcgcgacaacatccagggcatcaccaagccggcgatccgtaggctggcgaggaggggcggcgtcaagcgcatctccgggctcatctacgaggagacccgcggcgtgctcaagatcttcctcgagaacgtcatccgtgacgccgtcacctacacggagcacgcccgccgcaagaccgtcaccgccatggacgtagtctacgcgctcaagcgccagggccgcaccctctacggcttcggcggctaggtcggccccccatctggtggcgaatgactcacggtgatggcggtggtcgtgttgtgtgccttgtcttgtgtagtctgtgctcactgtatcagtgctttgttctgtggtagttgtgctaaggggaattccgtgctgaggtgttctgagtttctagtccatctggtgtaatctcgttgctgttatcaatgtatgaatgaaaagagagaaccctcggttctagccttatgtttctacaaaaaaaaaanaaaaaaggcccctagggc

SEQ ID NO: 15652 - DNA, 1497 bp, Sorghum bicolor
  Clone ID: SORBI-28MAY03-CLUS1324_1
gccggcctggccgggaccaactcaccgcggcgaattcgaatccacaccaccactagagtcttccttcctcttcgccggccaccaaccccagtcccgcacgccaaaaaatacacctccacaatctcctctcgacttcgagctcctcgctctcagccatgtcggggcgcggcaagggaggcaagggtctgggcaagggcggcgcgaagcgccaccgcaaggtgctccgcgacaacatccagggcatcacgaagccggcgatccggaggctggcgaggaggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacgggttcggcggctccgctggcacggccccgatcgtcatcttcagctgcaacccgattttctgcatgccagggaggcgcgcaggcttaatttccgacaggtacacaggaacagactgattggcgaatccgacgccgacgccgaggaggatacgaccgatgatgagcatggcgacgttctgggctgcgccgttgagggcggcgccgacgaggaaggtgaggccgccgacgagcatggaccacttgcgtccgaggacgcgggtgacggtggcggcgaagaaggaggcgacgagcgcggcgaggtagagggaggaggtgaaggtctgcagcagctggttgtcgtacttgcagtactggttggtcttggcctcctgcttcttccggaacacctccgggaagaacttctcaaggaacgggtccatggaggtcacgccgcctgagataccgatgtcatatccgaagatgagaccgccggtggcggcgacgatgcaggtgagcaacacaaagagggtgagcttgccggggtagtccttgcccccgcccgtgttcacgatggcaccgccggccatcgtatccggcctcttggtttcctctcgatcgactggagaagacgattgatcgaggaagacaggctataggctcaatcaatcaatgtaacttggatggatgaaatcgagctgagaaaccaaggagagttgtagctagctgttattgtctttaaatataacagagtcgataataagggctcgacgccgggccggggtgaggagagagtgcacaatgcattcgtgcgcctcttctccgttgccgtctgcagctgctgctcgttccatcttactccgtcctttgggttccttgtgccgtgctttccttgatgtagagagttctcagattcttaggtctctgctgtgtgtctcgttattacgtggaatcatgtgtccctaatagtgctgaaagttcaacacccagttgtatcttcctttgcagcaatgaaatgttaactctgaatggctattattcagaaaaaaaaaaaaaaaaaaggccccta

SEQ ID NO: 15653 - DNA, 688 bp, Sorghum bicolor
  Clone ID: LIB5052-006-A1-XP1-C1
gccggccgggctccaatcttcatctccaaatcacctcccaatctcctctcgacttcgagctcctcgctctcagccatgtcgggccgcggcaagggaggcaagggtctgggcaagggcggcgcgaagcgccaccgcaaggtgctccgcgacaacatccagggcatcacgaagccggcgatccggaggctggcgcgcaggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggtttcggcggctaagctcggtccgcccccaatctccgctccggcggcatctctggttcctggtcgccgtgcgcgtcggtggtgctatgtttagcagctgttagggtttcgtgtcgtctggtgtctgtgctatctggctgtcttgtgcaaagttatctgtcctgttttgtgtgtattggaacaatgctagatgaatgaaatggatctgtgttttagttacgactgcatctttgtaccaactgtttttggcactgatggcacaaacctgtggacatgttcagacctgaaaaaaaaaaaaaaaaaaggcccctaaggc

SEQ ID NO: 15654 - DNA, 278 bp, Sorghum bicolor
  Clone ID: LIB5048-011-R1-XP1-E10
ccgggatccacttcaccaccccaccaccagcaaccgcaaccggaaaatccccaatcccctcggcttcgcggcgaacatgtcggggcgcggcaagggcggcaagggcctgggcaagggcggcgcgaagcgtcaccggaaggtgctccgcgacaacatccaggggatcacgaagccggcgatccggaggctggcgaggaggggcggcgtgaagcgcatctcggggctcatctacgaggagacccgcggcgtgctcaagatcttcctcgagaacgacatcc

SEQ ID NO: 15655 - DNA, 1855 bp, Sorghum bicolor
  Clone ID: SORBI-28MAY03-CLUS2378_1
gcacgaggagcccgccgaacgcctgacactcccgctgcgcccgatttttgctaacccattccaggtccacgcatccacaatgttagagccattccttgcaccattctgcaattacaacgctccatacaaattctcgctgccaaagcatcagacttaaccctggttgaaagagtttcctagactaaactcactgatgcatgaaatagtaacaacaggtcagatgttaaaccgtcgcaacaagtttccacaacagggccggggttggcctgtttgccgatcataaaccatttccttcggaccctggcaacaggtaagaaacttagccgcctcggttactactaatcttttggttatgcacaataactctcatctagcctgtataaatacacaagaacaatggcttgtacagttccgcaatttgcgcagagaaaacaaactgccgcatctcagatcagtcactgcctcaggtcactggaagtaattcatcattgggcctggggatctagacccacagcaccaaaccttgcaccggcaccaatcccagcattgggtggctgtgccaccacaacattgtcatcagcaaatagcgccttgatgaaggacggtgtcttcagggggcgccggccagtcatccgtgggtatacatcttccaggaagtagtacacatgtccagcaatcatacccaagagatccacccggccgcggctccacacaagatagataagccctccagatcataccgaacacctgccacttcagtagaacacacttgatctcaggcacaggaagttgatatcagaaaatgcaggctgccgctactgccgttgggttctcggccgtgctgcctgtcaaggcccggccggcggcgaggagcacggcggtggcccgcgtccctgccacaaggaggagcgtccgtaccgccgctgccgccgtcgtcgtcgcggagcctgcggaggtcgactacagctcgagcttctcggtgttcccgatggaggcctgcgacctgctcggcggcgacgcgtgcatcgggaagatgttcccggaggccaagctcgccgcggcggcgccggaggcgagcaggagggtggacgcggtggagagggactacctgtcctacgacgggccaaaaacggtgttcccgggcgaggcgtgcgacgacctcggcggcgagttctgcgaggcgccgtacatggacggcgtctccagggacgcctgaagcctcaagacctgacctgatccatccatgtctgtctgtccagactccacaaacaaaattggcctcactgtcgagtagatggatgatctcatgatccgttcacaccatgtacggtattgtgtataaacttacgtagttacacgtagtagatcccgggggagctagcgtgcgtgtgcgtacgttggtactctacagaataacagcagccaggcaaggccaaagggtgtatatatgtatgtcatgtatatatgtatgtatatgtatatatgtatgtcttggcctcttgggttgtgtcagctgtgaagattggaacgcagtgctgtggaacttacgctacaaccgatatgttccctgcagagccaatggaccgaatggagtgcgtgctagagtacttaaactgacctgaatactagctgccagccaagctgcacaatcgatatggactgggacaaattttctatcagaaccattggtggcgtaatttatttgaactagtacaaaatatactgtattatgctacaaaaaatcaagcagatctaacttagatgtagcccccaaagcattaaatttcagtactgaattactaagctccaagcaatatgaattatttatatcagcgcttttcagctttttacattg

SEQ ID NO: 15656 - DNA, 499 bp, Sorghum bicolor
  Clone ID: SORBI-28MAY03-CLUS141_2
agctcatccacggccgctgggccatgctcgccaccctcggcgccctctccgtcgagtggctcaccggcgtcacctggcaggacgccggcaaggtatagtttcatgcatgtatccatggagttcgttcgttccaagcgcatgcgcttcaacgatctaaccatcctgtgaattgatcgatgtgacggccggcgtgcaggtggagctggtggacgggtcctcgtacctgggccagccgctgccgttctccatctcgacgctcatctggatcgaggtgctggtgatcggctacatcgagttccagcgcaacgccgagctcgacccggagaagaggctgtaccccggcctggcgtacttcgaccacgtcggcctggccatggtcccggtgctcggattccggctgcagctggacgccaccaagcacgcgcgcctcgccatggtcgccttccacgtgttcgacctgatccacaccaccatcttcgacacgttcggagcatgctct

SEQ ID NO: 15657 - DNA, 1874 bp, Sorghum bicolor
  Clone ID: SORBI-28MAY03-CLUS141_1
aggattcgccgtgcaggccgccgccaccggcaggggagcgctcgacgcagcagacacccaccaccaccaacctcagcacaccaaaggagaggaggaggagcagcaggacagccatggcttcgtcagtggccgccgcggcgagcacattcctgggcacccgcctgtcggacccggcgccgcagaacgggcgcatcgtggcccggttcggcttcggaaagccgaaaaaggctgctgcccccaagaaggtgtccaagatctcctctgaccggccgctgtggttccccggcgccgtggcgcccgactacctcgacggcacgctggtcggcgactacggcttcgaccccttcgggctcgggaagcccgtggagtacctgcagttcgatttggactcgctggaccagaacctggccaagaatgagcccggcgtcgtcatcggcacccgcttcgagtcctccgacgtcaaatccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcgtacctgggccagccgctgccgttctccatctcgacgctcatctggatcgaggtgctggtgatcggctacatcgagttccagcgcaacgccgagctcgacccggagaagaggctgtaccccggcggctcctacttcgacccgctcggcctggcggccgacccggagaagaaggagcggctgcagctggcggagatcaagcacgcgcgcctcgccatggtcgccttcctcggattcgccgtgcaggccgccgccaccggcaaggggccgctcaacaactgggccacccacctgagcgacccgctccacaccaccatcttcgacacgttcggagcatcctcttaattaagcccgccattaattgctccgccctgttcgtcgatcgaaacgtgttcttataaattaactatgatctctatgagcctggagagatggatggatgaacccgtcgtgcgtggtttcattttgtgatgagtgagagagagagagtgtatgggggcaggacgatcgatcctttgctaatggagatctcgttaattaggagagctgcagcagggacttggtgatttgtaatatatgatccagtgatgaattagtgctccattcacttgagagcctgtaccccggcggctcctacttcgacccgctcggcctggcggccgacccggagaagaaggagcggctgcagctggcggagatcaagcacgcgcgcctcgccatggtcgccttcctcggattcgccgtgcaggccgccgccaccggcaaggggccgctcaacaactgggccacccacctgagcgacccgctccacaccaccatcttcgacacgttcggagcatcctcttaagcccgccattaattgctccgccctgttcgtcgatcgaaacgtgttcttataaattaactatgatctctatgagcctggagagatggatggatgaacccgtcgtgcgtggtttcattttgtgatgagtgagagagagagagtgtatgagggttgggggcaggacgatcgatcctttgctaatggagatctcgttaattaggagagctgcagcagggacttggtgatttgtaatatatgaaccagtgatgaattaatgcatcattcacttgtaaacatatgttccagtgatgcattattgtatctttcacttgtgctgtaaaaaaaaaaaaaaaaaaaaaaaaaaaaaaaaaaaaaaaaaaaaaaagggaggccgctcgcgatctagaactagt

SEQ ID NO: 15658 - DNA, 724 bp, Sorghum bicolor
  Clone ID: SORBI-28MAY03-CLUS6203_2
ggccgctcgaggccggccgggccggggaatcacaggagccccccagccccgagaacatccaggttcaacaagatgcagatcttcgtgaagaccctgactgggaagaccatcaccctcgaggtggagagcagcgacaccatcgacaatgtcaaggccaagatccaggacaaggaaggaatcccgccggaccagcagcggctgatctttgccgggaagcagctggaggatggccgcaccctcgcggattataacatccaaaaggagtccacgctccacctcgtgctcaggctccgcggtggtatcattgagccctcgctgcaggcgctcgcacgcaagtacaaccaggacaagatgatctgccgcaaatgctatgcacgcctgcaccccagggctgtcaactgccgcaagaagaagtgtggtcacagcaaccagctgagggccaagaagaagatcaagaactgaggtgttgccgctagtcagtttcatggacaattgaagtcctctgttgtagcaatgcatgttgtactgtgttgttgtcttgttgaaccgagtttgtttacccaacatttgggtctgttgtgatgtttcaccttgtcgattgtcgatgacgacagtactatatggcaatagctaattagctactgtgatttggtctaaaaaaaaaaaaaaaaaaggcccctgcagctaccgcttcatgtttggccagtgctatgcgcgcccgcat

SEQ ID NO: 15659 - DNA, 1399 bp, Sorghum bicolor
  Clone ID: SORBI-28MAY03-CLUS6203_1
acgccaccctctgcgcaccacgccgacgagcagccgccgcgctcaagctccgcccccattccattgcattcccaatcccattccattcagatccggcactccacttcacacacaaacagagcagaacgaggagggagaggatatgctggccatcttccagaagcaggtggcgcacgcgccgcaggagctcaacagcccccgcggcggcgcggcgtccaacaagccccggaaccccgacgagatcctgcgcgacttccacgccgcgcaccccaccaacgccatctccacctccttcagcggcggcgccgcgctcgcctgcgtcggccccacctccgccggcaccggcaccggcaccggcacctacccgcggatgttctgcggcctggacgacatctactgcgtcttcctgggtcgcctcgacaacctgagcggcctcatccggcagtacggcctgtgcgggcggtccaccaacgaggcgctgctggtcatcgaggcctaccgcacgctccgcgaccgcgggccgtacccggccgaccaggtcgtcaaggacctcgcgggggccttcgccttcgtcgtcttcgacaaccgctccggcgccgtgttcgccgcgctgggcgggaacggcgacggcgtgccgctgtactggggcgtggcggcggacgggtccgcggtcatcagcgacgaccgcgacgtggtgaagcgcgggtgcggcaagtcgtacgcgccgttccccgctggctgcatgttccacagcgagggagggctcaagagcttcgagcaccccatgaacaggctcaaggccatgccacgcgtcgacagcgagggcgccatgtgcggcgccaccttcaaggtcgacaccttcaccaagatcaactccatgccccgcgtcggcagcgccaccaactgggccgccgcctgggaggatgccatctagcggtgtccactgctcgatctgctcaccaaccaaaccatcatgtcccatgtctgcaagtctgcacggcaacctcccctgcccctgcccgtggtcttcctatctactaatagatccaagcactgcgtcaaaacttccatccaaacattattttctgaaaggctccatcattctgattgggctagtgctacgggaaacaggatggaatagtatgccatgttactagaactttgttttctttttcccttttttttttccttatcctggcatttgtacattagtttctgcagtgcttgtggcttgtggacttgggttgttcaacatcatgaataagaaagaagagtttgctccaaaactttgctaagctcctcctggactttggagcatcgctgctctgttagttggctgattagaggcctctttggttcatatgtatctaacattgccacctcggaacacgtcacattt

SEQ ID NO: 15660 - DNA, 553 bp, Sorghum bicolor
  unsure (1)..(553): unsure at all n locations
  Clone ID: LIB3480-050-P1-K1-G3
cgatgacattgaggataacctccaaagcccacttatttctcgtcaagcaacaagtgtggaaggaaaggagattgctgcacctcatggtagcataatgggtgctgtgggaagaagcagtagcctgcagggaggggaggcagtaagcagcatgggcattggtggaggatggcagttggcgtggaaatggactgagagagagggcgaagatggggaaaaggaaggtggcttccagcgtatttatttgcatgaggagggcgtacaaggcaggggttctatattgtcattaccaggaggggatgttcctcctggtggtgagttcgtccaggctgcagctcttgtgagtcaaccagctctttactcaaaggaactgctggagcagcgtctgatcttcgccgggaagcagctggaagacggccgcaccctggccgactacaacatccagaaggagtccacccttcacctcgtnctccgccttcgcggtggcatcattgaaccttctctccaggcgctcgcccgcaagtacaaccaggacaagatgatctggcgcaagtgc

SEQ ID NO: 15661 - DNA, 355 bp, Sorghum bicolor
  Clone ID: LIB3476-017-P1-K1-D5
cccacgcgtccgacaaggcaggggttctatattgtcattaccaggaggggatgttcctcctggtggtgagttcgtccaggctgcagctcttgtgagtcaaccagctctttactcaaaggaactgctggagcaacgtgctgctggtcctgcgatgatgcatccatctgaggcagttgctaaaggtccaagatgggctgacctgtttgagcctggagtgaagcatgcactgtttgttggcataggaatacagatcctgcaacagtttgctggcatcaatggtgttctctactacactcctcaaattcttgagcaagcaggtggttgtgttcttctgtcgaacattggccttagcgca

SEQ ID NO: 15662 - DNA, 1096 bp, Sorghum bicolor
  Clone ID: SORBI-28MAY03-CLUS3375_1
aaaaaaaaccggactccatccaaatcccactccccaatcccatcccgtcggagaaattcatcgaagcgaagcgaagcgaatcctcccgatcctctcaagatgcagatcttcgttaagaccctcactggcaagaccatcacccttgaggtcgagtcctcagacactattgacaatgtcaaggctaagatccaggacaaggaaggcatccctccggaccagcagaggctcatctttgctggcaagcagctcgaggatggccgtaccctagctgactacaacatccagaaggagtcgactctccaccttgtgctcaggctcaggggtggcatgcagatcttcgtcaagaccctcactggcaagaccatcaccttggaggtggagtcctcagacaccattgacaacgtgaaggcaaagatccaggacaaggaaggcatccccccagaccagcagcgtctcatctttgccgggaagcagcttgaggatggccgcacccttgccgactacaacatccagaaggagtccacccttcacctggtgctccgccttcgtggtggtatgcagatcttcgtcaagaccctcaccggcaagaccatcaccctggaggtggagtcctctgacaccattgacaatgtgaaggccaagatccaggacaaggagggcatccccccggaccagcagcgtctcatcttcgctggcaagcagctggaggatggccgcacccttgctgactacaacatccagaaggagtccacccttcacctggtgctccgcctgcgtggtggcatgcagatcttcgtcaagaccctcaccggcaagaccatcacccttgaggtcgagtcctctgacactattgacaatgtcaaggctaagatccaggacaaggaaggcatccctccggaccagcagaggctcatctttgctggcaagcagctcgaggatggccgtaccctagctgactacaacatccagaaggagtcgactctccaccttgtgctcaggctcaggggtggcatgcagatcttcgtcaagaccctcactggcaagaccatcaccttggaggtggagtcctcagacaccattgacaacgtgaaggcaa

SEQ ID NO: 15663 - DNA, 1506 bp, Sorghum bicolor
  Clone ID: SORBI-28MAY03-CLUS3548_1
gcacgaggctgcccttccagccttaccagccctcctcgtcaaaccagtaacaccgatctagggtttcacctttccccttcctctcgttcctccaccggcgcttgcgcttcgcggtgcgtaagccatgattgcggccgggactctcgatcctcctacctacctgcctccaccggcgccccgcagcgcgcctgcccctccaccggcgccgcgccgcgcgtctgccatgactgctgcccggcgtcccgctcctatctacgtgttcaacaacgaagtgcgtgcgggcgaattgatcggcaggccgggcaaattgatcggcaggccgggggaagggtggactgagattaagatcgtttgcaggaaggcttacggatgcggggacaacatcaaggaggcgttgaatggcctcagtctccacgtgctcctcggcgactatccgcttctcccctcagtccttggccatccgcatgagccaagaagctgatgtccgttttatcgcggggcctgccttccgccgccagggaaaatgtactgatcaagagtcagggagcgtggtgacaggtgtcaaggcaaaagttgcgtgtcttctgctggatccgggttttttgttgccagattgctcttagtagttgggttcatgttcctgagtactcgtagcttctttcgagctttgtttccattctgctatggatgtttaagactccccttaatttcttgcaagtctttaggtacttatcttttgattgtgctgcatttgtgaaacgttaacttgtgcctgtgcttatattattctatgtgcggagctcagccgttttgttttgacatcgaccggccgccctttctctgcgtgttctctctgttgatgggggcaaacctgacttgtgcatgggagatgaagaagagggtgagctggaatgtgccggtgagcgtctatgaacgattcatgacggacatgaccttctcttttcaaggcaagggtatttgggttgatctgtcgcaagccatcatgtactgtgacctgcaaaccactgactctgtcattggttttgactgcatcaagttgccagtcgggtgcgagcttaacttggaggatgcgttggactgtgaggagtcgatgaagatgtcccggaccatgggctgtgtcaggggctcaatctggttcgtatgcattcgccgtggtgagcacaatgcagatgacttagtgacaatgtggactctggaactgccttgggggcagtggaagaatgaggcaaggtttcctgtcagagagctctggaggtcctgctttcgccgccagggacaatgtactgatcaagagtcagggagcgtggtgacaggtgtcaaggcaaaagttgcgtgtcttctgctggatccgggttttttgttgccagattgctcttagtagttgggttcatgttcctgagtactcgtagcttctttcgagctttgtttccattctgctatggatgtttaagactccccttaatttcttgcaagtctttaggtact

SEQ ID NO: 15664 - DNA, 488 bp, Sorghum bicolor
  Clone ID: LIB3481-024-P1-K1-E12
cgtccggttgcttcagttcctgctgctgcctaactgtgattttcgtccttcaccgccgttgcccgcacgtgacacgcatggcggcaagcgctgaaccgtccaccggctcggcaacagccaacaacaggcttgcgttgcgcaccgactcggctcgtgtcggttctgtcgccaccgcgcgcgggccacggcgctccgggatctcggtgaccgcttctcgtcagagaactatcagacaaggatggcgacttacgagcccaagaacattctcatcaccggtgctgctggttttattgcatcgcatgtcgccaaccgcctggttaggaactacccgcactacaagattgttgtcctcgacaagcttgactactgctccagcctaaagaacctcaacccctcgcgggcttcaccaaatttgaagtttgtcaagggtgacattgcaagtgctgatctggtgaactaccttctggtcacagaatcgattgacacca

SEQ ID NO: 15665 - DNA, 783 bp, Sorghum bicolor
  Clone ID: LIB5121-005-A1-PF1-H10
aattcaaatccgcgcccgccccgcgttttagtcgccagcacggcccctccctctcgatctcctcctccccgtcgcggcaggaggcatcgtgatcgtgatcgtccggccgtggttccccgcactcgccccacaactccgacaccgcccgcacgggacgcgcgtgcccgcccgcggacgtccttcgcctccgcgacaggcttgcgccccggctcggctctgcctccactgcggccttcctggatctcggccaccgctcctcgtcagagaactatcagacaaggatggcgacttacgagcccaagaacattctcatcaccggtgctgctggttttattgcatcgcatgtcgccaaccgcctggttaggaactacgatgctgttcctgcagcgcgaggaccttcgtgatctgccctactacctcgtttacgaccacaagaacgcgtcactctccatgatcagctacatcccagatcccctcgaagtcattggtatgttaaagcccgtccccaagcgcacctctgacggtgcttatgagctgttcctcatggctcgtgaatctcacgatggtctgcccatggcttttgacatcgaccggccgccctttctctgcgtgttctctctgttgatgggggcaaacctgacttgtgcatgggagatgaagaagagggtgagctggaatgtgccggtgagcgtctatgaacgattcatgacggacatgaccttctcttttcaaggcagggtatttgggttgatctgtcccaagccatcatgtactgtgacctgc

SEQ ID NO: 15666 - DNA, 450 bp, Sorghum bicolor
  Clone ID: LIB5052-007-A1-XP1-D5
gccggccgggttgggtgttcgtcaccactcttttactgagacagttgccatctcttcgcatttcttccaaaggaagcatgtttcacacaagaggaagtatgatgaactccatcctgtagcaggtcctgctttcgccgccagggacaatgtactgatcaagagtcagggagcgtggtgacaggtgtcaaggcaaaagttgcgtgtcttctgctggatccgggttttttgttgccagattgctcttagtagttgggttcatgttcctgagtactcgtagcttctttcgagctttgtttccattctgctatggatgtttaagactccccttaatttcttgcaagtctttaggtacttatcttttgattgtgctgcatttgtgaaacgttaacttgtgcctgtgcttatattattctatgtgcggagcaaaaaaaaaaaaaaaaaaggccccta

SEQ ID NO: 15667 - DNA, 329 bp, Sorghum bicolor
  Clone ID: LIB3476-060-P1-K1-G4
cccacgcgtccggtgctcctcggcgacgatccgcttgtcagctcatccttggccatccgcatcagcccagaagctcatgagagattcaactcggagcttgacggccgtgcccgaaaaaactgcaggccgcactacctgaacagtaatatgactgcgagggccagcataatcctgatggatgaagagcaggacctcatgatcatgatgctgttcctgcagcgcgaggaccttcgtgatctgccctacatcccagatcctcctgaagtcattggtatgttaaagcccgtccccaagcgcacctctgacggtgcttatgagctgttcctcat

SEQ ID NO: 15668 - DNA, 1830 bp, Sorghum bicolor
  Clone ID: SORBI-28MAY03-CLUS63_1
gccggccgggcacgaaactcacaaaaaaacgcacctcacaacaagctgcaccgcagcaaccttagtgagaagctgaagtactgatccgatcgatccagtatggcaaacgcgccgccgaggatcttggcagtcctgggggctctcgggctagcactcctctgcgctgccgccgtcccggcctctgcgctgccgcgccgctgaactgcggctgccaggcaggttactgctgcagcaagttcggttactgcggcacgacggacgaatactgcggcgacgggtgccagtcgggcccgtgccgctcgggcggcggcagcagtggaggtgggaacgtgggtggcgttgtcaccgacgcattcttcaacggcatcaagaaccaggccgggagcgggtgcgagggcaagaacttctacacccggagtgcgttcctgagcgccgccgacgcgtacaaaggcttcggtggcgggtcggtggcgggcaagcgcgagatcgccgccttcttcgcccccatcacccacgagaccgggcatttctgctacatcagcgagatcaacaagaacaacggctactgcgactcgagcgacaggcagtggccgggtgccgcgggacagaagtcccgcgggcccgcaactctggaaatcccgtggaagctaccactacgggccggccggcagggccatcggcttcgacgggcttcgccgcgatcgcgttcaagacggcgctctggtactggacgaacaacgtgcacggggtgatgtcgcaggggttcggcgccaccatcagggccatcaacggcgccctcgagtgcaacggcaagaatactgcccagatgaacgcgcgggtgggctactacaagcagtactgccggcagctcggcgtcgaccccgggcccaacctcacttgctaggcgagtggcgtcggcagtccttggatggctcgtccagaaaatgcatgctcggcgtcgcaccctcgcgaaacacagagtttagcgagtacgagctagctagtagtaacaataaaacgctggggctgagcctgtttgttgcaccttactaataatgaagcaactataccctcgaaacattagtgtgtacactcgcgcttgtactttactacgattgcatcaagggtttaaagactaaatcaataaacagtgtacgattgtagaccacttgtactctttacggttgcagcgagggtttaaaaactgaaccaatatgcaaagtttacggttgcagaataataaaaaacaaagggtcctacggcttgcatctttggatttatactggaagagctaaatcacaagctagatggtgtcaggactgcaaggagttccatcaagctaaagatggcgatggatgggttgaacagtcctttcaatctgttctatttggcatgctgcgggagcttgatttacctcatgcatatgtttgtgcagaaagctacatatttgatgtcactgagtggttcaactgtcagggaatgagatgcccggcgaacactcacaaggcaacctttcatgtcaatgccaacatggcaaggcagagtagtggcaaggggagtacctcagcacagaggggtggtaaggccccaagtggtgtaaacatggatggaggactgaacgaggaagagttcttcgagtggttccagaatgcagtcaactctggaatgtttgagactgcattcggggcacaaggtgacccggcttctcctggtagcggaagcaatgcgaagagtagcagtagcaatagtagtaggaaaaagaagaagggaaagaaacagtggtaagcaaagcaggttagtgtctggtgatcactacccagggcagacaaa

SEQ ID NO: 15669 - DNA, 558 bp, Sorghum bicolor
  unsure (1)..(558): unsure at all n locations
  Clone ID: LIB3481-033-P1-K1-H2
cgtccggccgagcaagaactactgcgacgcgaacaacacggagtggccgtgccaggcggggaaggggtactacgggcgaggcccgctgcagatctcgtggaactacaactacgggccggcggggcagagcatcggcttcgacgggctgggcgaccccgacgcggtggcgcgcagcgccgtcgtcgcgttccgggcggcgctctggtactggatgaacagcgtgcacggggtcttcgtctccgggcagggcttcggcgccaccatccgggccatcaacggcgcgctcgagtgcgacggcaagaacccggactccgtcaacgaccgcgtcgcctactacaagcagttctgccaggatttcggcgtcgacccaggaagcaacctcacatgctgatgactgacgtcgtgtactagttgtgtggatgtggtcatgtggatgtgattcggtttggtagtgtgaattgtgtgtaaatngtgtgtttggggatcggagcggcgagacatcaacaagctagtaggttagggatgtgatgttgtgattcagagacttatatatacgga

SEQ ID NO: 15670 - DNA, 464 bp, Sorghum bicolor
  Clone ID: LIB3480-034-P1-K1-E10
caaggacaacgcctactgtgactcgagctacacacagtggccgtgcgccgcggggcagaagtactacggaagaggccccctgcagatctcgtggaactacaactacgggccggcaggacagagcatcggcttcgacgggctcgggaacccggacgccgtggcgcaggacgccgtgatcgcgttcaaggcggcgctctggttctggatgaacaacgtgcacggggtgatgccacaggggtttggcgccaccatcagagccataaacggcgccctcgagtgcaacggaaacaaccccgcgcagatgaacgcgcgggtgggctactacaagcagtactgccagcagttcggcgtcgacccggggagcaacctcacctgctagaagtgatgggttcatgcctgccttcttatattaatataagggtgtatatatacttagaattgagagtgcgtagtagtattagaga

SEQ ID NO: 15671 - DNA, 356 bp, Sorghum bicolor
  Clone ID: LIB5121-006-A1-PF1-F3
ctacaggcagtactgccagcagctcggcgtcgaccccggacccaacctcacttgctaggtagctaggcgagcggcgtcggcgagtcctttggctcctcgtcgcacggctcgtccagaataaataaatgcttggcatcgcacccttcgcgaaacctagttttgcgacggaacgtgctagcaagcagtaataataaaacgccggggctgagcccgtttgttcaaccggaataatgaagcaactgtattatatgcatgttgcctcgaaaaaaaaaaaaaaaaaaaaaaaaaaaaaaaaaaaaaaaaaagaaaataaaaaaaaaaaaaaaaaaaaaaaaaaaaacgaaaaaaaaaagaaa

SEQ ID NO: 15672 - DNA, 428 bp, Sorghum bicolor
  unsure (1)..(428): unsure at all n locations
  Clone ID: LIB3480-034-P1-K1-C10
cccaacctcacttgctaggtagctaggcgagcggcgtcggcgagtcctttggctcctcgtcgcacggctcgtccagaataaataaatgcttggcatcgcacccttcgcgaaacctagttttgcgacggaacgtgctagcaagcagtaataataaaacgccggggctgagcccgtttgttcaaccggaataatgaagcaactgtattatatgcatgttgcctcgaaacagtgtgtacgattgcagatcgcttgtactctttacggttgcagcgagggtttaaaaactgaaccaaaggtccttatgggtctttccagaagaatagcttgcaaaaagtgcggcgacttgcatctttggatttatacttgangagcttaatcacaaagctagatggtgtcaggactgcaaggagttccatcaagctaaagat

SEQ ID NO: 15673 - DNA, 444 bp, Sorghum bicolor
  Clone ID: SORBI-28MAY03-CLUS1115_3
gccggccgggtcggggagggtcgatcctagcctcgctaagcactttccaacagatgtggatatcgaaggaggagtatgatgagtctggcccagcaatcgttcaccggaagtgcttctaagtttcaccagttgttgttacctagtctcaagtagtcaagttatgtccccttcatttcttgagatatgtgtggcagatttgcatgctacgtttatttgcatcggacctgagtcttctctgggatagacccttctttgtgtgttgttgcttcatgtgcggtttgtgaggttagttgtcaaacatgcttggcttgattggttgtacctctgagagctgatagttatataaattgcttggattgtgctggtgctatcaatagtcttgtatgtatctgaattctgaaagcattgttatctgagcaaaaaaaaaaaaaaaaaaggccccta

SEQ ID NO: 15674 - DNA, 1142 bp, Sorghum bicolor
  unsure (1)..(1142): unsure at all n locations
  Clone ID: SORBI-28MAY03-CLUS1115_2
ggcgcccggtgactgggaatcgcagacggcgtcccacttgtcgccctccatcctctgcttctccgacagatgccacaggagaaccacgaggccgccgggtagggcgacgccggcaaccatgcacagcatgaacaggaggctccggtaccaccacgccaccacgttgtgcggcttcacgtagtaagcctccaccagggtgaacgccaggaggaagccgagcgtggacgccaggaagtacatggccgcccagaagttgtccccggtgccgaccagaccagacatggtcgaaccgttcttgacgaacatgccagggactttgcggtcgtccacgacgatgccgtcctccaatgggggcaaggattcttgagtcacgaaggcctggatgtccagtttcaacctgtccgagacagatgaactgatggtctgagcatcaacagcggacaagagagaaagcncctgccacttcttgactgaccaaaggaccagcacgttcttgggcatgcattgcttgccctcctcgatcctgtggattatgtcgctcaagatcgccaagaacggcgatattccaatgcctcctgccaccaagatgagattctcgtacatcaagtggtagggtgattcatgcccatacgggccttccacgcaggctgtcatgcgtccgcattgcaactcagagtcacccctgttcttgtcctggacatcggtgatgatgctcctcagtttttcagtccatgtgccgagtacttttatgagaaccgacatgtggtatctcccatccatgggacttgaagatacactgaacggatgccactgcaagaacgatagctcgcgaacttgaatgaagatgaaactcaaagcattgtagcggaggcctggtggttttgaaaatactagctccaccgtcccacatgggcggcaggcggctgaaacgatgtcaactttggcccttgactgccagaaccttaaaaagcggtcgagcatgaagaggaacacaaccccggccgaaatactgaagaggaagttgccgacatggaacgccaagaacacgatgaagacgacgtagagctggtgggtgtagaagaagagctcaaagaacctcttcctcactgggtgaagtgatgtcacccacataagtaggccgc

SEQ ID NO: 15675 - DNA, 1634 bp, Sorghum bicolor
  Clone ID: SORBI-28MAY03-CLUS1115_1
tgaagcccgcagacggcccccgactgccacaagtctctctcctctcctctctctctctctctctctctcctcgcgacgactgggcgagaccgccgccgcccttcgccaggtgcccaggtctccgccgcttccttcgccggaggtcaccagcagttctgtagaaatggctgatggtgaggacatccagcctcttgtctgcgacaatggcaccggaatggtcaaggctggttttgctggtgatgatgcaccgagggctgttttccctagcatcgtgggtcgtcctcgtcacacgggtgtcatggtagggatgggacagaaggacgcgtatgttggcgatgaggcacagtccaagagaggtattctcacgctcaagtacccgattgagcatggtattgtcagcaattgggatgacatggagaaaatctggcatcacactttctacaacgagctccgtgttgccccggaggagcaccctgtgttgctcactgaagctcctctgaacccaaaggccaacagggagaagatgacccagattatgtttgagactttcaatgttcctgccatgtatgttgcgattcaagcagtgctctccctctatgctagtgggcgtactactggtattgttctcgactctggtgatggtgtgagccacactgtgcccatttacgaaggatatgcccttccccatgccattcttcgtttggatcttgctggccgggacctcacggactccctcatgaaaattctcacggagaggggttactccttcacaacctctgctgagcgggaaattgtaagggacatcaaggagaagcttgcatatatagcccttgactatgagcaagagttggaaactgccaagaacagctcctcagttgaaaagagctatgagctacctgatggtcaagtaatcaccatcggtgcagagagattcaggtgccctgaggtcctcttccagccatctatgattggtatggaggctgctggaatccatgagacaacatacaattcaatcatgaagtgcgatgtggatatcaggaaggacctctacggcaacattgtgctcagtggtggttcaactatgttcccgggtatcgctgatcgtatgagcaaggagatcacttcgcttgcaccaagcagtatgaagatcaaggttgttgcaccacctgagaggaagtacagtgtctggataggagggtcgatcctagcctcactcagcactttccaacagatgtggatatcgaaggaggagtatgatgagtctggcccagctattgttcacaggaagtgcttctaggttttctcatcgcctagtctcaagttatgtctcctccatttctcgagacacttgtggcagatttgcatgctacctttattttcatcggacctgagtcctctcggggataggccctcctttgtatgttgtggctcccatgtgcgagcaccgcccgtgtcgtatcacatgttatgtgagatgagttgttgtcaaacttgcttggcttgattggttgtacctgtaagagctgatagttttataaattgcttggactgttctgctgctaccttgtatctgaattctgaaagcattgttatctgagcatagcatcaatgaaagtattcattgcctgtgccgc

SEQ ID NO: 15676 - DNA, 462 bp, Sorghum bicolor
  Clone ID: LIB3478-035-P1-K1-E11
gtagcagcagaacagtccaagcaatttataaaactatcagctcttacaggtacaaccaatcaagccaagcaagtttgacaacaactcatctcacaaaccaggtgatacgacacggcgtgctcgcacatggagccacaacatacaaaggagggcctatccccgagaggactcaggtccgatgaaaataaaggtagcatgcaaatctgccacaagtgtcttgagaaatggaggagacataacttgagactaggcgatgagaaaacgtgactcaagaatccttgcccccattggaggacggcatcgtcgtggacgaccgcaaagtccctggcatgttcgtcaagaacggttcgaccatgtctggtctggtcggcaccggggacaacttctgggcggccatgtacttcctggcgtccacgctcggcttcctcctggcgttcaccctggtggaggcttactacgtga

SEQ ID NO: 15677 - DNA, 1111 bp, Sorghum bicolor
  Clone ID: SORBI-28MAY03-CLUS4518_1
gccggccgacaccatagcttgaggatggccgcacccttaggaactggacatccagaaggagtccacccttcacctggtgctccgccttcgtggtggtatgcagatcttcgtcaagaccctctacaacatccagaaggagctggcccttcacctgttgctccgccttcgtggtgtgaaggccaagatccaggacaaggagggcatccccccggaccagcagcgtctcatcttcgctggcaagcagctggaggatggccgcacccttgctgactacaacatccagaaggagtccacccttcacctggtgctccgcctgcgtggtggcatgcagatctttgtcaagaccctcaccggcaagaccatcaccctggaggttgagtcctctgacaccattgacaacgtgaaggccaagatccaggacaaggagggcatccccccggatcagcagcgtctgatctttgctggcaagcagctggaggatggccgcacccttgctgactacaacatccagaaggagtccacccttcacctggtgctgcgtcttcgtggtggtatgcagatcttcgtcaagaccctcaccggcaagaccatcaccctggaggtggagtcctctgacaccattgacaatgtgaaggcaaagatccaggacaaggagggcattcccccggaccagcagcgtctcatctttgctggtaagcagctggaggatggccgcacccttgcagactacaacatccagaaggaatccactctccacctggtgctccgtctccgtggtggccagtaagtcctgggccatgagcagccgtccttccagggttcacatgtctggtgccttcctctgtccctctgatggagattatctgcatgtcgtggtcgtgtcttgatcgagtcggtgaagagtccctatgtttccctttctcagaaaatcgtcctatgtcagtctggttgtgttcgtgaacatttctgctggtgcccagcagtttggttggaactgtgcaatggaataattgaaccctgaatttcgtgtgacaatttgtcttcatggtttctggatatattgtttgttaacatgtttggggagtggaagctctatcttctgcgttgctgc

SEQ ID NO: 15678 - DNA, 851 bp, Sorghum bicolor
  Clone ID: SORBI-28MAY03-CLUS51_1
cctactctggctctcgaaaccctagtcccccctgctccctcacccaagccgccgccgccgccaatcccctcccgtcctccgcgagaccgcaaaccgctgagagcgagaagagatggccggcaagggagacgggccggcgatcggcatcgacctcggcacgacctactcgtgcgtcggcgtgtggcagcacgaccgtgtcgagatcatcgccaacgaccaggggaaccgcaccacgccctcgtacgtcgccttcaccgactccgagcgcctcatcggagatgcggccaagaaccaggtcgccatgaaccccatcaacaccgtctttgatgccaagcggctcatcggcaggaggttctctgatgcttctgtccagagtgatatcaagctctggcccttcaaggtcatttctgggcctggtgagaagccaatgattgttgtccagcacaagggtgaggagaagcagtttgcagctgaggagatctcctctatggttctcatcaagatgcgtgagatcgctgaagcttaccttggcagcacgatcaagaatgctgttgtcacagtccctgcctacttcaacgactcacagaggcaggccacaaaggatgctggggtgattgctggcctcaacgtcctccgtatcatcaatgagccaactgctgctgctatcgcctatggtcttgacaagaaggcaaccagtgttggcgagaagaatgtcctcatctttgaccttggaggtggtaccttcgatgtctccctcctcaccattgaggaaggcatctttgaggtcaaggccacagctggtgacacccatctgggtggtgaggactttgacaacaggatggtgaaccact

SEQ ID NO: 15679 - DNA, 496 bp, Sorghum bicolor
  Clone ID: SORBI-28MAY03-CLUS1160_2
cccacgcgtccgcaagttgcagttccaggcagcagatcagcagagacacacccacaccgtaccacacacactagcgacctgcagtctgatctgcaggtacgctagaaaccaagctacgactgctgtgtgctgcgtacgtacgtaggagtacgtggtggtagcgagatggcgaagaaagtggccttggtggcctcgctgctggccctgaacctcctcttgttcggtttcgccgacgcatgtggctgcaggtgcggcggctcctgccctagtccaccaggcggtggtggcgggggaggtggaggcgggggaggcggaggatctggtgtggtgggagcggaggcggcggatggagcggtgggggcggcagcggaggaggaggcggaggtggcggcagctgctgttgaggaggaggaggcggcggcggcggcgggacgcgcggtcgttgccctgtggacacgctgaagttgggcgtgtgcgccaacgtgctgaacgggct

SEQ ID NO: 15680 - DNA, 2030 bp, Sorghum bicolor
  Clone ID: SORBI-28MAY03-CLUS1160_1
gccgcgcccgcccccggttgcagttccaggcagcagatcagcagagacacacccaccgcgtcccacccgcctcccattccgtcccccctgcccagatccaattctcgacttctccgtccgccgctgccatggcgctctctgtggagaagacctcgtctgggcgggagcacaaggtcaaggacctctcgcaggcggacttcggccgcctggagatcgagctggccgaggtcgagatgcccggtctcatggcgtgccgcgccgagtttggcccgtccaagcccttcgccggcgctaggatctctgggtcgctccacatgaccatccagactgccgtcctcatcgagaccctcaccgcgctcggcgcggaggtccgctggtgctcctgcaacatcttctccacgcaggaccacgccgccgccgccatcgcgcgtgactcggccgccgtgttcgcctggaagggggagaccctcgaggagtactggtggtgcaccgagcgctgcctcgactggggcgagggcggcggtcccgacctcatcgtcgacgacggaggtgacgcaacgctgctcatccacgagggtgtcaaggccgaggaggagtacgagaagaccggcaagatccccgacccggagtccacagacaacgctgagttcaagatcgtgctcaccatcatccgcgacgggcttaaggctgaccctaagaagtaccgcaagatgaaggagaggcttgtcggcgtctctgaggagaccaccaccggagtcaagaggctctaccagatgcaggagaccggcgccctcctcttccctgctattaacgtcaacgactccgtcaccaagagcaagtttgacaacctgtatggttgccgccactccctccctgatggtctgatgagggccacagacgttatgattgctggcaaggttgccgtggtctgtggatacggtgatgttggcaagggctgtgctgctgcactcaagcaggctggtgcccgtgtcattgtgactgagatcgaccccatctgtgccctccaggctctgatggagggtcttcaggtccttacattggaggatgttgtctctgaggctgacatctttgtgaccaccaccggcaacaaggatatcatcatggttgaccacatgaggaagatgaagaacaatgccattgtctgcaacattggccactttgacaatgaaattgatatgcttggtctcgagacctaccctggtgttaagcgcatcaccatcaagccccagactgaccgctgggtgttccctgagaccaaaactggcatcattgtccttgctgagggtcgtttgatgaaccttgggtgtgctactggccatcctagctttgtaatgtcctgctcattcactaaccaggtcattgcccagcttgagctctggaaggagaagagctctggcaagtatgagaagaaggtgtatgtgctccccaagcaccttgatgagaaggttgctgctctccacttgggcaagcttggtgccaagctgaccaagctcaccaaatcccaggctgactacatcagcgtgccgatcgagggcccctacaagcctgcccactaccggtactaggcagcccagcacgacttccagctcactaggccggttgtgtgatatgaagtttgctacaccggctgtcagttatcttttgcatgcatatgcattgtcatatacgagctgaggggggatgcggtgaggtaaggggctgtttgcttcagctgaagaataatggtgttatcggcttggatgaggcgatgtgcgttgccagatacagttttgtcatgttgactctacttatctgattatcatttgtaagcgatttgctcaagttatgtgtcatttatgaataactttgcttttctcaagagcatacttagtcttatcctcaattgtcttgggtttggttggttgagtactttgattgtttgagttgcgttcaccaggatcgctgatatgttatttagcggttattgcatggttggtatcacgcgcgtgttttataaatgctgctagaag

SEQ ID NO: 15681 - DNA, 846 bp, Sorghum bicolor
  unsure (1)..(846): unsure at all n locations
  Clone ID: SORBI-28MAY03-CLUS211_2
cgtccggnggagcagaagccggcctgcctgatgccgcctctcgtggaaacatcgccggagttcgcctccggcggcttggcggaggcggacgggctctcagggttcgacgtcccggacatggagctcgctagcttcgcggcggacatggagagcctcctcatgggagtccacgacgggtttgatgatctgggtttcttggacgaagagaagcctcaggtgaacgcggacgcgtacttggaggccatggcggcgccggtgcctgaacgagaggacaagaaaaggaagcggccggagatgatactcaagctcaactacgatggctttcatcgcccccaaggtccgtggtggctccactgggtacaaccccttcgcgctccccgccgaaggcaaagtcaagaaggacctcctgaaggagaacatcaaaaacccccccgcgtccacgggcaacatcacgtttagcgtcaccaaaagcaacccgaagaccggcaaggtcatcggcgtctttaaaagcgttcaaccgtcggacaccgacctcggcgccaaggcgcccaaggatgtcaagatccaggggatttggtacgcgcagctcaagtgattcgttcgttctaactgctactaggcgtcggaaccgtcatggatcggatcttgggaaaccgccccccccacaactttggagagcaaaggaggaggagtcgtgtatgtacctattaatgcaaattcgggctgttggttttaaatttcagtttgagtttcttcaaaaaaaaaaaaaaagggcggccgccctttttttttttttttttttccccccccccccccccccttttttttttttttttttttttttta

SEQ ID NO: 15682 - DNA, 1422 bp, Sorghum bicolor
  Clone ID: SORBI-28MAY03-CLUS211_1
gcacgcgcacgaggcccaccagaggggcgaaaataaaggcattcccgacacgccccaccagagggggaaaaaaaaggcaacagcaacaccgccgcgacgacgacgacgacgacgacgatggcagcctcgctccaagccgcggccaccttgatgcagccggccaagatcggcggccgggcgcactccgcctcgctgccgtcccggccgtcgtcgcacctcgccagggcgttcggcgtcgacgccggcgccgccaggatcacttgctccctccagtctgacatcagggacgtcgccagcaagtgcgtcgacgccgccaagctcgccggcttcgctctcgccacctctgcgctcctcgtctcgggcgcgagcgcggagggcacgcccaggaggctgacctacgaccagatccagagcttgacgtacatggaggtgaagggcacgggcacggcgaaccagtgcccgaccatcgacggcggcgtggaggcgttcccgttcaaggccggcaagtaccagatgaagaagctgtgcctggagccgacgtccttcacggtcaaggcggagggcatcgccaagaacgcgccgcccgagttccagaagaccaagctcatgacccgcctcacctacacgctggacgagatcgagggcccgctcgaggtcggctccgacggcaccctcaagttcgaggagaaggacggcatcgactacgccgccgtcaccgtgcagctcccgggaggcgagcgcgtgccgttcctcttcaccgtcaagcagctcgtcgccaccggcaagcccgagagcttcggcgggccattcctcgtgcccagctaccgtggctcctctttcctcgaccccaagggccgtggtggctccactgggtacgacaacgccgtcgcgctccccgccggaggcagaggcgacgaggaggagctcctgaaggagaacatcaagaacgccgccgcgtccacgggcaacatcacgttgagcgtcaccaagagcaacccggagaccggcgaggtcatcggcgtcttcgagagcgtgcagccgtcggacaccgacctcggcgccaaggcgcccaaggatgtcaagatccaggggatctggtacgcgcagctcgagtgattcgttcgttctaactgctactaggcgtcggaaccgtcatggatcggatcttgggaaagtgtaccatggagaactttggagagcagaggaggaggagtcgtgtatgtacctattaatgcaaattcgggctgttggttttaaatttcagtttgagtttcttctttcttgtgttctcatgaactactcccctgtgcaaacgcaaagagctaagaggctgtttgataccagagattaattggtatatagttttaaaaaaatagtcatagaaaaatttagctaagctcgcactagcttagcgcaatagct

SEQ ID NO: 15683 - DNA, 590 bp, Sorghum bicolor
  Clone ID: LIB3478-057-Q6-K1-D4
gctagcttcgcggcggacatggagagcctcctcatgggagtccacgtcgggtttgatgatctgggtttcttgtacgaagagaagctcgtcggcttcgctctcgccacctctgcgctcctcgtctcgggcgcgagcgcggagggcacgcccaggaggctgacctacgaccagatccagagcttgacgtacatggaggtgaagggcacgggcacggcgaaccagtgcccgaccatcgacggcggcgtggaggcgttcccgttcaaggccggcaagtaccagatgaagaagctgtgcctggagccgacgtccttcacggtcaaggcggagggcatcgccaagaacgcgccgcccgagttccagaagaccaagctcatgacccgcctcacctacacgctggacgagatcgagggcccgctcgaggtcggctccgacggcaccctcaagttcgaggagaaggacggcatcgactacgccgccgtcaccgtgcagctcccgggaggcgagcgcgtgccgttcctcttcaccgtcaagcagctcgtcgccacccgcaagcccgagagcttcggcgggccattcctcgtgcccagcta

SEQ ID NO: 15684 - DNA, 2540 bp, Sorghum bicolor
  Clone ID: SORBI-28MAY03-CLUS470_1
ctgcacgacgacacaaaccgcatctcgaatccattgaccagacggcggcgcacatcttctcccccacggttctccccatcggcctgctggcttcccttcgtctcccccgatactgatcctcatcacccatgtctgctgaagttgctggaggacacccttatttcctctcgtgctacttctggttcatatactgcataaaattccgagatttcacttgatacaagtggaacactaggagttttgtgctaatacttcctaccatgtgaatcagttgtagctggtgaatttggcaagactcaagtttctctcatctgagttcagaaaacatctgttggttgattgcttgatctcctgcttcccttgagtcttgccaaccatagttttctctgatcatcagtgtggtctacgatctctttctgtgacttgaccaacttctctcttggtcctgtcaatctcgcaacactcccatccaaagacttgtctagaggttggattgccttgctacctgctggcactgcagcctcctgaagtcttctccttgctgcattctgttcccacacgtttgaaagctgctctcttctgctctgctttgttgatttgtgcacttggattctcttgtttgtgcactcaagcttctctcttccttggaaactagtgatctccttgaagcatttcagcttttgtctagaggtctttctattggtgttgaaggcaagtgaagctttagggtgatggcgcaaactagcttgcctcctggttttcgtttccacccaactgatgttgagctcgtttcctactacttgaagaggaagattatgggaaagaaacttattgtagacgctatatcagaggttgatctctacaagtttcctccctgggatctccctgataagtcctcccttcgaagcaaagatcttgaatggttcttcttttgtcctcgtgacaagaagtatcctaatgggtctaggacaaaccgtgccacaccaaatggttactggaagactagtggaaaggatagaaacattatgcttaactctcgcactgttggaatgaagaaaacattgatatttcatgaaggcaaggcccctaagggtgacagaactgattgggtgatgtatgaatacaaaatggaagatgaggatttggtttcttctggtttctcaaaggatgcttatgtactctgcaaaattttcaagaaaagtggcctgggtccaaggataggggagcaatatggggctccgtttaatgaagccgaatgggataatcctgaagctgaatcttctatgtttcctttgatggcctcttcagaagtagtgaacccaatagagggaccacgcgcccagcctgctgcccctgctggtgctcttcaggaaccacctctacataattcatctgctacttgtgctggagaggaatcatcatttgattatgccactgcaaatacttgtgctgatgacataacttttggctatactgttgctagctctgctatccaagatatacctgctcagatgtcaggagatggtgtggtttctgtgaacaacatatctaatgaggccaatgatatgtacagtcctcatgactgtgatggttttctattggaggagctgtctagatttctgaatgattctcctggagagtgctctggtcttcctccgatgtctgaagctgaggctcatgcttttgaagtcagctcttttggcctctacaatgaattatcagggcttgttgggttaggaggagtggaaaacaccagcaatgtggaaactacagattaccagctgccacctgacagagaactgtctgctgatgattacatggaactaactgatctccttgctcctgatccaagcttccccactgaatttcctgctgaggacagtcaatatatgcagtatcctcttgctcatttcaatggacattatgatgtccctacaatgtcaggtcctttggaaccaacaatgcctagcattttcgatgcttttcctccttccaataatggagtcctcgccacagatgtggtagccaactacatggacccaaccatgcagttccctttctcatgattggtttccaattgtcatggagttctctgttgctactacaactctttacgaaccttggatgttggggacgtcatcgatgtcatacttgggtgcatgaaatcgtctgctgctcttctgaaccaagctgaccaggcctcatgaaattgtctgctgctcttctgaaccaagcaaacaatgactggtatttcttggaagcacggtgcttggatcaatctgcatcgactactgcaagctcccaaccggttgagctgaccgtcaatctcggcgctctgctgagtatcaataagacttggcgtgtaaatctttggttatgttattacctgtgtgtattgcaacctgcatgattgccatctttaagcaatttggcttatgtattgacaatatgcaaaccattatgattgtcgtaatatggatgtttaattaatactttatgtttaccccgtcccccgttatgtagttaattggcttttgctc

SEQ ID NO: 15685 - DNA, 2301 bp, Sorghum bicolor
  unsure (1)..(2301): unsure at all n locations
  Clone ID: SORBI-28MAY03-CLUS68_1
accatgctgcctactggaagcaagccagtcgagggggccaaagacgatagggcaaacatggccgtcttcatcagctcctccggctcgccagggcgcgccacggcgacgaccacgacgacgacgacgctcctactcgcagtactagcggccgccgctgccgccggcctcctcttggcgccggtcgcggcacgcgggtcaccgcccgagcacgacaagcagctgcagctgcagcagcaggaggacgaccgcatcctggggctgccggggcagcccaacggcgtggcgttcggcatgtacggcggctacgtgaccatcgacgacaacaacggccgcgcgttgtactactggttcctagaggccgacaccgccgacccggcggccgcgccgctcgtcctctggctcaacggcgggcctgggtactcctgcagcggaatagactgccatcctccttcctagtgagaaggctcccttctactgagcaggggagcactgcctgcggcggcgtggctcgtgtgcttgatggcgacgattccgtggtgatccttgagtgttttcatgaataaaaggttaaaagttgttgagatgtatgtggagtagtactatgttgctggtttttttcttccgagctatgaataatgtacaaggcaaacagttggcctggcgatggatctagtgtatgtttctcctggaagccatatatgaataatgcatgttttggttgtacctgtgtacaggaacaggaacaactcacctttcattaacttccaagggttgctggtttccagtggtctgaccaacgaccacgaagacatgatcggcatgttcgagtcgtggtggcaccacggtctcatctccgacgagacccgggacagcgggctcaaggtctgcccgggcacctccttcatgcaccccacgccggagtgcaccgaggtgtggaacaaggccctggcagagcaaggcaacatcaacccctacaccatctacacgcccacgtgcgacagggagcccagcccgtaccagcgcaggttctgggcgccccacggccgcgcagccccaccaccattgatgctgcccccctacgacccctgcgcagtcttcaactccatcaactacttgaatctccccgaggtgcaaacggccttacatgccaatgtcagcggcatcgtagagtacccatggactgtatgcagcaataccatatttgatcagtggggacaggcagccgatgacctgctacccgtctatagggagctcattcaagctggactcagggtctgggtctacagtggtgacacagacagtgtagtgccggtgagttcgaccaggcgctctcttgccgccctggagcttcctgttaaaactagctggtacccatggtacatggccccaaccgagcgcgaggttggtggctggagtgtgcagtatgaaggcctgacctatgtctcaccgtccggcgccgggcacttggttcctgtgcaccgtccggcacaggcgttcctcctgttcaagcaattcctcaagggcgaacccatgccggccgaggaaaagaatgacatcctccttcctagtgagaaggctcccttctactgagcaggggagcacctgtgcggcggcgtggctcgtgtgcttgatggcgacgattccgtggtgtaaccaattgagtgttttcatgaataaaaggttaaaagttgttgagaagtatgtggagtagtactatgttgctggtttttttcttaccgagtctagaataatgtacaaggcaaacagttggcctggcgaaaaaaaaaaaaaaaaaaaaaaagcggccgcgaattnnngcggagctgttccgtgggcgacggctgtcggagaagtcgaaccgggagaagctggacgcgttcgcggcggacgtggtgaaggagcaggagcggcgggcgcggagccccggcctgctgcccaccgtggtgatcaagcagtcgccggccacgccacgccgacgcccgggccgtcgtccgccaccaccgcctcctccaccgctgccaccggccggaccacctccaccatgcgtcgccgggngtcgcaggactcctaccagcagtagctgccgccgcccggccacccgccgcccgctctaagttttgtacatgccgccgtggacagaggaattgcgtcctccccttcccctctgtctctttttctcccacgtcgatgacgatgagccgttgacaggtgggtccaaggacgagtttaaacatggtgaagtgaaagtaagttatatgatgtagtaacttatatatgttgagatggggaagcaaaaaaaaa

SEQ ID NO: 15686 - DNA, 1418 bp, Sorghum bicolor
  Clone ID: SORBI-28MAY03-CLUS476_2
cggacgcgtgggcggacgcgtgggttctcgcactccactactcacagtcaccgccgctgccgcccactgattgtagctagagagcgcaaagggcgcaggaaggaggcgcaggcatgggcttcccttcttcctccctcgcggcggcggcgctcgtgctcctggccctgctcgccggaggaggcgagtgccgcgaggcccagttcgacgcgacggacgcggccggcgccggcgcggagaacttcaacaccagcgacgccgccgtgtactggggcccctggcagaaggcccgggccacctggtacggccagcccaacggcgccggccccgacgacaacggtggcgcgtgcggcttcaagcacaccaaccagtacccattcatgtccatggggtcctgcggcaaccagccattgttcaaggacggcaagggctgcggctcctgctacaagattcggtgcaccaaggacagatcctgctccgggcgggcggagacggtgatcatcacggacatgaactactacccggtgtccaagtaccacttcgacctcagcggcacggcgttcggcaggctggccaagcccggcctcaacgacaagctccgccactccggcatcatcgacatcgagttcaccagggtgccgtgcgagttccctgggctgaagatcggtttccacgtggaggagtactcgaaccccgtctacttcgcggtgctggtggagtacgaggacggcgacggcgacgtggtgcaggtggacctcatggagtccaagacggcgcacgggcccccgacggggcggtggacgccgatgcgcgagtcctggggatccatctggcggatggacaccaaccaccgcatgcagcccgccttctccatccgcatccgcaacgagtccggcaagacgctcgtcgccagaaacgtcatcccggccaactggaggcccaacactttctaccgctccttcgtccagtaccagtagtagcacgtacgtacctgattgattgattgattggatccaagcccagcccagcctagcccgcaattggagtggaattcggctcggctcggttcggtcatcatcatcactacgtacgtactatacgctactaccaatagacgactactactgctaccaagtacggcgaaacggaacggctagtcgttgtgtctctggtcatcgtgtcgttgcagttgtatcatggtccttggagtgagtcgttgcatgcattgggggcgcgcttttaggtcaggcgtcatgtgcgagtgtttgtgggtctgtaaggctggcatgtgcatggtgcgtgaccctaattgcaaaaaaaaaaagagagagagaactaagccgtgtgggaaaatggaggaggcaggcgtacaaggtacgctctcccgcccactattgctttataatttatatcatcatcat

SEQ ID NO: 15687 - DNA, 1587 bp, Sorghum bicolor
  Clone ID: SORBI-28MAY03-CLUS476_1
gcacaccatcgaaacacaaaccaggcagcagcgaactgccaaacttctcctgtctgcctaccgatagctctaatagctgccctctcaagtactagctacacgatggccacctgcacctcccccgtacttgcccgtggtgcacttctcttctcgctccttgcaacgtgtggctcccgcgctacacaagggagctttaacgcctccgacttcacggccgatcccgactgggaggctgccagggcagccgggcacggtgccctcacccgggccggccctggtgacgagggtcgcgcctgtgggttcaaggacgtgaacctgccgcccgtctcggcaatgacattctgcggcaacgaccccttgttcaaggacggcaagggctgcgggtcctggtaccagatacgatgccaaaacaacgatgcctgctccgacaaccctgagccggtgatcatcactgacatgaactactaccccgtgtccaagtaacactccgacttcagcggcacggctttcggcgagagggccagccccggccgccacgacgagctgcggcacgcccgcatcatcgccgtccagttcaagagggtgccctgcgactaccccggggagatgaagaagttccggcgtgcagaagagctcccaccccccctacttgtcgctcctcgtcgacttcgaaggactgcgccggcaacgtagtgcaggtggacctcttggaggcccaactccgggtcgtggacgccgatgcgcgagtccgggcgatccatctggatgctggtctccggccaccgcctcaccgcgccgttcgccctgcggatcaccaacgagtccggcaacacgctggtggcgcacgaagtcatcccggacaactgggtgcccaacacctactaccgttccctcgtccagtcttagcaatatataccctgctgcgcacaataataattctgtgtccttgtggttgattagtagtttggtattagtattgtattgctgcatggactgatgcgcttctgaagaggcgtcctcagtgaagttacgagtcctgagtgttggtggtgcgtggctgctttaaatcaggaatttgaagtccgggccaaagtgggaagctaagttaatttgcaaatgctttcccccccccatgtcaatatatgaatcagagcgatttaggttctatttggttcggtcatcatcatcactacgtacgtactatacgctactaccactagacgactactactgctaccaagtacggcgaaacggaacggctagtcgttgtgtctctggtcatcgtgtcgttgcagttgtatcatggtccttggagtgagtcgttgcatgcattgggggcgcgcttttaggtcaggcgtcatgtgcgagtgtttgtgggtctgtaaggctggcatgtgcatggtgcgtgaccctaattgcaaaaaaaaagagagagagaactaagccgtgtgggaaaatggaggaggcaggcgtacaaggtacgctctcccgcccactattgctttataatttatatcatcatcatcttcttcttcaatccgatcgatcggtgattaatcgaaaagtatattgtaatgtataaacacc

SEQ ID NO: 15688 - DNA, 534 bp, Sorghum bicolor
  Clone ID: LIB5048-009-R1-XP1-F7
ccgggcatcacgttccgcgtgcagcacgggtccaaccccatgtacctcgccgtgctcatcgagcacgagaaccaggacggcgacgtggtgcaggcggacatcatgcagaacaactccggctactgggagcccatgcacgagtcctggggatccatctggaggatcgaccccaaccgcccgctcaggggccccttctccatccgcatcaccaacgagtccggcaagcagctggtggccaagaacattatcccggccaactatgtcgccgacgtcgattaccgctcctacgtccagtatactaattaatcgaccgaccacacggtccatcttaattaagtgttcttttgtttagtggctcggagacttgaggatttttcacctcaataccgtcgtggtgtgtgagctagtgtgtcctgaagatgcgtgggaaattagaggaggcaagcatcaatgtgctctcccgcccacactgtcactctaccattaccagagtgtgtaaccagcaaatcatggttatatataatttatactaac

SEQ ID NO: 15689 - DNA, 736 bp, Sorghum bicolor
  Clone ID: SORBI-28MAY03-CLUS17466_2
gccggccggggcggggccgcatccttagcacctactcccattcgccgcatctctcaatttctcaaatcatccatggagatcaacttgctccacgtgacgggcccctcccacgcatcgctcccggtcccggatagctatgctgtcccgcagctcccacaggcgaaggcgaccccaactgacattaccctgccccttatcgatctgtcccgtagccgcggcgagcttcgccgcgctatcctcgacgccggcaaggagtttggcttcttccaggttatcaaccatggagtcccggagcaggtgttacaggacgtggaggcagtgagtgaagagttcttccagttgccggcggcagacaaggcgcatttctactcagatgatacaaacagacccaaccggctcttctccggctccacatacaagaccagcaaaaggttgtactggatggactgcctccgccttgcgcgcgccttccccggcggcgacagcaagaaagaatggcctgaaaagcccgaggagctccgcaatgtttatgaaaactacactgcactgatgagaggacttgggttggagctgctgcacatgctctgtgagggcctggggctcccttctgactatttcgacggcgaccagagtgccggcgatatgattctcagtgtcatccggtaccctccgtgcccgacgcctgacgtgacgcttggcctgccaccgcactgcgacaggaacctcatcacacttg

SEQ ID NO: 15690 - DNA, 1463 bp, Sorghum bicolor
  Clone ID: SORBI-28MAY03-CLUS17466_1
acggcaagagacagcacaaacaaacgagctagctagcttcttgtaacatcacagtacggtggacttgcattgtgtagcttcgaattctccctaaacaccaacatactccattggccggccacgcatcgatctctcaagtcatccatggaaaacttgctccacgtgaccccgtcccacgtatcgctcctgaatagttatgctgtcccgcagctcccgcaggcgaaggcgacccccacagacatcagcctgcccgttatcgacctgtcccgtagccgcgacgaggtttgccgcgctatcctcgacgccggcaaggagtttggcttcttccaggttatcaaccatggaatcccggagcaggtgttgcaggacatggagtcggtgagtgaagagttcttccagctgccggctgcggataaggcacatttctactcggaggatacaaacaggcccaaccggctcttctccggctccacgtacaagaccagcaaaaggttgtactggatggactgcctccgccttgcgcgcaccttccctggcagcgactgcaagaaagaatggcctgaaaagcccgaggagctccgcaatgtttttgaaaactacactgcactaatgaatgtttttgaaaactacactgcactaatgagaggcctggggatggagatgctgcatatgctctgtcagagcctggggctcccgtctgactatttcgatgaagaccaccggcccggcgcctggcctcccagtgtcatccgataccctccgtgcccgacccctgacgttacgcttggtctgccaccgcactgcgaccggaacctcatcacacgtgtcctctccggctccgtgcctggcctccaggttttctacaaaggtgactggatcatggtcaagcccatacgagattccttcgtcatcaactttggcctgcatctcgaggttgtgaccaatgggatcataaagagcgttgagcaccgcgtgataaccaactcggtgcaagcaaggacgtctgtggtgataaccataaacggcaccgaagattgccttattggacctgccggcgagctccttggtgaaaacaagcccccacgctaccgcactgttacgctccgcgatttcatgcgcatctataacaaatccctcgagaaccctgatgccgctatcaaagaacgcatgaagcccttcatgatatgatgattttatatgtatatgcctgctggttgccttgttctcccacccagacataggcaaggaataatatcagttttgtttatcttgttgctcgtgatccatatgtactagcacacaaaccgtcctccgatggtcatcatgtgtatgtgctatgaagaaccaaaagactcaaatatgttctgaataaaatatacgatctcattgttcttatattacgtactcaatctaattgtttttgtgtttcccctatatatatatcccatcagaccatttaactc

SEQ ID NO: 15691 - DNA, 496 bp, Sorghum bicolor
  Clone ID: SORBI-28MAY03-CLUS874_2
gttactcgcttgaaggctgacaacccactttatggatcttcactgattgattatgcccatattgagcaatggatggactttgctacgacagaggtcgatgcaaacactggaaagtggttgtacccacgtatggggttttatccttatgctgctgtgacagaagaatcggccattgctgccttgaagagagcatttggttccctgaacactcatcttgcatcaaacacattccttgttgggcattcagtgactcttgcagatatcgtgctgacatgcaatctttatttgggctttagccgtatcttgactaagagttttacctcagaattccctcatgttgagaggtacttctggaccatggttaaccaaccaaacttcaaaaaggtcattggagatgtgaagcaggcagaagctgtgccacctgttccaaagaaggctgctccagccaaagagcagaagcctaaggaagccaaaaaggaggcccaaaaagaggccc

SEQ ID NO: 15692 - DNA, 1783 bp, Sorghum bicolor
  Clone ID: SORBI-28MAY03-CLUS874_1
gccggccatcttgattccccacacacctcgtcgctgttgtaagcattcggcggcggcgagccgcagcgacgcagctatcacattaggtgcgcggccctcgccctccgtaaacccctcttccacccgcggcctgctcctgcgatctgcccagcagatctgaggttccgatcggccgtccccgtgaaccagcggcaaccgtcggcatggcgctcgtattgcattctggggctggaaacaagaatgccttcaaggcacttattgctgcagaatacagtggggtcaaggtcgagttgaccaaggattttgagatgggtgtctccaacaagacccctgaatttcttaagatgaacccccttgggaaggttcctgttctggagactcctgatggcgctgtttttgagagtaatgctattgcacgctatgttgctcgtttgaaggatgacaaccctctttttgggtcttcccgtattgaacaagcccatgttgagcaatgggtggactttgctgcaacagaagttgatcctggtgttgcatggtacttgtatccaaggcttgggtttatcccttatgctcacacaaccgaggaaacagctattgcttcattgaagagatcgcttggtgctctgaacacacaccttgcctcaaacacataccttgttgggcattctgttactctagctgacattgtattgacatgcaacctctaccatggaattgcacggatcttgaccaagagcttcacttctgatttccctcatgtcgagaggtatttctggaccatggttaaccagcctaacttcaagaaggtcattggtgaggtcaagcaggcagagtctgtacctcctgttcagaaaaaggccgctcctcctaaggagcctaaggcaaaggatgtcaagaaagaagccccaaaggaggcccccaagccaaaggtggttgaggcaccagcagaagaggaagcaccaaagccaaagccaaagaatcctcttgacttgctgccaccaagcaagatggtccttgatgactggaagaggctatactcaaacacaaagaccaacttccgggaggttgccatcaaaggtttctgggacatgtacgacccagagggctactctctgtggttctgtgactacaagtacaacgatgagaacacggtgtcctttgtgaccctgaacaaggttggtgggttcctgcagcggatggacctggctcgcaagtatgcctttgggaagatgctcgtgataggctctgaggcacccttcaagttgaagggcctttggctcttccgtggccaggaggttcccaagtttgtaatggatgaggtctatgacatggagctctacgagtggaccaaggtggacatctctgatgaggcccagaaggagcgtgtcaatgctatgattgaggaccaggagccctttgagggtgaggccttgcttgacgcgaaatgcttcaagtgagtgtgcttgcctggagccagaactgtttaggccttgaattggatgtttatggaggagtttgcccttttacttgtgtctatgttgatctggtataccttgctgtgaactggttaaagtttgtgttggtttgagaatttttgtctatcttgtggtgcctcagccttcctcatttgaatgttttgccgtaacaatctggccatgtttttttttttttgcttatgtctgagatgttgtgattatgtttttaaaaaacatgcaagaacttgcgagatggtgtggagccatttaggaaacccttctaggacttactatcaaagttttgatct

SEQ ID NO: 15693 - DNA, 682 bp, Sorghum bicolor
  Clone ID: SORBI-28MAY03-CLUS1320_5
agccgaaggaaaaatttccccccaaccaaaagcggtctctcccaaacccctagctaccttcggatcccgatggcgaacccgcgcgtcttcttcgacatgacggtcggcggcgcggcggcggggcggatcgtgatggagctgtacgcgaacgaggtgcccaacaccaacggctcccaggtgtgtcatctgcaccgtcgataccccctggctcgacggcaagcacgtcgtctttggccaggtcgtcgagggcatggacgtcgtcaaggccatcgagaaggtcggatcccgcagcggatccacctccaaggaggtcaagatcgctgactgcggccagctcagctagatcgttggtctggtctgcccgtccgccctccctcccgtcatcgtccactccgcctgcgtcccgtcccgtttccggtttgcttcgatctgaataagatgatggtgatctgagtggtggtctgagttgagtcgtttatttatcatgtgcgtctgtctgtgtcgctcgcggtttaatctagcggtgtaggtgtggatctccgaatcccatggcgcctctgcttacttcgtgtttcatcaccagttatatgttatgagatccaggataatgcattaatgctatgagaactgagattcggtttaaaaaaaaaaaaaaagggcgccctcgcgatctagaactagt

SEQ ID NO: 15694 - DNA, 900 bp, Sorghum bicolor
  Clone ID: SORBI-28MAY03-CLUS1320_3
atccgtcaaaatctacgaagggcgaccaggcgaggctaggagagagaggaaaacgagtgagaaggaggtgggaaaaaaaaaatgctgcgccacgccgcccgccgtctcgtctcccgcaccgctgcggcggcccctgcccgccgggcgctcgccacggcggaggtgcctgcggaggccggcgaggactccacgttcgtggaggcgtggagaaaggtcgcccccaacctcgagcccccaacgacgcccctctccctcatgaagccgcgcccgcccacgccggccaccatccccaccaagctcaccgtcaacttcgtcctcccctacaagtccgagatcgccaacaaggaggttgacatggtaattgtaccagctacaactggtcagatgggtgttttgccaggccatgttgccacaattgcggagctcaagcctggtgttctctcagtacacgagggaaatgatgtgaccaagtactttgtgagcagtgggtttgctttcgtccatgcaaactccattgctgatattgtggctgttgaggctgtccctgtggatcagatcgacccagcattggttcagaagggtctcgcagacttcactgccaagcttggttcggcctctactgacctggagaaggctgaggctcatatcggagtcgatgttcacagtgcgctcaatgctgcattgactggttaattggtggcatcttaaattgtctgtttttttcattgagtctaagtttgcaaactcatggacatgggatggagggaatgatcctaaataaattatactccatctaaaacatggacatttgttccttgttacctgaatcctgcatggatttctttgtgcactggtaaatattttaactttgagctcaagacctggagctgttattttttt

SEQ ID NO: 15695 - DNA, 1027 bp, Sorghum bicolor
  Clone ID: SORBI-28MAY03-CLUS1320_2
tgtgcggcgctcgagccggccgggccgggcccgaaacgcaacccgccgtcgcgcgcgcccgcccggctattttaccgcaccagtcctccgtccgccacgggagatcagatcacagaacgcaacagccgaaggaaaaatttccccccaaccaaaaaccctctctcccaaaccctagctaccttcggatcccgatggcgaacccgcgcgtcttcttcgacatgacggtcggcggcgcggcggcggggcggatcgtgatggagctgtacgcgaacgaggtgcccaagacggccgagaacttccgcgcgctgtgcacgggcgagaagggcgtggggaagtccgggaagccgctccactacaagggctccaccttccaccgcgtcatcccgcagttcatgtgccagggcggcgacttcacccggggcaacgggaccggaggcgagtccatctacggcgacaagttccccgacgagaagttcgtgcgcaaccacacggcccccggggtgctctccatggccaacgccgggcccaacaccaacggctcccagttcttcatctgcaccgtcgataccccctggctcgacggcaagcacgtcgtctttggccaggtcgtcgagggcatggacgtcgtcaaggccatcgagaaggtcggatcccgcagcggatccacctccaaggaggtcaagatcgctgactgcggccagctcagctagatcgttggtctggtctgcccgtccgccctccctcccgtcatcgtccactccgcctgcgtcccgtcccgtttccggtttgcttcgatctgaataagatgatggtgatctgagtggtggtctgagttgagtcgtttatttatcatgtgcgtctgtctgtgtcgctcgcggtttaatctagcggtgtaggtgtggatctccgaatcccatggcgcctctgcttacttcgtgtttcatcaccagttatatgttatgagatccaggataatgcattaatgccaaaaaaaaaaaaaaaaaagtcttaaaaaaaaatgcgatac

SEQ ID NO: 15696 - DNA, 1068 bp, Sorghum bicolor
  Clone ID: SORBI-28MAY03-CLUS1320_1
ctgtgcggcgctcgagccggccgggccgggatccaccaaatcctcttccgcctctcctcgattaacaaatcccccaaccactccagatccccaaaaccctagccgcccccaccctccggcgatggcgaacccgcgcgtcttcttcgacatgacggtcggcggcgcaccggccggtcgtatcgtgatggagctctacgccaacgaggttccccgcacggccgagaacttccgcgcgctgtgcacgggcgagaagggcgtggggaagtcgggcaagccgctccactacaaggggtcgacgttccaccgcgtgatcccggacttcatgtgccagggcggcgacttcaccaggggcaacgggacgggaggtgagtcgatctacggcgagaagttccccgacgagaagttcgtgcgcaagcacacggggcccggggtgctgtccatggccaacgctgggcccaacaccaacggctcccagttcttcatctgcaccgtgccgacgccctggctcgacgggaaacacgtcgtgtttgggcaggttgtggaggggatggatgtcgtcaaggcgattgagaaggttgggtctcgcagtgggtccaccgctaaggaggtcaagatcgccaactgcggccagatctgataggtgtcgagcttgccgccgccgccctccgtcgttcgtcatcggctcgtcgtcctcccccctcctccttccatgctcctgttcaattcccttccccttcctcgctctgaataagatggcgtactgtcggtgatctgagaggtggtttgagtacttgagtctgaatttgtgtccctagtgtcgtttgtgtcatctgtccgtttaatcgttggtggtgactagggtttcataggtggccgatccgtggatctggtgtatcttgcctgcctaattatttcgtcgtcgtgtttctgctgtgtaatggtgtgatcgggcatgatgattatgctaagacaactgctgaaacttgctttccaggataatgcattaatgctatgagaactgagattcggtttcaaaaaaaaaaaaaaaaaaaaaaaaaaaaaaaaaac

SEQ ID NO: 15697 - DNA, 717 bp, Sorghum bicolor
  Clone ID: LIB5048-003-R1-XP2-A10
ctccagactacgcacatctgcgttgcagctctcatggatcgaatccgtcaaaatctactaagggtgaccaggagaggataggagagagaggaaaacgagtgagaaggaggtggggaaaaaaaaatgctgcgccacgccgcccgccgtctcgtctcccgcaccgctgcggcggcccctgcccgccgggcgctcgccacggcggaggtgcctgcggagtgccggcgaggactccacgttcgtggaggcgtggagaaaggtcgcccccaacctggagccaccatccaccgcccgatccctgacttcatgtggcacggcggcgacttcaccaatggcaacgggactggaggtgagtccatctacggcgagaagttccccgacgagaagttcgtgcgcaagcacacggagcccggcgtgctgtccatggccaacgctgggcccaacaccaacggctcccagatcttcatctgcaccgtgccgacgccctggctcgacgggaaacacgtcgtgtttgggcaagttgtggaggggatggatgtcttccaggcgattgagaacgatgggtctcacagtgggtccaccgctaaggaggtcaagatcgccaactgcggccagatctgataggtgtctagcttgccgccgccgccctccggcgttcgtcatcgactcgtcgtcctcccccctcctccttcaatgctcctgatgaattcccttcccctt

SEQ ID NO: 15698 - DNA, 431 bp, Sorghum bicolor
  unsure (1)..(431): unsure at all n locations
  Clone ID: LIB3478-035-P1-K1-A10
ggggagaggctgcgagagggaagcgaggagagagagagggtgagggtaaggggaggcgccgacgccgagttcttgctccatcccgcggcggcggggcggatcgtgatggagctgtacgcgaacgaggtgcccaagacggccgagaacttccgcgcgctgtgcacgggcgagaagggcgtggggaagtccgggaagccgctccactacaagggctccaccttccaccgcgtcatcccgcagttcatgtgccagggcggcgacttcacccggggcaacgggaccggaggcgagtccatctacggcgacaagttccccgacgagaagttcgtgcgcaaccacacggcccccggngtgctctccatggccaacgccgggcccaacaccaacggctcccagttcttcatctgcaccgtcgataccccctggctcga

SEQ ID NO: 15699 - DNA, 1959 bp, Sorghum bicolor
  Clone ID: SORBI-28MAY03-CLUS2488_1
atctgccgccgccgccgccccccaccccctggctccgcggcgtccctcttctcttcttctacaaatagtcccggccggccgcggaggctagggggaaaaccgcaaacgccaccagcccaccacagatagcgagcgagcgagcgggcgagcgcttctagggcttttttttttcgagatggcggtcacgatcacgtaaagcgcaaacgccaccagcagcccaccacagatagcgagcgagcgagcgggcgagcgcttctagggcttttttttttacgagatggcggtcacgatcacgtgggtgaaggcgaggcagatcttcgacagccgcggcaaccccaccgtcgaggtggacatcggcctcagcgacggcagctacgcgaggggtgccgtgccgagcggcgcatccactggaatatatgaggccttggagttgagggatggaggatctgattatcttggcaagggtgttcttaaggctgtgagcaatgtaaatagcattattggaccagcaattgttggaaaggaccccactgagcaggttgagatcgacaacttcatggtccaacagcttgatggtacctccaacgaatggggctggtgcaaacagaagcttggagcaaatgccattcttgcggtttcacttgctgtgtgcaaagctggagctatggtgaagaagattcctctttaccagcacatcgcgaatcttgccggaaacaaaactctggtgctccctgtacctgcctttaatgtgattaatggaggatcacatgctggaaacaagcttgccatgcaggagttcatgattctcccaactggtgcctcctcgttcaaggaggccatgaagatgggagttgaggtgtaccacaacctgaagagcataatcaagaagaagtatggtcaagatgccacaaatttggaatggatgttgctgcttctgcattctatagtgagaaggacaagacgtatgatcttaatttcaaggaggagaacaacgatggttcaaacaaaatttcaggtgacagcctgaaagatctgtacaagtcctttgtgtctgagtaccctattgtgtctatcgaagatccattcgatcaggatgactggaccacttatgccaaactcactgatgagattggacagcaagtgcagattgtaggagatgatcttcttgttactaaccccactagggttgccaaggccatcaatgagaagacctgcaatgctcttctcttgaaggtgaaccaaatcggctctgtgactgagagtatcgaagctgttagaatgtccaagcgtgccggatggggtgtgatggcaagccacaggagtggcgagactgaggacaccttcattgctgacctctcagttggcctggctacgggccaaatcaagacaggagctccctgccggtctgagcgcctggccaaatacaaccagctcctcaggatcgaggaagagctcggtgatgccgcagtctacgccggagcaaagttcagggcaccagtggagccctactaaaccacgagagcccagagtctggagaaagaagacgaggatgtttcttgtggagctactagttcgctgctgctttttgatagaatgtctgtactatcacaataaaagtatggtcttgtttgccggagagctacactagtgattttgtcgtgggaacaaaaaaaaagaaaaaaagaactgtttttctagatatgagtgatggagtggtggtccgcactcgttgtaatatcgttgcccaaactgattttgatgggtactccacagaaagcaagcgactttcttgtttcttttgctctatgaaacattttcgtattcggcatggaaattctttactatggctttgcttttatcggcagatggagccatagctgcatcttgcacaacagaaaatcattatgatcttgccatatgctagagactttctatcttttgctctgttattaagccatt

SEQ ID NO: 15700 - DNA, 685 bp, Sorghum bicolor
  Clone ID: LIB5048-011-R1-XP1-G3
ccgtgatgttcaccgtgaccaccagagaccccgatcccacccccgatccccttccgtaatctgcaagtccctcgtcgccggtggcgtcgcgggaggagtgtggacatcggcctcagcgacggcagctacgcgaggggtgccgtgccgagcggcgcatccactagtcacgtactgctgttgctccactccaacgattgaaaatcttgcttcaggtcacgtgctgctgttgctcgactcgaacgattgagaatcttgcttcaggatccgagcaatgttggacgatgctgaggagcactggaacatacgtgaggagtctgccaagctgcggctcaaggagctgaaggagctcgcgtatgacatcgaggacgttgtagacgaatatgagtatgaggtcctccatcgatctactggcttgtacagaactggcaagcgcaagcaccgggaggaaactgaggcctatccggtggatactggtatagtggaagttcctaatgacttggttcttcaagcgagaaaactaatcagaaggttggatgatatcaaatattattctgaccgtttgagtttatcagagaatgatggtgagagacggtatacaccggatattagtagtgtgcgacatactagctctgttgtatttgagaaagacattttggggcgagaccaggacaaagagaagataatt

SEQ ID NO: 15701 - DNA, 442 bp, Sorghum bicolor
  Clone ID: LIB3476-030-P1-K1-D8
accagagaccagacccccgatccccttccgtaatctgcaagtccctcgtcgccggtggcgtcgcgggaggagtgtggacattggcctcagcgacggcagctacgcgaggggtgccgtgccgagcggcgcatccactgggagaagcgcttggcattggacgcgagccacgcacacatttagcatttttgagtagtatattgttcttcctattgtcatctgtcatcactgccttttgttcaggagaaatggtctttgctcattgatgtgcttcattttggcttggaaattaaacaaattactattgtcgtggaatctggatgactattagtgtccctgcatgctctaaattacttcatttctgatttgcacaggtcacgtactgctgttgctccactccaacgattgaaaatcttgcttcaggtcacgtgctgctgtgctcgac

SEQ ID NO: 15702 - DNA, 135 bp, Sorghum bicolor
  Clone ID: LIB3480-010-P1-K1-G7
gtgattttgtcgtgggaacaaacaaaaaaaaactgttttttttgggtgatgagtggcgggccgcactcgatgtaatatcgttgcccagactgattttgatgggtacgcaacaggaagcaaacgacttcttgtttc

SEQ ID NO: 15703 - DNA, 1599 bp, Sorghum bicolor
  Clone ID: SORBI-28MAY03-CLUS19058_1
gcacgagggcagacacgacgccagagaccggctagctccctccgccccgccgtggcggccctcgtcgccgtcgccgccctcctctccctcgccggcccagccgcggccacggggaacaccggccccgtgacggccttctcgggccgcaacgagcccgagggcacgctccgcgaggcctgcgacacgggcgcctacaccaatcaaacaaggcatcaatggcggtggcaagaagcaagagaccagctagctccctcctgcccgccgtggcggccctcgtcgccgtcgccggcctcctctccctcgccggcccagccgcggccacagggaaaaccggccaggtgacggtcttctggggccggaacaaggccgagggcacgctccgcgaggcctgcgacacgggcacctacaccatcgtcgtcatctccttcctcagcgtcttcggccaaggcggcaacaagccgcccactctagacctctccggccaccccatcgccggcatcggcgacgacatcaagcactgccagtccaagagcatcatggtgttcctctccatcggcgggttcggcgaccactactccctccccagcgccaaggccgccacggacctcgccgactacctctggtacgcctacttcccagcgcccacgccgcgcgccggcgtgcaccgcccgttcggcgacgcctacgtcgacggcctcgacttcttcctcgaccgcggctcgccggcgtactacgacgtgctggccaagcgcctgtggagctacaacaagcagttccgcgcccggacgcccgtgcagctgtcggcgacgccgcggtgcgcgttcccggaccgccaggtgcagcgggtgctcgccacggggctcgtcaccagaatcaacgtcaggttctacggcgacgcgcactgcgccgcgtactggcagcaggagtgggacaagtggacggcggcgttcccggaagactccatctacgtcggcctgccggcgtcggagcagacggtcgggtacgtccaccccaagaacctctactacggcgtcgtccccgtggtgcagaaggcggccaactacggcgggttcatgatctgggaccgatacgccgacaagaagaccaattacagtagctacgccattgaatgggcttgatcgatgatcagagctccatctccatccatgccgtctactctgtcagtctgtctctgtgtgtatctactgtagtgttgtccatctcctcactagtgtgcttgtgtgcaagaataaagtgaggcaagtgcatcaataaaccgttgataatatcgtcgctagttttgtacacgatcctctggaaatattcagcatctggcatggatacgaatttaagttcagaggatcacaccgagaccacaactgctgaattgtggagagcaaaaaaaatcaagaacaaatgtaaatgtcacgtggcattttttttttttctgaagagagccggacagccaaaaacaacatggcccgtctgcagaacccagaacgaatcagctacgcatctgtttcggtagcacatggatttgttcttctggaacagaacagagaaatttcaggaataataataaaggcaaactacattctc

SEQ ID NO: 15704 - DNA, 732 bp, Sorghum bicolor
  unsure (1)..(732): unsure at all n locations
  Clone ID: SORBI-28MAY03-CLUS9424_3
ngccggccgggccgggactcattcttggccaatacactagaacagataaatttggcctcttgtttagttggcaattttttttagttttgtagcactttcgtttgtatttgataattattgttcaatcatggactaactaggctcaaaaaaaaaaaaaaaaaaaaaaaaaccggccgggccaggatatacctggacgcgaattgtgtaccgtgcctttccccatcagcatgtccaccgactgcaacaaggtcagctaaatgatgaaatctaccacgtaagtacataccagtgcacgtgatgaagctagcaagccaggaaaaataaaataaagttgtgtggtaacatacaggaggattaatagcatgctgtatctatatagtattatgtaaccgtgtgcatcatgcactgtgcacatatacatatatatatatatatatgtatgtgtggcttgcagtgcgacctagctagcttctcgatcatgatgtgctcatgcatgtatgcggatgatgtgtgtgtgtgaacagctactacactgttgactgttcagtggcttggatcgacctacttgttcggatagttaatggtttgctatatagcggtgcttgttaatcagaaaaaaaaaaaaaaaaaaaaaaaaaaaaaaaaaaaaaaaaaaaaaaaaaaaacctagggctaccaaaagccacaaaaaaaccatatcagcaacaaaaaaaaaaaaaaaaaaggccccta

SEQ ID NO: 15705 - DNA, 573 bp, Sorghum bicolor
  Clone ID: SORBI-28MAY03-CLUS9424_2
gccggccgggtcgggaaaatagagctcctgcccggcacctaatgctgcagcaagcaagcacagcactgtcatcaaccacacacactcacacacgtctcaaactgacggcgacgatggctgtggtgagcaggaagacgtcgacgatggtggcagcagtggccgtggtggtggcgctgctgctggcgtcggcgtcgtctgcgtcggcggcgatcacctgcggtcaggtggggacggcgctggcgccgtgcatcccgtacgcgacggggagggcgagcgcgctgccgtcgtcgtgctgcagcggcgtgcgcagcctgaacgggcaggcgcgcagcagctcggaccggcaggcggcgtgccggtgcctcaagagcctcgccaacagcgtcaagagcgtcaacatgggcaccgtcgccaccatccccggcaagtgcggcgtctccgtgcctttccccatcagcatgtccaccgactgcaacaaggtcagctaaatgatgaaatctaccacgtaagtacataccagtgcacgtgatgaagctagcaagccaggaaaaaaaaaaaaaaaaaaggccccta

SEQ ID NO: 15706 - DNA, 948 bp, Sorghum bicolor
  Clone ID: SORBI-28MAY03-CLUS9424_1
gcaagcggcggttcagaagccgaaactgtcaacggccggccgggccgggagcaagcaagcacagcactgtcatcaaccacacacactcacacacgtctcaaactgacggcgacgatggctgtggtgaacaggaagacgtcgacgatggtggcagcagtggccgtggtggtggcgctgctgctggcgtcggcgtcgtctgcgtcggcggcgatcacctgcggtcaggtggggacggcgctggcgccgtgcatcccgtacgcgacggggagggcgagcgcgctgccgtcgtcgtgctgcagcggcgtgcggagcctgaacgggcaggcgcgcagcagctcggaccggcaggcggcgtgccggtgcctcaagagcctcgccaacagcgtcaagagcgtcaacatgggcaccgtcgccaccatccccggcaagtgcggcgtctccgtgcctttccccatcagcatgtccaccgactgcaacaaggtcagctaaatgatgaaatctaccacgtaagtacataccagtgcacgtgatgaagctagcaagccaggaaaaataaaataaagttgtgtggtaacatacaggaggattaatagcatgctgtatctatatagtattatgtaaccgtgtgcatcatgcactgtgcacatatacatggatatatatatatgtatgtgtggcttgcagtgcgacctagctagcttctcgatcatgtgctcatgcatgtatgcggatgatgtgtgtgtgtgaacagctactacactgttgactgttcagtggcttggatcgacctacttgttcggatagttaatggtttgctatatagcggtgcttgttaatcaaaaaaaaaaaaaaaaaaaaagctacctaggcatcttccgatcaagaaaacaaaaaaggatttcagacacgacttaatcaacacccgtcttagccgcggatccagatgac

SEQ ID NO: 15707 - DNA, 1069 bp, Sorghum bicolor
  Clone ID: SORBI-28MAY03-CLUS1381_3
gccatggagggcgacagcaccaacctcgacgcggcgatagagtcgctcctcaatgtcgagaagcagatgaggctggccggcgatgtcgccggcacgcggaaggccgtcatcgacatcgtcgagctctgctacaaggccggcgcgtggaagacgctcaacgaccagatcgttctcctctccaagaggagaggccagcttaagcaggccattactgccatggttcaaaaagcaatggactacatgcggccgggccgggttgctgcagcgtccgtcgccccctttcccctccccatccccgcgggccgccagaggcaaattcgacctcgattcgtccccgcttcgcccggccgccagcgggattccctccgccccgcgcggatctgaccgctgcgctccgtcaccacgccgctccaatccgccatgaagggggccaaatccaagggcgccgccaaggccgatgccaagctggcggtgaagagcaagggtgcggagaagcccgccaagggcaggaaggggaaggccggcaaggaccccaacaagcccaagagggctcccagcgctttcttcgtcttcatggaggaattccgcaaggagttcaaggagaagaaccctaagaacaagtctgtcgctgcggtgggaaaagctgccggtgacaggtggaaatccctcagcgaatcggacaaggctccctatgtagccaaggctaataagctcaagctagagtataacaaggccattgctgcctacaacaagggcgagagcaccgctgctgctaagaaggctcctgccaaggaggaggaggaggaagacgaagaggagtctgacaagtccaagtcggaggtcaatgatgaggatgacgacgagggtagcgatgaggacgaagacgatgacgagtgatggagcttgctctgagacgatggaccatgctttgtccaacaatggagctgcgacagaaaggccctgtggcgaaaaattataggagccttatatccatgtcctagaattattcagtttcacttcacaccgtgatgttttaccttttgtcgtgctataacggatagcgctcctt

SEQ ID NO: 15708 - DNA, 940 bp, Sorghum bicolor
  Clone ID: SORBI-28MAY03-CLUS1381_2
ccggtgtcgacccacgcgtttctctagtatctatccctccctctagcagggggagggaggcgagcttgctctagtacacacgaacgaacggtacgtacgtccatcgctagctcgctcgccatggcctccctctcctctgccaccatcaccgccccttccgccttcgccgcgccggccgcccgcgccgtggccaggaggtcgtccttcaccgtgcgcgcctctctcggcaaggccgccggcacggccgccgtggccgtggccgccagcgcccttcttgccggcggcgccatggcccaggaggtgctgctgggcgcaaacggaggcgtgctcgtcttcgagcccagcgagttcaccgtcaaggccggcgacaccatcaccttcaagaacaacgccgggtacccgcacaacgtcgtcttcgacgaggacgaggtgcccagcggcgtggacgccaccaagatctcgcaggaggagtacctcaacgcgccaggcgagacctactccgtcaccctcaccgtgccgggcacctacggcttctactgcgagccgcaccaaggagccggaatggtcggcaaggtcaccgtcaactaactacgtcctactactagtatcttctccatatatattgcgccgccatggatccggccaccatgcatattcctcctcctcctcctcctcctcctcctcctcctcctcctcctccttactagctgttgcatttcctgctttatttgtactccggtccacatgcatcctcgattatccaccgtccgtaccatcgatcgatctcttctttcacaccaacaatgcaagaagcagtgccgtgcagtgtgtgtatgagagtgagagctagagacccgccttctttttgtttgctgatgaatcgatacagtggtcatcgtgatctatgttcactactgcactacccatttcagtcacaaaa

SEQ ID NO: 15709 - DNA, 1798 bp, Sorghum bicolor
  Clone ID: SORBI-28MAY03-CLUS1381_1
cgaggactgggttcccaggccgtcctccggcgggctggccggccagaggcctcttgcttcttgctgctatctagtatctatcctccctctagcagcttaattagcagcttgctctagtacacacgaacgaacggtacgtacgtccatcgctagctcgctcgccatggcctccctctcctctgccaccatcaccgccccttccgccttcgccgcgccggccgcccgcgccgtggccaggaggtcgtccttcaccgtgcgcgcctctctcggcaaggccgccggcacggccgccgtggccgtggccgccagcgcccttcttgccggcggcgccatggcccaggaggtgctgctgggcgcaaacggaggcgtgctcgtcttcgagcccagcgagttcaccgtcaaggccggcgacaccatcaccttcaagaacaacgccgggtacccgcacaacgtcgtcttcgacgaggacgaaatgcccagcggggtggacgccaccaagatctggcaggaagagtaccctaacgcgccaggcgagacttcctcaggcacctctaccgttggaggcaccaaatccctctactaacagcagcaggaagccccggcagtgaagggtaataatccctcactagagcagaccagggccactagtacctacagcataggcgagagcacctcgggtattaagagggcatctgtgaaggaggaggaggaggaagaccaactgctgtttgacaagttcatgtcgaaggtcaatgatgagtatgacgacgagggtagcgatgaggacgaagacgatgacgtgtgatggatcttgatctgagacgatggaccatgctttgtccaacaatggagctacgacagaaaggccctgtggcgaaaaactataaggatcctatatccatttactataattattcagtttcacttcacatcgtgatgtttttacttttgtcgtgctataacggatagcgctccttgttggcgccaccggcgggtggttttgcttctggtctggtgtgtggccacactggaccagcagagacgcccgcttgtacctagattactgtttccattgtcgtcatcggctaacattgtgataatataagtttgggtaatgttagattgagtatttagtttccaaggctgcagaagatttgaagctgaggattatcgaacataatatcttggtcgtgtccaaatactattcgaggattaccctcaagaggcttgcagatcttctttgcctgagtttgcaggaggcagagaagcatctttcagacatggtgaactcaaaagctttgattgcgaagattgacaggccgatgggagttgtcagtttccagacgactaaagattgtaacggtgtacttaactcatgggctaccaacctcgagaagcttctcgacctggtcgagaaaagctgtcaccagattcacaaggaaaccatgatccataaggcggtgttgaaagcttgagtgtttgtgtttgcccattttggtttaggtctccctggtagccctgccgtggtgttaagatagtgtaacggcaggactctgaattgagactatttcagattaaccggtggtgtcaagtggaagatcatttaagatgaaccagtgttctgtcaaatgaattacacatggacaggataataattctctgtatctcaagaaaccagtcgccgtagagtaattctggattcgtgtcctgatgggagattttggttgaattcgttggtccttggtggcacttgttacgggtcacacattctataacaaactaacattgttgttttgct

SEQ ID NO: 15710 - DNA, 496 bp, Sorghum bicolor
  Clone ID: LIB3476-028-P1-K1-C9
ttggaaatctgccgttgttacaaggctatttatgatattccagcaattaaagaggatccaacaaagtggataccgattcttaggaagatctgttggtacttggtgctagcacctcatgatcctatgcaatcgagccttctcaatgctacactagaggataaaaacctttcagaaatcccaaatttcaggttattgctgaagcagctggtcaccatggaggtgatacagtggacaaatttgtgggaattcttcaaggaggaatatgagaaagaggagaatcttctcgggggagctttgggtgccaaagcttcagaagatttgaaactgaggatcatcgaacataatatcttggttgtgtccaagtactatgcaagggttaccctcaagaggcttgccgatcttctttgcctgactttgcaggaggcagagaagcatctctcagacatggttaactcaaaagctctgattgcaaagatcgacaggccgatgggagttg

SEQ ID NO: 15711 - DNA, 376 bp, Sorghum bicolor
  Clone ID: LIB3476-060-P1-K1-G12
gcaagattatgtcagagcacaaattttatcaaggaaaattagtactagagtatttgaagcagatccatcgaaggaaaaaaagaaaccaaaggaaggggacaatattgttcaggatgctcctgcagacattccatccctactagaattgaagcgcgtctactatgaactcatgattcgatattacatgcacaacaatgattacctggaaatctgccgctgttacaaggcgatttatgatattccagcgataaaagaggatccaacaaagtggataccgattcttcggaagatctgttggtacttggtgctagcaccccatgatcctatgcaatctagccttctcaatgctactctcgaggacaaaaacctttcggag

SEQ ID NO: 15712 - DNA, 219 bp, Sorghum bicolor
  unsure (1)..(219): unsure at all n locations
  Clone ID: LIB3481-009-Q6-K1-D1
tcgactacgcgtccgtgatcctatgtcactgaagatatgttgaaacaagttttcaccccttgntggggaagtggtccatgttaagatccctgttggcaagagatgtggttttgttcaatatgctaacagatcttctgcagaggaggccttggtaattctgcaaggcaccttggttggagggcagaatgtgaggctttcatggggncgcaacccttcaaa

SEQ ID NO: 15713 - DNA, 1993 bp, Sorghum bicolor
  Clone ID: SORBI-28MAY03-CLUS8141_1
aatacttctccgaaacaaattctccggaacagcctcccccgcaacgacttccgcttccgcttccttggataaccacaccacctgccccgaccgccctcagccatggagaaggcgatcgatcggcagcgggtcctcctggcgcacctcctcccctccgcctccgcctccgcctcctccgcgcagcctcagcttgcggcgtcggcgtgcgcggccggggacagcgccgcctaccagaggacctcctccttcggggacgatgtcgtcgtcgtcgctgcgtaccggacgcccatatgcaaggccaagcgaggaggcttcaaggacacctacccagaggacctcctcactgttgttctcaaggctgttctggacaacactagaatcaatccagctgacattggtgacattgtggttggtacggtgcttggtcctggttcccagcgtgcaatcgagtgcaggacggctgcgttgtttgctggattccctgaaaccgttcctgttagaactgtcaaccgacaatgttcatctgggcttcaggcagtagccgacgtcgcggctgctataaaggctggttactatgacatagggattggtgctggtttggaatccatgtccataaattccatgggttgggaagggcaagttaacccaagaataactgaactccagaaagcacaggattgtcttctgcccatgggaattacttctgaaaatgtcgcccatcgatatggtgtaaccaggcaagagcaagaccaggctgctgctgagtctcataggagagctgctgcagccacggcctctggaaaattcaaggatgagatcgtccccgtgccaacaaagattgttgatcctaaaactggagaggagaagaaagttgtgatatcagttgatgatggggttaggccagggaccacagcatctggattggcaaaacttaaaccagtttttaaaaaggatgggactacaactgcaggcaattctagtcaagtgagtgatggtgctggagctgttcttctcatgaaaagatctgtggctctgaagaaaggacttcctattcttggtgttttcaggagctttgccgctgttggagtggatccagctgttatgggtgttggtcctgctgtggccattcctgctgcagtgaaatctgctggccttgagattggagacattgatctgtttgaactgaatgaggcctttgcctctcaatttgtttattgctgcaacaagttgggcctggaccgttccaaagtaaatgtaaacggaggcgcgattgcccttggacacccactgggtgcaacaggtgcccggtgtgtggctactcttctaaatgaaatgaagcgccggggcagagactgcagatttggcgttgtcaccatgtgtatcggatctggaatgggggcagcagctgtgttcgagcggggagatgctgtggatggactctccaacgtgagggacacccagacacaaaattttctgtcaagggatgcaaagtagaggtgcagaaaaatcatccatccgagagcaacataagcctgctacattagtactaatacgacatccgtatatttttttcttcacaaacactactctgtatacgacaaataaaagggcgtcatgcagtatcctcttgtagccacctaagatgcgaaatcagaaaagaaaagggccgggtgttgtagacagctcaatgttctgagcttgttctgttattgccttttgtctcagactgaacaaacagcaaaaatcttgctcgttgccttgtgtgtatttgaaccagaaggatgaagagcgcctttgtgcactgggctgattaaaatccccaatctgctgttgagacgcttgcttgctataccactgttgtctggcaatagtagttggccgcattttgtccagtgtgctggatggatgaactggtaaccgattcagcagtgtagcttatagttgtaggtgctgtttgttaagataggccatgcctgaaatggctccatcattt

SEQ ID NO: 15714 - DNA, 1838 bp, Sorghum bicolor
  unsure (1)..(1838): unsure at all n locations
  Clone ID: SORBI-28MAY03-CLUS302_1
gcgactggaaggaaagaaaggaagggcctcctgtccacctctcatccctcctctccctagctagcaagctctagccttcctgtagcgcgtcggagatgggcgcctccaccaccacgtcgctggcggcggcggcggcagcgctgctgctgctcgtgtcgctcgccgcggcggcggacatgtcgatcatctcctacggggagcggagcgaggaggagacgcggcggatgtacgcggagtggatggcgacgcacggccggacctacaacgccatcggcgaggaggagaggcggtatcaggtgttcagggacaacctccgcatcatcgacgagcacaacgccgccgccgacgcgggcgtccactccttccgcctggggctcaaccgcttcgccgacctcaccaacgaagagtaccgcgccacctacctcggcgtcaggaccaagccgcagagggagaggaagctcagcgccaggtaccacgccgacgataacgaggacctgccggagtccgttgattggaggaccaagggcgccgtcgcggaggtcaaggaccagggcagctgcgggagttgctgggctttctcaacaatagcagctgtggaaggcatcaaccagattgttacgggcgacttgatctccttgtctgagcaggagcttgtcgactgtgacacttcatacaaccaggggtgcaatggaggtctgatggactatgcgtttgagttcatcatcaacaatggtggaatcgacacagagtctgattacccttacaagggcacagatggccggtgtgatgccaacaagaaaaacgcgaaggttgttactatcgacagctatgaagatgtaccagcgaacagtgagaagagtctgcagaaagcagttgcaaaccagcccgtcagtgttgctattgaggctggtggcaatgcatttcagctctacagctcgggtatcttcactggaaagtgtggaacagcgttggaccatggtgtcacggccgtcggctatggcacagagaatggaaaggactactggatcgttaagaactcatggggcagcagctggggcgagtccggttacatcaggatggagcgcaacatcaaggactccagcggcaagtgcggtatcgccgttgagccatcgtaccccctgaaggagggcgccaaccccccgaaccctggcccgactccgccgtcccccaccccagagcccagcgtctgcgacaactactactcgtgccctgagagcaccacctgctgctgcatctacgagtatggcaagtactgcttcgcctggggctgctgcccgctcgagggcgccacctgctgtgacgatcactacagctgctgcccccatgactaccccatctgcaacgtccagcagggaacctgcctcatgggcaaggacagcccactgtcagtgaaggctacgaagcgcaccctggccaagccgcactgggctttttctggcaacactgatggcatgaagagcagcgcttgagaaaacgcagcatggcattaaggccgtcaacagccagggtgattagagccccagcatgcaaaatgatcacctggtcgctcattcatgactaaagcatggctcggcggtcgctgtttacctatatccctatagtaggtactcctgtacataaagcctgaaaaaatgggttcagttgtttatcgaactctgccaaatttgcttttgcatataatgtaaaattcagctagctctgctaagctcctcgcttcagttcgacagaactgcaattgatattgatgttatggaaattgatattggaacaatcagcaatattatgcttatattcatttcttgggcggcctcanaaaa

SEQ ID NO: 15715 - DNA, 1974 bp, Sorghum bicolor
  Clone ID: SORBI-28MAY03-CLUS8236_1
ccttcccgagcctcccctgccccgccctgcccggcccttctcaccccgccacagccgaatcgaatccgagacgccgcgtttttctctctcctgcgctgcgccgtccctcagcctcacctccgccgccgaatccgagactccgatctcgggttcaccgcagcgcacagagcacccccaccgactgtcccccggcccgatccgcgctctcatctccgtcgcttcagtcatggcaggaatggcacctgagggttctcagttcgatgctaagcactatgattctaaaatgcaggagctgctgagcactggtgagactgaggagttcttcacttcatatgatgaagtttttgagagttttgatgacatgggtctccaagagaatcttctgagaggcatttatgcttatggttttgagaagccttctgcaattcagcagagaggaattgttcccttctgcaaggggcttgatgtcattcagcaagcacaatctggtacaggaaaaacagcaactttctgttctgggatcttgcagcagcttgattatggcctggtggaatgccaggccttggtccttgctcccacccgtgagcttgcacagcaaattgagaaagtcatgcgcgcacttggtgactacctgggtgttaaggtccatgcatgtgtgggaggaacatctgtccgtgaggatcaaaggattcttgccagtggtgtgcatgttgttgttggtacacctggtcgtgtttttgacatgctgcgtaggcagtccctccgccctgataacatcaagatgtttgtgcttgatgaagctgatgaaatgctttctcgtggtttcaaggatcagatttacgacatcttccaacttcttccagccaagattcaggttggagtcttctctgctaccatgccccctgaggcccttgagatcacccgcaagttcatgaacaagcctgtcagaatccttgtgaagagagatgagctgactcttgagggtatcaagcagttctatgtgaatgtggagaaggaagactggaagctggacacactgtgtgacctgtacgagaccctggccatcacccagagtgtcatcttcgtcaacacccgccgcaaggtggactggctcactgacaagatgaggagcagggaccacactgtctctgccactcacggtgacatggaccagaacactagagacatcatcatgagggagttccggtctggttcctcgcgtgtgctcatcaccaccgacctgcttgctcgtggtattgatgttcagcaagtgtccctggtcatcaactatgatcttcccacccagccagagaactacctgcatcgcattggtcgtagtggtcgtttcggtaggaagggtgttgccatcaactttgtgacccgcgacgacgagcggatgctgtttgacatccagaagttctacaatgtggtgattgaggagctgcctgccaatgttgctgaccttctgtgatcattttgaagaaaaactgaacaaaaaaaagggaggcgaggggaactgataaggcttggttttgtcgaaatatcgcgggggaggaagtgatatggtcggtggggtttctatgttaaagtcgtggtcatggacaatttgtggtttttctttatgccatgttttgggaatttttgtagctgcctaggccttgtggtatgtgctgctgtgggggttcattagtatcaagaggaagacgctgctggcgctggagtgtttttctctttattagtactttgtttaaaactatgtatgaccgaatgatggtatttatttgtgtcatccttgactcttattctgctgcaaccagatgtatcgttccatgtgtttgcagcacttgtttttgctgctctgagtaaaacctttttactcggttgagcttgtcaactgttggtgcacggcctacggtaatgtatttcgaagtggtactactacgcaagatgtggcactggcgttttgtaatagta

SEQ ID NO: 15716 - DNA, 884 bp, Sorghum bicolor
  unsure (1)..(884): unsure at all n locations
  Clone ID: SORBI-28MAY03-CLUS5359_1
gccngctgtgcggcgctcgcggccggccgggccgggatcgccagatcaccaccacaggcacatcactgcctagtcacctacactacgaagctaggttggtagaggccggccggcaatggcgtccaaggttgagctggtggtggaggtcaagtccccggcggacaagctgtgggcggcgctgcgcgactccacggagctgttccccaagatcttccccgagcagtacaagagcatcgagaccgtcgagggcgacggcaagtccgccggcaccgtccgcctcctcaagtacaccgaggcggtgccgatgctgacgttcgccaaggagaagctggaggtggcggacgacgagaacaaggtggtgtcgtacagcgtggtggacggcgagctggttgacttctacaagaacttcaagatcacgctgaaggtggccaaggcggcggcggcggagggcgagggtgaggccggcgccgtcgtcaactggtccatggagttcgacaaggccaacgaccaggtgcccgacccggacgtcatcaaggagaccgccaccaagacgttccacgacctcgacgactacctcctcaagaactagcagatggagacggtccagtgtccagtttactgctactactactactagtgctctgctgctagtgcacgtcgctggtgtggtgttggttggttcgatcgtgtccatgctggtctatttgctacctagctacgtagctaccaaggtccgtgtcctcgtacgtctgaggttcatgttgctgcggcgccgcgtcgtcgtgcatctgacgacgtgtcgttgcacactggtcctcctcccgcgtcaataaagctatccgtgttcacgccaaaaaaaaaaaaaaaaaggcccctagggccgc

SEQ ID NO: 15717 - DNA, 600 bp, Sorghum bicolor
  unsure (1)..(600): unsure at all n locations
  Clone ID: LIB5051-006-A1-XP1-F4
gccggccgggccgtcgatcgccagatcaccaccacaggcacatcactgcctagtcacctacactacgaagctaggttggtagaggccggccggcaatggcgtccaaggttgagctggtggtggaggtcaagtccccggcggacaagctgtgggcggcgctgcgcgactccacggagctgttccccaagatcttccccgagcagtacaagagcatcgagaccgtcgagggcgacggcaagtccgccggcaccgtccgcctcctcaagtacaccgaggcggtgccgatgctgacgttcgccaaggagaagctggaggtggcggacgacgagaacaaggtggtgtcgtacagcgtggtggacggcgagctggttgactcctacaagaacttcaagatcacgctgaaggtgtcgtcaactggtccatggagttcgacaaggccaaagaccaggtgcccgacccggacgtcatcaaggagaccgccaccaagacgttccacgacctcgacgactacctcctcaagaactagcagatggagacggtccagtgtccagnttactgctactactactactagtgctctgctgctagtgcacgtcgctg

SEQ ID NO: 15718 - DNA, 512 bp, Sorghum bicolor
  Clone ID: SORBI-28MAY03-CLUS146_3
acagactccacagcgcccgcgccagaagccaaaaccctcccccgccccctgcaggctgcaaccgcagccgccgagtccgcaggggaggccaagggtttcctggagaaatacccggccctggtcaccggttttttcttcttcatgtggtacttcctcaacgtcatattcaacatcctcaacaagaagatctacaactacttcccctatccatactttgtgtccttgatccatctagtagtgggtgtcgcatactgcctcgtcggctggagtgtcggtctccccaagcgagcgcctatcaatgccaatctcctgaagctgctctttcagtggcattgtgccatggtattggtcacgtcactagcaatgtgtccttcgctgctgttgcagtctcattcacccacactatcaaagcatggagccgcgcagtactctgggcaggtctatggcatgcatgcatgcacgtaggatgttggactgtcatcatcaataaaagatgagtggggggggggcgc

SEQ ID NO: 15719 - DNA, 653 bp, Sorghum bicolor
  unsure (1)..(653): unsure at all n locations
  Clone ID: SORBI-28MAY03-CLUS146_2
atctccggccaccgtggggaagaaccagctgaaatcactcgtccaagaacaccacaccaccagtccaccaccacaagtagagatttcgtcttggagagccaccaccaatggcttgttccactgcatctttagcggggacgctgctggcgttggcgctgatgttccaggcctccctcgcggggaggaggctcaccgcgctcgtgcaggagccggccatcaccatgaagtaccacaagggcgcgctcctgacgggccccatcgccgtcaacttcatctggtacggcgacttctcggcgccgcagcgcgcggtgatcaccgacttcgtctcgtctctgtccgcgccgccggcggcggtgcagccggagccgtccgtggccacgtggttcaagacggcgcgcaagtactacgccagctccaaggtgcggttcccggcgcttcgcctcggctcccacgtcgtcgaccagaactgctccctcggcaagcgcctcacggagagggacctcctcaggctcgccgccaagggtggcccgagccgcgccatcaacctggtcctcacggccgccgacgtggccgtggacgggttctgcatgtcccggtgcggnacgcacggcgcggccccgcggtcccgctccggccggttcgcgtacgtgtgg

SEQ ID NO: 15720 - DNA, 1719 bp, Sorghum bicolor
  Clone ID: SORBI-28MAY03-CLUS146_1
ccccgcatcccagagccacaaacaagaagaaccagctgaaatcactcgtccaagaacaccacaccaccagtccaccaccctaactacagactccacagcgcccgcgccagcagccaaaaccctcccccgccccctgcaggctgcaaccgcaatgtcggcggccgggacgctctccggcggcgccgccggtctatccggcctcctccgcctccgccgccgggccgcccccgcccccgcgatcgccgcgccgtcgctccaccccgctgggaccatcaagtgcaccgccgtgcccgatgccgccccgattgtctggggccgccagctccgaccggcgctcctcctccccgcggcactgctcccgtcgtcgcagcccgccaagaagcacaatctgcgcccggccgccgcagccgccgagtccgcaggggaggccaagggtttcctggagaaatacccggccctggtcaccggttttttcttcttcatgtggtacttcctcaacgtcatattcaacatcctcaacaagaagatctacaactacttcccctatccatactttgtgtccttgatccatctagtagtgggtgtcgcatactgcctcgtcggctggagtgtcggtctccccaagcgagcgcctatcaatgccaatctcctgaagctgctctttccagtggcattgtgccatggtattggtcacgtcactagcaatgtgtccttcgctgctgttgcagtctcatttgcccacactatcaaagctctggagcccttcttcagcgcagctgctactcagtttatccttgggcagcaagttcccctctctctgtggatgtctcttgcccctgttgtcattggtgtttcaatggcatcccttactgagctttcgttcaactggactggcttcatcaatgccatgatatcaaacatctcattcacttacaggagcatttattccaagaaagctatgactgacatggatagcaccaacgtgtatgcttacatctcaataattgctctcattgtttgcattccacctgcaataatttttgaagggccccagctaatgtcgcatggatttagtgatgccattgcaaaagtaggtttgacaaagtttgttagtgacctagtcttggttggactgttctaccatctgtataaccagattgctacaaacaccttggagcgagtggctcctctgacacatgctgtcggcaatgtgttgaaacgtgtttttgtcattggtttctcaatcgttgtttttggcaacaaaatttccacacaaactggaattggcacgtccattgccatagcgggtgttgctttgtactcttacattaaggctaagattgaagaggagaaaaggaaaaagagcgcatgatgaggtgactgctgtgaatattatcgggtggctgagttatacctcctcggacacaacatcgtcgacaatctcgacctacttctatgccttgttttgttttcatcttgagtcagttggtccattgtttgttcccaatctggtgattaactctgcaaattctgtttgtggaattggcagtgatacaaatttcggttcttaagtaaaactggttgctggtactggtagacagtggtattcgcctgtaacttaatggatgcttggaataccgggtgtaccgtaatacaaagggcacaggactctgcctgactaaataaaacggtgaactttcaccctgcttcgccgtaccc

SEQ ID NO: 15721 - DNA, 2906 bp, Sorghum bicolor
  Clone ID: SORBI-28MAY03-CLUS49598_1
agcaccttcgcctcctcctctccctcccagccctcccgccctcgctcctctgcagcatcccacagaaatcccccgccggcatgcatcatcttagccatcctcttcttcctcgagcgtctgggctttcccctttccgcggcattgctcgatcttcccacagctgccggcgttgctcggctctgcctcgccgtgctgcgctcccgagcgtccccacggtgttctgggtcgctcagatgggggtggggatgaaactgctcgcacgagtccggaggcgcctcgtcccgctccttcgccgccacaggatggcgctgctcacggcgccggcggtggccgcgctgctgctcgtcttctggtccgcggcgtacggtggtgacgcccagggcgtgccgccgtacaaggaccccaagaacgacgtggaggtccgcgtcaaggacctgctcgcccggatgacgctggccgagaagatcggccagatgacgcagatcgagcggctcgtcgcgtcgccgcaggtgctcaaggactactacatcggcagcctgctcagcggcggcgggagcgtgccgcggaagcaggcgacggcggcggagtggatggccatgatcagcgacttccagaaggcgtgcctgtccacgcgcctcggcatcccgatgatctacaggatgctcgcctccccctcctcctcttcttcccacctgctgctctgcctttctggtccggaggcgcctcgtcccgctccttcgccgccacaggatggcgctgctcacggcgccggcggtggccgcgctgctgctcgtcttctggtccgcggcgtacggtggtgacgcccagggcgtgccgccgtacaaggaccccaagaacgacgtggaggtccgcgtcaaggacctgctcgcccggatgacgctggccgagaagatcggccagatgacgcagatcgagcggctcgtcgcgtcgccgcaggtgctcaaggactactacatcggcagcctgctcagcggcggcgggagcgtgccgcggaagcaggcgacggcggcggagtggatggccatgatcagcgacttccagaaggcgtgcctgtccacgcgcctcggcatcccgatgatctacggcatcgacgccgtccacggccacaacaacgtgtacggcgccaccatcttcccccacaacgtcggcctcggagccaccagggaccctaatctggtgaagaggatcggcgccgcgaccgcgcttgaagtgagagccaccggcatccagtacgcgttcgcgccatgcattgctgtgtgccgtgatccgaggtgggggcggtgctacgagagctacagcgaggaccaccgtatcgtgcagtccatgactgagctcatcccgggcctgcagggcgacgtcccgcagaacttcaccagcggcatgcccttcgccgccggaaagaacaaggtggcggcgtgcgccaagcacttcgtcggcgacggtggcacgcagaacggcatcaacgagaacaacaccatcatcgaccgcgacggtctgatgagcatccacatgccggcctacttggacgcgctccgtaagggcgtctccaccgtcatgatctcctactccagctggaacgggctcaagatgcacgccaatcacgacctcatcacgcgcttcctcaagggcaggctcaacttccagggcttcacgatctcggattgggagggcatcgacaggatcaccagccctccaggggcgaactactcctactctgtgcaggcttcaattcttgctggcattgacatgatcatggtgccaaacaactaccaagacttcatcaccatcctgaccggtcacgtcaacagcggtctgatcccgatgagcaggatcgacgacgccgtgacgaggattctgcgcgtcaagttcaccatgggcctgttcgagaaccccatgccggaccctagcctcgccgaccagctggggaagcaggagcacagggacctggcgcgggaggcggtgaggaagtcgctggtgctcctcaagaacggcaagccaggcgacgcgccgctgctgcccctgcccaagaaggccgccaagatcctggtcgccgggagccacgccgacaacctgggttaccagtgcggcgggtggacgatcgagtggcagggcgacacggggcgcatcaccgtcggcaccacgatcctggacgccgtgaaggcggccgtggacccgtcgacgacggtggtgttcgcggagaaccccgacgccgacttcgtcaagaacggcggcttctcgtacgccatcgtggccgtgggcgagcacccgtacacggagaccaagggcgacagcctgaacctgacgatcccggaccccgggccgagcaccgtccagacggtgtgcggcgccgtgcggtgcgcgaccgtgctcatcagcggccgccccgtggtgatacagccgttcctgggcgccatggacgcgctcgtggcggcctggctgccgggaacggaaggccagggcatcaccgacgtgctgttcggggactacgggttcacggggaagctgccgcggacgtggttcaagtccgtggaccagctgcccatgaactacggcgacaagaagtacgacccgttgttcccgctcgggttcgggctcaccacacagggcaaggggtactagaacaaggatggatgatgggtggtagagatagaaaattgaattaaacagtgctctgtcgaggggacatgaactgggagttcttgtttccttcgattaatttgggtggtatgctcagttctcactgtggagttgcatccacaaagatgagccatctcattcttatattataatcaatcttccattttgctcaactctctcgaggactgtttcacggtggttcataatcaagtaaagatcagattggcgcaatacaaatttccagtggc

SEQ ID NO: 15722 - DNA, 862 bp, Sorghum bicolor
  Clone ID: SORBI-28MAY03-CLUS6243_1
gcacgcggctctcgagccggccgggccgggatcgcaagcaagcacgcagcacaactccttcagtaacaaagcatcacctgcttcttccttcgcctgtgatccattcaaccgagagcatgtcttgctgcagcggcaactgcgggtgcggctccggctgccagtgcggcagcggttgcggcggctgcaagatgtcccctgacatggagaccaccgccaccgtcggcatgaagcccatggtgctcgctgcaccgaccaccaaggccagcgccggcgggttcgaggcggccgtcgagggtggcggctgcgactgcaacacctgcaagtgcggcagcagctgcggctgcagctgctgcagctgcaactgagccatcccggcgatggcgcacgaggaggaaggaggagacagagacaacaaccaccccccagcgtactaaactatgtagcggcgtctaaataagatcctgtcaactgcgtgcgtgcaccgccattattcatgcatggtcgccggcctcgtctccgtctccgatcctggggttgttcatctccaacgtctcgcggtttgacgattgccgtcgtcgtcgatcctatgtccgcctcgtgcctgatctaatatatgtgttttttttctgcaaaaaaaaaaaaaaaaaagaggagacagagacaacaaccaccccccagcgtactaaactatgtagcggcgtctaaataagatcctgtcaactgcgtgcgtgcaccgccattattcatgcatggtcgccggcctcgtctccgtctccgatcctggggttgttcatctccaacgtctcgcggtttgacgattgccgtcgtcgtcgatacctatgtaccgcctcgtgcctgatac

SEQ ID NO: 15723 - DNA, 601 bp, Sorghum bicolor
  unsure (1)..(601): unsure at all n locations
  Clone ID: LIB5047-007-R1-XP1-A12
gccggccgggcttggatcgcaagcaaggcagcacaactccttcagtaacaaagcatcacctgcttcttccttcgcctgtgatccattcaaccgagagcatgtcttgctgcagcggcaactgcgggtgcggctccggctgccagtgcggcagcggttgcggcggctgcaagatgtcccctgacatggagaccaccgccaccgtcggcatgaagcccatggtgctcgctgcaccgaccaccaaggccagcgccggcgggttcgaggcggccgtcgagggtggcggctgcgactgcgacacctgcagctgcaactgagccatcccggcgatggcgcacgaggaggaaggaggagacagagacaacaaccaccccccagcgtactaaactatgtagcggcgtctaaataagatcctgtcaactgcgtgcgtgcaccgccattattcatgcatggtcgccggcctcgtctccgtctccgatcctgnggttgttcatctccaacgtctcgcggtttgacgattgccgtcgtcgtcgatcctatgtccgcctcgtgcctgatctaatatatgtgttttttttaaaaaaaaaaaaaaaaaaggccccta

SEQ ID NO: 15724 - DNA, 2297 bp, Sorghum bicolor
  Clone ID: SORBI-28MAY03-CLUS10595_1
accattgtggtcatctactgcaactctagtgcgtatcgccttaaacaccactaactagtaaactttccgatttccccttagcaatttactagtatactactaatactgaatactcgcagagaaaaaaaactccggcttcttactagctattggtgttttcataatgactctgcctgtaacgactccagcttattgttatctgactctgacaatccctcgagccttctatgatagcgtggcatctggaacactccaatcaatttattaattcccatttcattcatttatttttattctagtggtaatacactgcagcacaagttcttattacactatacgagtacaactcagcaccttgctgcttcaacactagccagcaagagtgaaattgaagttgctgcacgaaagcccgatggcattgaggaacgtggtgaatccgagctgcttcttctccacatccagcaccagcaggtggttctcgagctggaacccaccgatgaccgccgccggcgcttgtccggccgccgccttgacgaacccgaggcaggccgtgttgccgttcacctgcaccatggagttgccgccgagcaccgagtagttctgcccaccctgcagcatcacgtcgatctgcggcacggcgtagcccagccgcgtcggcggcagcttcgtcgagtcgtagcaccgctcgaacggcgcgacggcggccaccctcgacatccacgggaagtttggcccggtcgccgccgcgtcgaacgcgttcacgaagggcacgtacacgtcgggccggagagatgtgtagggcgtcgtggagctcagcgccacgaccagcgaggagccgccggccgaggaggtgccgacgcgactctgctccacggcgatgccggtggcggagacgaagtacccaggggagccgttgaacccttgcagcgacgccgtgccggccagcatcgtggtgaagtcgccacggtcagggaagaccaagggacctccgccgaagatggccacgccgacgctgtcgccggtcgtcgacttgccgtcgctcgggaggcagagcgcgatcttgttggcgaccttctgcgtgcgcgccacctgcgccgggaacgactggctcgtcgacggcgcgagacccgcgacgccgacggcaccggcagggacctttgcctgtggcgtgcaggaggccacggcagagaaggagaccgggaacagcgggttctgcccgtcggtggcgttcgcggagagcgtggtgaccgtgccgttcttggaggtgcacgtcgtcagcgagatgaccgggctggtgaggtcgaggagcagcgggtggccgtccttgagcggcgccgtgtagagggaggtggacgcgtccttggtgacggcggtgacaaggggcttgccgccgccgccgccgccgccactggctgccgtgcatggtgacgacaacgccgagatgcagagtgagatgaggacgaggaagggtttggggttccacattttgctgccgcttggttttgagcagctttgcttgtttgtttggtgcggttgctggttttatgctccagtaggcctgcacttttcctcctgccattaaaagctgggccacctgaatttcccgaattaatagctgcgtctgcaatcctagaagttctgtagaaccgtgaacgtacgaaagtatttctatcctagagaccactccgcttgtcacagatatggtatctcctccaattggataaccgacaacagtgactgcatcctgaagagccggtaatgttccaaactcgacaggtgaaactccttcccagaattcatcgtcattgacagttaagagtgcaatgtcacactctgtgccgatggccaggacggtggcaaggtacttggtgtcggagccgcgcttcttgagcttaacctgggtatggtgctccacggagtgggcattggtgaggacacggcggccgctgatgataaacccgctgctgctagagctgtactgccgcttccgctgccacggcagcgagaagttgggctccgtgtgcacgcagaacaccttgaccacggcgtccatgcacggcaccaccctgaccacctcatcccagctcgcggggcctgcctccgccaccgccactgccaccgcatcgcctccattcgccaccggtttcggctccccgcggcggggcggggacggcggacgcgcggcgtccgcgtccgcgggggcctcattacggcgcggcttgcggccacggcgcccagccggagcgggtgcggccgccggtgagtgcctcgtgcggtcgggggagggcgcctcgtgc

SEQ ID NO: 15725 - DNA, 454 bp, Sorghum bicolor
  Clone ID: LIB3478-016-P1-K1-C10
gccgccctttctattcattttctttctgctgggaagggccactataaccacggaccagtaatgattccttttcccgctaataatttaacaatgtagcagttataatgaaaccatgttaagaaaaaaaaatcggcttcttactagctattggtgttctcataatgactctgcctgcaacaactccagcttattggtatctgactctgacaatccccagagccttctatgatagcggagcttagacacctgcctgccctttgacacacagaacccctcaaaagatatttagttcacactacaaaatacattgggcgttctcttgctcacggaccgggtactatgctgcacttatcaattcaaccaataatatggcgcaatctgttgacccacctgatggcccacggctgcatcatgctccctcctcccactaggccttaaggtcatccgacattgc

SEQ ID NO: 15726 - DNA, 670 bp, Sorghum bicolor
  Clone ID: SORBI-28MAY03-CLUS524_7
atctcggtgcgcggccacaacgtgttctgggacgaccagagccaccagatgccgtgggtgagcaagctcagcgtggacaagctcagggccgccgtggcgaagcacctcaagagcgtcgtctcccgctacgccggcaaggtcatccactgggacgtggtgaacgagaacctccacttcagcttcttcgaggagaagctgggcaaggacgcgtccggggagatcttcaaggaggtggccaagctggaccctaagcccatcctgttcatgaacgagttcaacacgatcgagcagccctgcgacaaggcgccgctgccgaccaagtacctggccaagctgaggcagatccagtcgtacccgggcaacgaggacctcaagtacggcatcggcctggagagccacttcgccaagcccaacatcccctacatgaggggctcactggacacgctggcggcggccaaggtgcccatctggctcaccgaggtggacgtcaccaaggggcccaagcaggtggagttcctcctcctcctggccttcgcagccaccgccgaggcccgcgtcgtccgcgagctgatcggcgagaacgcatgccagcagacatgcaaccaggtgcacttcaagaagatgtgccagagcttgacgaaactcccgaaggtgacgacgccgggggagc

SEQ ID NO: 15727 - DNA, 1807 bp, Sorghum bicolor
  unsure (1)..(1807): unsure at all n locations
  Clone ID: SORBI-28MAY03-CLUS524_6
cgctcaccgcgaagaagtcgtcgccaaggaacgcaagaagaaggtgaagatcacggtggagagcggcggcaagccgttgccggacgcggagctgtctgtggtgtgggtggccaaggggtttcccctgggcaacgccatgaccaaggagatcctggacatgcccgagtacgaggagtggttcacgaagcggttcaagtgggcgacgatggagaacgcgatgaagtggtacagcacggagtacaacgagggtgaggaagggttcgtggtggcggacaagatgctggcgctggcggagaagcacaacatctcggtgcgcggccacaacgtgttctgggacgaccagagccaccagatgccgtgggtgagcaagctcagcgtggacaagctcagggccgccgtggcgaagcacctcaagagcgtcgtctcccgctacgccggcaaggtcatccactgggacgtggtgaacgagaacctccacttcagcttcttcgaggagaagctgggcaaggacgcgtccggggagatcttcaaggaggtggccaagctggaccctaagcccatcctgttcatgaacgagttcaacacgatcgagcagccctgcgacaaggcgccgctgccgaccaagtacctggccaagctgaggaaaaccattgtatgttgcatttgcacagcgcaaagaagatagaaaagcgatgttgcaggcacagttttctcagatgcgccctgcagtaccaatgacacccactttagccccacggcttccaatgtaccctcctatggctcctcagcaactcttctatggacaagcaccatcagatcccacgcgtccgcgggcaacgaggacctcaagtacggcatcggcctggagagccacttcgccaagcccaacatcccctacatgaggggctcactggacacgctggcggcggccaaggtgcccatctggctcaccgaggtggacgtcaccaaggggcccaagcaggtggagttcctggaggaggtgatgaggggagggttcggccggccgggcgtagagggcatcgtcatgtgggccgcctcgcttccgccgctaggtttcctttgtagcgggtttttttcctctcgagacacacctccaccacagtccacacccggcggtcggatcgatggcggcggaagcggcggctgcggggaaggagaagatgctgacgctgatcagcagcgacctcgagaagttcgaggtggaggagtcggcggcgagggagtcgcggaccatcgggaacatgatcgaggacagctgcgccgacaacgacatcccgctgcccaacgtcaacgccaggatcctcgccaaggtcatcgtgtactgcaggaagcacgcctcggcgcgcggcggcaccgatgctggtgatgcggagccaaccgctgcgactaacaaggcatcagaggatgagctcaaaaccttcgatgctgagttcgtcaaggttgaccaggccaccctctttgacctgattctggctgcaaactacctggacatcaaggggctgctggacctgacctgccagactgtcgccgacatgatcaaggggaagactccagaggagatccgcaagacattcaacatcaagaatgacttcacaccanaggaagaggaggaagtgaggagggagaaccagtgggcctttgaatgatgctggaggctctaacaacagcaatatcgtataacaggccagagaggaagtctccttgttcgggatgttgtgatttttggagcagctatagactgtcttgggtttacaaatcgcttaaaagtgtaatgtaggtttggtcg

SEQ ID NO: 15728 - DNA, 1523 bp, Sorghum bicolor
  Clone ID: SORBI-28MAY03-CLUS524_5
gccggccgggctgcggaacgcgatccctaatcgacttcccctatctttcgccctcttcgcgcagcagctacagagctagggttccgtcctcgatccgatccggcgagtgctcaccacctttccccacttccctccgatcgaatcgatggcggccgagggcgaaaagaaaatgataaccctcaaaagctcagatggtgaggagttcgaggtggaggaggcggtggcgatggagtcgcagaccatccgccacatgatcgaagatgactgcgccgacaacggcatcccgctccctaacgtcaactccaagatcctatccaaggtaatcgagtactgcaacaagcacgtacatgccgccgctgccgctgccgcagcctccaaggccggttccgacgacgtgggtgccgccgccgccaacagcaccgccgcctccggtgaggacctcaagaattgggatgctgacttcgtcaaggtcgaccaggccacgctcttcgacctcatcttggctgcaaactatctcaacatcaagggtctgctggacctgacctgccagactgttgctgacatgatcaagggcaaaaccccagaggagatccgcaagaccttcaacatcaagaatgacttcacccctgaggaggaagaggagatccgcagggagcgccggccgggccgggatcagcctgtgcattctctcggccttcgcttctgtttcttattaggccgccctctacactcctcgaaataacaatcgagggcggtcaagagaaacgagagcggcagacaccatggagagctcgaggatcatcgtcgcctccctcctcctcctcctcctggccttcgcagccaccgccgaggcccgcgtcgtccgcgagctgatcggcgagaacgcatgccagcagacatgcaaccaggtgcacttcaagaagatgtgccagagcttgacgaagctcccgaaggtgacgacgccgcgggagctcctgctggcgtcgatgcgcgtcgcggcggagaaggcgaaggaggccaagagccgtgtggacgagtacgcggcgaggtcccacgagggccggccgatggagtccatcctcagttcctgcagctccgggtacgacaacgtggtgcagacgctggaggagacggagaagatcgtcgccacgcagggaacccaggtggacttgaacaccaagctgtcggacgccgtcacgagcgccggcgactgcgacaacgccttccaggacttcccggagatgaaggaccccttcttggccatgcagcggaacgtctggcgcctcgtggacaacgtcctcaacatcgccgtcgtcgtcaagcagtcgggggacgcgcacgcccactagccgcgtgcgcgctgtaaaagcaggggtggtgttgtatcgatctcccgcacttgaatatatatgaacaaggcttgggaaaattctgtattactagtagtgtaacacggaattacaggttgagcttctatcatgtacttttttgttcttggtacaaaaaaaaaaaaaaaaaaggcc

SEQ ID NO: 15729 - DNA, 902 bp, Sorghum bicolor
  Clone ID: SORBI-28MAY03-CLUS524_4
ccggggagggaaaaagcacgagaggtcgaggccggtcgactcgaccccaatctattctccccgtcgattctgttcctcaatccgccgcgcgccgcagctagctagctagggtttcgtcgcagcagccctcttcgatccatcgatggcgtccgagggcgacaacaagaagatgattaccctgaggagctccgacaacgaggagttcgaggtggaggaggcggtggccatggagtcgcagaccatccgccacatgatcgaggacgactgcgccgacaacggcatcccgctccccaacgtcaactcgaagatcctctccaaggtcatcgagtactgcaacaagcacgtccacgccgccgccaagcccgctgaaggcgcggacgccaacgcagccgccgcagccgggggcggcgaggacctcaagaactgggacgcggagttcgtcaaggtcgaccaggctacgctcttcgacctcatcctggctgccaactatctgaacatcaagggattgctggacctgacctgccagacagttgctgacatgatcaagggcaaaactccggaggagatccgcaagacattcaacatcaagaacgacttcactcaagaggaggaggatgagatccgcagggagaaccagtgggcctttgagtgatggtcttccgtggtggtgttgcggtgctgcttaaaagaaagatggatgtctgcaccgtgctctacaatgctattagtgctagtctacttactaaatatatatggtcggtcgtaatggttgtatgccttttggaagcgggttatggtttggattggatggaggtcaaactgagtgctagtttggttgtctggaaatatatattatttagtactactatctcagcatcattggatctatgatgatttacccc

SEQ ID NO: 15730 - DNA, 867 bp, Sorghum bicolor
  unsure (1)..(867): unsure at all n locations
  Clone ID: SORBI-28MAY03-CLUS524_3
gccggccgggccggggcaatccctaatcgacttccccaatctttcgccctcttcgcgcagcagctacagagctagggttccgtcctcgatccgatccggcgagtgctcaccacctttccccacttccctccgatcgaatcgatggcggccgagggcgaaaagaaaatgataaccctcaaaagctcagatggtgaggagttcgaggtggaggaggcggtggcgatggagtcgcagaccatccgccacatgatcgaagatgactgcgccgacaacggcatcccgctccctaacgtcaactccaagatcctatccaaggtaatcgagtactgcaacaagcacgtacatgccgccgctgccgctgccgcagcctccaaggccggttccgacgacgtgggtgccgccgccgccaacagcaccgccgcctccggtgaggacctcaagaattgggatgctgacttcgtcaaggtcgaccaggccacgctcttcgacctcatcttggctgcaaactatctcaacatcaagggtctgctggacctgacctgccagactgttgctgacatgatcaagggcaaaaccccagaggagatccgcaagaccttcaacatcaagaatgacttcacccctgaggaggaagaggagatccgcagggagaaccagtgggcctttgagtaaggaggtgctgagccctctgatctcttatgcctaggtttcgtcatatctactaccttgcaatgctctgcttttaatgtcatcgtaatggttgtaagtattttgggagtcactttgcttgagaatgtgttgggtaaaactgatgtggtcaatggtcggntatactatgaaaggacatcggctgctgccctaagagtg

SEQ ID NO: 15731 - DNA, 857 bp, Sorghum bicolor
  unsure (1)..(857): unsure at all n locations
  Clone ID: SORBI-28MAY03-CLUS524_2
gtttaggctcccaaaagccaaaaatcaaggagaaatattcgcagcggcagcgcgtctcgataaaagccggcatcaactgttccgtcaaagcagagtccacccctccccgcgccgttctttttggttcccctgtccccgccgcctccgaaacccaccgatggaggtcgtcgccgccgccgccgccgccgcgaagcagaagacgaagaagcacgagaagcacatacacctcttctactgctccgaatgtgaggagctcgccctcaaggtcgccgccagctccgacgccatcgagctccagtccatcaactggcggagcttcgacgacggcttcccgaacctgttcatcaacaaggcccacgacatccgggggcagcacgtggcgttcctggcctcattcagctcgccggcggtcatattcgagcagatctccgtcatcttcgcgctgcccaagctcttcatcccctcattcacgctcgtgctgcccttcttccccacgggctccttcgagcgcgttgaggaggagggcgatgtcgccaccgcgttcaccctcgcgcgcatcctctcgatgatccccaagtcgcgcggcgggccgacaagtgccgtcatctacgacatccacgcgctccaggagaggttctacttcggggacgacgtcctgccatgcttcgagacagggatcccgctcctgctgcagcgcctccgccagctgccggacgcaaaaaatatcaccattgcctttccagatgatggagcgtggaagcggttccacaagctgttgcagcactttccaatgatagtctgtaacaagttcgtgaagtgacaagangatagtccgtataaaggaaggaatccctgag

SEQ ID NO: 15732 - DNA, 3021 bp, Sorghum bicolor
  Clone ID: SORBI-28MAY03-CLUS524_1
gtcgacgcagttcgccccgctaaggcctaagcgacttccccaatctttcgtgaaggagcaccatcctttattacccagtactacagtattatacaacactcagagcacacagggtatactgacaccgacatagcaaagcatactctctcacgcataccaattatataacgagacactacatccacaaatcgcacgcgctctcccaatctctcgtgcacatcgcaaaatggcaccaatggtggtacggctcagaatggctcagccgccaagacatgcgccggcgcactgtgtaacggcctagaccacaatctccagcgtccaccggtacatctccttctccggcaccggcaggtcgacggacacgaggccggtgtcggcgtcgtagccgaactccacttccgccgagtccagcaggcacctcgccggctcccgcgagcagtaggcaccgaaccggccgcacccgcgcaccctgagcgccaccacggccttcccgccgccgtccactgcgcggcactcctcgacggcgcccccggcgttgaacatgtcgagcagccccacgggcgcgaacgccacccccggcgcggcggcgcggagcgggcacacgtggaacacctcgtactgcagcggcgccagcgtcacgggcagcgcggcgccacgcggcagccgcaccagctcccgcgcgctgttgcgcctacaccacggcctcgccgttcccctcgccgttgctgtcgttggcgctatcgttgccgccggcgacggcggcgcgtgttatggcggtcacttcgccggcgcgcgtggcggcggtcagcgtcgtgggcgacgcgccgtgcacgctctcccacttcgttgcgcggctgcaccaggcggtctggcactcgaagacgtccacggcgctgccgcagtccgggaagttggagatgttgagcgtgggttgggccgtcacctcgcggggcggagtcggggcagtctcgggtaactccgccagcgcgctggacgctgcaagcggagcggaagggcagaacgttgttcctcttcagcacgaagttgtcgttccccggcctgtcaatggcatatatcgcggcgccgccgatggctctgccagcaccgtggtactcagccgtcgggagcaagcaatcaaacataccccacttgagatccattaaccagccgaggcaattggtgtttttgagcgacgcaggcgacatggacggtgtgcgagaccggttcgcgcgggtagaagtcgtcggaggcgcgcaccacggcggtctgcctggcgctgtagagcatgtcggtgttgtggcacatgcaggagatgcagccgttgtcggggaagctgcacgccacggaggcctcgagcgcgcggtggtaggccctggtgagcgcgacgcggccgccatggccggcgcccagcgtctcgatgatgttctgcacgtccaccttgacgccgtccacgccgcaggaggccaggtacgcgtggagctcgccgtagaagtcccgcgcccgccgcgggtgcaccaggccgaggcccaggacggacagcgagtccatgacgatgtccggctggttcgccgtcacgcctggggactgcaccgggtacgccagcgccggctcgtaacgctccatcgctgtccccgacgacggcgccacgccgccccagtaccccgccatcgcgtgccacacgtacacctgcttcacgccgtgcacgcccttggtctccgacaccagccgcttcagcccgccgtcgccgtcgccgtcgccgtccggcttggtctggaacttggtgttctccttgatccccgtcagccgactggcgaattgcgcgccctcctggacggcgacgttggggtcgtcgggcttcttgttgtcggaggcgatctgctgccagccgtcgtcgatgatgaggaaccgcggcggcgcgccgcccttggacaggctctggaggccgtgcttgacgccgccggcggtgacgtcggtgtagaaggcgtcccaggtgcaccagccgaaccagtcgaggaacgacggcatcctcttcctctctcggtggtggaacgtctgcaggtgcttctccaccgccttgaccgcggcggtgacggcgtcgaaggggctgtcgccggcgtggaggtataccttgcgcgcgccctgctccgtctgcaccgccttgtcgccgctctcgacgcagatctccagctcgtcgcggtcgttcccctgcagcgccgcccggaactgcccctccagcagcggcagcatcaccacgtacgcgggtttgccgtcgccgtcggttgcggcaggcatgacctcgacgcgcgtgaactgaggggttgctggaggtatgatccaggcatatgatatgggaggcttccctgtgagagatgcagccgtatcaccggccgcccaaattgggactctgacttctgcccttgcaaatgctaatcctgagcagcaaagaacgatacttggtgaaaatctatacccactggttgagcaactggaaccaaaccaagcagcaaaggtcactggaatgcttttggagatggatcagactgaggtcctgcacctgctcgagtcccctgatgctctcaagtccaaggttgctgaggcgatggatgttctacgcaatgtggcccatcagcaaaacccaaacaccccgaccaatcagcttgctgcattatcactgaccgaaggcattatctcctaactttgaaagccataacaaactatctccagtttgcaattgagtgtggtgtttccaaaggttatctggcacatgagagtattgctcctttttttttcttccatactatggttggacttgtgagtgtcgtttccatactggatgttaggttttattcgtgctctgcgatatcctggcgataaggcaaagcacttgtttgcaagtttgagtactattgggggctgttgattacatacctgtccttttcaccttgtcggaagttttgccactcaattgaatgagtgagggaacttattgcaccttatcaagtgttttgtgatctgatgtcg

SEQ ID NO: 15733 - DNA, 411 bp, Sorghum bicolor
  Clone ID: LIB3480-004-P1-K1-D2
caagaacctgccgcagggggacctcgtcgacaggctcctggacgagtggaggaaggtgcccgagaagcccatgacggacagcaatggtgtgttcgaggccgagctcttccacggcgagtaccaggtcaccgtcaagcacgcgtcgctcaaggagcccatcgtgcagacggtggacctcgacaccaaatcggaggccgccataaaggcctagctaattaactgcttaagagtactccacgcatcatgtcggtgtcgctcactgtaacattcccatttgtatgacggtgtcgctaacttgtaacattccaatctgtttttctatataaatatatatacatatgatcttttttattccgaaatataaaagtaatttgtatgtatattctacaagtattattaatataattatag

SEQ ID NO: 15734 - DNA, 485 bp, Sorghum bicolor
  Clone ID: LIB3480-059-Q6-K1-A10
ctcaccgaggtggatgtcgtcaagggacccaaccaggtgaagaacctggagcaggtgctcagggaagggtacggacaccccggcgtcaatggcatcgtcatgtgggcggcgtggcacgccaagggctgctacgtcatgtgcctcacggacaacagcttcaagaacctccccgtcggcgacgtcgtcgacaagctcatcgcggagtggaagacgcaccgcgcgtccgccaccaccgaccacgatggggcggtggagctcgatctgcccctaggcgagtataagttcaccgtaagacacccgtcgctgaaagctgctgcggttcaaaccgtgaccgtcgacgacacttcgtcgtcggcgtcggagttcaccatcaacgtcaagtcctaggagccatgcatgctactatacgcgcagtaagtctggaggagatttaattagttattaattaggtctttatttctttctttctggtgaataaacagatg

SEQ ID NO: 15735 - DNA, 606 bp, Sorghum bicolor
  unsure (1)..(606): unsure at all n locations
  Clone ID: LIB3480-053-P1-K1-G1
ttcttattaggccgccctctacannctcctcgaaataacaatcgagggcggtcaagagaaacgagagcggcagacaccatggagagctcgaggaggcggtggcgatggagtcgcagaccatccgccacatgatcgaagatgactgcgccgacaacggcatcccgctccctaacgtcaactccaagatcctatccaaggtaatcgagtactgcaacaagcacgtacatgccgccgctgccgctgccgcagcctccaaggccggttccgacgacgtgggtgccgccgccgccaacagcaccgccgcctccggtgaggacctcaagaattgggatgctgacttcgtcaaggtcgaccaggccacgctcttcgacctcatcttggctgcaaactatctcaacatcaagggtctgctggacctgacctgccagactgttgctgacatgatcaagggcaaaaccccagaggagatccgcaagaccttcaacatcaagaatgacttcacccctgaggaggaagaggagatccgcagggagaaccagtgggcctttgagtaaggaagtgctgagccctctgatctcttatgcctagggttcgtcatatctacta

SEQ ID NO: 15736 - DNA, 872 bp, Sorghum bicolor
  unsure (1)..(872): unsure at all n locations
  Clone ID: SORBI-28MAY03-CLUS97_2
cggtgcgtgnaattatnngtgctgaaacggggagccaatggaggaagaagcccttgaacgagttgaaaagcttgcagaagtaaatcccatgcttggtatctcgtaccctgaattaacagaaatgcaagcccgtgccatctttgaagctgctatagcaatgtccaaccagggtgttgaagttttcccagagaggatggttcctcttgttggaacaccacaggaattgggacatcaagtgaatgttatcaaacaaactgctgagaaagttttcgccaatgcgggtaaaactattggctacaaaattggaactatgattgaaattcccagggcagctctagtggctgatcagatagcagagcaggctgagttcttctcttttggaacgaacgacctcacacagatgacttttggctacagcagggatgatgtgggaaagtttattcccatttacctggctcagggtatcctccaacatgacccctttgaggttctcgaccagagaggagtgggcgaactggttaagtttgctacagagaggggccgccaaactaggcctaacttgaaggtgggcatttgtggagaacatggtggagagccttcatcagttgctttcttcgccaaggttgggctggattacgtttcttgctcccctttcaggttggtcaagtgataaactcatgatccaatccaacaagtatatctctttacatcccggttatgttaacggcagcaaaatcttaactggtttttatatgaaataccttctgcagggttcccattgctaggctagctgcagctcaggtgcttgtctgagggtgctgagggtgcctcctcattcgcaaccggatgatcgcctgctgatggcgcatctg

SEQ ID NO: 15737 - DNA, 3335 bp, Sorghum bicolor
  Clone ID: SORBI-28MAY03-CLUS97_1
agccttcacccacagcggctgtgttgtgtattttgtcactgatcagtgagtgatcagctgcctcgtaactttccgcagagcctcactctgccccttcgcgcgcgcgcacgcaagcacgctcccctgccctgccctgccctgccacacagcaggcacgctcgctcgggtcgatcgatcgatcgagctctcccgttagcgcgcggaaggatggcggcgtcggtttccggggccaccatctgccttcagaagcctggctccaaaagcaggagggccagggatgcgacctcctccttcgcgcgccgatcggtcgcggcgccgaggtccccgcacgccgccaaggcgagcgtcatccgctccgacgccggcgcgggacggggccagcattgcgcgccgctcagggccgtcgttgacgccgcgccgattgccacgaaaaagagggtgttctacttcggcaagggcaagagcgagggcgacaagagcatgaaggaactgctgggtggcaagggcgcgaacctggcggagatgtcgagcatcgggctgtcggtgccgccggggttcacggtgtcgacggaggcgtgcaagcagtaccaggacgccgggtgcatcctcccggcggggctgtgggccgagatcctggacggcctgcagttcgtggaggagtacatgggcgccaccctcggcgacccgcagcggccgctcctgctctccgtccgctccggcgccgccgtgtccatgccaggcatgatggacaccgtgctcaacctcgggctcaacgacgaggtcgccgccggcctcgccgccaagagcggcgagcgcttcgcctacgactccttccgccgcttcctcgacatgttcggcaacgtcgtcatggacattccccgctcactgttcgaagagaagcttgagcacatgaaggaatccaagggggtgaagaatgacactgacctcactgccgctgacctcaaggagcttgtgggtcagtacaaggaagtctaccttacagctaagggagagccattcccctcagaccccaagaagcagcttgagttggcagtgcgggctgtgttcaactcgtgggagagccccagggcaaagaagtacaggagcatcaaccagatcaccggcctggtcggcactgccgtgaacgtgcagtccatggtgtttggcaacatgggcaacacttctggtactggcgtgctcttcactaggaaccctaacactggagagaagaagctgtatggcgagttcctgatcaatgctcagggtgaggatgtggttgctggaattagaaccccagaggatcttgatgccatgaaggacgtcatgccacaggcttatgaagagctagttgagaactgcaacatactggagagccactacaaagagatgcaggatatcgaattcactgttcaggagaacaggctgtggatgttgcagtgcagaacaggaaaacgtacaggcgcaggtgccgtaaagattgctgtggacatggttagcgagggccttgttgagcgccgtcaagcgattaagatggtagaaccaggccacctggaccagcttcttcatcctcagtttgagaacccagcgttatacaaggataaagttattgccacgggactgccagcctcacctggggctgctgtgggccagattgtgtttactgctgaggatgctgaagcatggcatgcccaggggaaagctgctattttggtgagggcggagaccagccctgaggatgttggtggcatgcacgcagctgctgggattcttacagaaaggggtggcatgacttcccatgctgctgtggtcgcccgtgggtggggaaaatgctgtgtctcgggatgctcagccattcgtgtcaatgatgctgagaagactgtagcgattggagaccatgtgctgagcgaaggtgagtggctatcgctgaatggatcaactggtgaagtgatccttggaaagcagccgctttccccaccagccctcagtggtgatttgggaactttcatgtcctgggtggatgatgttagaaagctcaaggttctggctaatgcggatacccctgaggatgcattggctgcacggaacaatggggcacaaggaattggactatgccggacagagcacatgttctttgcttcagatgagaggattaaggctgtaaggcagatgattatggctcccacagttgaactgaggcagcaggcactagatcgtcttttgccttaccagaggtctgactttgagggcattttccgtgctatggatggactttcggtgactattagacttctggaccctcctctccacgagttccttccagaagggaatgttgaggaaattgtgcgtgaattatgtgctgaaacgggagccaatgaggaagaagcccttgaacgagttgaaaagcttgcagaagtaaatcccatgcttggtttccgtgggtgcaggcttggtatctcgtaccctgaattaacagaaatgcaagcccgtgccatctttgaagctgctatagcaatgtccaaccagggtgttgaagttttcccagagatcatggttcctcttgttggaacaccacaggaattgggacatcaagtgaatgttatcaaacaaactgctgagaaagttttcgccaatgcgggtaaaactattggctacaaaattggaactatgattgaaattcccagggcagctctagtggctgatcagatagcagagcaggctgagttcttctcttttggaacgaacgacctcacacagatgacttttggctacagcagggatgatgtgggaaagtttattcccatttacctggctcagggtatcctccaacatgacccctttgaggttctcgaccagagaggagtgggcgaactggttaagtttgctacagagaggggccgccaaactaggcctaacttgaaggtgggcatttgtggagaacatggtggagagccttcgtcagttgctttcttcgccaaggttgggctggattacgtttcttgctcccctttcagggttcccattgctaggctagctgcagctcaggtgcttgtctgagggtgctgagggtgcctcctcattcgcaaccggatgatcgcctgctgttggcgcatctggtgattaataatattgttacagagccatgatctgtgaagataattagtagcagggctcataaaagctacaattccatccctttttgcagttatgtaaaactttcaaactgtttatgctcaaaaactctgttcttcaatggatcatcaattatcgattatataaaaaaaaaaaacataattctttaaaaaaaaaaaaaagggcagccgctcgcgatctagaac

SEQ ID NO: 15738 - DNA, 269 bp, Sorghum bicolor
  Clone ID: LIB3481-025-P1-K1-A10
cgtccgcccacgcgtccgcccacgcgtccgcggacgcgtgggtgagaaagttttcgccaatgcgggtaaaactattggctacaaaattggaactatgattgaaattcccagggcagctctagtggctgatcagatagcagagcaggctgagttcttctcttttggaacgaacgacctcacacaaattacttttggctacaacaaggatgatgtgggaaagattattcccatttacctggctcagggtattcttcaacatgacccctttg

SEQ ID NO: 15739 - DNA, 240 bp, Sorghum bicolor
  Clone ID: LIB3478-037-P1-K1-D1
cattgttggacggcgaccaaatggatagatatgggttgctattttcaggctggacgttctatgaaaccagcatctatagatgccggacagagcacatgttctttgcttcagatgagaggattaacgctgtatagcagatgattattgctcccacagttgaactgaggcagtacgcactagatcgtatttagccttaccagacgtctgactctgatggcattatacctgctatgcatggac

SEQ ID NO: 15740 - DNA, 517 bp, Sorghum bicolor
  Clone ID: SORBI-28MAY03-CLUS401_4
gcgtcctctccagcgtccgcggccgcgtgggctctggcaccatcgacaatgtgaaggctaagatccaggataaggagggtatccccccagaccagcagcgtctgatcttcgctggcaagcagctggaggatggtcgcacccttgcagactacaacatccagaaggagagcaccctccacctggtgctccgtcttcgcggtggtcagtaagccatcagtcgttgaagctgctgccgcacctgggttgtctagtgcctcttgtttcggccatgtccagtctttgaagtatctgtatggtccgtcattgaagcgttggtcagtctgaagtatttgtatggaagcatttgtatggtctgtgtcgtgtctgagttcgtttcatggaccggttgtgttcctctgtgttctacccaaaactatagtgcggcagcatatggcttaattctaaataaatgtgatgttggaatttaaaatatgtgttgaatattgttttttgctatgtcagttaattttactaaaaa

SEQ ID NO: 15741 - DNA, 1280 bp, Sorghum bicolor
  unsure (1)..(1280): unsure at all n locations
  Clone ID: SORBI-28MAY03-CLUS401_3
ggccggaccggccgcggtagacccaccccatctcctctctcctgttgttcggagcacacgcacaatccgatcgatccccaaatccccttcgtctctcctcgcgagcctcgtggatcccagcttcaagatgcagatctttgtgaagaccctcactggcaagactatcaccctcgaggtggagtcttctgacaccatcgacaacgtcaaggccaagatccaggacaaggaaggcatccccccggaccagcagcggctcatctttgccggcaagcagcttgaggatgggcgcacgcttgctgactacaacatccagaaggagagcaccctccaccttgtgctccgcctcaggggaggcatgcagatcttcgtgaagaccctaactggcaagacgatcacccttgaggtggagtcctcagacaccatcgacaatgtcaaggcaaagatccaggacaaggagggcatcccaccagaccagcagcgtctgatctttgccggcaaacagctggaggatggccgcacccttgcggattacaacatccagaaggagagcaccctccacttggtgctgcgtctcaggggaggcatgcaaatcttcgtgaagacccttactggcaagacgatcacccttgaggtggagtcctcggacaccatcgacaacgtcaaggccaagatccaggacaaggagggcatcccaccggaccagcagcgtctgatctttgctggcaagcagctggaggatggccgcacccttgcggattacaacatccagaaagagagtaccctccacctggtgctccgcctgaggggtggcatgcagatctttgtgaagacattgactggcaagaccattaccctggaggttgagagctctgacaccattgataacgtgaaggccaagatccaggacaaggagggcatccccccggaccagcagcgtctgatcttcgctggcaagcagctggaggatggccgcacccttgcagactacaacattcagaaggagagcaccctccatctggtgctccgtctccgtggtggtcagtaagccataggtcgtttaagctgctgctgtacctgcgtttgtctggtgccctcttgtgtacctgcatatggaggttgtcgtctattaagtatctgtggtttgttttagtcgtgactgagttggtttgaaggacctgttgtgtcttgtgtcccgtgtgtctacccaaaactattatgccgcagtatggcttcatcatgaataagttgatgtttgaacttnnnnaaaaaaaantnntnnt

SEQ ID NO: 15742 - DNA, 993 bp, Sorghum bicolor
  Clone ID: SORBI-28MAY03-CLUS401_2
ccgggataaatagccaggacgcctcctcgccggtcgccaatctcatctcgcattgtgttgttcggagcaaggagaacccagccccccatcgctctcaatcccaatcgatcttcttctcgtgagcctcgtcaatccatcacccgcttctaagatgcagatctttgttaagaccctcactggcaagaccatcacccttgaggtggagtcttccgacactatcgacaacgtcaaggctaagattcaggacaaggagggcatccccccagaccagcagcggctcatctttgccggcaagcagctggaggacgggcgcacgcttgctgactacaatatccagaaggagagcaccctccacttggtgctccgcctcaggggaggcatgcagatctttgtgaagaccttgactggcaagaccatcacccttgaggtggagtcttctgacaccatcgacaatgtcaaggccaagattcaggacaaggagggcatccccccagaccagcagcgtctgatcttcgctggcaagcagctggaggatggccgcaccctcgctgactacaacatccagaaggagagcaccctccatcttgtgctccgcctgaggggtggtatgcagatctttgtgaagaccttgactggcaagaccattaccctggaggttgagagctctgacaccattgacaatgtgaaggccaagatccaggacaaggagggcatccccccggaccagcagcgtctgatcttcgctggcaagcagctggaggatggccgcacccttgcagactacaatatccagaaggagagcaccctccatctggtgctccgtctccgcggtggtcagtaagccgtgggtcgtttaagctgctgctgtacctgtgtcgtctggtgccttctggtgtacctgggaggttgtcgtctatcaagtatctgtggttggtgtcatgagtcagtgagtcccaatactgttcgtgtcctgtgtgcattatacccaaaact

SEQ ID NO: 15743 - DNA, 2028 bp, Sorghum bicolor
  unsure (1)..(2028): unsure at all n locations
  Clone ID: SORBI-28MAY03-CLUS401_1
ctcgcctcgtcgtcgtccgcgaacctctcgtcttgctcggacttcggagcacacgcacaacccgatccccaatccccctcgtctctcctcaccggcttcgcggatctccgcttcaagatgcagatctttgtgaagaccctcaccggcaagactatcacccttgaggtggagtcttctgacaccatcgacaacgtcaaggccaagatccaggacaaggagggtatccccccggaccagcagcgcctcatctttgctggcaagcagctcgaggacgggcgcactcttgctgattacaacatccagaaggagagcaccctccacttggtgctgcgtctcaggggaggcatgcagatcttcgtgaagacccttactggcaagacgatcacccttgaggtggagtcctcggacaccatcgacaacgtcaaggccaagatccaggacaaggagggcatcccaccagaccagcagcgcctgatcttcgctggcaagcagctggaggatggccgcacccttgcggattacaacatccagaagcagagcacccgccacctggtgctccgccgcacgggggctatgcagatatttgtgaagacccttactggcaagtcgatcacccttgaggaggcgtccatgtgaaggcccaagatccaggagacgaagggcattcccccggatcagcagcgtctgatctttgctggcaagcagctggaggatggccgtactcttgcggactacaacatccagaaggagagcaccctccacttggtgctccgcctgaggggtggtatgcagatctttgtgaagactttgactggcaagaccataaccctggaggttgagagctctgacaccatcgacaatgtgaaggctaagatccaggataaggagggtatccccccagaccagcagcgtctgatcttcgctggcaagcagctggaggatggtcgcacccttgcagactacaacatccagaaggagagcaccctccacccggcgctccgtcttcgcggtggtcactcacccagcaggcgctgaagcggtcttcgccaaggctttgtctagtccctccttgttccggccatgtccaagctctttgagaattcgtacagtgccgacaataagccaggttaagtcgggtattctgacggtatagccacgtgtaaggtccgtgtccaggccgagggcggtttccctcaacctggccggcgtctttcctgcgatggaaagcagcatgagagtggcgccccgcttgcggactacttcataagtaatgagtcatccctgcacttggtgctccgccgctgggcaggtgtcctcttgtgtgtcaagatcttgacgggcaagtcaatcacccttgagttggtgtcttttgtcaccattgacaacgtctaggccaacattcaggacactgaaggcatccccccagacaaccagcagctcatattcgccgacaagcaactcgaggacgggcgcacgcttgccgactacaacatccagaaggagagcactctccaccttgtgctccgcctcaggggaggcatgcagatctttgtgaagaccctgaccggcaagactatcacccttgaggtggagtcctcggacaccatcgacaatgtcaaggccaagatccaggacaaggagggcatcccccctgaccagcagcggctcatcttcgccggcaagcagctggaggacgggcgcactctcgctgattacaacattcagaaggagagcaccctccacttggtgctgcgccttaggggaggcatgcagatcttcgtgaagacccttactggcaagacgatcacccttgaggtggagtcctcggacaccatcgacaatgtcaaggccaagatccaggacaaggagggcatcccaccggaccagcagcgtctgatcttcgctggcaagcagctggaggatggccgcacccttgcggattacaacatccagaaagagagcaccctncacctggtgctccgcctcangggaggaatgcagatcttcgtgaagacattgacgggcaag

SEQ ID NO: 15744 - DNA, 383 bp, Sorghum bicolor
  unsure (1)..(383): unsure at all n locations
  Clone ID: LIB3478-058-Q6-K1-F7
tccggtgttgttcggcgtccacggtcacagtttgtacccaatccctcttctccgagccgggtcgatcgcccccttccctcgcttcaagatgcanatctttgtgaagaccctcaccggcaagactatcacccttgaggtggagtcttctgacaccatagacaacgtcaaggccaagatccaggacaaggagggcatccctcctgaccagcagcggcttatcttcgctggcaagcagcttgaggacggccgcacgcttgccgactacaacattcagaaggagtcaaccctccacttggtgctgcgcctcangggaggcatgcagatctttgtcaagaccttgactggcaagacaatcacccttgaggtggagtcttctgacacca

SEQ ID NO: 15745 - DNA, 544 bp, Sorghum bicolor
  Clone ID: SORBI-28MAY03-CLUS4043_2
cccacgcgtccgctggtctcagcaactagtatacaattaggccttgtttagttccaaatttttttggaaaattgacactgtagcactttcgtttgtatttgacaaatattgttcaatcatggactaactaggctcaaaagattcgtctcgtcaattccgaccaaactgtgtaattagtttttattttcgtctatatttaatactccatgcatgcgtctaaagatttgatgtgacggggaatctgaaaaattttgcaaaattttctgggaactaaacaaggccttgatctaccgtgaaaaatagttgcatgatggtttaacttaatttggcttttgatatataaattaatagataaaaatgtcttttagggaacaaaccactacctttttccgtatctggagagagtcttaggcaaacaaagaataggtttacctctgcgcgagtaggagataacagcagcatcaaccttcttataccagtagacaatctgagaacatggaatgcgctggccccaaaggcatgtccatttgtcattaccaaggtg

SEQ ID NO: 15746 - DNA, 1915 bp, Sorghum bicolor
  Clone ID: SORBI-28MAY03-CLUS4043_1
ccccgcagcacctttgggggtgcaaaaccgtccaaggcaagcctcaaactagtcaaatccacgccgagagtcaagtccagacatatagctatgcctcaagcgcttgcggttttggcattactaagcttcaaatgccccagcgaacacctagacgcggcctggctcctttccatcgcggaggcttctcagagggggacaccagctggcagcgcgtcagcagggttgccccccccttcgggagctgcatagcctcacctcatgggagagcgtaggaaaacgaccacttaaacaaggcaatgcatgaggatgcagcaagtactagaaaggtaccacaaggtgctggtaccagggccattagtatggggaggattacacaagaagaagaagaagaagcaggttaggaggagatcacccaagcggacggacggcatggaatggaagtgggaagcgtcaaagtttttatgtgttttgttttggcacaccacgacctgacccaaattctagctaaattgcagtagtagagtagtataagcaaacggaacgggaaggaacaattgttgcgcaaatcgctggacgggaccctgcaatgcaacggccgggacactgccgcggaacaaaccgacacgagacggcgagctggatggaggaaagcttccgcttcagggcttccagaggatggtggtgtcggcgatcatggaggtcaccacgtatgggtccatgttggacgccggccggcggtcctcgaagtagcccttgccgttctgctccgtctcccggcccacgcgcactgacgcgccacggtttgccactccccagctgaaggtgttgatgtcggcggtctcgtgcctgccggtgaggcggcgctcgttgccctcgccgtaggccgcgatgtgctccttgtgccgcaacttcagcttctcaatggcggccttgatcacctcgtacccgccctcgttcctcatggacttggtgctgtagttggtgtgtgcgccggcaccgttccagtcaccagggatgggctttgggtcgaatgtcaacaccacaccggcgatctcggtgatcctctcaagaatgtagcgagcaacccagacctgatcacctgaagaaatgccgacggacggtccaacttggaattcccactgccctggcatgacctctccgttgatgccactgatgttgatgcctgcataaatgcaagccttgtagtgggcatcaactatgtcacgcccgaatgacttgtccgcaccgattccacagtagtaaggaccctgagggccagggaagccaccaagaggccacccaaggggccagttggtgtccttctgaaggagggtgtactcctgctcaataccgtaccagggctcctcagcagcgacctcagggttgctgaagatcttggcggcgttgtgcctcttgttggtgggaattggctcgccagctggggtgtagcaatcgcacatgacaaggatgttgttgcccctccggaatgggtccttgaagatagcctgcgggtacaggatgacctcactgtcctcgccgggggcctggccggtgctggagccgtcgtagttccacttgggcagcttgctgggatcggtcaccgggccggagagggtcctggctttgctcctgagatccatgccagatccaccgatccatatgtactcggcgatgatcttctcggtggtgtccgagaggctgaggttgacgaggtcggtgagggaggccatggccggcggcggctgggaaggacccaaaggaggaagaagagggaggaggtggtggtgtgggattgagacccagtgggggccggcgatgagggcggctatatattggcgacgaccaaggacaaggatgggaaacaagttggcgtccagccggcccccgctctttgagagttgatcccaataaaaac

SEQ ID NO: 15747 - DNA, 490 bp, Sorghum bicolor
  unsure (1)..(490): unsure at all n locations
  Clone ID: LIB3476-022-P1-K1-F1
cacttctccagtactataaactacaggcgcgcgcgggcgcagcccgctgcgctgctagctcaccccgcgttctacttgcactgctcgatccaaagcgtccagtccaagtctccaatcgatccaatccacgcagagagtctcatcaatcgattgcgccacaccacaagcacagtcagcttatttgcttccatggcggcggaggctaagacggagcctgcagctccagccgcggcggcgggtttgggcctggcttcaggggagcagccgccgcagcagcagcagcagccgaagaagaagactgtgtgtgtggtcgcggtggacgacagcgaccacagctactacgcgctggagtggacggtgcggcacgtgacgggcgccggcggcatggcgggcggcgccgccgacctcgtcatcgttcacgccaagccctcgtcgtcctccgtcgtcagcttcngcngccctggagccgtcgaggcgatcaggtacgtgg

SEQ ID NO: 15748 - DNA, 555 bp, Sorghum bicolor
  Clone ID: LIB3481-033-P1-K1-E9
cgtccgattcaatgtttcatgtatgtgccaaaagattcgatgtgactggaaatcttgaagacgttttggttttcaggatgaactaaacaaggccttagcttaaaactgtaccagctgctaacgttttggcatttggcaaaataagtctttttagttctccaaatttttcaagattcctgttcacatcgaatctttcgacatatgcataaagtattaaatataaataaaaagatagctaattatacattttacctgtaatttgcgagacgaatcttttaagcctacttagtctatagttgaataataattgtcaaataaagccaaaagtactataatagcgaaatctaaaatttttcgcaaactaaggccttgtttagttctaattttttttttggaaaattgacactgtagcactttcgtttgtatttgacaaatattgtccaatcatggactaactaggctcaaaagattcgtttcgttaatttcgacaaaactgtttaattagttgttattttcgtttatatttaatactctatgcatgcgtctaaaaattcg

SEQ ID NO: 15749 - DNA, 421 bp, Sorghum bicolor
  unsure (1)..(421): unsure at all n locations
  Clone ID: LIB3480-030-P1-K1-A5
attaaatatagataaaaataaaaactaattccacagtttggtcgaaattgacgagacgaatcttttgaacgtagttaggccatgattggacaatatttgtcaaatacaaacgaaagagctacagtgtcgattttgcaaaatattttggaactaaacaaggcctgagaatactgagataggaaaatatggaggccttgaagaagaggttgagagttgggacacttaagagggacaaggcccttttaatgcaggactgtcagatggaatcacaacagaactggaaaagtcctcaatgtggaccgtactaattgactttctgcagatttgtgacgaacggaatcctgagactggccaggttagccaccattgngaacctgaagaccatcgggattgcttggaatccagtttattgattaatcct

SEQ ID NO: 15750 - DNA, 229 bp, Sorghum bicolor
  Clone ID: LIB5052-006-A1-XP1-G5
gccggccgggctttctaggagatgagattaggagaatatttacgcttcccacttccattccatgccgtccgtccgcttgggtgatctcctcctaccttcttcttcttcttgtgtaatcctccaataatggccgtaccacacttgtggtacctttcagtacttgctgcatcctcatgcattgcattgtataagtggtcgctttcaaaaaaaaaaaaaaaaaaggccccta

SEQ ID NO: 15751 - DNA, 471 bp, Sorghum bicolor
  Clone ID: SORBI-28MAY03-CLUS683_3
cccacgcgtccgggccgtgcggcccttgatgcccggttcaaggtctctggtatcccacacctggtcatccttgatgcaaaaactggtgaagtttacactgaagatggtgttgaatttgtgagtgagtatggcgtggaggcttaccctttcacaccagataggatcaatgaactgaaggaacaggaaaaggcagaaaaggagaatcaaactattcaaagcgtgcttggcacatctactcgagactatctcatttcaaacaagggagacaaggtacccatctctgagcttgaggggaagtatgttggtctgtgctttgtggtggatggctatggaccagtcattgaattcactgattcgcttgctaagatctatgagaaactcaaagaagtgggggagaaatttgaagttgtagctgtttccttggacagagagagtcagcatttattgaaagttttgcaaagatgccttggc

SEQ ID NO: 15752 - DNA, 796 bp, Sorghum bicolor
  unsure (1)..(796): unsure at all n locations
  Clone ID: SORBI-28MAY03-CLUS683_2
gttactttgagcttaggtctcttcctacactagttctgattggccctgatgggaagacactgaacagcaatgttgcggacataattgatgagcatggttttgaggcatgggagggcttcccattcagtgctgagaagctggaaattcttgctgagaaggcaaaggctaaagctgcatctcagaccttggagtcccttctaatcagtggtgatttggactttgtcattggaaaaggtggagcaaaggttcctgtatcagaacttgttgggaagactgtcctcctctacttctcagcaaaatggtgtggaccatgccgtgccttcctgcccacacttgtcaaggaatacaacaagatcaaagagaagaacagtgattttgagatcgtcttcatctccagtgacagggatcagagctcattcgatgattttttctctcaaatgccatggcttgctctacccttggaagatgaaaggaaggtatccctgaagaagaccttcaaaatccgtgggatcccttcacttgtcgccatcggtcctactgggcagacagtcagcagggacgcaaaggcccagctgatgatccacggtgctgatgctttcccattcactgaggagagactcgaggagctgcagaagaagctggacgagatggcaaaggggtggcctcagaagctgaagcatgagctgcatgacgagcatgaactcgtcctgcttgcgccgggtacgtacggctgcgacgggtgtgaagagatgggcagcacatggtcctacangtgcgatgagtgtgactttgatct

SEQ ID NO: 15753 - DNA, 2571 bp, Sorghum bicolor
  Clone ID: SORBI-28MAY03-CLUS683_1
acagcgaaacatcaactgcgtaggaagccgcggccagagcccagagagccccagagccagttcccgttcccgtccatcaaccgtcaaaccaccaccaccacccgcgcccaccactccactccgtccgctctcgcctgctctgcttgctttctctcgcacgctccagcggatggcggaggcggaggcggaggccgcgcccgcagcagcagccggcggcggcggcatcggggacatcctcgcccccgccgagccggctttccccctcgcccacgcccgtgagcacgtgaagagcggcagcatcgagccgacccctgtggccctcgcctcctcggcctcgttgtcctcgccagcgctgacgtccagtcgtgagacacatggagtggacacagtgcaccgcttccagggcgcgcgcatccagggcttccaggcgtaggctgctcagactggcgctggggtccatcaatgctgtgcagagatgcctggggtgcgcgaagagatttctcgccactgagcaaggcatctcgtcctcgaggatgtcttattcgaggttccttgagtatcttgacaaggatagagtgaagaaggttgatttgtttgagaacgggacgattgctatcgtggaggccatttctcctgagcttggcaaccgcgtgcagagagtccgtgtgcagctgcctggtctaagccaggagcttcttcagaagttgagggagaagaacattgattttgctgctcacagcaaccaggaggactctggttctcttctgttcaaccttattggaaatttggcattcccacttatcctcatcggtggtctatttttactctcaagccagtcattgaattcactgagtcgcttgctaagatctatgagaaactcaaagaagtgggggagaaatttgaagttgtagctgtatccttggacagtgaagagtcagcatttaatgagagttttgcaaagatgccttggcttgcaattcctcaaggtgaccagaagtgtgagaagctggttcgttactttgagcttaggtctcttcctacactagttctgattggccctgatgggaagacactgaacagcaatgttgcggacataattgatgagcatggttttgaggcatgggagggcttcccattcagtgctgagaagctggaaattcttgctggttggggcttccagagttcgtcaccttttcaagtggagtaaggagaatgctccttgcatagtatctgttgatgaaattgatgctgttggaaggcaaagaggtacaggtattggtggtggaaatgatgaaagggagcagactctcaatcagcttctgactgagatggatggttttgagggcaacactggaattattgttattgctgccactaaccgagctgacatcttggattctgctttactcagacctgggcgctttgacagacaggtgtctgtcgatgttcctgatgtccgtgggaggacagagattctaaaagtgcatggtagcaacaagaagtttgattctgatgtttctcttgatgtcatagcaatgagtcctactgggcagacagtcagcagggacgcaaaggcccagctgatgatccacggtgctgatgctttcccattcactgaggagagactcgaggagctgcagaagaagctggacgagatggcaaaggggtggcctcagaagctgaagcatgagctgcatgacgagcatgaactcgtcctgctgcgccgtggtacgtacggctgcgacgggtgtgaagagatgggcagcacatggtcctacaggtgcgatgagtgtgactttgatctgcaccccaagtgcgcgttggcggaggaaaagaagggtgaagaggaggaaggcaagtccactgaggaagcccctgctgggtatgtgtgcgaggaaggcgtgtgcaggaaggtctagatttgttctactgagttccctttgcgtttccggtgctatctgaatggtgcgagcgatgccaataagatggtcgtaacttttggtatgtctcaaattggtccatggtccctgatggagggtggagcacagagtggggatgtcatcatgagaatgatggcaaggaactccatgtcagagaagcttgcggaggacattgattcggctgtgaagcagttgtcagatgaggcctacgagattgctctgaggcacattagaaacaacagggaggccattgacaaaatcgttgagttgctcattgagaaggagacactgaccggagacgagttccgggcgattctttccgagtttgtggagatccctgttgagaaccgggttcccccagccacaccggcggccgccctccctgcctaaactctagtcttgtaggggtgaaatttgttgttgtaagatgttcatattttgtattcttggtgtacactaactctacttcacctgccggatttttggtacacgacatgtaacttactcatggtgaattatagtaaaatgtaattagcttaaaaggcctgccgcaacattttcaatttatagcttctggcgagtgaaatctcttgctcggcgattaacgagaaaattccacggttcctactgc

SEQ ID NO: 15754 - DNA, 500 bp, Sorghum bicolor
  unsure (1)..(500): unsure at all n locations
  Clone ID: SORBI-28MAY03-CLUS105_2
cccacgcgtccgctcctctcctcttctctcgtctccccgcccgagctcaccaacgcccctcctcgccgcggatcccccgctactccggtagaaaatggctgacgccgaggatatccagcccctcgtctgcgacaatggaaccggtatggtcaaggctgggttcgctggagatgacgccccgagggccgtcttccccagcatcgtggggcgcccgcgccacaccggtgtcatggtcgggatggggcagaaggacgcctacgtcggtgacgaggcgcagtccaagaggggtatcctgaccctcaagtaccccatcgagcacggaatcgtcagcaactgggacgatatggagaagatctggcatcacaccttctacaacgagctccgtgtggctcccgaggagcaccccgtcctcctcactgaggcgcccctgaaccccaaggctaaccgtgagaagatgacccagatcatgttcgagaccttcaacacccncgccatgtacg

SEQ ID NO: 15755 - DNA, 1841 bp, Sorghum bicolor
  Clone ID: SORBI-28MAY03-CLUS105_1
gcacgaggcccacttctcccctgtttcctctcgtgcattctccgtgggaagcgaggaggactcgcggccggcggcacgcgctgccatccaggtccagtcgacccgcccctcttcgctgcgatcccagcccgcccccccttgccggcgtcctcgccgcggggctcgcgctacgtctgcccatgctggatgatccctgggctgatgacccccggggatgccatcaagcccccggtatgctacaatggcggttggatggtgaaggccggttgcgccggtgattatgcgcgcagggttgtcttcccgagtctcgtcgggggtctgcgccatacgggggtgatggatggggactggggcagaaaggcgcctacgtcggcgacgagcctcagtccaagaggcccatcttcaccctcaagatccccatcgagtgcggactcatcagcaactgagctgacatggaaacgattagacaccgcaccttctacaacgagatccgtgtcgcccccgaggagcaccccgtgctgctcaccgaggcgccgctgaaccccaaggcgaacagggagaagatgacccagatcatgtttgagaccttcaatgtgcccgccatgtatgtcgccatccaggctgtgctttccctctatgccagtggacgcacgacaggtatcgtgttggactctggtgatggtgtgagccataccgtgccaatctacgaagggtatgcccttccgcacgccattctgcgtcttgacctcgctgggcgtgatctcacagacagcctgatgaagattctcactgagaggggttactccttcaccaccactgctgaacgggaaattgtaagggacatcaaggagaagctcgcctatgtggcacttgactatgagcaggagctggagactgccaataccagctcctctgtggagaagagctacgagttgcctgatgggcaggtgatcaccatcggggcagagaggttcagatgccctgaggtcctcttccagccttctttcattggcatggaatcacctggaatccatgagaccacctacaactccatcatgaagtgtgatgtggatattaggaaggacctctatggtaacattgtgctcagtggtgggtcaaccatgttccctgggataggagaccgcatcctcgactccatgactgcccttgaacaaagcagtatctcgatcaaggaggaggcgcagtctgagaggaagaacattcaccggattggcgggtacatccttgcctcacttagcacttgccaacagttatggatctcaatccggcagtttcatgagtcagacgcaacaattgttcaccttaactgcctataaacgttggattcatggtgcttttatcttctgcggcctgctcttttgccttgtgtttgtgtcgctgctttcaagctaatgtttttgagatttgggttccattgaaccatctagcgggatttattggttatgacgaaagtaatgtacattgatacctatgttatatctctagtggtttcggtaatagatcttttgtttattcaatttttgtgagatgcattacgagtctactggcaagtttggtgccagtgttaaagagtattgaactatctactagcagtccttgtctactagtatgttctgtaatatagttttcaggtgattcattatcatttctattgtgcattcattctgggatatgacctatcgacattgcccagttaattcatgatttctcgtgtaatctttatgtgagtttcggagttgtaatcataacagtgccctcattgatgcagatctgatagtggcatcagtcaagaagttatttgccaaagagcaagacattac

SEQ ID NO: 15756 - DNA, 899 bp, Sorghum bicolor
  unsure (1)..(899): unsure at all n locations
  Clone ID: SORBI-28MAY03-CLUS193_2
cgtccggccaccactccccccatcgatctctcctcagtcccccgccgggaagctacgctacgaaggatggcgtccgtcaccgcccgcgccccggtcgcggccctgcgcccgtcggcggcgtcgtcgctcaacaagtcgtcgtcgtcctcggccttccttggccactctagccgcctcggccgcaccgcgtcgccgacgaccaggcgcagcctcaaggcggaggccaagggcgagtggctccccggccttccctcccccgcctacctcgacggcagcgtcttcaacccgctcaacttcgcgcccacgctcgaggccaaggagaaggagctcgccaacgggaggctggcgatgctggcgttcctgggcttcctgatccagcacaacgtcaccggcaaggggcccttcgacaacctgctgcagcacctgtctgacccatggcacaacagcatcattccagaccttttatcgatgatatatatccaggtcatgtaaaatgtgatccatcgctagcgagctgatggggactggaaggcaaacattgaagcgcggtcgtcgatgttaattcctttctggatcagtttgtgtgatgtgtgttgttaatcgatctggagggtatagattggggcggggggtgttgtaacttgtaatgcatggtatgaagagagagagggctgaggagtgacactgctggtatgtacattaatccaaggggagggctaagggtnaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgggcccccccnnnntttttntttttttccttcttaccatttttttgaaaaaaagggttt

SEQ ID NO: 15757 - DNA, 1338 bp, Sorghum bicolor
  Clone ID: SORBI-28MAY03-CLUS193_1
gcaccactgctcgtgaacaaggcagcacgaggctcgatcgacgatctaaaaaccaacgtgctcgatcgacgatctccccctccgccaccactccccccatcgatctctcctcagtcccccgccgggaagctacgctacgaagcatggcgtccgtcaccgcccgcgccccggtcgcggccctgcgcccgtcggcggcgtcgctcaacaagtcgttgtcgtcgtcgtcgtcctcggccttcctcggccactctagccgcctcggccgcaccgcgtcgccgacgaccaggcgcagcctcaaggcggaggccaagggcgagtggctccccggccttccctcccccgcctacctcgacggcagcctgccgggtgacaatggcttcgacccgttgggcctggcggaggaccccgagaacctgcggtggttcgtgcaggcggagctggtgaacgggcggtgggcgatgctcggcgtggccgggatgctgatcccggaggtgctgaccaaggccgggctcatcaacgcgccgcagtggtacgacgccggcaagtcggagtacttcgcgtcgtcgtcgacgctgttcgtgatcgagttcatcctgttccactacgtggagatccggcggtggcaggacatcaagaaccccggcagcgtcaaccaggaccccatcttcaagagctacagcctgccgccgcacgagtgcggctaccccggcagcgtcttcaacccgctcaacttcgcgcccacgctcgaggccaaggagaaggagctcgccaacgggaggctggcgatgctggcgttcctgggcttcctgatccagcacaacgtcaccggcaaggggcccttcgacaacctgctgcagcacctgtctgacccatggcacaacaccatcatccagaccctctcttagtcgatgatatatatccaggtcatgtaaaatgtgatccatcgctagcgagctgatggggactggaaggcaaacattgaagcgcggtcgtcgatgttaattcctttctggatcagtttgtgtgatgtgtgttgttaatcgatctggagggtatagattcggaccgggtttgttgtaacttgtaatgcatggtatgaagagagagagggctgaggagtgacactgctggtatgtacattaatccaaggggagggctaagggtaagattgtttgatcagtatcctcatcgatctatcccgatggggttcctcttgtgcttacttcttgcttgccacttgccagtccatggttcagtgtggaaacacatgcatgtatttgtacgagaactagtaggcttgtataattaagcaaatggtaaacatcgatgcccatcgcg

SEQ ID NO: 15758 - DNA, 1446 bp, Sorghum bicolor
  Clone ID: SORBI-28MAY03-CLUS737_1
cggctgccgccggcgagaaacccaatccagacaagcaaggaatccccgatggctcatcgcgttctcctcctcctttctctcgcggcggccgtcgcggtagccgccgccgtcgacacggaggatccgctgatccggcaggtggttcccggcggagatgacaacgagctggagctgaacgcggagtcccacttcctgagctttgtgcagcggttcggcaagtcctacaaggacgccgaagagcacgcgtaccggctgtccatcttcaaggccaacctgcgccgcgcgcgccggcaccagctgctggacccgtcggcggagcacggcgtcactaagttctccgacctgacgccggccgagttccgccggacctacctcggcctccgtaagtcacggcgcgcgctcctcagagagctcgggaagtcggcgaacgaggcgcctgtgctccccaccgatggcctgcccgacgacttcgattggagggaccacggcgccgtcacccctgtcaagaaccagggttcgtgcggctcgtgctggtcgttcagcacgtcgggagcgctggagggtgcgcactacctcgcaactggcaagctggaggtgctttccgagcagcagatggtcgactgtgaccacgtgtgtgatacatcagaacctgattcatgtgattctgggtgcaatggtgggctgatgacgaatgccttcagttatctccagaaggctggtggccttgagagtgagaaggattacccttacactgggagtgatgataaatgcaagtttgacaagtccaagattgttgcttcagttcagaacttcagtgttgtgtctgttgatgagggtcaaattgctgctaacctcattaaacatgggccactggcaatcggcatcaatgctgcctacatgcagacatacatcggaggcgtgtcatgtccatacatctgtggcaggacccttgaccacggtgttctccttgttggctatggcgcagctggttttgcccccattcgcctgaaggacaagccatactggatcatcaagaactcgtggggcgagaactggggggagaacggatactacaagatatgcaggggttccaatgttcgcaacaagtgcggcgtcgactccatggtctctaccgtgtccgcagtccgcacctcgaaggagtagactctgatcagttgtcttccctgattataatggtgatttcatatattgtagaactacaattcctgccagtaatatatgctccatctgtgctgttttatatatcgaaggcagcaaagatgtgaagcggcaacgcgatgcttgctgtaagtttatgtttggcttgcgacgcatgctacacgctatttggatgtagcaaagttatcaacatctgtatacgcattttaatctacaaaacttttgaataatttgtacataaaattatggtgtaatacgacccctact

SEQ ID NO: 15759 - DNA, 1927 bp, Sorghum bicolor
  Clone ID: SORBI-28MAY03-CLUS450_1
acttttaatttgtttcgaaaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccactccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcggttcttttttctgcagtacctcgacgtgacatgagcgtgaaagaggttcaagaatccgttttctttttataagggctaaaaacgaatcacttatttttttggctttttggccccatattacaagtcttggataagaatctacaacgcactagaacgcccttgttgacgattctttactgcgacagcatctaaggttcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcatccttactgtccctctacagaaccgtacatgagattttcacctcatacggctcctcgttcaattctttcgaagggatccttttcctcgttcgggagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcattttgaatctgggctcttctatcttcgacttatttttttggctttattctttatttatttcatttcgatttttccctcttcctctatccctatcctctaggtacagcgtttgcatcaatagagaactttttcctctgtatgaatcgatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatctccccaagtcgcttcttcatctccgggaatccggtaaggtacttttggaacaccaatgggcatattagattaatattattaaatttaagtaaaaaaactacactttaatatggaaacgtaagaatggaagagaaagaaagaatccgccctgtaccagtcccacttttcttctctgtggaccgaggcctcgtgc

SEQ ID NO: 15760 - DNA, 454 bp, Sorghum bicolor
  Clone ID: LIB3478-005-P1-K1-D3
gcactaagaacaggcaagcctttttgggttgtatccgaagacatggaaagggatgtttttatgtcagcagacgaagccaaagcttatggacttgtcgatattgtaggggatgaaatgattgacgagcactgcgatactgatccagtgtggtttccagaaatgtttaaggattggtagtgggtggattccttgtaaatttatttcaaacctaaattcgggttttatgctatagaaaatagaaatacttcatgatgatgaatcatcaggttaagatcgatctaaaccaatccattttatatatacaatacatacgacatgccaacggttaaacaacttattagaaatgcaagacagccaatacgaaatgctagaaaatcggccgcgcttaagggatgtcctcagcgtcgaggaacatgtgcctagggtgtatactatcaaccccaaaaaacccaac

SEQ ID NO: 15761 - DNA, 558 bp, Sorghum bicolor
  Clone ID: SORBI-28MAY03-CLUS98_10
tcgacccgctggggctctcggacccggagggcaccggcggcttcatcgagcccaagtggctggcctacggcgaggtgatcaacgggcggttccccatatccagactgcggatacacagcagcgacacggtcgcctgaacacgcacgcacacccacgttgtcagaagctgatcgtggttcaagacggcgctcctctccggccggcagctgctgggccacgatcgcgtgaactcgcacgcacacccacgttgtcagaggctgatcgatggcgtcgcaggccctcctccagaggactgcaagcacggggcgacagggagctggatcggctcatgctcaggtcaccaacagggaccgcacccctcgtcgatgaacaacagctcggctctgaccccaaagcaaggtgcccacaggcatctgttgttcgcgtacaagcatttcctctgctaccttgatagcacactaggcccgcgactattgattctaccagctggtgctctcgcaccctgagggcaccgacggcttcatctagcccaaatgaatggcctacggctatgtgatc

SEQ ID NO: 15762 - DNA, 858 bp, Sorghum bicolor
  Clone ID: SORBI-28MAY03-CLUS98_6
gcaaggagtatgatgagcttatggaagagttcatggctgctattaagcaaatctacggtgagaaagtcctcattcagtttgaggactttgccaatcataatgcctttgatttgcttgaaaaatataggaagagccatcttgttttcaatgatgatatccagggcacagcatcagtggtccttgcaggtctgttagcagcactcaagatggttggtgggaccctggcagagcagacttatttgttccttggtgctggggaggctggaactggtattgcagaactcattgctcttgagatttcaaaacagacgaaggccccaattgaagagtgccgcaagaaggtttggctggtggactcaaagggtttgattgttgactctcggaaaaactcccttcagtcattcaaaaaaccttgggcacatgagcatgagcccttgacaaccttgtatgatgctgttcagtccatcaaacctacagttctgattgggacatctggagttggaagaacattcacaaaagaagttgttgaggccatggcttccttcaatgagaggcctatcatcttttcactgtcaaatccaacctcacattcagaatgtactgctgaagaagcatataactggactcagggtcgtgcgatatttgccagtggcagtccatttgaccctgtggagtacgatgggaagattttggcccgggccaggcgaacaatgcctacattttccctggattcggccttggtcttggtatttctggagccatccgtggtcacgagggacatgcttctttgccgctgggaagcactagctggtcaggccacacaagagaactttgaccaggggtcgatctttccaccct

SEQ ID NO: 15763 - DNA, 854 bp, Sorghum bicolor
  Clone ID: SORBI-28MAY03-CLUS98_4
cgtccggcgcacgcgtccgaaaatatatcaacgcagatgatactgcaatgttgtagttatcgctgtttaatatagtccctgctgctaaccaccctggttgcgggtgctgctggtcgacactgtacctttctatgcatatatgatatgttgtaacgttatgaaaagcaaacaatcttttgtcccaaaaaaaaaaaaaaaaaaaaaaaaaaaaaaaaaaaaaaaaaaaaaaaaaaaaaaaaaaaaaaaaaaaaaaaggcgaagcgcaaaaaaacaaggaagaggccggcgtggcggcggcggcggcgcggggcgccggcgactacgcgaaccacaagcaccgcgagcagaaggcggcccactacgagaccaagcgtcagggcgccggagcacagccacagggtgccgcacggctactactgcaactgaaactcatccgatcgatcgatgcatatgcagatgcagatcatgcagatggacgatcgaacgaatgcatcagcatcaactcgatcctatggactgccgtacgtacgtacgtactatacgtgcgtgtaagtaaataagagcagacgtgacgtgtgtgttgctcactactcatacttatttgcaaaataataactaagcgcatgcttctgcagcgtgtaataaacgatcactattaggccttgttatttggatgtagtcggattcgcatcaatccacatgtgttaaaggtggattggagtggaacttaaactaaattccaccccagtccactctaacacatgtggattgagatgaatccgacaatattcaaacaaggccttaaatgtattgatgcatgcaattaaactatgtatatattgtgtgttaatgtc

SEQ ID NO: 15764 - DNA, 1075 bp, Sorghum bicolor
  Clone ID: SORBI-28MAY03-CLUS98_3
gcgctagcagcaatccattgtgtgtaattaattgtaacccgggccggcccgacactgcacgagatggccgactactaccacggcggcagggccagcatgtacgacgactgctacgacgccggcaggcacggcggcggcagcatgaaggcctactcgcgcaccgacgagtactatgacaacgtgcaggacgatcgcctgaacacgcacgcacacccacgttgtcagaagctgatcgatggcggctcaggctctcctctccggccggcagctgctgggccgccggccgggctgcgcccctctccgcccgccgaaactgcggaggtacagcagcgacacgatctcgccaccgcacgcaccttgtccgaagctcagcaccgatctatggcggctcaggctctcctctcccgcccggccgtgcagtcggccgtctccaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggattcgacccgctggggctctcggacccggagggcaccggcggcttcatcgagcccaagtggctggcctacggcgaggtgatcaacgggcgcttcgcgatgctgggagcggcgggcgccatcgccccggaggtcttcgggaagctgggcatcatcccgccggagacggcgctgccgtggttcaagacgggggtgatcccgccggcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcggcccactcttcaacccgctcggcttcggcaagaccgagaaggagatgaatgagctcaagctcaaggagacccaagaaacggcaggctcgccatgctcgccatcctcggctactttcatca

SEQ ID NO: 15765 - DNA, 1133 bp, Sorghum bicolor
  Clone ID: SORBI-28MAY03-CLUS98_2
gccgggcgggccgggcggggaactgcggatacacagcagcgacacgatcgcctgaacacgcacgcacacccacgttgtcagaagctgatcgatggcggctcaggctctcctctccggccggcagctgctgggccgccccgccgtgcagtcggccgtctccaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggattcgacccgctggggctctcggacccggagggcaccggcggcttcatcgagcccaagtggctggcctacggcgaggtgatcaacgggcggttcgcgatgctgggagcggcgggcgccatcgccccggaggtcttcgggaagctgggcatcatcccgccggagacggcgctgccgtggttcaagacgggggtgatcccgccggcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcggcccactcttcaacccgctcggcttcggcaagaccgagaaggagatgaatgagctcaagctcaaggagatcaagaacggcaggctcgccatgctcgccatcctcggctacttcatccaggggctcgtcaccggcgtcggcccgttccagaacctgctcgaccacctctccgaccccgtcaacaacaacgtgctcaccagcctcaagttccactagaacgtccgttggttgctgcatcatacctgttgttcatatgctctggcttggctgatgcatggaaaggagcctgaagcgttgcatcaggactcatggccagcctgctgctgcttgtaacaaattagtattgatcttgttgagaccacaaactatattgcacatggtaaatcaatgtgcaaaaaaaaaaaaaataaaaaattaaaaacaaaaacaaagaaaacattaaactaaaagg

SEQ ID NO: 15766 - DNA, 2757 bp, Sorghum bicolor
  Clone ID: SORBI-28MAY03-CLUS98_1
cgtacgcttcagagcgcttctacggttagaaagtgcttgttcagttcgaggacttcgccaaccataatgcctttgatttgcttgaaaaatataggaagagccatcttgttttcaatgatgatatccagggcacagcatcagtggtccttgcaggtctgttagcagcactcaaggtggttggtgggaccctggcagagcacacttatttattccttggtgctggggaggctggaactggtattgcagaactcattgctcttgagatttcaaaacagacgaagactccaattgaagagtgccgcaagacacattctttccgcgactcttcttctttgatgtgcccctctccgcccacccgaactgcggatacacagcagcgacacgatcgcctgaacacgcacgcacacccacgttgtcagaagctgatcgatggcggctcaggctctcctctccggccggcagctgctgggccgcacgaggcctgcactagcgctagcagcaatccattgtgtgtaattaattgtaacccgggccggcccgacactgcacgagatggccgactactaccacggcggcagggccagcatgtacgacgactgctacgacgccggcaggccccgaggtggcagccctcctcccacccccaactccgacgagagccccaggatttctgagccaaatcctttttgtgacccaatgggagaggcctcgccgtcgatcgccaaggacgtcaccgagttgatcgggaacacgccgctggtgtacctcaacaaggtcaccgatggctgcgtcggccgcgtcgccgccaagctcgagtccatggagccctgctccagcgtcaaggataggattggctacagcatgatcacagacgcagaggagaaggggctgatcattccaggcgtgagtgttctgattgaaccaactagtggcaacacaggcattggactagcctttatggctgctgccaagggctacaaacttatactcacaatgcctgcctccatgagcatggagaggaggatcatcttgaaggctttcggtgctgaacttgtccttactgacccactcctgggaatgaaaggagctgtcaaaaaggcgtaagagattcactcaaagacacccaagtcatacatcctcaaccaattcaacaagcccgaagaccagaagagtccttatgcgactacgggtccctatttccgcccggccgtgcgctgggacgtctcctgctcgtcggcgaggaaggcggacttggtcgacagggccagctccagccctccagccaagcaaggtgactacaggcagctgtggttatcgtccaagcagaccctctcgtacctcgatggcacgctgcccggcgagtctggattcgactcgatggggctctcggacccggtgggcaccggcgtggttatcgagccccattggctgactctacacgttttgagcaacggagccattgagactgcaagactggcgttcgacaaggctatggatgggtatccgactgttggcatcctctgggggagttaggcgcgccagtagacctgaactgccgtaaagctattggttgtcgtgttcccaagctttggtgagcgctacccctcatcagtgctgttccagtcgatcaagaaggaagcagagagcatggtggtcgagccctagagcatgcaattctcgcgaccattttcaggatgttccccattttcgtcacagaaataaagcttcggtgcccttcttcttcccttgactcgacatacatctgtctgccgacgatgtccagccccatgtggtcgatgttttgacatcgtttatagacattgtgatgtttttttacctacaatttgacactcgttctattctgtatatcgcgtcagccaagtgtgaaatccaagccgcccaccccgtcaacaacaacgtgctcaccagcctcaagttccactagaacgtccgttggttgctgcatcatacctgttgttcatatgctctggcttggctgatgcatggaaaggagccagaaacgttgcatcaggactgatggcaagcctgctgctgctttcatcttttcactgtcaaacccaacctcacattctgaatgtactgctgaacaagcatatacctggactcagggtcgtgcagtatttgccagtggcagtccatttgcccccgtggagtatgatgggaagacttttgtacctgggcagtcgaacaatgcctacatcttccctggactcggcctcggtcttgttatttctggagccgtccgtgtccacgaggacatgcttcttgccgcctcggctgcactagctgatcaggccacagaggagaactttgtcacgggatcgatcttcccacccttcaccaacatcagaaagatctctgcgtacattgctgcagccgttgctgcaaaagcttatgaactcggtttggcgacccgtctgcctccccccaaagacctggtggcatatgcagagagctgcatgtactctcctgtctaccgtaactaccagtagtgctgctggaatcaattttggagttataaaatatatcaacgcagatgatactgcaatgttgtagttatcgctgtttaatatagtccctgctgctaaccacccttgttgctggtgctgctggtcgacactgtacctttctatgcatatatgatatgttgtaacgttatgaaagcaaacaatcttttgtcccaaagtttgttattcctttcgtttgctttatgatggtcttttgattttgaaaaca

SEQ ID NO: 15767 - DNA, 490 bp, Sorghum bicolor
  Clone ID: LIB5049-003-R1-XP1-A9
gccggccgggccgggaaaaagctttgatggatgcagcggtgagttttgcttttctccattaccaggtctcaggttcgaaccagatctatagcaaatttttcctattatgttttcaagagagctgcatgtacactcctgtctaccgtaattaccgatagtgctgctgggatcaattttgcagtaataaaatctatcaacgcagatgataccgcaatgttgtagttattgttgtttgttgtccctgctgctaaaccacccttgttgttggtgctgctggtggacactgtacatgtctatgcatatatgatgtgttgtaactttatgaaaggaaacaatcctgtgtaccaatgtttgttattctttcgctcgcgtatgatgatctgttaaagtggcatgtaaggaaactatagaattctgcatgtctgcacatacgaattgttaagtgatctttctggttaatggctaaaaaaaaaaaaaaaaaaggccccta

SEQ ID NO: 15768 - DNA, 453 bp, Sorghum bicolor
  unsure (1)..(453): unsure at all n locations
  Clone ID: LIB3478-038-P1-K1-B11
gacgagaggcttttctacaagcttttgattgaaaatgtggtggagctgcttccttatgtttacacaccaactgtaggtgaggcctgccagaagtatgggtccatctttggacgaccacagggtctgtatgtcagctggggctctcggacccggagggcaccggcggcttcatcgagcccaagtggctggcctacggcgaggtgatcaacgggcggttcgcgcagctgggagcggcgggcgccatcgccccggaggtcttcgggaagctgggcatcatcccgccggagacggcgctgccgtggttcaagacgggggtgatcccgccggcgggcacctacaactactgggccgactcctacacgctcttcgtcttcaacatggcgctcatgggcttcgccgagcaccgncggcttcaggactggtacaacccgggctccatgggcaagcagtact

SEQ ID NO: 15769 - DNA, 389 bp, Sorghum bicolor
  Clone ID: LIB3481-011-Q6-K1-D7
cgtccgcgcctgccctagcgctagcagcaatccattgtgtgtaattaattgtaacccgggccggcccgacactgcacgagatggccgactactaccacggcggcagggccagcatgtacgacgactgctacgacgccggcaggcacggcggcggcagcatgaaggcctactcgcgcaccgacgagtactatgacaacgtgcaggacgaccgcatcaggatgaggcccgtgtacgccgacgacgactgtactggctacaacggcggcggctacggcgccggcaggcagaccgccgtctacactactgacgagtactcccgcggcggcggctacggcggcgagcaggagcacttcaagagagaggagagggagcacaagccaaggagcgcc

SEQ ID NO: 15770 - DNA, 370 bp, Sorghum bicolor
  Clone ID: LIB3481-024-P1-K1-H5
cgtgcgattaattgtaacccgggccggcccgacactgcacgagatggccgactactaccacggcggcagggccagcatgtacgacgactgcgtgacgacgccggcaggcacggcggcggcagcatgaaggcctactcgcgcaccgacgagtactatgacaacgtgcaggacgaccgcatcaggatgaggcccgtgtacgccgacgacgactgtactggctacaacggcggcggctacggcgccggcaggcagaccgccgtctacactactgacgagtactcccgcggcggcggctacggcggcgagcaggagcacttcaagagagaggagagggagcacaagcacaaggagcgccttggcgaagtgggcg

SEQ ID NO: 15771 - DNA, 4013 bp, Sorghum bicolor
  Clone ID: SORBI-28MAY03-CLUS70_1
cacagccttctgcgcccagtctgggaaccgcgtcgccgcccccccctacctagacgtcgaattgatgtagctcactcttagtcggtgcagaaccttgatttttattgctagcttcgactctggagccaagaaggccctaaaacgtcggcgacccgctcccgctccagagctcgctgcttcgctccacccacccttaacagggaaagagaggacatattatctaacgagtatcccatttttacattggtttacaacatagtacaagtacaccatgcatcgcaccacgaacattccatcatcattgacagtctactccgcagtccgcccccacaaaaaaatgaagtttcatatcggccatcaacctaacaatgcatgtgcggtagcactcctcaataatgctaaacctcatttaggggtgaaggcctggaagatggtggcgtggccggggtcggcgaggtgggcgaagaggttgtcgatggggccagtgccggtgtactcggcctggaaccaggcgcccatgacggcgagcatggcgaggcgtccgttcttgatctccttggtgcgcagctccttgatcttctccggcgagccggagccccagccgagtgggtcaaaccacaggccaccagggtacccgacgtcggtgccggtgagcttgttgctggggaagatggggtcagtgttgacgcttccgggcttgatgatgtcagcccagcggcggccctcggcccagccgatgaggatgagctcgatgatgaagagggtggtggtgtcggtgaagtactgctgctcgccggcggtgtaccagaagggcgtgttgaggatgccgatcttggtcaggaactccgggatgaagatgcccgccgcgccgagcatcgcccaccggcagtgcaccagctccgcctgcacgttccaccgcaggctctccgggtcagatccgaggccccagggatcaaagccgaagtcgcccggaaggctgccgtcgagccacgggggaggggtgctgccggggaaccagatcggcctgtcggggtccgccgcggcgcgcacggcgaacgacggccgggccgcctcggtggcctgcctcagcagcgtcttgccgccgaggaaggacgtcgacgacgcgcgctgctgcccattcctggggagcgccgcgacggcggtggtggaggacgaggaggcggagacgagtgccattgagctgtgtggcgtcggcccttgtcatggctgttgtggttaatgaaaatgaagaggatgatgaacctgggcccgaacaaccaccacaacagcagaagaagaagagactgtggggtctcattgtttgccaccatgaaagccccagatatgtcccgtttccactgcggtatgcctgtgaattcttggcccaagtgtttgctgtccatgtaaacaaggagtttgaattggagaagcagatacgagagaaaagcattctgcgaatgcaaacaatgctctctgacatgctgttcaaggaagcatctcccttgagtatcgtatctgggagtccaaatatcatggacctagttaagtgtgatggtgctgctcttttgtatggggacaaagtctggcggcttcaaacggctccaaccgagtctcagatacgtgatattgccttctggctttcagaagttcatggggattccactggcttgagtactgatagcctccaggatgctggatatccaggagctgcttcccttggtgacatgatttgtggaatggcagtggctaagatcacgtccaaggacattcttttctggttcaggtcacatacagctgctgaaatcaaatggggaggtgcaaagcatgatccatctgataaggatgacaacagaaggatgcaccctaggttgtcctttaaggctttccttgaggttgtcaagatgaagagtttgccatggagcgactacgagatggatgctattcactcattgcaacttattcttagaggtacactgaatgatgccttgaagccggtccaggcatctggtttagataaccagattggtgatctcaaacttgatgggcttgctgaattgcaagcagtgacaagtgaaatggttcgcctcatggaaacagcaactgttccgatcttggcagtagatggcaatggattggtcaatggatggaatcaaaaggtagcagaattgtcagggttgagagttgatgaagctataggtagacacatacttacacttgtggaggattcttctgtatcaattgttcagaggatgctatatttagctctgcagggcaaagaagagaaggaagttcgatttgagttgaaaacacatggctccaagagggatgatggccctgttatcttggttgtaaatgcttgtgccagtcgtgaccttcatgaccatgttgttggggtgtgctttgtagcccaggatatgactgttcataagttggtcatggacaaatttactcgggttgagggggactacaaggcaatcattcacaacccaaacccgctcattcctcctatatttggtgctgaccaatttggatggtgctctgagtggaatgtagccatgaccaagcttactgggtggcacagagatgaagtgatagataagatgctccttggtgaggtttttgacagtagcaatgcttcctgccttttgaagagcaaagatgattttgtacgtctttgcattatcatcaacagtgcattagccggtgaagaggcagaaaatgctccattcggtttgtttgaccgcaatgggaaatatattgaatgccttctgtcagtgaacagaaaagtaaatgcagatggtgttgtcactggagtgttctgtttcattcatgttcctagtgatgacctgcagcatgcgctacatgtgcagcaagcctctgagcagacagcacaaagaaggttgaaggctttctcgtacatgcgacatgccatcaacaaacctctctcaggtatgctttattctagggaaacactcaagagcacaggtctgaatgaagagcagatgaggcaggtccatgttgcagatagttgtcatcgccagctaaacaagatacttgccgacttagatcaagataacattactgacaagtcaagttgcttggatttggatatggctgaatttgtgttggaagatgtggtggtgtctgctgtaagtcaagtactgataggttgccagggtaaaggtatcagagttgcttgcaacctgccagagagattcatgaagcaaaaagtttacggggatggtatccgactccaacagatcctctccgacttcttatttgtttcggtgaagttctctcctgttggtggctctgttgatatctcttccaaactgactaagaacagcattggggaaaaccttcatctcatagacttcgaacttaggatcaagcaccaaggagcaggagtcccagcagaaatattgtcacaaatgtatgaggaggacaataaagagccgtcagaggagggtttgagccttcttgtttctagaaaccttctgaggctcatgaatggtaacattcgtcacatcagggaagctggcatgtcaaccttcatcctcactgctgaacttgctgctgctccttcagcagttggacaatgaagccatcacatgctctctcagagttcattctgaaagccacggtggtttgcggagaatgggaaatgctgcagcgcgttgcatcaccgaatgcataagaaataagattgacttgtatggttatttgttagggggggaaagttgtactggcatagacgcatagtaaggttccatacttctgctctgtttgtgcctgtaaaccaactgtgcaagttttaaacttccagaaacaaagaaaaaaccaagttcaagttaatatgaataataaagtgtttttataaaaaagctgataaattattaaatttagcggcagctttggtgtcttatttctgcctacgctcccacgctctgtgtatgtggtggtacagtatactggtgtagctatgcctggtgggctaaccacggctcttgtcc

SEQ ID NO: 15772 - DNA, 483 bp, Sorghum bicolor
  Clone ID: LIB3481-035-P1-K1-G2
cgtacaggccaccctttttttttttttttgcacacatcatcatcatcatcaagccattgattcaggggagaggggacatattatggaacgagtatcccatttttacattggtttacaacatagtacaagtacaccatgcatcgcaccacgaacattccatcatcattgacagtctactccgcagtccgcccccacaaaaaaatgaagtttcgctatatttagctctgcagggcaaagaagagaaggaagttcgatttgagttgaaaacacatggctccaagagggatgatggccctgttatcttggttgtaaatgcttgtgccagtcgtgaccttcatgaccatgttgttggggtgtgctttgtagcccaggatatgactgttcataagttggtcatggacaaatttactcgggttgagggggactacaaggcaatcattcacaacccaaacccgctcattcctcctatatttggtgctgacc

SEQ ID NO: 15773 - DNA, 451 bp, Sorghum bicolor
  Clone ID: 9302145
acaataccgggcgcgttagtgtctggtaattggaatgagtacaatctaaatcccttacctaggatccattggagggcaagtctggtgccagcagccgcggtaattccagctccaatagcgtatatttaagttgttgcagttaaaaagctcgtagttgcaccttgggccgggtcggccggtccgcctcacggcgagaaccgacctactcgacccttctgccggagcatcgaccatggatgagtatctatctacgcctgatatgatgagatgatgagttgtctactcctgctacgtcgtcctactgaatacaaatctctccgtatgtacgtacgtgtcgtcgtgtacgctgtgatacgcttgcatcttagcgtatgtacgtacgtgcgtgtgtacatgtgtgtgtgagagatgtacttttccttgttgggtttatttttgagtgcatgcacta

SEQ ID NO: 15774 - DNA, 473 bp, Sorghum bicolor
  Clone ID: 7553021
gcacgaggggcaggtgagctcggccatcgcgccctgcctgtcctacgcccggggcccgtcaggagcctcaactccgccgcccgcaccaccgccgacaggcgcgccgcctgcaactgcctcaagaacgccgcccgtggcatcagcggcctcaacgccggcaacgccgccagcatcccctccaagtgcggcgtcagcgtcccctacaccatcactaaacctaaacgatgatcgatcgatcgatgatccattccgccgccgccgccgtcgtcgtcgatcggcgccggagcatcgaccatggatgagtatctatctacgcctgatatgatgagatgatgagttgtctactaatctctccgtatgtacgtacgtgtcgtcgtgtacgctgtgatacgcttgcatcttagcgtatgtacgtacgtgcgtgtgtacatgtgtgtgtgagagatgacttttgcttgttgggtttatttttg

SEQ ID NO: 15775 - DNA, 493 bp, Sorghum bicolor
  unsure (1)..(493): unsure at all n locations
  Clone ID: LIB3480-034-P1-K1-B5
cggacgcgtgggcagttacatacattattacataccatccaccgatcgaggatccaaggaagaagatgggagtgaacatgatgtcgtggtcgatgcangtggtgttggtggtggcgctggcgtttttggtgggtggtgcatggtgcggtcctcccaaggttgccccgggcaagaacatcacggccacctaccagcccctcaagaactcctggggcgctgtttggaggaaggacagcgacaagcccatcaagttccccgtcactgtccaaatcaccaccgagggaggcaccaagaccgcctacgaagacgtcatccccgaaggatggaaggccgacaccacgtacaccgccaaataagctatccagcagacctaccacagatctgggctgggttggattggatcccagctacccaagcaatgcattacacttatgcatgcattgatccatgcataatatctatttttactgctgctattgtgacgaagacaacg

SEQ ID NO: 15776 - DNA, 660 bp, Sorghum bicolor
  Clone ID: LIB5052-011-A1-XP1-G2
gccggccgggccgggaccagctagcacttgctcacttgcattccaaagctagtacacaagctagcagtctcctcgatcccagtctcgatcagaattcagacaccaagaacatcgacgacatggctcggcttgctgtggcgatcgccgcctgcaactgcctcaagaacgccgcccgtggcatcagcggcctcaacgccggcaacgccgccagcatcccctccaagtgcggcgtcagcgtcccctacaccatcagcacctccaccgactgctccagggtgagctaaacctaaacgaggatgatcgatcgatgatccattccgccgccgtcgccgtcgtcgtcgatcggcgccggccggagcatcgaccatggatcgagtttgtctactactgctacgtcgtaatactgaataaaaatctctccgtatgtacgtacgtacgtgtcgtcgtgtacgctgtgatacgcttgcatcttagcgtatgtacgtacgtgcgtgtgtacatgtgtgtgtgagagatgtacttttgcttgttgggtttatttttgagtgcatgcactgtgtgcggtgtttattatttatgtccgtgtacgttcctctcgctcctgtggtttgtactatgttcgatcactgctacatgcacacacacatcttttcgtttccg

SEQ ID NO: 15777 - DNA, 353 bp, Sorghum bicolor
  Clone ID: LIB3476-031-P1-K1-H2
caacacccgccgcctcctgcaatcctcgtagcctccgtcgagcatcgatcatgtcggcctactgcggaaagtacaaggatgagctcatcaagaatgctgcctacattggcacccctggcaagggtatccttgctgctgatgagtccactggcaccattggcaagcgtctttccagcatcaatgtcgagaacgtggaggagaaccgccgtgccctccgtgagctccttttctgctgccctggtgccctccagtacatcagcggtgtgatcctcttcgaggagaccctctaccagaagaccaaggatggcaagccttttgtcgatgtcctccctggcatcaaggtcgacaagggc

SEQ ID NO: 15778 - DNA, 611 bp, Sorghum bicolor
  Clone ID: LIB5047-003-R1-XP1-B10
gccggccgggctggggcgctatctggaggaaggacagcgacaagccaatcaagtttcctgtcaccgtccaaatcaccaccgagggaggcaccaagaccgcctacgaagacgtcatccccgaaggctggaaggccgacaccacctacaccgccaaataaattgtccaactgacctaccgctgctctgggctcgcttgaattggatcccaacttcccaagcaatgcattacgcttatgcatgcattgatccttgcataatatctatgttgctgctgcaacgatgacgacgtcctccttcatcctctccatatgtagctagacagaggcttccttcgtcctctccatatatagctagggcgaggctctccatccgctctgttattatattaaaaagagagaagggcgaagaaataaagagagtggatacataataagtatctaacgagagatttgagacgcttttgtacgtaataaaaggagagcgagacaaacaacagttgtctatggatctcccatgtaatctcaattttatcatgcctacattttaagtgaatacacattttttcaagactaattgaaattaaagaaaaaaaaaaaaaaaaaaggccccta

SEQ ID NO: 15779 - DNA, 506 bp, Sorghum bicolor
  Clone ID: LIB5047-012-R1-XP1-E11
gccggccgggccgggctcttccctcttacagccgccgccgcatctcccagcctccccgcgctcgcctccgtcgccgctgccgccgccgtttcgcagccatgggtaaggtgcacggatcgttggcccgtgccgggaaggtccgcgggcagacgcccaaggtggcgaagcaggacaagaagaagaagccccgcggccgcgcccacaagaggatgcagtacaaccggcgcttcgtcaccgccgtcgtcggcttcggcaagaagcgcgggcccaactcctcggagaagtaggcgccgcgatgcgacgccgttcggctcgtaccggttcctcaccctttccgctctcagtttgcttatgctcttgctggtagtagtttcgttgtgcaagcagaggaagaaccttttgtagtttcagcttcgttgttcgtgtgatgagatgggaactcgagattatatatgtccctcgttattaagaatttgaggcaaaaaaaaaaaaaaaaaaggccccta

SEQ ID NO: 15780 - DNA, 763 bp, Sorghum bicolor
  Clone ID: SORBI-28MAY03-CLUS100_8
aggcgacatggtacggcaagccgacgggcgccggccccgacgacaacggaggcgcgtgcgggtacaaggatgtgaacaagggccccttcaacagcatgggcgcgtgcggcaacctccccatcttcaaagacggcctcggctgtggctcctgctttgagatcaagtgcgacaagccagccgagtgctccggcgaggctgtggtggtgcacatcacggacatgaactacgagcaaatcgccgcctaccacttcgacctcgccggcacggcattcggtgccatggccaagaagggcgaggaggagaagctgcgcaaggcgggcacatcgacatgcaattccgccgggtcagtgcaagtacggcgaaaaggtcaccttccacgtggagaaggggagcaaccccaactacctggcattgctggtcaagtatgtcgatggcgacggtgacgttgtgggggtggacatcaaggagaagggtggcgacgcttaccagcccctcaagcactcctggggcgctgtttggaggaaggacagcgacaagcccatcaagttccccgtcactgtccaaatcaccaccgagggaggcaccaagaccgcctacgaagacgtcatccccgaaggatggaaggccgacaccacgtacaccgccaaataagctatccagcagacctaccacagatctgggctgggttggattggatcccagctacccaagcaatgcattacacttatgcatgcattgatcatgcataatatctatttttact

SEQ ID NO: 15781 - DNA, 646 bp, Sorghum bicolor
  Clone ID: SORBI-28MAY03-CLUS100_9
accagctagcacttgctcacttgcattccaagctagtacacagagctatcagtctcctcgatcccagtctcgatcagaattcagacaccaagaacatcgacgacatggctcggcttgctgtagacgatcgccgtggtggcggcggcggctgtggaggtgactcgctggaccacaacggactggtcaacatgtacggaaagtgtgggagggtggctgctgcgcgcaaggtgttcgatcggatgaagagcagggacttgatttcatggaactcgatgattgggagctatggcacacatggtttgtgtgacgaagcccttgcaatgttcgaagacctgaccagggctacggttgagcctgacggcgttacattcgtcgccgtgctgtctgcgtgtagccacacagggcgcgtcgcagagggtcgctgcttgttcaaccagatggtgcgggagcacaagatctccccaaccatggagcactacacctgcatggtcgacctcctggggcgtgctggccttctgaaggacgtgtttgatcttatcgagactatgccaatgaggcccgacctgtgtgtgtggggagcgctgctcaactcttgcaggattcacggggatgccgcggtggctgaagctgccatagccaaagttct

SEQ ID NO: 15782 - DNA, 372 bp, Sorghum bicolor
  Clone ID: SORBI-28MAY03-CLUS100_10
accagctagcacttgctcacttgcattccaaagctagtacacaagctagcagtctcctcgatcccagtctcgatcagaattcagacaccaagaacatcgacgacatggctcggcttgctgtggcgatcgccgtggtggcggcggcggcgacgcgggcgccccgacgtcgtggagggcaggtccatggagccctcctccgacgcgcctgctcccagccccgacgcctcgtccccggagtcgtcgtcgtcgccgccgccacgcaccctccagcagcagctcttccgactaaccgaccggccgccgtcgccggcagagatatcgcgccctccgtctacggtgaacgatccggccggccagcatctcgccactcgg

SEQ ID NO: 15783 - DNA, 1132 bp, Sorghum bicolor
  Clone ID: SORBI-28MAY03-CLUS100_11
gccggccgggctgggccctctttgtcctaccttcagcggcttaggggttagtccgacaacattccagcacggagtcatggacgcacaagccctgcaggcggcatcccagaggcgtcgctggcggctcctacaggcgagcgggtcgatggcgtgagcagcggctcctcctagtggagagcgggagccacctccttacggcgggtgagacggcgactcagacgagttggctggcgagctcttcccccttcagcgctgagcactctccaccacgacggtggcccccaacgagcaattggcacagatctttatacggtggcagaaatccagatcatggagtcagcggtggcgcagatccaacggtgccctgaggtgctcacggtggcaggggcagacgccagtaccacccgtgcttgcagtgacatgtcagttggcgctcgcagccatccggatccgatgagcggcggcgacgacggtggcggcactcagatgggcttggtgggcttcgttgatgagctcactaatttttttttattgattaattgaggcgagcatatcaactgtttagtgggctccatcgatgaactcactgttttttttgttttttattgattaatcgaggcggggatgtagttctatgattaacagtgatcattgattggagaccggttgccaatgtctgcctcctataaaatttatgtaccagtgcgacaccgatcggcatgtgtcgttgtagcgtgcattttccactatgatcttcgaggtaaccaacacacgagtctagatcgctggtcgatgcatggccggttccgttcagtcgaagcggccgtcgctgtcgacgaagcgcttgatgacgcgcatgagctcggcggaggcgtcggaccacgggtcgatggtgaagaagccgtgctgctggccgtcgaaatcccgcacctcgacgggcttccccgcggccttgagccgatccgcatagtccacggcgcggtcgtggaggatgtcgcgtcccccgacgacgaccatggtgggcgcgaactcgacggcgtccagcgcgggcgcgccggggccgaacgggttggacacggggtggtcggccgtggcgccctccggcagcgacaggcgccagtaccggtcgttg

SEQ ID NO: 15784 - DNA, 755 bp, Sorghum bicolor
  Clone ID: SORBI-28MAY03-CLUS100_12
cgatactgacgtgcaaatcgttcgtctgacttgggtataggggcgaaagactaatcgaaccatctagtagctggttccctccgaagtttccctcaggatagctggagcccattacgagttctatcgggtaaagccaatgattagaggcatcgggggcgcaacgccctcgacctattctcaaactttaaataggtaggacggcacggctgctccggtgagccgtgccatggaatcgggagctccaagtgggccatttttggtaagcagaactggcgatgcgggatgaaccggaagccgggttacggtgccaaactgcgcgctaacctagaacccacaaagggtgttggtcgactgctccagggtgaactaaacctaaacgatgatcgatcgatcgatgatccattccgccgccgccgccgtcgtcgtcgatcggcgccggagcatcgaccatggatgagtatctatctacgcctgatatgatgagatgatgagttgtctactactgctacgtcgtactactgaataaaaatctctccgtatgtacgtacgtgtcgtcgtgtacgctgtgatacgcttgcatcttagcgtatgtacgtacgtgcgtgtgtacatgtgtgtgtgagagaatgtacttttgcttgttgggtttatttttgagtgcatgcactatgtgcggtgtttattatttatgtccgtgtacgtttcctctcgctcctgtggtttgtactagttcgatcactgctacatgcacaccc

SEQ ID NO: 15785 - DNA, 416 bp, Sorghum bicolor
  Clone ID: SORBI-28MAY03-CLUS100_13
tacagtctcgatcagaattcagacaccaagaacatcgacgacatggctcggcttgctgtggcgatcgccgtcgtcgtcgatcggcgccggccggagcatcgaccatggatcgagtttgtctactactgctacgtcgtaatactgaataaaaatctctccgtatgtacgtacgtacgtgtcgtcgtgtacgctgtgatacgcttgcatcttagcgtatgtacgtacgtgcgtgtgtacatgtgtgtgtgagagatgtacttttgcttgttgggtttatttttgagtgcatgcactgtgtgcggtgtttattatttatgtccgtgtacgttcctctcgctcctgtggtttgtactatgttcgatcactgctacatgcacacacacatcttttcgtttccaaaaaaaaaaaaaaaaaaa

SEQ ID NO: 15786 - DNA, 1160 bp, Sorghum bicolor
  unsure (1)..(1160): unsure at all n locations
  Clone ID: SORBI-28MAY03-CLUS100_14
gccggccgggccgggaccagctagcacttgctcacttgcattccaaagctagtacacaagctagcagtctcctcgatcccagtctcgatcagaattcacacaccaagaacatcgacgacatggctcggcttgctgtggcgatcgccgtaggaggcggcggcggcgaagcaggagatgaagaagaacccccgcggacgcgcccacaagaggatgcagtacaaccggcgcttcgtcaccgccgtcgtcggattcggcaagaagcgcgtgcccaactcctcggagaagtaggcgccgcgatgcgacgccgttcggctcgtaccggttcctcaccctttccgctctcagtttgcttatgctcttgctggtagtagtttcgttgtgcaagcagaggaagaaccttttgtagtttcagcttcgttgttcgtgtgatgagatgggaactcgagattatatatgtccctcgttattaagaatttgagatatgatgatatgagccaatgactttattttaaaaannanngnnnnnnnnnnnnnnnnnnaagacaagcaggtagctagctatatatctgctctaatactaggatgcgctcatcagctcctgtgcgtgccgccgtcgtccaacaggtttcactagtgccgagtgccgagtagagcttgcacgtacagagcatggcgagcatcttcttctccgaggtcgcgccgtggcagctcgtccccgccgccgccgtcgccccgccgaggtcggccaagctcgacaccatcgtcgaggacgaggaggacgacgtctccggcgtcagcatggcgcacgacgccgccgttgccgggtgctgcttccagagtggtggggctttttcttcgtcgtcgtcagcttcggtggcgggcggcggctactcctgaaccggccggcctctacggcgcggcggctggcgcgcaccagagtcatattgttgaggtgaaattatcgtgtgtgcgctcgggataaatataaataaataaagaagaaagtttatgtatgtatgtatgtatgtatgtatgtatgtatgtatgtatgtatgtatgtatgtatgtatgtgtccctagcaattatatttagacgttgcaaaagggcatgacacgtcggtttgtgtaactatatatagtttactatgttgttgacgaca

SEQ ID NO: 15787 - DNA, 665 bp, Sorghum bicolor
  Clone ID: SORBI-28MAY03-CLUS100_15
gccggccgggcctcccatttgaaccctcaccagctagcacttgctctcactgcattccaaagctagcatatatactagcacacagtcaggcactcagatcactcagcaccgccgacaagcgcaccgcctgcaactgcctcaagagcgccgccggacgtgtcagcggcctcaacgccggcaacgccgccagcatcccctccaagtgcggcgtcaacatcccctacaccatcagcgcctccatcgactgctccagggtgaactaaacctagctagacgacgacggcggcggcggccgcctgatcgatcgatgatccatttccgccgtcgtcgatcggcgccggagcatcgatcatgactccatgagtatcgatctatatctacgcatggatgatgatgatgagttgcctactgttacgtactatactgaataaaatctctccgtccgtacgtgtcgtcgtgtactacgctgtgatacgcctgtgtagcgtgtacgtcaacatgtgtgtgtgtacgtgagagagagaggaaccgttcatgtcctttgctcctccgatccgtcttcgtacgattttggaggagaccccggtttgtactatgttcactgttgctaccttatgatacacacatctttttgtttgcgaaaaaaaaaaaaaaaaaggccccta

SEQ ID NO: 15788 - DNA, 618 bp, Sorghum bicolor
  Clone ID: SORBI-28MAY03-CLUS100_16
gcacgaggcacttgctcacttgcattccaaagctagtacaagcaagtctcagacacccccagaacatcgacgacatggctcggcttgctgtggcgatcgccgtctcccgaggacgcggcgacgccgtcgtcgaggttcgtcaacaagctgcggggcgggttgccgccggaggtcagcctcgacgacctcgccgacgagttcttccgcgccagggcggagtccgagggcgacgacgacgaggaggagactgctgcgcctgtgcgtggccggtcaaggtttccggcgcccgcggagcgtggcggcggaggccggcggagctccaccgcgcggtacgccagggagacggagtcttcgcggcagcgcgggcgctccgtgtcgcgcccgccggacgagcgacgaggcgtcggtgccaatgcggtgaatgccggctctgcagctgcaggcaggaggcagcggtatgcttcggtggaccgccgcgcttccatggatcggcaacggtggtgcgattcggataatgacatggagatttctcaccgctatggttccagtgggatacataccaaaagtagcagtggcaatagcctgcagagttcattccataagccatctagagcaaac

SEQ ID NO: 15789 - DNA, 653 bp, Sorghum bicolor
  Clone ID: SORBI-28MAY03-CLUS100_17
tatcgctagcacttgctcacttgcattccaaagctagtacacaagctagcagtctcctcgatcccagtctcgatcagaattcagacaccaagaacatcgacgacatggctcggcttgctgtggcgatcgccgtggtggcggcggcggcggtggtgccgatgcgggagacgccgcgccagcggctgtggaactccaacctcgacctcgtggtgccgcgcttccacacgcccagcgtctacttctaccgccgcggcgacggcgccgcggcgccggcggaggggttcttcgacggcgagcggatgcggcgcgcgctggcagaggcgctcgtgccgttctacccgatggcgggccgcctcgcgcgggacgaggacgggagggtcgagatcgactgcaatggcgagggagtgctcttcgtcgaggccgacgcgcccgacgtctccgtcgacgactacggtgacttcgcccccaccatggacctgaaacgcctcatcccgaccgtggattacaccgacgacatctcggccctccctctactggtgctccaggtgactcattttaaatgtggaggcatctcccttggtgttggcatgcaacaccatgtagcggatggcatgtctggcttgcacttcattaactcgtggtctgacctctgt

SEQ ID NO: 15790 - DNA, 716 bp, Sorghum bicolor
  Clone ID: SORBI-28MAY03-CLUS100_18
cctctgagctgctctccaccaagagctgctgccaccaccaccaaacccatcgctggatttgtccagagtctttcctgtttcaccgccccagatctgatccgcggcgccgcgtcttcgctcagatggtgatcactgtgaggcggtcgacgatggtgcgcccggcgcgggagacgccgcgccagcggctgtggaactccaacctcgacctcgtggtgccgcgcttccacacgcccagcgtctacttctaccgccgcggcgacggcgccgcggcgccggcggaggggttcttcgacggcgagcggatgcggcgcgcgctggcagaggcgctcgtgccgttctacccgatggcgggccgcctcgcgcgggacgaggacgggagggtcgagatcgactgcaatggcgagggagtgctcttcgtcgaggccgacgcgcccgacgtctccgtcgacgactacggtgacttcgcccccaccatggacctgaaacgcctcatcccgaccgtggattacaccgacgacatctcggccttccctctactggtgctccaggtgactcattttaaatgtggaggcatctcccttggtgttggcatgcaacaccatgtagcggatggcatgtctggcttgcacttcattaactcgtggtctgacctctgtcgtggagctcaaatttctgtcatgcccttcattgaccgcactcttattcgcgctcgtgat

SEQ ID NO: 15791 - DNA, 647 bp, Sorghum bicolor
  unsure (1)..(647): unsure at all n locations
  Clone ID: SORBI-28MAY03-CLUS100_19
ctgttggtcaagtacgtcgacggcgacggtgacgttgtgggggtggacatcaaggagaagggtggcgacgcgtaccagcccctcaagcactcntggggcgctatctggaggaaggacagcgacaagccaatcaagtttcccgtcaccgtccaaatcaccaccgaaggaggcaccaagaccgcctatgaagacgtcatccccgaaggctggaaggccgacaccacctacaccgccaaataaactgtccaacagacctaacgctgctctgggctcggttggattggatcccaacttcccaagcaatgcattacacttacgcatgcatggatccatgcacaatatctatttttttactgctgctactgctacgacaatgtcctcctttgtcctctccatatatagctagagtcaggctctgctctcttatattattattatataagataagaaataggagagagagaggagagagaccgagtacataataagtgtctaattaaagagagatttgagaggcctttattttatatataataaagaatccaaggagtgaggcaaacagcaacaaaaatgcgttgtactgtccatggatttccatgtaatctcaattataccatgtctacattttaatagaatacacacttttt

SEQ ID NO: 15792 - DNA, 1252 bp, Sorghum bicolor
  unsure (1)..(1252): unsure at all n locations
  Clone ID: SORBI-28MAY03-CLUS100_20
gggccgggaatcgcctcacaattacatacatcacataccatccaccgatcgacgatccaaggaagatgggagtgaacatgatgtcgtggtcgatgcaggtggcggtggtggtggcgctggcgtttctggtgggcggcgcatggtgcggtcctcctaaggttgccccgggcaagaacatcacggccacctacggcagcgactggctggaagcgaaggcgacatggtacggcaagccgacgggcgccggccccgacgacaacggcggcgcgtgcgggtacaaggatgtgaacaaggcccccttcaacagcatgggcgcgtgtggcaacctccccatcttcaaggacggcctcggctgcggctcttgctttgagatcaagtgcaacaagccggccgagtgctctggtgaggccgtggtggtgcacatcacagacatgaactacgagcaaatcgccgcctaccacttcgacctggccggcacggcgttcggcgccatggccaagaagggcgaggaggagaagctgcgcaaggcgggcatcatcgacatgcagtttcgccgggtcaagtgcaagtacggcgaaaaggtcaccttccacgtggagaaggggagcaaccccaattacctggcattgctggtcaagtatgtcgatggtgacggtgacgttgtgggggtggacatcaaggagaagggtggcgacgcgtaccagtcccttaagcactcctggggcgctgtctggaggaaggacagcgacaagcccatcaagttccccgtcactgtccaaatcaccaccgagggaggcaccaagactgcctacgaagacgtcatccccgaaggctggaaggccgacaccacctacaccgccaaataagctatccaacagatctacgactgctctggtctaggttggattggatcgcaacttcccaagcaatgcattacacttatgcatggattgatccatgcataatgcttattttttactgctgctgttgcgacgatgacgacgtcctccttcatcctctccatacgtagctagagtgaggcttccatcgtcctctccatatatagcttgggcgagactccatccgctttgttatattaaaaaaagagaagggtgaagaaacaaagagaccggataaataataagtatctaacgagagatttgagaggcttttgtatgtaataaaaggagagtgagacaaacacacaggtgtcccatggatctcccatgtaatctcaattntatcatgccta

SEQ ID NO: 15793 - DNA, 618 bp, Sorghum bicolor
  Clone ID: SORBI-28MAY03-CLUS100_21
gccggccgggccgtggatcgcagtcacactcacacacacaacaagccactctcggtcaagccaccaaggcagctagcatcagcaatggcccgcgcctgcgtgttcctggtcgtgctcctcctggccgccgtcgcggtggcgccactcacgacggtcgtcgacgcggcgcgccccgacgtcgtggagggcaggtccatggagtcctcctccgacgcgcccgctcccagccccgacgcctcgtccccggagtcgtcggacgcaccctccagcagcagctcttccgactaaccgaccggtcgccgtcgccggcagagagatatctcgccctccgtctacggcgatcgatccggccggccagttcttggcaattggcctgatctacatatccgatacggcaaaactatttcccttttgattttctctagaacaataatgtgtgctgcatgcaccctgatgatatatatatgtgcatgcgtggtgcgcgcggcaaacgcacacatgaatgtgcttgcctaattgttgttttgttgttgtttcgaattcctctctctcctattttaattttgttcttgtatatgtaatatgtgtcacccaatattataatccgtgtgctacgct

SEQ ID NO: 15794 - DNA, 649 bp, Sorghum bicolor
  Clone ID: SORBI-28MAY03-CLUS100_22
gccggccgggccgggatcgcaatcgcaacacacacagcagcaagcaagcaagaagcagccaaggcagatagctagcagcgtcgcaataatggcccgcgcctgcgtgttcctggtcgtgctcctcctggccgccgtcgcggtggcgccgctcacgacggtcgtcgacgcggcgcgccccgacgtcgtggagggcaggtccatggagtcctcctccgacgcgcccgctcccagccccgacgcctcgtccccggagtcgtcgtcgtcgtcgtcggacgcaccctccagcagcagctcttccgactaaccgaagacgggtcgccgtcgccgacagagatctccatgcatctacggcaatcgagttcttggcaattggcgtcatatctatccggccgatccagcaaaactatttcccttattttgattctttccaacaataatgtgcgtgcatgggtgcgcgcggcaaacacacacatgaatgtgctttcctaattgtttttttttcttctttggctctctgtctctttttgtttatgtagtataatgtaacatccgtcacccaatatatatacagttcgtgctacgctctttaatttaatcttgtggtgatgatagccctttaattcaaaaaaaaaaaaaaaaaaggccccta

SEQ ID NO: 15795 - DNA, 456 bp, Sorghum bicolor
  Clone ID: SORBI-28MAY03-CLUS100_23
gcacgaggctagcacttgctcacttgcattccaaagctagtacaagcaagtctcagacacccccagaacatcgacgacatggctcggcttgctgtggcgaccgccgccgtcgtcgtcgatcggcgccggagcatcgaccatggatgagtatctatctacgcctgatatgatgagatgatgagttgtctactactgctacgtcgtactactgaataaaaatctctccgtatgtacgtacgtgtcgtcgtgtacgctgtgatacgcttgcatcttagcgtatgtacgtacgtgcgtgtgtacatgtgtgtgtgagagcatgtacttttgcttgttgggtttatttttgagtgcatgcactatgtgcggtgtttattatttatgtccgtgtacgtttcctctcgctcctgtggtttgtactagttcgatcactgctacatgcacacacacatctctttg

SEQ ID NO: 15796 - DNA, 653 bp, Sorghum bicolor
  Clone ID: SORBI-28MAY03-CLUS100_24
gccggccgggccgggatcatcgcaatcgcaacacacacagcagcaagcaagcaagaagcagccaaggcagatagctagcagcgtcgcaataatggcccgcgcctgcgtgttcctggtcgtgctcctcctggccgccgtcgcggtggcgccactcacgacggtcgtcgacgcggcgcgccccgacgtcgtggagggcaggtccatggagtcctcctccgacgcgcctgctcccagccccgacgcctcgtccccggagtcgtcgtcgtcgtcgtcggacgcaccctccagcagcagctcttccgactaaccgaccggtcgccgtcgccggcagagatatctcgccctccgtctacggcgatcgatccggccggccagttcttggcaattggcctgatctatatatccgatacggcaaaactattttcccttttgattatttgttttggaacaataataatgtgctgcatgtatgtgcatgcatgcgtggtgcgcgcggcaaacgcacacatgaatgtgcttgcctaattgtttttttcctcttcctttcctctgtgcctctgtctccttttgtttatgtatctgtaacatatacgtcacccaatatagtgcgtgtgtatatgtaacatgttgctcacttataaacttctcttgat

SEQ ID NO: 15797 - DNA, 1289 bp, Sorghum bicolor
  Clone ID: SORBI-28MAY03-CLUS100_25
ccgggattcatcgcatcgtagttacattacataccatccaccaaacgatcgaaggaagatgggagtgaacatgatgtcgtggtcgatgcaggtggcgttggtggtggcgctggcgtttctggtgggcggcgcatggtgcggtcctcccaaggttgccccgggcaagaacatcacggccacctacggcagcgactggctggaagcgaaggcaacatggtacggtaagccaacaggcgccggccccgacgacaacggcggcgcatgtggttacaaggatgtgaacaaggcccccttcaacagcatgggcgcgtgcggcaacctccccatcttcaaggacggcctcggctgcggctcctgctttgagatcaagtgtgacaagccggccgagtgctccggcgaggccgtggtggtgcacatcacggacatgaactacgagcaaatcgccgcctaccacttcgacctggccggcacggcgttcggcgccatggccaagaagggcgaggaggagaagctgcgcaaggcgggcatcatcgacatgaagttccgccgggtcaagtgcaagtacggcgaaaaggtcaccttccacgtggagaaggggagcaaccccaactacctggctctgttggtcaagtacgtcgacggcgacggtgacgttgtgggggtggacatcaaggagaagggtggcgacgcgtaccagcccctcaagcactcctggggcgctatctggaggaaggacagcgacaagccaatcaagtttcccgtcaccgtccaaatcaccaccgagggaggcaccaagaccgcctacgaagacgtcatccccgaaggctggaaggccgacaccacctacaccgccaaataaactgtccaacagacctaacgctgctctgggctcggttggattggatcccaacttcccaagcaatgcattacacttacgcatgcatcgatccatgcacaatatctatttttttactgctgctactgctacgacaatgtcctcctttgtcctctccatatatagctagagtcaggctccgctctcttatattattattatataagataagaaataggagagagaggagagagagaccgagtacataataagtgtctaattaaagagagatttgagaggcctttattttgtatataataaagaatccaaggagtgaggcaaacagcaacaaaaatgcgttgtactgtccatggataaccatgtaatctcaattataccatgtctacattttaatagaatacacactttttaatgattaattgaaatttatgat

SEQ ID NO: 15798 - DNA, 604 bp, Sorghum bicolor
  Clone ID: SORBI-28MAY03-CLUS100_26
gccggccgggccgggctcttccctcttacagccgccgccgcatctcccagcctccccgcgctcgcctccgtcgccgctgccgccgccgtttcgcagccatgggtaaggtgcacggatcgttggcccgtgccgggaaggtccgcgggcagacgcccaaggtggcgaagcaggacaagaagaagaagccccgcggccgcgcccacaagaggatgcagtacaaccggcgcttcgtcaccgccgtcgtcggcttcggcaagaagcgcgggcccaactcctcggagaagtaggcgccgcgatgcgacgccgttcggctcgtaccggttcctcaccctttccgctctcagtttgcttatgctcttgctggtagtagtttcgttgtgcaagcagaggaagaaccttttgtagtttcagcttcgttgttcgtgtgatgagatgggaactcgagattatatatgtccctcgttattaagaatttgagatatgatgatatgagccaatgactttattttgcgtaaaaaaaaaaacacacccgcgacaacaacaatggccctggagacgtgcttcagagcgtgggcgctgcacgccgcccctgccgctggtggca

SEQ ID NO: 15799 - DNA, 1485 bp, Sorghum bicolor
  Clone ID: SORBI-28MAY03-CLUS100_27
cgtatgtttccgctcgcacaagcctgagcactcccttgaaatactccccatctccatcgccccgcctaccccgctcagccattcgaccccaatttcgcttgcagttccagtagcctccctcccctcccgcgcgcatcgatcatgtcggcctactgcggaaagtacaaggatgagctcatcaagaatgccgcatacattggcacccctggaaagggtatccttgctgctgatgagtccacaggcaccattggcaagcgactttcaagcatcaatgtcgagaacattgaggagaaccgccgtgcccttcgtgagctcctcttctgtgcccctggtgccctccagtacctcagcggtgtgatcctctttgaggagaccctctaccagaaaaccaaggatggcaagccctttgttgatgtcctcaatgagggaggtgtgctccccggcatcaaggttgacaagggcaccattgaggttgctggcaccaacaaggagaccaccacacaaggccatgatgaccttggcaagcgctgcgccaagtactatgaggctggtgcccgctttgccaagtggcgtgccgtcctcaacatcggccctaacgagccatcacagcttgccattgacttgaacgctcagggtcttgctcgctacgccatcatctgccaggagaatggtctggtgccaattgttgagcctgagatcctcgtcgatgggccacatgacattgagcgttgtgcctatgttacggagatggtccttgctgcctgctacaaggctctcaatgagcaccatgtcctccttgagggtaccctcctgaagcccaacatggttacccctggctctgactccaagaaggtggctcctgaggtgatcgctgagtacactgtgcgtgccctccagaggactgtccctgctgctgtgcccgccatcgtcttcctctctggtggacagagtgaggaggaggccacactaaacctgaatgccatgaacaagctcaacaccaagaagccgtggtccctatccttctcattcggccgtgcccttcaggcgagcaccctcaaggcctgggctggcaaggaggagaacgtggagaaggccagggctgccttcctcaccaggtgcaaggccaactcggaggccaccctcggcacatacaagggtgacgctgctgccggcgagggtgtctcggagagcctccacgtgaaggactacaagtactgagctgcctcacattctggacccctgagtctgcttgcgtttaggttgagtgtttgtcagtcagagcccaaattttggacatcggaacttggttttaataatcctgaacttatggatgatggttgcttactttttatactcatgtattaattagtattttttggtgttcatcttgtgtaatctggtcgtaccgatggtaaatcgaggggccacattttgttctgtccgttgctgtaatatgctggttatgttattggtatagtatatgtc

SEQ ID NO: 15800 - DNA, 905 bp, Sorghum bicolor
  unsure (1)..(905): unsure at all n locations
  Clone ID: SORBI-28MAY03-CLUS100_28
cgctcgaggccggccgggccgggcctcaccagctagcacttgctctcactgcattccaaagctagcatatatactagcacacagtcaggcactcagatcactcagcacacacgaatagctcgatcgatcgacatggcacgcagcatgcagtttgctgtggcgatgatcgccgtcgtcgtggccgcggtgctgctggcagcggcgacgacgacgtcggaggccgccgtcacctgcgggcaggtgaactccgcgattagcccctgcctcgcctacgcccgcggcaccggcaccgcaccctccgcggcctgctgcagcggcgtcaggagcctcaactccgccgccagcagcaccgccgacaagcgcaccgcctgcaactgcctcaagagcgccgccggacgtgtcagcggcctcaacgccggcaacgccgccagcatcccctccaagtgcggcgtcaacatcccctacaccatcagcgcctccatcgactgctccagggtgaactaaacctagctagacgacgacggcggcggcggccgcctgatcgatcgatgatccatttccgccgtcgtcgatcggcgccggagcatcgatcatgactccatgagtatcgatctatatctacgcatggatgatgatgatgagttgcctactgttacgtactatactgaataaaatctctccgtccgtacgtgtcgtcgtgtactacgctgtgatacgcctgtgtagcgtgtacgtcaacatgtgtgtgtgtacgtgagagagagaggaaccgttcatgtcctttgctcctccgatccgtcttcgtacgattttggaggagaccccggtttgtactatgttcactgttgctaccttatgatacacacatctttttgttnaaaaaaaaaaaaaaaaaaaaaaaaaaa

SEQ ID NO: 15801 - DNA, 968 bp, Sorghum bicolor
  Clone ID: SORBI-28MAY03-CLUS100_29
gccggccgggccgggaccagctagcacttgctcacttgcattccaaagctagtacacaagctagcagtctcctcgatcccagtctcgatcagaattcagacaccaagaacatcgacgacatggctcggcttgctgtggcgatcgccgtggtggcggcggcggcggtggtggtgctggcggcgacgacctcggaggcggccatctcctgcgggcaggtgagctcggccatcgcgccctgcctgtcctacgcccggggccagggctccgcaccctcagcaggctgctgcagcggcgtcaggagcctcaactccgccgcccgcaccaccgccgacaggcgcgccgcctgcaactgcctcaagaacgccgcccgtggcatcagcggcctcaacgccggcaacgccgccagcatcccctccaagtgcggcgtcagcgtcccctacaccatcagcacctccaccgactgctccagggtgagctaaacctaaacgaggatgatcgatcgatgatccattccgccgccgtcgccgtcgtcgtcgatcggcgccggccggagcatcgaccatggatcgagtttgtctactactgctacgtcgtaatactgaataaaaatctctccgtatgtacgtacgtacgtgtcgtcgtgtacgctgtgatacgcttgcatcttagcgtatgtacgtacgtgcgtgtgtacatgtgtgtgtgagagatgtacttttgcttgttgggtttatttttgagtgcatgcactgtgtgcggtgtttattatttatgtccgtgtacgttcctctcgctcctgtggtttgtactatgttcgatcactgctacatgcacacacacatcttttcgtttccaaattgttgttatgcatgcatgcgccatgtgactgtgttccatgactcccaaacgcttggtcaagagagttactgctctattctccctaaaaaaaaaaaaaaaaaaggccccta

SEQ ID NO: 15802 - DNA, 1529 bp, Sorghum bicolor
  Clone ID: SORBI-28MAY03-CLUS100_30
ctcggcccatcctccgcatcccccgtctccgtctgccaaaccattcctcccaacaacacccgccgcctcctgcaatcctcgtagcctccgtcgagcatcgatcatgtcggcctactgcggaaagtacaaggatgagctcatcaagaatgctgcctacattggcacccctggcaagggtatccttgctgctgatgagtccactggcaccattggcaagcgtctttccagcatcaatgtcgagaacgtggaggagaaccgccgtgccctccgtgagctccttttctgctgccctggtgccctccagtacatcagcggtgtgatcctcttcgaggagaccctctaccagaagaccaaggatggcaagccttttgtcgatgtcctcaaggagggaggcgtcctccctggcatcaaggtcgacaagggcaccattgaggttgctggcacggacaaggagaccaccacccagggccatgatgaccttggcaagcgctgcgccaagtactacgaggccggtgcccgctttgctaagtggcgtgctgttctcaagatcggccccaatgagccatcacagcttgccattgacctgaatgctcagggcctggctcgctatgccatcatctgccaggagaatggtctggtgccgattgttgagcctgagatccttgttgatggccctcatgacattgatcgctgcgcttatgtcactgaggtcgtccttgctgcctgctacaaggctctcaacgagcaccatgtcctcctggagggtaccctcctgaagcccaacatggtgaccccaggctctgactctaagaaggtgacccctgagttgattgctgagtacaccgtccgcaccctccagaggaccgtccctgctgctgtgcctgctgttgtcttcctctccggtggacagagcgaggaggaggccaccctcaacctcaatgccatgaacaagctcaacaccaagaagccgtggtccctgtccttctccttcggtcgtgccctccaggcgagcacactcaaggcctgggctggcaaggtggagaacatcgagaaggctagggcggccttcctcgccaggtgcaaggccaactctgaggctaccctcggcacctacaagggtgatgctgctgctgacaccgagagcctccacgtcaaggactacaagtactgagttgcttctctttgcgtgcccgttttggaactcctgcctacgagtaggttgctgagtgtggtttgctcgtttgagcttatattcggacaacaaaaaaaaacatgcttcctatgtggatgatggttatctttatattcgtatattaactagtctctttggtgttaaatttcgtgtaatatggtcctgccgatggagcatcgagcagcctcttttttttgttctatctactaatgctgtaatgctggttatgtatcggcaaaaaccattctatatgctgagttggagacagcaacctatgtggatcatattttgttgagacgaactcatgagagattttagacataataatagagtatgg

SEQ ID NO: 15803 - DNA, 1283 bp, Sorghum bicolor
  Clone ID: SORBI-28MAY03-CLUS100_31
cagttacattacataccatccaccgatcgaaggaagaagatgggagtgaacatgatgtcctggtcgatgaaggtggcgttggtggtggcgttggtgtttctggtgggtggcgcatggtgcggtcctcccaaggttgccccaggaaagaacatcacggccacctacggcagtgactggctggaagcaaaggcgacatggtacggcaagccgacgggcgccggccccgacgacaacggcggtgcgtgcgggtacaaggatgttaacaaggcccccttcaacagcatgggcgcgtgcggcaacctccccatcttcaagaacggcctcggctgcggctcatgctttgagatcaagtgcgacaagccggccgagtgctccggtgaggccgtggtggtgcacatcacggacatgaactacgagcaaattgccgcctaccacttcgacctggccggcaccgcatttggcgccatggccaagaagggcgaggaggagaagctgcgcaaggcgggcatcatcgacatgcagttccgccgggtcaagtgcaagtatggcgaaaaggtcaccttccacgtggagaaggggagcaaccccaactacctggcactgctggtcaagtatgtcgatggcgacggcgacgttgtgggggtggacatcaaggagaagggtggcgaggcgtaccagcccctcaagcactcctggggcgctatttggaggaaggacagcgacaagcccatcaagtttcccgtcactatccaaatcaccactgagggaggcaccaagaccgcctacgaagatgtcatccctgaaggttggaaggccgacaccacctacactgccaaataagctgtccaacagacctaccgctgctcttggatgggttggattggatcccaacttcccaagcaatgcattacgcttatgcatgcattgatctatctattttttactgttgttgctgcgacgatgacgacgccctccttcatcctctccatacgtagctagagcaaggtttccttcatcctctccatatatagctaggacaaggctccatccgctctgttattatattaaaaaaagagaaggacgaagaaacaaagagaccagatacataatatgtatctaacgagagatttgagaggcttttgtatgtaataaaaggagagcgagacaaataacaattgtccatggatctcctatgtaatctcaattttatcatgcctgcattttaagtgaatacactttttttcaagactaattgaaatttatgatatgcacatttgattctt

SEQ ID NO: 15804 - DNA, 537 bp, Sorghum bicolor
  unsure (1)..(537): unsure at all n locations
  Clone ID: LIB3481-013-P1-K1-E12
cgtccgcagcaaggcagcaagcagctcactctcagctcgctccctcactactagctagtactacatagcagcagcaatggcgcccaccgtgatggcctcgtccgccaccgccgtcgctccgttccagggtctcaagtccaccgccaccctccccgtcgcccgccgctccaccaccagcctcgccgctgacggaggagcagctgctgaagcaggtggactacctgctgcgcaacaactgggtgccctgcctcgagttcagcaaggaaggcttcgtgtaccgcgagaactccacctcgccgtgctactacgacggccgctactggaccatgtggaagctgcccatgttcggctgcaccgacgcgtcgcaggtctacaaggagctgcaggaggccatcgcctcctacccggacgcctacgtncggatcctcggcttcgacaacatcnagcaagaccagtgcgtcagcttcatcgcctacaagcccgcgggcagcgagtgattaaactgctagctagctcctgcgtgagctaatggcatat

SEQ ID NO: 15805 - DNA, 416 bp, Sorghum bicolor
  Clone ID: LIB3478-047-P1-K1-F9
gatgaacatcggcagcaggccagccaagaggaagccgggcggcggcatcccctggatcttctcgtggacacagacgaggttccacctccccgtgtggctgggagtcggcgccgccttcaagtgggccatcgacaaggacatcaagaacttccagaagctcaaggagatgtacaacgagtggccattcttcagggtcaccctggacctgctggagatggttttcgccaagggagaccctggcattgccggcttgtacgacgagctgcttgtcgccgaggaactcaagccctttgggaagcagctcagggacaaatacgtggagacacagcagcttctcctacagatcgctgggcacaaggacattcttgaaggcgatccttacctgaagcaggggctgcgtctgcgcaatccctaca

SEQ ID NO: 15806 - DNA, 542 bp, Sorghum bicolor
  Clone ID: 9305464
gcacgaggaaacagcaagcagctcactctcagctcgctccctcactagctactagtactacatagcagctgctgaagcaggtggactacctgctgcgcaacaactgggtgccctgcctcgagttcagcaaggaaggcttcgtgtaccgcgagaactccacctccccgtgctactacgacggccgctactggaccatgtggaagctgcccatgttcggctgcaccgacgcgtcgcaggtctacaaggagctgcaggaggccatcgcctcctacccggacgcctacgtccggatcctcggcttcgacaacatcaagcagacgcagtgcgtcagcttcatcgcctacaagcccgcgggcagcgagtgattaaactgctagctagctcctgcgtgagctaatggcatatggctgcctgctgctgcctctcaacctgttcgttcggttttgcatccttggggtcacacacacaccttgggttctttcttcttctttttttcaccttttgctgctgttggttcctttgcttctatatatgctgctgat

SEQ ID NO: 15807 - DNA, 539 bp, Sorghum bicolor
  Clone ID: LIB3478-053-Q6-K1-B10
ctcctacagatcgctgggcacaaggacattcttgaaggcgatccttacctgaagcaggggctgcgtctgcgcaatccctacatcaccaccctgaacgtgttccaggcctacacgctgaagcggataagggaccccagcctcccggtggccggaagccaagttcatcaacagcgcctacaccgtcagcatccccctcatgcagagaggatcggtgaccgttgcaccatacaagcttgtcctaaggactgttatagtcaccgcgacgactctagtggcactgatgataccattcttcaacgctgtgctggggctcctcggcgcattcagcttctggccgctgacggtttacttccccataagcatgcacattgcccagggcaagatcaccaaggggacgaagtggtaccttctgcaggctttgagcatgatttgtttgatgatttcagtggcggtgggaataggctctgtaactgacattgtcagtagcctgaaggtctcttccaaccctttcaaactgtaagctaaaggttattgtagtc

SEQ ID NO: 15808 - DNA, 898 bp, Sorghum bicolor
  Clone ID: SORBI-28MAY03-CLUS85_5
actccttcatcggcctcggcctctcggtggggcagtgggtgtctcacggtggcggcctcgggggcaggatcgcaggtgctaccgcggcgtcctccaccaagaagctctggaatgtgctccttgccctggggaacattgccttcgcttacacctttgcggaagtgctaattgagatccaggatacactcaagtcaccaccaccggagaacaagacgatgaagaaggcagcaatgtatgggattggagccaccaccatcttctacatctctgttggctgcgctgggtatgctgcatttggttcaaatgctccaggcaacatcctgacggcaggcgggttgggtcccttctggctggttgacattgccaacatgtgcctcattctccacctgatcggtgcataccaggtatatgctcagcctatctttgcttcagttgagaggtgggcagcctcccggtggccggaagccaagttcatcaacagcgcctacaccgtcagcatccccctcatgcagagaggatcggtgaccgttgcaccatacaagcttgtcctaaggactgttatagtcaccgcgacgactctagtggcactgatgataccattcttcaacgctgtgctggggctcctcggcgcattcagcttctggccgctgacggtttacttccccataagcatgcacattgcccagggcaagatcaccaaggggacgaagtggtaccttctgcaggctttgagcatgatttgtttgatgatttcagtggcggtgggaataggctctgtaactgacattgtcagtagcctgaaggtctcttccaacctttcaaactgtaagctaaaggttattgtagtcgtgtacaatatgtaaaaattttttcctaagtcgaagaagaatgtaggaca

SEQ ID NO: 15809 - DNA, 453 bp, Sorghum bicolor
  Clone ID: SORBI-28MAY03-CLUS85_6
gccgggccgggacccaagcagcaaaacagcaaggcagcaagcagctcactctcagctcgctccctcactactagctagtactacatagcagcagcaatggcgcccaccgtgatggcctcgtccgccaccgccgtcgctccgttccagggtctcaagtccaccgccaccctccccgtcgcccgccgctccaccaccagcctcgccaaagtcagcaacggcggcaggatccggtgcatgcaggtaataacaacatagttaacacaagagctagttggcctttcgttcttggctccggccggccatctttcattcattctttgcagcagagcagagctagcgaaatgcaaccacaaacacgtacatcgatcgatgcatgcattaatttgcaggtgtggccggcgtacgggaacaagaagttcgagacgctgtcgtacctgccgccgctgacggagg

SEQ ID NO: 15810 - DNA, 888 bp, Sorghum bicolor
  Clone ID: SORBI-28MAY03-CLUS85_7
caagacgtcggtgaagaacacggtgacgcaggtggcgaagaaggtgctgaccatgaacccgtcgggcgacctctccagcgcgcgattcagcgagaaggagctcatcaccgccatcgaccgcgagggcgtgttcacgtacgcggaggacccggccagcgccagcctcccgctgatgacgaagctgcgcgccgtgctggtggaccacgcgctcagcagcggcgacgcggagcgggagccctcggtgttctccaagatcaccaagttcgaggaggagctccgcgcggtgctgccacgggaggtggaggccgcccgcgtcgccgtcgccgagggcaccgcccccgtggcgaaccggatcgcggacagccggtcgttcccgctgtaccgcttcgtccgcgaggagctgggctgcgtgttcctgacgggcgagaagctcaagtcccccggcgaggagtgcaccaaggtgttcaacggcatcaaccagggcaagctcgtcgaccccatgctcgagtgcctcaaggagtgggacggcaagccgctgcccatcaacgtcgtcaactaaaagacgccgccgccatccgtgcatggccggaggaggaggaggaggagaagaagaagaggaggaaaatacatgaaaaataaaacttgtacaccgtgtatgtccagatcgtgcgtgtcgtcgtttcttcgttgttgacttttggttgtaattgatcgatccgtatgtgtgtgtgcgtgtgtgtggcgttgttctttcttctttgtgtagctgccctgtcaccgcctgcgatgtgcatgccatggcagacagcgttttctaagatcctatatactgttgtattttggggtgaaccactcaattccttcttctaagtgtcctaatagaatgct

SEQ ID NO: 15811 - DNA, 1049 bp, Sorghum bicolor
  Clone ID: SORBI-28MAY03-CLUS85_8
gcacgaggggagcagcacaaccaggacgtcaactccctgggcctcgtctccgccaggaagaccgccgaggccgtggacatcctcaagctcatgtcgtccacgtacatggtggcgctgtgccaggccgtcgacctgcgccacctcgaggagaacctcaagagcgccgtcaagaactgcgtgatggcggcggccaggaaagtgctcaccactagcctcgacggcgacctccacagcgcgcgcttcagcgagaaggccctgctcaccgccatcgaccgcgaggccgtgtacgggtactacgacgacccctgcagcgccaactcgcccctgatgaagaagatccgcgccgtgctggtggaccacgccctcgccagcggcgaggccgagaaggacgccagcgcgtccgtcttctccaagatcaacaggttcgaggaggcgctaagggaggcgctgcccagggagatggaggccgcccgcgtggcgttcgagacgggcacggcgccgatcggcaacaggatcaaggacagccggtcgtacccgctgtaccgcttcatccgccaggacctcggcgccgtgtacctgaccggcgagaagctcaagtcccccggcgaggagtgcaacaaggtgttcctggcgctcagcgagggcaagctcatcgaccccatgctcgagtgcctcaaggagtgggacggcaagcccctgcccatctgctaagcagcaggacgccgccaccggccggcgccggcgccaagaggcaagaggatcgaggaggagatcacaccgtaccgtatgcgagaaaggaataaagaagggagtatttttcagtattctcaaggcttcatttcgtttgcgatttgaagttgaagattattattatatgttgttgttctgtgttcgtcctttttttgtgattgtagcagtgatccgtgcaaacgtgtattctgtctctgttgttcttaccttgctgccatgtcattggccatggtctgccactcagcttttctgatctgtaatctacttattttgaagtaaaatgcactactactatattg

SEQ ID NO: 15812 - DNA, 688 bp, Sorghum bicolor
  Clone ID: SORBI-28MAY03-CLUS85_9
gagctgtgctacaaatccctgtgtgagtgcggcgacaaggccatcgcctcctacccggacgcctacgtccggatcctcggcttcgacaacatcaagcagacgcagtgcgtcagcttcatcgcctacaagcccgcgggcagcgagtgattaaactgctagctagctcctgcgtgagctaatggcatatggctgcctgctgctgcctctcaacctgttcgttcggttttgcatccttggggtcacacacacaccttggtttctttcttcttctttttttcaccttttgctgctgttggttcctttgcttctatatatgctgctgatgtatccattgttggcatcatccatctcgatcgatctctccccctacatatacctgctagaaaaaactactgcaactagcgttgggtgaggaacatatatgtgaatgcaagctccggctatcatgtatgtgtaatatatatggcattggagtttgctctggttattcacagagcaaagaagtacttatttacatccatataacatatactttccttccatacaacaatggctagaagccatcttgtaatttttgcttatttgtttactttctttccctttttttgtctcttgaacttttatgtaagctggttcgcattttcttaataaataaatacacagcagggggaaacccctcctgtttcca

SEQ ID NO: 15813 - DNA, 2325 bp, Sorghum bicolor
  Clone ID: SORBI-28MAY03-CLUS85_10
cgcagttccgcgaccccgtcgtcaagatcgagggctccacgctccgcgtcggccaggtggccgccgtggccgcggccaaggacgcgtccggcgtggccgtcgagctggacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaatgccggaatcttcggcaatggctccgacggccacacgctcccgtccgaggtttcgcgcgcggccatgctcgtccgcatcaacaccctcctccagggctactcgggcatccgcttcgagatcctcgaggccatcaccaagctcctcaacaccggcgtcagcccgtgcctgccgctgcggggcaccatcacggcgtcgggcgacctcgtcccgctgtcctacatcgccggcctcatcacgggccgccccaacgcgcaggccgtcaccgtggacgggaggaaggtggacgccgccgaggcgttcaaggtggccggcattgagcacggattcttcgagctccagccaaaggagggtctcgccatggtcaacggcacggccgtgggctctggccttgcctccaccgtgctctttgaggccaacgtgctcgccatcatggccgaggtcatctccgcggtgttctgcgaggtcatgaccggcaagccggagttcaccgaccacctcacgcacaagctgaagcaccacccgggacagatcgaggctgccgccatcatggagcacatcttggaaggcagctcgtacatgaagctggcgaagaagctcggcgagctcgacccgctgatgaagccgaagcaggacagatacgcgctccgcacgtcgccgcagtggctcggcccgcagatcgaagtcatccgcttcgccaccaagtccatcgagcgcgagatcaactccgtcaacgacaacccgctcatcgacgtgtcccgtggcaaggcgctccacggcggcaacttccagggcactcccattggtgtgtccatggacaacacccgtctcgcgctcgccgccatcggcaagctcatgttcgcgcagttctccgagctggtgaacgactactacaacaacggccttccctccaacctgtctggtgggcgcaacccgagcttggactacggtttcaagggcgccgagatcgccatggcctcctactgctctgagctccagttcctgggcaacccggtgacgaaccacgtccagagcgcggagcagcacaaccaggacgtgaactccctgggcctcatctcctccaggaagaccgccgaggccatcgacatcctgaagctcatgacgtccacgttcctgatcgcgctgtgccaggccatcgacctccgccacatcgaggagaacgtgaaggccgcggtgaagaactgcgtgacgcaggtggccaagaagtcgctgagcctgaacgccaggggcgggctccacaacgcgcgcttctgcgagaaggacctgcagacggcgatcgaccgggaggcggtgttcgcgtacgcggacgacccgtgcagccccaactacccgctgatgcagaagctccgcgcggtgctgatcgagcacgcgctggccaacggcgacgccgagcgcgtcgtggagacgtccatcttcgccaaggtggccgagttcgagcagcaggtccgcgccgcgctgcccaaggaggtggaggccgcgcgcgccgccgtggagagcggcaaccctctggtgcccaacaggatcaaggagtgccggtcctacccgctgtaccggttcgtgcgcgaggaggtcggcacccagtacctgaccggcgagaagacgaggtcgcccggcgaggagctgaacaaggtgctggtggccatcaaccagcgcaagcacgtcgacccgctgctcgagtgcctcaaggagtggaacggcgagccactgccgctctgctgagctgcgcctggcagtgcgcaagagcagagaagatcaaggtatacagatcgaagaaaaaccaaagtacagcggctcaagacagagcgtttcaagatcattgtgaagtttttacaaccagactagcagaagatactctctatatttaccgttgccttgtactactagtagctaaagttcatgtgaatgttgttgtgttcttccccgcagctgcgacgccatggcctgcaatgcgcatgttcttggctgttgcagctactgaaacttttgatggttttaacttgtaagttgggggataaagtaaattattttgttctcc

SEQ ID NO: 15814 - DNA, 1133 bp, Sorghum bicolor
  unsure (1)..(1133): unsure at all n locations
  Clone ID: SORBI-28MAY03-CLUS85_11
cgtccgcccacgcgtccgaaacagcaaggcagcaagcagctcactctcagctcgctccctcactactagctagtactacatagcagcagcaatggcgcccaccgtgatggcctcgtccgccaccgccgtcgctccgttccagggtctcaagtccaccgccaccctccccgtcgcccgccgctccaccaccagcctcgccaaagtcagcaacggcggcaggatccggtgcatgcaggtgtggccggcgtacgggaacaagaagttcgagacgctgtcgtacctgccgccgctgacggaggagcagctgctgaagcaggtggactacctgctgcgcaacaactgggtgccctgcctcgagttcagcaaggaaggcttcgtgtaccgcgagaactccacctcgccgtgctactacgacggccgctactggaccatgtggaagctgcccatgttcggctgcaccgacgcgtcgcaggtctacaaggagctgcaggaggccatcgcctcctacccggacgcctacgtccggatcctcggcttcgacaacatcaagcagacgcagtgcgtcagcttcatcgcctacaagcccgcgggcagcgagtgattaaactgctagctagctcctgcgtgagctaatggcatatggctgcctgctgctgcctctcaacctgttcgttcggttttgcatccttggggtcacacacacaccttggtttctttcttcttctttttttcaccttttgctgctgttggttcctttgcttctatatatgctgctgatgtatccattggtggcatcatccatctcgatcgatctctccccctacatatacctgctagaaaaaactactgcaactagcgttgggtgaggaacatatatgtgaatgcaagctccggctatcatgtatgtgtaatatatatggcattggagtttgctctggttattcacagagcaatttacatccatataacatatactttccttccatacaacaatggctagaagccatcttgtaatttttgcttatttgtttactttctttccctttttttgtctcttgaacttttatgtaagctggttcgcattttcttaataaataaatacacancanggggaaacccctcctgtttacagt

SEQ ID NO: 15815 - DNA, 2554 bp, Sorghum bicolor
  Clone ID: SORBI-28MAY03-CLUS85_12
aagaagacacgccaactcctcctgctcttcttcttcaattctccaccggtccaccggcaccaccagcagtcctcctcccgcccgcaaccacaccacagcaaaaaccacggcaatggcgggcaacggcgccatcgtggagagcgacccgctgaactggggcgcggcggcggcggagctgtccggtagccacctggacgaggtgaagcgcatggtggcgcaggcgcggcagcccgtggtgaagatcgagggctccacgctccgcgtcggccaggtggccgccgtcgcgtccgccaaggacgcgtcgggcgtcgccgtcgagctcgacgaggaggcccgcccccgcgtcaaggccagcagcgagtggatcctcgactgcatcgcccacggcggcgacatctacggcgtcaccacggggttcggcggcacctcccaccgccgcaccaaggacgggcccgcgctccaggtcgagctgctcaggcatctcaacgccgggatcttcggcaccggcagcgatggccacacgctgccgtcggaggtcgtccgcgcggcgatgctggtgcgcatcaacaccctcctccagggctactcgggcatccgcttcgagatcctggaggccatcaccaagctgctcaacaccggggtcagcccgtgcctgccgctccggggcaccatcaccgcgtcgggcgacctcgtcccgctctcctacatcgccggcctcatcacgggccgccccaacgcgcaggccaccaccgtcgacgggaggaaggtggacgccgccgaggcgttcaagatcgccggcatcgagggcggcttcttcaagctcaaccccaaggaaggtctcgccatcgtcaacggcacctccgtgggctccgcgctcgcggccaccgtgatgtacgacgccaacgtcctcgccgtcctgtccgaggtcctgtccgccatcttctgcgaggtgatgaacggcaagcccgagtacaccgaccacctcacccacaagctcaagcaccacccgggctccatcgaggccgccgccatcatggagcacatcctggacggcagcgccttcatgaagcacgccaagaaggtgaacgagctggacccgctgctgaagccgaagcaggacaggtacgcgctccgcacgtcgccgcagtggcttggcccccagatcgaggtcctccgcgccgccaccaagtccatcgagcgcgaggtcaactccgtcaacgacaacccggtcatcgacgtccaccgtggcaaggcgctgcacggcggcaacttccagggcacgcccatcggtgtctccatggacaacgcccgcctcgccatcgccaacatcggcaagctcatgttcgcgcagttctccgagctggtcaacgagttctacaacaacgggctcacctccaacctcgccggcagccgcaaccccagcctggactacgggttcaagggcacggagatcgccatggcctcctactgctctgagctccagtacctgggcaaccccatcaccaaccacgtccagagcgcggagcagcacaaccaggacgtcaactccctgggcctcgtctccgccaggaagaccgcggaggccatcgacatcctgaagctcatgtcgtccacctacatcgtggcgctgtgccaggccatcgacctgcgccacctcgaggagaacatcaagacgtcggtgaagaacacggtgacgcaggtggcgaagaaggtgctgaccatgaacccgtcgggcgacctctccagcgcgcgattcagcgagaaggagctcatcaccgccatcgaccgcgagggcgtgttcacgtacgcggaggacccggccagcgccagcctgccgctgatgacgaagctgcgcgccgtgctggtggaccacgcgctcagcagcggcgacgcggagcgggagccctccgtgttctccaagatcaccaagttcgaggaggagctccgcgcggtgctgccacgggaggtggaggccgcccgcgtcgccgtcgccgagggcaccgccccccgtggcgaaccggatcgcggacagccggtcgttcccgctgtaccgcttcgtccgcgaggagctcggctgcgtgttcctgacgggcgagaagctcaagtcccccggcgaggagtgcaccaaggtgttcaacggcatcaaccagggcaagctcgtcgaccctatgctagagtgcctcaaggagtgggacggcaagccgctgcccatcaacgtcgtcaactaagacgccgccgccatccgtgcatggccggaggaggaggagaagaagaagaggaggaaaatacatgaaaaataaaacttgtacaccgtgtatgtccagatcgtgcgtgtcgtcgtttcttcgttgttgacttttggttgtgattgatcgatcacgtatgtgtgtgtggcgttgttctttcttctattgtgtagctgccctgtcaccgcctgcgatgtgcatgccatggcagacagcgttttctaagatcctatatactgttgtattttggggtgaaccactcaattccttcttctaagtatcctaatagaatgctcacctactgtctc

SEQ ID NO: 15816 - DNA, 1179 bp, Sorghum bicolor
  Clone ID: SORBI-28MAY03-CLUS85_13
gctactgggacccaagcagcaagaagcagcaaaacacagcaagcaagctcactcgatctcgctctctcactactacctagtactacatagcagcagcaatggcgcccaccgtgatggcctcgtccgccaccgccgtcgctccgttccagggtctcaagtccaccgccaccctccccgtcgcccgccgttccaccaccagcttcgccaaagtcagcaacggcggcaggatccggtgcatgcaggtgtggccggcgtacgggaacaagaagttcgagacgctgtcgtacctgccgccgctgacggaggagcagctgctgaagcaggtggactacctgctgcgcaacaactgggtgccctgcctcgagttcagcaaggaaggcttcgtgtaccgcgagaactccacctcgccgtgctactacgacggccgctactggaccatgtggaagctgcccatgttcggctgcaccgacgcgtcgcaggtctacaaggagctgcaggaggccatcgcctcctacccggacgcctacgtccggatcctcggcttcgacaacatcaagcagacgcagtgcgtcagcttcatcgcctacaagcccgcgggcagcgagtgattaaactgctagctagctcctgcgtgagctaatggcatatggctgcctgctgctgcctctcaacctgttcgttcggttttgcatccttggggtcacacacacaccttggtttctttcttcttctttttttcaccttttgctgctgttggttcctttgcttctatatatgctgctgatgtatccattgttggcatcatccatctcgatcgatctctccccctacatatacctgctagaaaaaactactgcaactagcgttgggtgaggaacatatatgtgaatgcaagctccggctatcatgtatgtgtaatatatatggcattggagtttgctctggttattcacagagcaaagaagtacttatttacatccatataacatatactttccttccatacaacaatggctagaagccatcttgtaatttttgcttatttgtttactttctttccctttttttgtctcttgaacttttatgtaagctctggttcgcattttcttaataaataaatacacagcagggggaaacccctcctgtttacagtaaaaagaaaatctctgatcttcattc

SEQ ID NO: 15817 - DNA, 3482 bp, Sorghum bicolor
  Clone ID: SORBI-28MAY03-CLUS85_14
gatcatcaactcgcagcagagaaggggggaggagcagcacgaggcaacacgccgcgccgcgccgctccaaccatctccagcttcgttcgcgcttcccggcccactccccggccgccgccgccatggcgtccgagcggcaccactccatcgacgcgcagctccgtgccctcgcacccggcaaggtctccgaggagctcatccagtatgacgccctgctcgtcgaccgcttcctcgacatcctccaggacctccatggccccagccttcgcgaatttgtccaggagtgctacgaggtgtcggccgactacgagggcaagaaagacacgtccaagctgggggagctgggagccaagctgacggggctggcccccgccgacgccatcctggtggcgagctccatcctgcacatgctcaacctcgccaacctggcggaggaagtggagctggcgcaccgccgccggaacagcaagctcaagcacggggacttctccgacgagggctccgccaccaccgagtccgacatcgaggagacgctcaagcgcctcgtgtcgctcggcaagacccccgcggaggtgttcgaggcgctcaagaaccagagcgtcgacctcgtcttcaccgcgcatcccacgcagtccgccaggaggtcgctcctgcagaaaaacgccaggatccggaattgtctgacgcagctgagtgccaaggacgtcacggtcgaagacaagaaggagctcgacgaggctctgcacagagagatccaagcagctttcagaactgatgaaatcaggagagcacaacccaccccacaggatgaaatgcgctatgggatgagctacatccatgaaactgtatggaacggtgtgcctaagtttttgcgccgtgtggatacagccctgaagaatatcggcatcaatgagcgccttccctacgatgttcctctcattaagttctgttcttggatgggtggtgaccgtgatggaaatccaagagttactccggaggtgacaagagatgtgtgcttgctgtctagaatgatggctgcaaacttgtacatcaatcaggtcgaagacctgatgtttgagctctctatgtggcgctgcaatgatgagcttcgtgctcgagccgaagaagtccagagtactccagcttcaaagaaagttaccaagtattacatagaattctggaagcaaattcccccaaacgagccctaccgggtgatccttggtgctgtaagggacaagttatacaacacacgcgagcgtgcacgccatctgctggcaactggattttctgaaatttctgaggacgcggtatttaccaagatcgaagagttccttgagccccttgagctgtgctacaaatccctgtgtgagtgcggcgacaaggccatcgccgacgggagcctcctggacctccttcgccaggtgttcgcgttcggtctctccctggtgaagctggacatccggcaggagtcggagcggcacaccgacgtgatcgacgccatcaccacgcacctcggcatcgggtcgtaccgctcgtggcccgaggacaagcggatggagtggctggtgtcggagctgaaaggcaagcgcccactgctgcccccggaccttcccatgaccgaggagatcgccgacgtcatcggcgccatgcgcgtcctggccgagctcccgatcgacagcttcggcccctacatcatctccatgtgcacggcgccctcggacgtgctcgccgtcgagctcctgcagcgcgagtgtggcattcgccagacgctccccgtggtgccgctgttcgagaggctggccgacctgcaggcggcgccggcgtccgtggagaagctcttctccactgactggtacatcaaccacatcaacggcaagcagcaggtgatggtcggctactccgactccggcaaggacgccggccgcctgtccgcggcgtggcagctgtacgtggcgcaggaggagatggccaaggtggccaagaagtacggcgtgaagctgaccttgttccacggccgcggtggcaccgtcggcaggggcggtggcccgacgcacctcgccatcctgtcccagccgccggacaccatcaacgggtccatccgtgtgacggtgcagggcgaggtcatcgagttcatgttcggggaggagaacctgtgcttccagtctctgcagcggttcacggccgccacgctggagcacggcatgcacccgccggtgtctcccaagcccgagtggcgcaagctcatggaggagatggccgtcgtcgccacggaggagtaccgctccgtcgtcgtcaaggagccgcgattcgtcgagtacttcagatcggctacccctgagactgagtacgggaagatgaacatcggcagcaggccagccaagaggaagccgggcggcggcatcaccaccctgcgtgccatcccctggatcttctcgtggacacagacgaggttccacctccccgtgtggctgggagtcggcgccgccttcaagtgggccatcgacaaggacatcaagaacttccagaagctcaaggagatgtacaacgagtggccattcttcagggtcaccctggacctgctggagatggttttcgccaagggagaccctggcattgccggcttgtacgacgagctgcttgtcgccgaggaactcaagccctttgggaagcagctcagggacaaatacgtggagacacagcagcttctcctacagatcgctgggcacaaggacattcttgaaggcgatccttacctgaagcaggggctgcgtctgcgcaatccctacatcaccaccctgaacgtgttccaggcctacacgctgaagcggataagggaccccagcttcaaggtgacgccgcagccgccgctgtccaaggagttcgccgacgagaacaagcccgccggactggtgaagctgaacccggcgagcgagtacccgccggggctggaagacacgctcatcctcaccatgaagggtatcgccgccggcatgcagaacaccggctaggccgcttccccttcactcacctgcagagtactgcacggcaataataatcacagcttccggatggtggcgttttgtcagttttggatggagatgctgaaaactgacaccacctgttttcactatatgcatgtttatgtaatttcctcggctttggcctctttatatttttcactcttgttgtgaagtccaagtggaaaatcttggcatcttaaatatattgtaataatgaacatcatataatctacaaatttactattatgtattaatgaatcttggcagggaaaatgccactatatatgtatcccagcccattggatggactttttttaccatgatgctacttcaaccatccctctttagatagtgctaaacagtttctgaaatctaatgcctggcaatatatgttaccaattgaatcagtgagagatagcatctacttgattggtaatttttattggaatgatctagtgcatt

SEQ ID NO: 15818 - DNA, 564 bp, Sorghum bicolor
  unsure (1)..(564): unsure at all n locations
  Clone ID: SORBI-28MAY03-CLUS880_10
ctcaatcccccccacccagcccaaacaatggcgtcggacgggagcggcgtggtgacgttgtacgggaacaacggcgcagcccttctgagggaccactcaagggtatcatgggctatgtggaggaggatttggtttccaccgacttcgttggtgacagcaggtcgagcatcttcgatgccaaggctggtattgccctgaacgacaacttcatcaagcttgtcttagatcgcgacaacgagtggggctacagcaaccgtgttgtcgacctgatccgccacatgttcaagacccagtagagagctttccgtagcatcccaatggccttggtctttctgctttccatagcatcccaatggccttggtcgctgtccatcccgctgcttgtctatgctgagaataaatgtgaatggtgcctctggacgcccgctccatgctgggtctgaacatgttttgtgtttccatttctgctaccatcctgtaacaaattcgctaatatgggacctgagtttagttttttgcttgtgangaaaaaaaaaaacaacaaatatttataaaaaaataaac

SEQ ID NO: 15819 - DNA, 516 bp, Sorghum bicolor
  Clone ID: SORBI-28MAY03-CLUS880_9
accagccccattctcgatcccgtttgaaatccatccgtcctcgtttcctccgtcccgcagcctctcgtccccatggccaagatcaagatcgggatcaatgggttcggcaggatcggaaggctggtggccagggtggccctgcagagcgacgatgtcgagctcgtcgccgtgaacgaccctttcatcaccaccgattacatgacctacatgttcaagtatgacactgtgcacggacagtggaagcaccatgaggtcaaggtcaaggactccaagacccttctctttggtgagaaggaggttgctgtgtttggctccaggaaccctgaggagatcccgtggggctcggttggtgctgattatgttgttgagtctactggtgttttcactgatcaggagaaggctgcagctcacttgaagggtggtgccaagaaaggtgtcatttctgctcctagcaaggatgcccccatgttcgttgttggtgtcaacgagaaggagtacaagtctgacattaacatt

SEQ ID NO: 15820 - DNA, 684 bp, Sorghum bicolor
  Clone ID: SORBI-28MAY03-CLUS880_7
cgcgtccgccattctcgatcccgtttgaaatccatccgtcctcgtttcctccgtcccgcagcctctcgtaaaggacacaagggctaaaaccctctccaccacccatatccgcttccttcatctcgagcatctcctatctccgtcgtcctcgttcttcaactcgccatgggcaagattaagatcggaatcaacggtttcggaaggatcggcaggctcgtggccagggtcgcgcttcagagcgaggatgtcgagctggtcgccgtcaacgaccccttcatcaccacggactacatgacctacatgttcaagtatgacacggtgcacggccactggaagcacagtgacatcaccctcaaggactccaagacccttctcttcggtcagaagccggtcaccgtctttggcatcaggaaccctgaggagatcccgtggggcgaggctggtgctgactatgtcgtggagtccactggtgtcttcactgacaaggataaggctgcggctcacttgaagggtggtgccaagaaagttgttatctctgccccaagcaaagatgcccccatgttcgttgttggtgtcaacgagaaggagtagatagctgatattcacattgtttcgaatgctagctgcacatcataactgacaactttggtatcctcgggggtctgatgacaacttgtcatgcca

SEQ ID NO: 15821 - DNA, 798 bp, Sorghum bicolor
  Clone ID: SORBI-28MAY03-CLUS880_6
cgtccgcagcaccactggcagagaatctgaatgggaagcatgagcccaagtcccccaaagccgatccccgttcaccaaaagctgctactcatgggacctgggccacttctgtaaagaatcccattggtgccagcagcactggagctgccaaggctgttggtaaggttcttcctgatttgaatggcaagctcactggtatgtccttccgggttcccaccgtggatgtgtcagttgttgacctcactgtccgaatcgagaagggtgcctcctatggggatatcaagaaagctattaaggctgcttctgagggaccactcaagggtatcatgggctatgtggaggaggatttggtttccaccgacttcgttggtgacagcaggtcgagcatcttcgatgccaaggctggtattgccctgaacgacaacttcatcaagcttgtctcgtggtacgacaacgagtggggctacagcaaccgtgttgtcgacctgatccgccacatgttcaagacccagtagagagctttccgtagcatcccaatggccttggtctttctgctttccatagcatcccaatggccttggtcgctgtccatcccgctgcttgtctatgctgagaataaatgtgaatggtgcctctggacgcccgctccatgctgggtctgaacatgttttgtgtttccatttctgctaccatcctgtaacaaattcgctaaaaaaaaaaaaaaaaaaaaaaaaaaaaaaaaaaaaaaaaaaaaaaaaaaaaaaaaaaaaaaaaaaaaaaaaaaaaaaaaaaagaagg

SEQ ID NO: 15822 - DNA, 378 bp, Sorghum bicolor
  Clone ID: SORBI-28MAY03-CLUS880_4
ccggggcacccgcgtggttgacctgatccgccacatgagcagcaccaactagatgaacgaactgaaggtctggtgatacaagggagtagggagttgtcttcttccccggagaaagtgcttccgagaataaaatttttctatctatcggattgtctgaaactattatgttgggtgtattgtatcgtagtggttggttgagcattgaatggctcatattttgtcaggtctactatctaccgttgataaacttttaatcaaccgttatatttcagttttgcattaaaaaaaaaaaaaaaaaaaaaaaaaaaaaaaaaaaaaggcccctaaggaacgaaaacgatcaaaaaaataaaggatcccccccaatgaaagaaatca

SEQ ID NO: 15823 - DNA, 392 bp, Sorghum bicolor
  Clone ID: SORBI-28MAY03-CLUS880_3
gtccgcattcctggtcgacccgcgtccgggacgcgtgggcattaatgacttcgatgctctatcagattttaacctcagatattctgataaagcatataggcgagagtagcatcttatacttttatgtgttgttagatgttctgatttgaaaatcgcattgagatgtctaaatttacttctccagttgcttgcggatcttgctcatatgagatgtacgagtttatctctggctcttgttagatggtagaaagcagcaggcaacttgttttttttttgcttgcattacagtaagcaggttgctttagatcaccacactacaaatactccttatagcaatgtatagctcaggatagaaataaaatggggtggcctattatttatgggcaaaaagg

SEQ ID NO: 15824 - DNA, 752 bp, Sorghum bicolor
  Clone ID: SORBI-28MAY03-CLUS880_2
gccggccgggccgggcgtgcggttcatgccatcactgccacccagaagactgttgatggaccctcagccaaggactggagaggtggcagggctgctagctttaacatcatccccagcagcactggagctgccaaggctgttggtaaggttcttcctgatttgaatggcaagctcactggtatgtccttccgggttcccaccgtggatgtgtcagttgttgaccttactgtcagaatcgagaagggtgcctcctatgaggatatcaagaaagctattaaggctgcttctgagggcccactcaagggtatcatgggctacgtggaggaggatttggtttccacagacttcgttggtgacagcaggtcgagcatctttgatgccaaggctggtattgccctgaacgacaacttcatcaagcttgtctcgtggtacgacaacgagtggggctacagcaaccgtgttgtcgacctgatccgccacatgttcaagacccagtagagatttttctgctttccatagcatcccaatggccttggtcgctgtccatcccgctgcttgtctatgctgagaataaatgtgaatggtgcctctggacgcccgctccatgctgggtctgaacatgttttgtgtttccatttctgctaccatcctgtaacaaattcactaatatgggacctgagtttagttttttgcttgtgaagaatataaacagtggggttgcaatgtaaaaaaaaaaaaaaaaaaggccccta

SEQ ID NO: 15825 - DNA, 1567 bp, Sorghum bicolor
  Clone ID: SORBI-28MAY03-CLUS880_1
gcacgaggctcactctccataaccaaccccattctcgatcccgtttgaaatccatctcgtcctcgtttcctccgtcccgcagcctctcgtccccaaggccaagatcaacacccggatccgcttccttcatctcgacgctccacttatctcgagcatctcccgtccccgttctccatctcctaactcgccatggggaaaaattatttcggaaaaaccggtaggcttcgggaggggtcggcacgtctcgtggccagggttcgcccgccagccgtgagggatgtctgcgctcgtccggccgtcaacgaccacttcatcaacaaggattacgtgcacgacatgttcaagtatggcaccgtgcacggccagtggaagcacactcaaatcatcctcaaggactccatgaccgttctcgtcggtaagaagcctgtggccagtcctttggcgtgaggaaccctgaggacattcctggtgggggcggctggggcggattcactggtatgagtacagtggtggcttaactggcagggacatggcagcggcactatctagaagtgtggtgcccaaagaagcgcgtaatttcggccctgatcaaagatgggcccatgttagttcatgttgtcaatgagtataaatacacctcggaaattaacattgtctccaatgctagctgcaccacgtacctgccttgctccccttgataaaggcattcatgacaactttggtattattgacggcttcatgacagctgttcatgccatcactgccacccagcaggtctgttgatggaccttcagccgagtaccttaccgttagcagagccgcaactttcaaggtgattcccaggatgattggtgctttcaatgtgatgcggatgggtagttcctggctggattcgaccgtgcacctgtcggttgtttcgcgttccttcagtgtagtgttgagttggtcctatgagcctccgaagagagatatgaaggcagcttgtgagtctccagtcaagggtctagtctgctacttagtggccaatttggggtacaatgggctctgtggcgacagcagtggtggcatccggcatcccaggggtggtcctgacccgcatcatgacttcaacgaccttgtctcccggtatgacaacctgtaggactacggcaacggggttgtagaactggtccggcacaagttaccgccccggtgaacatttttctgccttgcttagcatcccaaagacattgttctgtgtccattcgacggttttggtcggttgacaataaattggtttggtgtcttgggaatcccgctccatgctgccttttcacatctttggattcacctgttttgggtcccgttttttcaaccaattcactttaatatgtaccattctgtaacgatttctcttaatatgggactatgagtttagtttttgctttgtgaagaatataaacagtggggttgcagttttgctgtgtttagctggtttggttgcatagatgagctggtccttcgggaataatagttttcgttctgtgttgagaaatctggtcttaccgtgcctaacttgttttttggt

SEQ ID NO: 15826 - DNA, 470 bp, Sorghum bicolor
  Clone ID: LIB3478-039-P1-K1-B11
gttcgagcagtcaccccttctgcatgattttgtggcctgaagaatgctcatttgctcatacatcagatgatttgtatttagcacctgccggccggccgcccgcccaggtgaataacatatatatgtgcctgaaaaggagcattgttgggttgtagcctgtagtttcaattggatacagatttggaggtatagcaggaaatgtaatatagtgtaggtggttggggtgatagggtaaaaaaaaaagggcgacgacaacttcatcaagcttgtctcgtggtacgacaacgagtggggctacagcaaccgtgttgtcgacctgatccgccacatgttcaagacccagtagagatttttctgctttccatagcatcccaatggccttggtcgctgtccatcccgctgcttgtctatgctgagaataaatgtgaatggtgcctctggacgcccgctccatgctgggtctgaacatg

SEQ ID NO: 15827 - DNA, 446 bp, Sorghum bicolor
  unsure (1)..(446): unsure at all n locations
  Clone ID: LIB3476-057-P1-K1-B4
ccccattctcgatcccgtttgaaatccatccgtcctcgtttcctccgtcccgcagcctctcgtccccatggccaagatcaagatcgggatcaatgggttcggcaggatcggaaggctggtggccaagtggcgttcccacgaccacgcgttgctactacttccctcggcgcactcgatctgtattcctgttcgatgataatagtcgtggtcctagcggtcttacagtcaagaagcaaaggaacactgttagaagataatctggacacccagtaggcctgcaaagaggttggagttgttgctactgtatgtgcatctaccaacattgcagtgtttgtcatccctattgacaactgaacctgcactttcctgaaattttatagaatttctgctggcccttanagtattcagttttcattttccatgttttgtcaatacctttgaattca

SEQ ID NO: 15828 - DNA, 372 bp, Sorghum bicolor
  Clone ID: LIB5049-012-R1-XP1-H12
tgcggcgctcgagccggccgggtcggggctttttctcatctctctcgtgtatcgtcggctttaaaaggacacaagggctaaaaccctctccaccacccatatccgcttccttcatctcgagcatctcctatctccgtcgtcctcgttcttcaactcgccatgggcaagattaagatcggaatcaacggtttcggaaggatcggcaggctcgtggccagggtcgcgcttcagagcgaggatgtcgagctggtcgccgtcaacgaccccttcatcaccacggactacatgacctacatgttcaagtatgacacggtgcacggacactggaagcacactgacatcaccctcaaggactccgacacccttctcttc

SEQ ID NO: 15829 - DNA, 1840 bp, Sorghum bicolor
  Clone ID: SORBI-28MAY03-CLUS739_1
gcacgcggcccgcgaaggcgagccgactaggctagccgagcaccgcagagacaggcggcagagacaggcgtcttcgtactcgcctatctccgcgactcaaagcttctcccccttctcccatttcccaccgccgccgccgttccacccttccgacgacaccatgagggagtgcatctcgatccacatcggccaggccggtatccaggttggaaacgcgtgctgggagctctactgcctcgagcatggcattcaggctgatggccagatgcctggtgacaagaccgttgggggaggtgatgatgctttcaacaccttcttcagtgagactggcgctgggaagcatgtcccccgtgctgtgtttgttgaccttgagcccactgtcatcgatgaggtgaggactggcacttaccgccagctcttccaccctgagcagctcatcagtggcaaggaggatgcagccaacaactttgcccgtggtcactacaccattggcaaggagattgttgacctgtgccttgatcgcatcaggaagcttgcagacaactgcactggtctccagggtttccttgtcttcaatgctgttggtggaggaacgggctctggacttggttccctcctcttggagcgtctgtctgttgattatggcaagaagtccaagcttggtttcactgtgtacccatcccctcaggtctctacctcagtggttgagccatacaacagtgtcctgtccacccactctctcctcgagcacactgatgtcgctgtcctccttgacaatgaggccatctatgacatctgccgccgctcccttgacattgagcgcccaacctacaccaacctcaacaggcttgtgtcacaggtcatctcatccctgactgcatccctgaggtttgatggtgctctgaacgttgatgtgaacgagttccagaccaatctggtgccctacccgaggatccacttcatgctttcctcctacgctcctgtgatctcggctgagaaggcctaccacgagcagctgtccgttgctgaaatcaccaatagtgcctttgagccatcctccatgatggccaaatgtgatcctcgccatggcaagtacatggcctgctgcctcatgtaccgtggtgacgtggtccccaaggatgtgaatgccgctgtggccaccatcaagaccaagcgcaccatccagttcgtggactggtgcccgactggcttcaagtgtggcatcaactaccagccacccagtgtggtgcccggcggtgacctcgcaaaggtgcagcgtgccgtgtgcatgatctccaactccaccagcgttgtggaggtgttctcccgcatcgaccacaagtttgacctcatgtacgccaagcgtgccttcgtgcactggtacgttggtgagggtatggaggagggtgagttctctgaggcccgtgaggacctggctgcgcttgagaaggactatgaggaggttggcgctgagtacgacgagggtgaggatggtgacgagggcgacgagtactagaagctttctggttctacagcgtcgggcctatttgctgcaattatcccgtgatctgccctgagtggctcgtactatcttgtttgtctgtgggttccgaacttatctgtcattgtgtggtttacaacacccgatgttgtaagacttgtggttaattccctgctttgcgacttgttgggttattaagagccgttatatggttgtctttcttgataattaagatgctgtcgtctctgcgatgcacttcttttatcgcctgggtttgtcttgtttcatcagtgtagtgggttagttttgatgtcttgtcatcagtagtgaattgtttga

SEQ ID NO: 15830 - DNA, 408 bp, Sorghum bicolor
  Clone ID: LIB3476-057-P1-K1-C8
cccacgcgtccgactgcctggagcatggcattcaggctgatggccagatgcccggtgacaagactgttgggggaggtgacgatgctttcaacaccttcttcagtgagactggcgctggcaagcacgttccccgtgctgtgtttgttgaccttgagcccactgtcactacagtgttaggactcgaagaaggaaaggattgcataattgttggaactttatataagcacatgaagttgaagccttccattcttgatgaatatgccaaagagaggtctgcaattcctcttgtcaaaccgcataatttcatgcatcctgatgatcatctcattctcgaagatgaaagtggaagggttacacttgcaggagccattcctccagcagcatttgtgacctggggttgagtggctc

SEQ ID NO: 15831 - DNA, 356 bp, Sorghum bicolor
  Clone ID: LIB3476-009-P1-K1-H7
cggacgcgtgggcgcagagacaggcgtcttcgtactcgcctatctccgcgactcaaaagctttctcccattccccagcggcgccggcgttccacccttccgacgacaccatgagggagtgcatctcgatccacattggccaggccggtatccaggtcggaaacgcgtgctgggagctgtactgcctggagcatggcattcaggctgatggccagatgcccggtgacattgagcgcccaacctataccaacctcaacaggcttgtgtcccaggtcatctcatccctgactgcttccctgaggttcgatggtgctctgaacgttgatgtgaacgagttccagaccaacctggtgccct

SEQ ID NO: 15832 - DNA, 1555 bp, Sorghum bicolor
  Clone ID: SORBI-28MAY03-CLUS73_1
acgaccgacgcgtccgacgctaccgacaactcgtgcgtgatcaacctgatcattagcaagaagccgagatccaggccagagaagcgagcactagcgacagcacacatacatcaacgtacagctatggcacttggggatcgctccctgctccgccgtgctcaatctcgaccccagcagttagcctctgcaggttccggagccgcctgagtataccccacggccacaccaaaaccacacagtcacagacacacaccgctcgctgcttcaagaaaccaccgagctcccaagcgcgcaaggcaggagagagaggagcggaaatggaggggaaagaggaggacgtgcgcctgggcgccaacaagttctcggagcggcagcccatcgggacggcggcgcagggcgccggggacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccaactccaagtgcgccaccgtcggcatccagggcatcgcctggtccttcggagggatgatcttcgcgctcgtctactgcaccgccggcatctccggagggcacatcaacccagctgtgactttcgggctgttcttggccaggaagctgtccctgactagggccatcttctacattatcatgcaatgcctgggtgccatctgtggagctggagtggtgaagggcttccagcaggggctttacatgggcaacggtggtggtgccaatgttgtcgcccccggctacaccaagggtgatggccttggcgctgagatcgttggcaccttcatcctggtctacaccgtcttctcggccactgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcatgcctggagcgaccattggatcttctgggtcggccccttcattggtgctgccctggctgccatctaccaccaggtgatcatcagggccatcccgttcaagagcaggtcttaagctggtcttaagctgccgcggccgtgccgagacatgccagtccgaagaacgagcgtcttcctgtgatgtctttgtctgccctgcccacgcctaggtccaaagtcgattcctcgtctctcttcaagattgctcactgctgcactgttctgtaatctgaacccaggactttgtgtattcctgtaccgagctcagctgtgtatgtttttcttccatcgtggagaatttaagttattaccgtttgttgcaagggttcccgtctccttttatgcgttgggatcttggcaagaaagggcacatgtcatgtgaaaatgtgaatctatctgtctagtgaaatttgcatcgaaagtcaaattgattcagatttttct

SEQ ID NO: 15833 - DNA, 973 bp, Sorghum bicolor
  Clone ID: SORBI-28MAY03-CLUS96_2
aaccttccaggtggaagggtctacagtgcttgcagcgctgcattaggagatcatcacatgtccgtctccaggcgtggacggccgggggaggacaatgcaaagctctgtacatggtgccatggtggtgtaatgtaacataactgctaggcatgcaactgatgctgatctatctgtatcatctcccttccataaaagagaagtgcgtacgctattgtgtcttatcctaccagtactaggctgattcactgaagaagtagaatccaaggaatgaaggaatcccattccttcactccattcattcagttttgaccttttcttttctttcagtgcttgcttcaaatcttttcctaccacttttcgtactatgtccagattcgtaccatggaatccatgtgttgtgttttctcttttgttaacaacaagcttaagtactctaattctcggggttaggtgcaaaatgtcccacctaattactctgaatgacatgatgaccatttttcttcagtgagtcattcagtaaacagaccaacgatgtttctgagtcacaagtcacacagctcacaaacagaaactgatgccgacaaaacacaaaatttgtgttgtttggtgaatgctgaccaggtcgttcgcggcgaaagacgaggtgttctgcctgttcgagggtgtgctggacaacctggggcggctgagccagcagcacgggctgtccaccaagggcgccaacgaggtgctcctcgtcatcgaggcctacaagacgctccgtgaccgggcgccctacccggccagcttcatgctcgcacagctcaccggcagctacgccttcgtgctcttcgacaagtccaccaactccctcctcgtcgcatctgatcctgagggcaaggtgccgctcttctgggggatcactgctgatggctgcgtcgccttctctgatgacattgacatgctcaaaggatcatgtggcaaatcgctcgcg

SEQ ID NO: 15834 - DNA, 1319 bp, Sorghum bicolor
  Clone ID: SORBI-28MAY03-CLUS96_1
gcagggcacgaggcaagagtgtacaaggaagaagaagcaccagcagcttttcttgatgctaccttgatccatcagcctcaagagtgtacaaggaagaagaagcaccagcagcttctcttgatgctaccttgatccatcagcagcagcttcttcgtctgctttttggggagattattaggagtaggagtaggattactagttattattactagtgagtgagtgagtgagtgatcgagcgaggatgttggcggtgttcagcggcggtgtggtggaggtgccggcggagctggtggcggcgggaagccggacgccgtcgcccaagaccagggcgtccgagctcgtcggccggttcctgggtgcctccgagccggccgtctccgtgcagctcggcgacctcggccacctcgcttactcccacaccaaccaggcactcctccgcccaaggtcgttcgcggcgaaagacgaggtgttctgcctgttcgagggtgtgctggacaacctggggcggctgagccagcagcacgggctgtccaccaagggcgccaacgaggtgctcctcgtcatcgaggcctacaagacgctccgtgaccgggcgccctacccggccagcttcatgctcgcacagctcaccggcagctacgccttcgtgctcttcgacaagtccaccaactccctcctcgtcgcatctgatcctgagggcaaggtgccgctcttctgggggatcactgctgatggctgcgtcgccttctctgatgacattgacatgctcaaaggatcatgtggcaaatcgctcgcgcctttcccacaaggttgcttctactctaacgcccttggaggcctgaagtgctatgagaaccccaagcacaaggtcactgctgttcctgcagacgaggaagaaatctgtggtgcaactttcaaggtggaagggtctacagtcctgacagcgctgcatttttaggagatttccgtgtggaagcgtgggtggagcgcaatgcaatgcagaactgttgtacatgcatggtggattggtggtgtaacatagtggcaagtcatgttcatgcaactgagtctatctgtgtaatgcatctttcataaaaagagaagtactggaggcacttaagggttgatggttgtgtgtgtaccctgtatccctaggtgttcaacttacatggaacttgggtggttgagacatggtgctaatataatcgatcggttgcgtggaatatgtgaagtttgtaatctgttcctaataacaaagctttgtttctccagtcgtcgttgttcatgtgatgaatgaaaaaacggaattctagcaataa

SEQ ID NO: 15835 - DNA, 541 bp, Sorghum bicolor
  unsure (1)..(541): unsure at all n locations
  Clone ID: LIB3481-016-P1-K1-H9
cgtccggccgctcnttctggggatcactgctgatggctgcgtcgccttctctgatgacattgacatgctcaaaggatcatgtggcaaatcgctcgcgcctttcccacatggtaattaacgactcatcaagcaactgtcagatcagatcagatcacgtcttgacttgtgtgttgccaaacaccagatctctgaaactgaaaatgttgcttgccaatggcaacaactgctgaaggcagtctgaagattaaagtttctgtacaacatccaaattaagagcactcatcctcgttttttcgttttagctgatctcataatgctgcattattgtaggttgcttctactctaacgcccttggaggcctgaagtgctatgagaaccccaagcacaaggtcactgctgttcctgcagacgaggaagaaatctgtggtgcaactttcaaggtggaagggtctacagtcctgacagcgctgcatttttaggagatttccgtgtggaagcgtgggtggagcgcaatgcaatgcagaactngtgtacatgcatg

SEQ ID NO: 15836 - DNA, 219 bp, Sorghum bicolor
  Clone ID: 2909877
atctccctcccataaaagaagaagtgcgtcctgccggcatgcatggtcaggacttctgtgctagctgttggttgttgtgtgtgcagctgtatcctagttgttcgacacatggaacaacctgagagcttagctgagaccaggtgctgagcatagctgcatgcatgtatgaagtgctataatctgcagtgataacgaagctttgtttgtcaaaaaaaaaaa

SEQ ID NO: 15837 - DNA, 687 bp, Sorghum bicolor
  unsure (1)..(687): unsure at all n locations
  Clone ID: SORBI-28MAY03-CLUS3435_5
ctcccggcacgacaccacgcttcccatcggatcgaacagctagggtttcggagatgtttgggcgcgcgccgaagaagagcgacggcacccggtactacgagatcctcggcgtctccaaggacgcctcccaggatgacctcaagaaggcctaccgcaaggccgccatcaagaaccaccccgataagggcggggatcccgagaagttcaaggagctagctcaggcttatgaggtcctcagtgatcctgaaaagcgagagatttatgatcagtatggtgaggatgccctcaaggagggaatggngagcggtggagggatgcacgatccctttgacatattccagtcattctttggcggtgggagcccttttggaggtggtggcagcagtaggggcagaaggcagcgaaggggagaggatgtggttcatcctctgaaggtttctctggaggatttgtacaatggcacatcaaagaagctctctctgtcccgcaatgttctctgctccaagtgcaatggtaagggctcaaagtctggagcttcgtcgaggtgtgctggttgccaaggttctggctttaaggtccaaatcaggcagttgggacctggaatgattcagcaaatgcagcatccttgcaacgagtgcaagggttctggagagaccatcaacgacaaggacagatgcccacaatgca

SEQ ID NO: 15838 - DNA, 567 bp, Sorghum bicolor
  Clone ID: SORBI-28MAY03-CLUS3435_4
cccacgcgtccgggcttccagtttgttttgacacacctggataacaggcagctgctaatcaaatcaaaccctggcgaagttgtgaagcctgattctttcaaggcgatcaacgatgaaggcatgcccatgtaccagaggcccttcatgaagggcaagctgtacatccacttctcggtggatttcccggactcgttgagcctggagcagtgcaaggcgctggaggctgtgctcccacccaagccggtgtcgcagtacactgacatggagctggacgagtgcgaggagacgatgccgtatgacgtgaacatcgaggaggagatgcggaggcggcagcagcagcaccaggaggcatacgacgaggacgaggatatgccgggcggtgcgcagagggtgcagtgcgcccagcagtagttgcctgctatcagtagtagcagtgataaatgtttgacggtggcggcaaatttgttgtttcgcattgtgcgactactgttgggtcaagttttccctcgcatttaatgtcacaacacttcggtaacaaaaatgcagtattcatcaatccgttagcag

SEQ ID NO: 15839 - DNA, 1809 bp, Sorghum bicolor
  Clone ID: SORBI-28MAY03-CLUS3435_3
acaaacgccccccaacctctccctctcgcttcccactccgctcggccaccagctttgaccgcctcctcccctcccctccgctcctgctcctccccaccccactcccccgcaggagcggcggcggcggcggcggcgaggttgtatcccgcatcggcgagcggcaccggcggcaaaggcaagatgttcgggcgcgcgccgaagaagagcgacaacaccaagtactacgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaggttctgagcgacccagagaaacgtgagatttatgatcagtatggtgaagatgcccttaaggaaggaatgggtggtggaggagcccatgttgatccatttgacatcttctcatcattttttggaccctcttttggaggaggtggtggaagcagcaggggaagaaggcaaaggaggggagaagatgtagtccacccacttaaagtttctctggaagatctttacaatggcacctcaaagaagctctctctttcgcgcaatgtcatctgctctaagtgcaagggcaagggctcgaagtctggtgcatcaatgaggtgccctggttgccagggctcaggcatgaaagtcacaatccgccagctggggccttccatgatacagcagatgcagcagccttgcaacgagtgcaaggggactggagagagcatcaacgagaaggaccgctgcccagggtgcaagggtgagaaggttgttcaagagaagaaggttcttgaggttcatgttgagaaggggatgcaacacaaccagaagatcaccttccctggtgaagctgatgaagcgcctgatactgtcactggagacattgtattcgtcctccagcagaaggatcactccaagttcaaaagaaagggtgaagatctcttttatgagcacaccttgtctctgactgaagctctctgtgggttccaatttgttcttacacatctggacaacaggcagcttctcatcaaatcaaaccctggtgaagttgttaaacctgaccaattcaaggcgataaacgacgaggggatgccaatttaccagaggcctttcatgaaggggaagctctacattcatttcacagtggagttccctgactcactggcaccagagcagtgcaaggctctcgaggcagtacttccaccaaggtcttcatccaagctgacggacatggagatagatgaatgcgaggagacaactatgcatgacgtgaacaacatcgaggaagagatgcgcaggaagcaagctcatgctgcccaggaggcatacgaggaggacgacgagatgcccggcggagcccaaagagtgcagtgcgcgcaacagtaagcaggcgtatcatcatggcaattggcagggttgcgcttcaagtgctagagtggtctctggttttgctgtcgctgagatgcgaaataggaagctgattctacccctgcaagcagggaatgtatcctttttgctgcaactgaaaaaaaaaaaaattgctacctacgcatggctggctacctttcttttaacttttgtttgtgagatttgctagagtgatggtttcatcaatatataggtggacttaaatgtttgtggaatgctactgtataacgcacatatgggtgcactgtctgttgcatcgccgtctgaatgacatcgccgtttgcacatcggcacattttttttaaatataacgcataatcgcttgct

SEQ ID NO: 15840 - DNA, 775 bp, Sorghum bicolor
  unsure (1)..(775): unsure at all n locations
  Clone ID: SORBI-28MAY03-CLUS3435_1
gtagaaggcacctaacaggttgcaaaggcgattctgtcntaagtttccatgatacattccggagctcctagtcagttcgcagttgatatccaaggcaggactcaagccttgctcgcaatgttgctggacagccagtccaggccctcgtagagaccctcaccagttgtagcacatgtgctctggatgtaccagtgtcgctggcgcagggagtgtaatccaagcttgtcagtaatctctgcagcattcatggcattgggaagatcttgcttgttggcaaaaacaagcagcacagcatcacgtagctcatcctcattcagcatcctgtggagctcatctcttgcttcaacaacacggtcacggtcattgctgtccacaacaaagataagaccctgggtgttctggaagtaatgcctccagagaggtctgatcttgtcctgacccccgacatcccacacggtgaagctaatgttcttgtactcaacagtttcaacattgaaaccgatggtggggatggtggtgacgatctcgccgagcttgagcttgtagaggatggtggttttaccggcggcgtcgaggccgaccatgaggatccgcatctccttcttggcgaagagccggctgaagagcttcccgaacgcgagccccatcttcctccttcctccgcggcgggcccccctttccttcaccacctgcgctgcgtgctgaatgcgaaatccggaggaggaggaggaggaggaattggggatcgggggtggcggagcccggcccggccggc

SEQ ID NO: 15841 - DNA, 855 bp, Sorghum bicolor
  Clone ID: LIB5052-001-A1-XP1-E12
gccggccgggttcggggaccggaccggaccgcaccaccacgagctcccgcctccgccgatccgcgcacgcagatcgccgaagcccggcggcgcagagcccaaggggagggagggagctcgcggcggcggaggaggaaggcgttcgccacagtcgcggatttcctttgggaagagatggggctctcatttgggaagctgttcagccgcctcttcgccaagaaggagatgaggattctcatggtcgggctcgatgccgccggtaagaccaccatcctctacaagctcaagctcggcgagatcgtcaccaccatccccaccatcggattcaatgttgaaactgttgagtacaagaacattagcttcaccgtttgggatgttggtggccaggacaagatcaggcccctgtggaggcactactttcagaacacacagggacttatttttgttgtagacagcaatgacagggaacgtgttgttgaggctagagatgagctccacaggatgctgaatgaggatgagctgcgtgacgccgtgctgcttgtatttgcaaacaaacaagatcttcctaatgctatgaatgctgctgaaattactgacaagcttggtctgcattccctgcgccagcgtcactggtacatccagagcacttgtgctacgtctggcgaagggttgtatgaggggcttgactggctttccaacaacatcgccaacaagtcttgaagcttttcggctgggctcctagcaagaggaagacgtctgaacaacttatggctgctctttttacatattattactgagacaatctacagtagatagtgtgggtgcttattggaaaaaaaactcagagctctcttt

SEQ ID NO: 15842 - DNA, 525 bp, Sorghum bicolor
  Clone ID: SORBI-28MAY03-CLUS4949_4
aagactctctcttcccacccgagtctcgcccctcttgacacacgctcctcctccaccagtccgccgccgtctccgcgccccgcctcccccaaaccccaccgcctcgccggaaccctagcccctccgtcgccatgagggagatcctccacatccagggcgggcagtgcgggaaccagatcggggccaagttctgggaggtgatctgcgacgagcacggcatcgaccacaccggcaagtacgccggcgactccgacctccagctcgagcgcatcaacgtctactacaacgaggccagcggcggacgctacgtcccgcgcgccgtcctcatggacctcgagccggggaccatggactccgtgcgctcgggccccttcggccagatcttccgccccgacaacttcgtcttcggccaatccggcgccggaaacaactgggccaagggacactacaccgagggcgccgagctcatcgactccgtgctcgatgtcgtgcgcaaggaggcgagaactggactgcttacgggtc

SEQ ID NO: 15843 - DNA, 781 bp, Sorghum bicolor
  Clone ID: SORBI-28MAY03-CLUS4949_3
gccggccgggtcgggaacctccccttcttcttcgggactcccagacccagatctcttccccaccgccgccgccaccggccccaaatctccaaatcccccaaccggccgccatgagggagatcctccacatccagggcggccagtgcggcaaccagatcggggccaagttctgggaggtggtgtgcgccgagcacggcatcgacgccaccggccgctatggcggcgactccgacctccagctcgagcgcgtcaacgtctactacaacgaggcctcctgcggccgcttcgtgccccgcgccgtcctcatggacctggagcccggcaccatggactccgtccgctcggggccctacggccacatcttccgccccgacaacttcgtcttcggccagtccggagcaggcaacaactgggccaagggccactacaccgagggagccgagctcatcgactccgtgctcgacgtcgtgcgaaaggaggccgagaactgcgactgcctgcaaggcttccaggtgtgccactccctcggcggcggcaccgggtccggcatgggcacgctcctcatctccaagatccgcgaggagtaccccgaccggatgatgctcaccttctccgtcttcccctcgcccaaggtctccgacaccgtggtggagccctacaacgccacgctgtccgtgcaccagctcgtggagaacgcggacgagtgcatggtgctcgacaacgaggcgctctacgacatctgcttccgcacgctcaagctcaccaccccgagcttccggga

SEQ ID NO: 15844 - DNA, 1882 bp, Sorghum bicolor
  unsure (1)..(1882): unsure at all n locations
  Clone ID: SORBI-28MAY03-CLUS4949_2
agaacgcgttgctgctactccaccagttcgccgccgcagtgtgcgccccgcctgccccaaaccccaccgcctcgccggaaccctagccccgccggccgggccgggatgggagccgggcctctcctttctttaccacaccctcccccttcccctccccgctcccccctcatctggacggccgactcgcttcttcttctgtgagctaccaaccttgagatcaagccatgagggagatcctccacatccagggcggccagtgcgggaaccagatcggttccaagttctgggaggttgtctgcgacgagcatggtatcgaccccaccggacgctacgtcggcacctccgacctccagctcgagcgcgtcaacgtctactacaacgaggcctcatgcggccgcttcgtgccgcgcgccgtgctcatggacctcgagcccggcaccatggacagcgtccgcaccggcccgtacggacagatcttccgccccgacaacttcgtcttcggccagtctggcgcggggaacaactgggccaagggccactacaccgagggcgctgagctcatcgactccgtgcttgacgtcgtgaggaaagaggctgagaactgcgactgcctgcaaggcttccaggtttgccactcccttggaggaggtactggttcaggaatgggcaccctgctcatctccaagatcagggaggagtacccggatcgcatgatgttgacattctctgtcttcccgtcgcccaaggtgtctgatactgtcgtggagccctacaacgccacgctctctgttcaccagctggttgagaacgctgatgagtgcatggtgctcgacaacgaggctctctatgacatctgcttccgcactctgaagcttgctacaccaacctttggtgatctgaaccacctcatctctgcaaccatgagtggagttacgtgctgcctgcgcttcccaggtcagctgaactctgacctccggaagcttgcagtcaacctgatccccttccctcgcctccacttcttcatggttggatttgctccactgacctcgcgtggctcccagcagtaccgtgccctcaccgtcccagagctgacccagcagatgtgggatgccaagaacatgatgtgtgctgctgacccgcgccatgggcgctacctcacagcatctgctatgttccgtgggaagatgagcaccaaggaggtggatgagcagatgctcaatgtgcagaacaagaactcgtcctacttcgtcgagtggatccccgacaacgtcaagtccagtgtgtgcgacatcccgccgcgtggcctttccatggcctncaccttcattggcaactccacctccatccaggagatgttccgccgtgtgagcgagcagttcactgctatgttcaggaggaaggctttctcccacgcgtccgacaccagcgagggcatggacgagatggagttcaccgaggccgagagcaacatgaacgacctcgtcgccgagtaccagcagtaccaggacgccaccgccgaggagtacgacgaggaagagcaagacggcgaggaggagcacgcctgatcggaggccaactgatcgatgcaaaggacttcagagacttcgctcctatggtacaccaatcgagactacacattcctacaatcctactactacgtaccttaagtatgtacattcagtactgccgtatttccgttactgctgctagcttgtgtgtgtatctacagtcgtgtcactctcgtgtgtgttagtgttttgtgaacttgtgatatactgtcaccgntgtccaggttttgtgcgtatgtttattcatatgatgggattgctctttgttcttgtacgtattagtaaggaatattcatttttttggaagattgttt

SEQ ID NO: 15845 - DNA, 1978 bp, Sorghum bicolor
  Clone ID: SORBI-28MAY03-CLUS4949_1
gcccgagtcccacgggaagaccacccccacggacgtgcatcaacagccgcccccctccccccccgatctctctccctccctcgcggcgagttgctccgcagttcggatcttctcgaaccgcgacgtagatcagagtgagctggagatgcccgcaagactaatcggccactccgactccagccaggatatggtccgccgcgtcagtgagcagttcacaggtatgttcaggccgaaggcctgctacctctggtcctctggtggggcgctggattggatggagctcagcgaccccgagagccccctggacgccccggtggcttagcaccagcattgccacgaggacactgcccagcatccagagcggtctgtgcgggaagaacggtcggagccagctgcttgggcgagctcctccaggggctggtaaacacacggaagaggatgtcccctgtcgagttggtcgtccggatggagcgcatcagcggcgtgttgagggagggctgggaagtacgcgacggctggcattgcttccggatgtgccgctgctgtgacaccactccatttgcttgtgtatgatcgttggtccccatagtcgtcactaacatgtgggggaacggctagcttagctcagtaatcgctttgccctaggcacacttcaccgagggcgccgagctcatcgacaccgtgctcgatgtcgtgcgcaaggaggccgagaactgcgactgcctacaagggttccaggtctgccactcgctgggaggaggtactggttcaggaatgggcaccctgctcatctccaagatcagggaggagtagccggatcccatgatgtgtgcattctctgtcttcccgtgcgcccaaggtgtctgatactgtcgtggagccctacaacgccacgctctctgttcaccagctggttgagaacgccgatgagtgcatggtgctcgacaacgcggctctctatgacatctgcttccggacgctcaagcttgctacaccaacacaacaggtgttctccgccaagtacatgctgtacgctatcaaccgtggccatggccgttaccgcatcgccgcggagatgttccgtgggaagatgagcaccaaggaggttgacgagcagatgataaatgtccagaacaagaactcgtcctacttcgtggagtggatccccaacaacgtgaagtccagcgtgtgtgacatccccccgaggggcctgtccatggcgtctaccttcatcggcaactcgacttccatccaggagatgttccggagggtgagcgagcagttcactgccatgttcaggaggaaggctttcttgcactggtacactggtgagggcatggacgagatggagttcaccgaggccgagagcaacatgaatgacctcgtgtcggagtaccagcagtaccaggatgcgactgccgatgatgagggcgagtacgaggacgaggaggacgtgcaaggagatgaaatctgagaggctgtgatagtgttaagcctggtggttctagggcagggagaccttgatgggttttgtgtcccctttcgtattgtggccgtgttacatctgctagcgaatcaccttcgtggcccattctgtcgctgttgatgcttgtattttccgttgtgttacggaaccttgcctacggtacgatctttttcgtgcccccagtgttttgttcgcttgcactgcttgatatgccatggcttatatgtgaggagtatttgactgtcttgagtctgaccatttattggtatcgttattatgttaacctaagggaatccagacttgcttgttatgaaattctgaattgtactgctcctgtcggccatatccaagtgctgcctcgctggtccatggggcaccggatacggccggccggatctcaaccccatcgatagctccagagccgatttctgctgcgccatatggactcaagatccgcgttttagtttcaaaaaagaaaagtcgcgtttgcaa

SEQ ID NO: 15846 - DNA, 313 bp, Sorghum bicolor
  Clone ID: LIB5047-002-R1-XP1-A10
gccggccgggcctacgagatgcacatgctgcagtgatcgaacgatcgatcgatgcacggctggccggcactggcacaccacttgttcgtacgtcgtcgatcggttgtgtccgtggtgcgatgtgaccggagcctactgtttgcgtgtctcgtcggtcggcccgccggccgtgttctctgctcccgttatgcatgaatttcctgctgttttctttgttacatgcatccggtataatgtacgtgcccttgtcagtgcatatgcatggttctgtacctctccatgttcccaaaaaaaaaaaaaaaaaaggccccta

SEQ ID NO: 15847 - DNA, 388 bp, Sorghum bicolor
  Clone ID: LIB5051-003-A1-XP1-F5
tcgaggccggcctggttgcggatctggtgtccgagtaccagcagtaccaggatgccactgccgatgaggaggcagagtacgaggacgaggaggatggcatccaagacgagtaaggtgttctggactctggacagccacatatttgtacccctctctggacctggttttttctttcaagcttgtgctttgcctatggtttgcttattattgtattcgcgcatgttaatgctgggtatgtagtagcacttctgtggggtagcatgctgtatgctaccacttgccctctttcgccaccacaaagacttgttcacctgcactgcttgatatgccatggcttatatgtgaggagtatttgattattataaaaaaaaaaaaaaaaaggccccta

SEQ ID NO: 15848 - DNA, 189 bp, Sorghum bicolor
  Clone ID: SORBI-28MAY03-CLUS482_6
aaaccaagggaagccattaaggactgacaaaatcaagggacaaaaagagcaaggtcaacagacaccacatctttagttaagataatccatcaactccatgtctccagctcaaaactcaaacaaaaatgcttgttgcaggactacagggaacaataaacaccattgcgcaagttctgacccacgcgtccg

SEQ ID NO: 15849 - DNA, 825 bp, Sorghum bicolor
  Clone ID: SORBI-28MAY03-CLUS482_3
catccaagagtgccgacagaagcttcctcaaagcagcttggcagctcgagaagtcattaatttagctccttccattgccttcatactcctgatgcaaatcacggatcttgagcacgcgacgagccaaaagaagaccagtacagtaggctgcagcatagttggtcagaccaacttctagaccgtatcgtggcagctcatgggaataggcagcagcaagaaccatatcacccgcaatacttgcagatacgatttgtgcagtgatgtctttgttggtaaatcgcacaacgaatcggtatttgggcgtattgtacttgttcttgtcttggttaatcaaccttatccttgccctgtagtctgtcttaccagcacgccttctcttgaacttcacttggaaacgcttgaagtacgcattggtcttctgggtcttgacgaaccctcccgccatctcggtcgcctgctgtggctgcggcctgcggacgcggacgcagcggcagcggcggcggcggcggcggctggccgtcgacgacgcgcggctgttgagcgagcgcaccccggtgcagcacgccggggagggggacgccgtggtgcccatcgcgtacccgaggcacggcgccaccgaggatgtcacgtcgctgcagctcaccgccgccgatgccggctccgaggacgccagcagcagcgccgccaggaccgccaccgtcgtcgcgaccaccagggcgaggcgtggagcagccattgcaggacagaagagcagtggggggtggtgagctgttgatggtgtagtggtgttaagtgaagctgtgatggatcgcgagcccggccggc

SEQ ID NO: 15850 - DNA, 1308 bp, Sorghum bicolor
  unsure (1)..(1308): unsure at all n locations
  Clone ID: SORBI-28MAY03-CLUS482_2
accaggtctcattgcctcagactgaattatcctgacactataaaccaagggaagccagcaaaaacttggccaaacggcagcattaaaatattaggagtaaacatccataaggaaagcttgagagtaacaaagaaaccaggttaaacagcaagcaaacccccaaagccacgacgttgagtgctgctttgctagcctgctacacacacacccccgtacgatcgaggtacacgacgacagccacagcgacgacagagttggtgtaaactcaaggtagtaaacagtaaatactaattaaacggagtgatcactaacaggtacggtgcatgcatgatctactccttaatttatgtatctatctcattgcatgcatcatccatggagggagtcatggacgacatctggtaaaacaacgacgactgcatgctgatcgccatccaacgagcatgcctcatgcatgtccttatgatcgatcatcagttgatcttggagcagtcgacgttgggactaatgggcacgccgacggagacgccgcacttggaggggatgctggcggcgttacccatgctgacgccgccgccgccgccgagcctgctcgtcatgctcttgaggcaggcgcaggtggcctggcggtcggccgtcgacgacgcgcggctgttgagcgagcgcaccccggtgcagcacgccggggagggggacgccgtggtgcccatcgcgtacccgaggcacggcgccaccgaggatgtcacgtcgctgcagctcaccgccgccgatgccggctccgaggacgccagcagcagcgccgccaggaccgccaccgtcgtcgcgaccaccagggcgaggcgtggagcagccattgcaggacagaagagcagtggggggtggtgagctgttgatggtgtagtggtgttaagtgaagctgtgatggatagagaccatttgtgcagtgatgtccttgttggtgaatcgcacaacaaatctgtatttgggtgtgttgtacttgtttttgtcctggttgatgagccttatcctggccctgtagtctgtcttaccagcgcgccttctcttgaacttcacttggaaacgcttgaagtacgcattggtcttctgggtcttcacaaaaccacccatctcggtcgcctgctgtggctgtggaagcagcggcggcgggttcccccagcggcggcggcggcggcggcttctcctggggcgccgagagccatttttttttttttttttttttttttttttttttttttttttttttaannnggacgcacaaacaatatttttttccgcagcccggccggc

SEQ ID NO: 15851 - DNA, 1174 bp, Sorghum bicolor
  Clone ID: SORBI-28MAY03-CLUS482_1
gtccaaacgggagcattttaatattaagagtaaatatccagaactccagctcgaaactaacagaaacagctttgttcacatcgccaaacttaaacaaaaatgcctgttgcaggactacaggtaaggataaatgccatagcacaagttctgatcgcctcataagatagcactacttcgatgggactaaactttactcgtcatcctcatcatcatcatcggcaccaccagaggagttgagttggttgagcctttggacgaggctagccttcctctgctcatatgtcagcttcttggggttgtacctcttgtgctcctttggtggctgcttggttgacttagccacagatggatcagcacggatggcagcatgaaccttcttgtacagaccttccatgtcctcagcctcaattcccttcttaatgtaatcactgaagtgagactggtacttctctggctcctcctcagcaaggttcttcatgtagtcagcaacgtggccaccatagatgtacttgcggtgaatatcagcatccagctgcttgtcatccttcttaaacccagcaaacctcttctcgctgtgaggaatatccaggccaccatccaaagctcccttgagggcaccaaagacacggttccctgttgtagtcctgataaggccaacatccaacagagcacggaaaggcctcctctcatcagctggctcaacagagaagtcctcaccagtggcctcaacattgccctcatactcctgatccaaaccacggatcttgagcacacggcgagccaacagaagaccagtgcagtaggcagctgcatagttggtcagaccaacttcaagaccatatcgtggcaactcatgtgagtaggcagaagcaagaaccatatcacccgctatactagcagagatgatttgtgcagtgatgtctttgttggtgaatcgcacaacaaatctgtatttgggtgtgttgtacttgtttttgtcctggttgataagccttatcctggccctgtagtctgtcttaccagcgcgccttctcttgaacttcacttggaaacgcttgaagtacgcattggtcttctgggtcttcacaaaaccacccatctcggtcgcctgctgtggctgtggaagcagcggcggcgggttctcccggcgggcgagacggcccgcccgcccgcc

SEQ ID NO: 15852 - DNA, 727 bp, Sorghum bicolor
  unsure (1)..(727): unsure at all n locations
  Clone ID: LIB5049-007-R1-XP1-A5
gccggccgggcctgcgccatccatcacagcttcacttaacaccactacaccatcaacagctcaccaccccccactgctcttctgtcctgcaatggctgctccacgcctcgccctggtggtcgcgacgacggtggcggtcctggcggcgctgctgctggcgtcctcggagccggcatcggcggcggtgagctgcagcgacgtgacatcctcggtggcgccgtgcctcgggtacgcgatgggcaccacggcgtccccctccccggcgtgctgcaccggggtgcgctcgctcaacagccgcgcgtcgtcgacggccgaccgccaggccacctgcgcctgcctcaagagcatgacgagcaggctcggcggcggcggcggcgtcagcatgggtaacgccgccagcatcccctccaagtgcggcgtctccgtcggcgtgcccattagtcccaacgtcgactgctccaagtacgacgcctcctaggctgagtttttcaccctgtccaattgattanatatgtcgtccatgcatgcatgaatgcacagtgattatgagtgattttctgctaatgatcgagtgtgataaccatgatttgatatctttcatgttatgtacgtgcagggatcactgatgatcgatcataaggacatgcatgaggcatgctcgttggatggcgatcagcatgcagtcgtcgttgttttacagatgtcgtccatgactccctccatggat

SEQ ID NO: 15853 - DNA, 593 bp, Sorghum bicolor
  Clone ID: LIB5049-005-R1-XP1-H6
ccggccgggccgggctgcgatggggggacggagaaggctaggccagcttggcgttggttgtccaagtttaaggtggtaggctgaatccatcacagcttcacttaacaccactacaccatcaacagctcaccaccccccactgctcttctgtcctgcaatggctgctccacgcctcgccctggtggtcgcgacgacggtggcggtcctggcggcgctgctgctggcgtcctcggagccggcatcggcggcggtgagctgcagcgacgtgacatcctcggtggcgccgtgcctcgggtacgcgatgggcaccacggcgtccccctccccggcgtgctgcaccggggtgcgctcgctcaacagccgcgcgtcgtcgacggccgaccgccaggccacctgcgcctgcctcaagagcatgacgagcaggctcggcggcggcggcggcgtcagcatgggtaacgccgccagcatcccctccaagtgcggcgtctccgtcggcgtgcccattattcccaacgtcgactgctccaagatcaactgatgatcgatcataaggacatgcatgaggcatgctcgttggatggcgatcagcatgc

SEQ ID NO: 15854 - DNA, 2298 bp, Sorghum bicolor
  Clone ID: SORBI-28MAY03-CLUS1621_1
ggtccgacgaaaaatatacaaccctgaaggatgaattgttggcaacaaagaattttcctagcagccggggtaatagaagctccataacagagtggcctattaagaacttttaaaattgtaaaattaagactagggattggtttgggttgcccgatacccatcaaggagtatacaataataatggtttgcgggagacaaatccacggtttaataacgaaccatgttaacttaccataacaacaactcaattcctatcgaattccttcctatctaattccttcctatcgaattcctatagtaaaattcctataggatagaacgtacacagggtgtacacattatatatgaatgaaacatattcattaacttaagcatactcctttttttatttaatgagttgatattaattgaatatctttttttttagatttttgcaaaggtttcatttacgcctaatccatatcgaggcacgagggtcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttatgtaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaaggggcattacttgaatgcgactgcaggtacatgcgaagaaatgattaagagagctgtatttgcaaaggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttcagggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgtaaatggagtgctgaactagccgcagcttgtgaaatatggaaggagatcaaatttgatactttcaaagcgatggataccttatagatataagtagataaaactagatataaagaaggtctaaataaaataaaaaagaaaaaaaaaaaaaagagaaaaaataagttaagaaatgcagtaattcttctttattcttctaattgattgcaattaaattcggctcagtcttttttttagaaaagattgagccgaatttaaatagatcttgatacgatcatgagacttgacaaatcgagattcttctattctatatatctagaatatagaaaggtataatacaataaacaaatataaataaaaatatagtattatcgtacgataatggaatcaaatacgcagtatttacagaaaagagtcttcgtttattcctcgtgc

SEQ ID NO: 15855 - DNA, 2287 bp, Sorghum bicolor
  Clone ID: 1255713
caagaaataaaccactgccagccagtgacacggatcggagtccgacggacggacgcgcgcaccacgccggccggccgctcgatcgcatcgccgggatcgatactgctttgaacgggcgcctcacagtgctgctagctcctccatcgatcagctactgcacggccgcgccccgccggctgctctcatctcatccatcaggcatcagcatgtcgactctagccacgtcgcagctcgtcgccacgcacgccggcctaggcgtcccggacgcgtccatgttccgccgcggcggcgtgcagggcctgagggcggcggcccgggcatcggcggcagcaggggacgcgctcagcatgcggaccagcgcgtgtccggctccgaggcagcagccggcggcgcgccgcgggggccgcggaggaaggttcccgtcgctcgtcgtgtgcgccaccgccggcatgaacgtcgtcttcgttggcgccgagatggcgccctggagcaagaccggcggcctcggcgacgtcctcggcggcctgccgccggccatggccgcgaatgggcaccgtgtcatggtcgtctctccccgctacgaccagtacaaggacgcctgggacaccagcgtcgtgtccgagatcaagatgggagacgggtacgagacggtgaggtttttccactgctacaagcgcggagtcgaccgtgtgttcattgaccacccgctgttccttgagagggtttggggaaagacggaggagaagatctacgggcctgacgctggaacggactacaaggacaaccagctgcgtttcagcctgctatgccaggcggcacttgaagctcctaggatcctaagcctcaacaacaacccatacttctctggaccatatggggaggatgtcgtgttcgtctgcaatgactggcataccggccctctgtcatgctacctcaagagcaactaccagtccaatggcatctacaaggacgcaaagacggctttctgcatccacaacatctcctaccagggcaggttcgccttctcggacttcccagagttgaacctccctgagagattcaagtcatccttcgatttcatcgacggctacgagaagcccgtggaaggccggaagatcaactggatgaaggccgggatccttgaagccgacagggtcctcaccgtgagcccctactacgcggaggagctcatctccggcatcgccaggggctgcgagctcgacaacatcatgcgcctcaccggcatcaccgggatcgtcaacggcatggacgtcagcgagtgggatcccagcaaggacaagtacatcgccgtcaaatacgacgtgtcaacggctgtcgaggcaaaggcactgaacaaggaggcgctgcaggccgaggtcgggctcccggtggaccggaagatcccgctggtggcgttcatcggcaggctggaggagcagaagggccccgacgtcatggcggccgccatcccgctgctcatggaggaggacatacagatcgttctgctgggcactggcaagaagaagttcgagcgcatgctgatgagcgccgaggagaagtaccccgacaaggtgcgcgccgtggtcaagttcaacgcggcgctggcacaccacatcatggccggcgccgacctgctggccgtcaccagccgcttcgagccctgcggcctcatccagctccaggggatgcgatacggaacgccctgcgcctgcgcgtccaccggcggactcgtcgacaccatcatcgaaggcaagacaggattccacatgggccgcctcagcgtcgactgcaacgtcgtggagccggccgatgtgaagaaggtggcgaccaccttgaagcgtgccatcaaggtggtcggcacgccggcgtacgaggagatggtcaagaactgcatgatccaggatctgtcctggaagggccctgccaagaactgggagaacgtgctgctcagcctgggtgtcgccggcggcgagccggggatcgaaggcgaggagatcgcgccgctcgccaaggagaacgtggccgcaccctgaaggaggcgaggacccctgatatcgcgtgtagaacaaagatgatgaatcaagtgaacatgcatcttcgtatatatatgtgtcgtctatgagtatatatgaagaactatatagctgcttgtggtagtgtaatgtagtggtggccagtggcacaacctaataataagtacatgaactagttgcttgtgtgtgtaattaagtaccgatcggcaataatatattgctagtgaataaatggacttatatttgcgaagtca

SEQ ID NO: 15856 - DNA, 558 bp, Sorghum bicolor
  Clone ID: 2909875
gcagagctcgtgccctctagctgactcacgccccagtgtccacgtacaaagccaaagatatcatctactccagtgttaaccgacactatacccgcactaaccgtataatgttcggttagttggaagcagggaccgaatttatgaccgcaaagttcggtctcggtcttggtcagtttggttcggtctctcggtcttcgggtaattatgcccagagtgactcctacatgacctcctcaaccagtccccttagtacaggtttgggatacaacaaatatctgatggagcagtatgcagatggactgttattctatcgactcatgcttgttgcaagctttgctcaaactctgggtgtaacttgtgatttgtttgtgtttcatgatctgtaacaattaaaactgttagtttcggctgatcctgatattcagtaccatggatcttcgcctcagtagataggagtaacatcttttttctcgtatcagatgtacagtgacgagttggtatgggaaaagttcatttgtgttcagtttggagtaaaagttaaaaaaaaaaaaaaaaaaa

SEQ ID NO: 15857 - DNA, 630 bp, Sorghum bicolor
  Clone ID: 871529
cgtgctccgcctttcattggtttcgccagtcattgtagtagcttgtgcccccatggttgtggattaggtttccaagttgcctgtgattgtgtacccattgagtcttaggttgccttgccatggtgctatgataatctatctatctatcgatcctattgaaccccggcttcgtcccacccgggtgtgttagtcaaggaggtcaacggcggcctcagtggcgccaccggtggcatcggcggcggcggcggtatcggcgccggcgggagtgcctggcctccggcggcggcggcggtggactcggtggcggaggcatcggcggcggcggaggaggcatggcggtgggagtcgcggcggcatcggcggggtggcggaggcatcggtggcggccggggaggcggcgccctgacccggaccaactgccactacacagccggcagctcgaggacaggcaagtacaagagctaccgcagctcgtacctgaccactctcctcttccactgcttcggcttgggcgccctggagggcacagagggccagccactactggcacctccctctataccgcgccgcctgcacctcctgccaacgaagcagccacccgagccgcaccggtggttgtttatgctctgg

SEQ ID NO: 15858 - DNA, 425 bp, Sorghum bicolor
  Clone ID: LIB3481-049-Q6-K1-B2
ccccgggcgtgctccccgtcgagctcctcgcggcgcgtgcgcgcgcattcgccaccacgctccccggggtgccgctgctccggaggctcgccgacctgcacgcggcgccggcgtccggggagatcctcttctgcactgactggtgcatccaccacttctacggcgcgcatgctgtgatgcgtcggctactccgactccggcaaggacgcccgccgcctgtcctgggcgtggctgctgctcgtggcgcgcgtggagatggccatggtggccccgaagtacggcgtgaagctcgccttgttccacggccgcggtggccccgtcggccggggcggtggcccgtcgcacctcgccttcctgtcccagccgccggcctccgtctgcgggttctttcgtgtgtcggtgctgggcgtggtcctcctgttcct

SEQ ID NO: 15859 - DNA, 187 bp, Sorghum bicolor
  unsure (1)..(187): unsure at all n locations
  Clone ID: LIB3481-049-Q6-K1-B7
ggggtgcgtcgcggcaatgagcgctcgcctccactcgaanatcctgggcaccccagctcaactgtcgccggcgtgctcccgctgcgccaccgcagcgcccaccgcgggggctcaggagattgtctccctcttcagcagtagcctgcccggaagccaaagcctggtcgtgtgtcctcctcttctgcag

SEQ ID NO: 15860 - DNA, 556 bp, Sorghum bicolor
  Clone ID: LIB3481-049-Q6-K1-C10
gcgtccgttcagtgctggcaatgatgcagcaatttggtattgtgtaattgtcgctggtcgtccgggtgcagaattaagtaagaagagacaaattttgcgtaaggcccaagacaaactgttaggtgatgttgacggaagtgctggggaagtcgataattcagtagagacatcaagtgctgcaactgccttcaaagatgataggttgacctttgtttggttagatggagaagtacaaaagcaaatttgtgccttctatcttgccactgattatactggagcctgtggtcctagagactttggagatgacaatgataaacctgaaattttcattgttcgattccaaagaaatgcaacatatgaggcactgaaagctgaaaaaaagaacaatcttgtggacgttctccagggacagcatactgatgcgtcccagctagtggcaaggtacaagggtctagatgaaattgaagagataaataggtggatctctcagattatcaaagatggagatactagagaaattccttactttacttcaaaggtgccagaccttgttcca

SEQ ID NO: 15861 - DNA, 502 bp, Sorghum bicolor
  Clone ID: LIB3481-049-Q6-K1-C3
tctttcgttcctacctgtcctgataacacgggtactggccggtcattaccatcttaaagcacctaaacacggacccaaggtaacaagctggcccctatcttgaggcctccggccgctggtgccagcacgaggaacaggcacggcgactgcttctctgccctgctcactgctcagcccaagttcctcagtgcccggaaggccaagctctggtcacggcccttctggctatcggtgtctgtaactcctgttcctgattgactgcccacgcactgcgttctgtgacggaattggtttcggcactaaacaatttgacatgcttgtgatcattgtgaccatccgcacaacagcgctgatcttcctctgctgttctgggtgttgataaccctcatttcacgaccgtgcttggcgggatgtgttggatccaaccagctgatcattgtcttcgtctgaatgtggctacattcccttagtgaagacctcgaagaggattcctcttattgcc

SEQ ID NO: 15862 - DNA, 405 bp, Sorghum bicolor
  Clone ID: LIB3481-049-Q6-K1-C5
ctcctgccttcctcactgcctcgctccggtccgccagccgcgaatgccagcccccgcggctgactcccggcgctctgctagtcgccaccgcacctaccactcggcgccgtcggcaccggctatagcccgctcgccggcgccgttgacatggaacgtggttgctcgggctgatgggctgccggatccagcgcggagtccgtcgggttcgaggaggcggtggcgctgttcgaggaggaagaggcgacggcggaggaggcccgcgaggcgttcgcggtcttcgaccgcaacggggacgggttcatcgacgccgtggagctccttagcgcgctcacgtcgctcgggcttcaggccggcgtgccggacgcggattgccagtgcatgctcgacgccgtggaccgcgactgg

SEQ ID NO: 15863 - DNA, 647 bp, Sorghum bicolor
  Clone ID: LIB3481-049-Q6-K1-D8
gcgtccgctggatccgccactccatcgtgcgcgccatgacgctgtcaagcttcacccgcttcccgttcgccatggagtcggagcggcaggagatcggcaaggcgagggaggagctggcgttcgagctcggccggccggccacggacgaggaggtgaggcggaaggtgggcatctccccgcagcggtaccgcgacgtgctgcggatgaccaggcccacctactcgctgcacgccaggaaccgggtcacgcaggaggagctcatcaacgaggtcaccgacgacgatgccatcggcgtcgacgccggcggcaggcacaacacgctgctccgcctcgccatcgacgacctcctggactctctgaaacccaaggagagcctggtgatcaggcagcgattcgggctggacggcaggggaaagcgcacgctcagcgagatcgccggcaacctcagcatctcgcgggagatggtgcgcaagtacgagctcaaggcgctcatgaagctcaagcacccaacaagggtggaatacctgcgcaggtacatgtgatgtgagcccactgatggagcttcttctgctgccgacctgtcgcaccatagcatggattcgatgatgtatagtatagtatgcattggctacatatggagtaactag

SEQ ID NO: 15864 - DNA, 117 bp, Sorghum bicolor
  unsure (1)..(117): unsure at all n locations
  Clone ID: LIB3481-049-Q6-K1-E7
cccgggncgacccacgccctccggtcgcngtttttgaaaacacaacgggcgcacacaaacnggaaaacgacacgaccacagccaaagcgggggcagctcggcacgcccacacaaagg

SEQ ID NO: 15865 - DNA, 609 bp, Sorghum bicolor
  unsure (1)..(609): unsure at all n locations
  Clone ID: LIB3481-049-Q6-K1-F6
cgtccgcggccgcgtgggcagntatcaaacttagtcgttgacggtcatgatgatcgatcaacaaggaactcacgagtcacctaaagagctcagttctgttgtcaacaaaatggagataagtaaaggatataacataagcaacaaggatgcacagctatcgtgcagacagaagacaaaaaaacgcacgaaagtaacatcctcggccacctttggactcttctccaaaaagggaaaaaactgaagaacccaaatcacatactgaaagcactggacatgggggctctgagtcaacaaaagaagggacaaaggttgatatagatagattctttgtttttatgcagattaattctgcttaacatagctgtgtttagggtcatattattttctctgccaacatcgatttatatggcattgaacttgaactatctttattattccaagcatattgtaaggcttagctttaggacatacttctctgcccaacacttaatgcttttgtatagatactacaagctccatggatcgttcctgcatctatgcccaagaccgtcaaaggctgcaatgcacttactattgaccctgtaaaaaaaaaaaaaaaaagcggccgct

SEQ ID NO: 15866 - DNA, 607 bp, Sorghum bicolor
  Clone ID: LIB3481-049-Q6-K1-F9
gcgtctcgactaaattaagtgcatgctacaatctggctcaattccccattttccttcacctgcagcctctctatatgtccacattctctctcaacatgccaatatgtgtatcgatacaaatatctgcattgcatggagtcatcctgggaaatttcttagatccacgtggatatgaaagaagttgactccataagacataattagaatctactactttctcttatacatatctaggcaaatttctcttttgcttccatcagaactgccaaaggagatctttagaacaattcctatatttgttccttcttactatgaacctatgttgtgtttctttggttcttttgcatgaaagatttgaccatcatagattttattttgtacctggctaggccaaagtaataagctagaattctgcaaaacactaaattttctcttttggtaaacgctttttaggaaaattatggttacaactgcatcgtgattaacaaatattgaaatatgtcttacggtacctgacactatagccttcctactcagcgttgcaagtattgaagtatatatcactggactctacaaagaaacccaacacattagcccaaacgtcctc

SEQ ID NO: 15867 - DNA, 231 bp, Sorghum bicolor
  Clone ID: LIB3481-049-Q6-K1-G3
acgggggcggcacacccacagcgacacaggaggccagccagggggggaggacgcaacacccaccaaaaagaccagggcgcagacagaccaccccaacgagacagcagaggcacgacgcgcagacggcgccgcgccacggcaaacccacccccgcaacgaagcgggggcaccggcacccgaaacggccgcgcagccacccgggccacgggagccaggaacaccccaacaaaa

SEQ ID NO: 15868 - DNA, 238 bp, Sorghum bicolor
  unsure (1)..(238): unsure at all n locations
  Clone ID: LIB3481-049-Q6-K1-G4
ggggggagatatgcatccatcacttggactagnacgcatgcaacatgcattgcatgcacctactcgtccgtttcagagtcgccgttcaattcattcctgcggctngctgatgtatttacttaatattaggagacctccaattttttttttggcgcgctcgntcggcttccgacccggtgcgtgtgccatgggttgtttggtcggtgcggcggcggggtgtgtgggtggcggggcttgg

SEQ ID NO: 15869 - DNA, 235 bp, Sorghum bicolor
  Clone ID: LIB3481-049-Q6-K1-H11
actctaaaggatccaggcttacctgctgtgtgcgtgccaagttttcgttctcgtgtagggtaacctaaatttattttattgggcgacctaattcaacttcacggctgggaaaaccactagcgtggggggggggaaaacccttgcatcacatacctttttcgcctggtggcgtattacccaataggcccgtgccgttctcccttacaaacccttgcccatcctcattggcaaatgg

SEQ ID NO: 15870 - DNA, 238 bp, Sorghum bicolor
  unsure (1)..(238): unsure at all n locations
  Clone ID: LIB3481-050-Q6-K1-A4
gcggtcggccaaggcatattaataanaagaggggcaggagatcgagtaggcggcggcagcagcagcagcagcagagaagccatgtcggcgaactgcgtggacatcctgatcgccatcatcctgccaccgctgggtgtgctccctcaggtctgctgcgtcgcccggttgtgcctctgcctcctgttgggggtgcgcggctccctctcgcccctcgtcttcctcccgtctgtcctctggc

SEQ ID NO: 15871 - DNA, 233 bp, Sorghum bicolor
  Clone ID: LIB3481-050-Q6-K1-B4
acctgggacttacgcagtctgtggcagcgcgttcacggcccgccacgtctggtagcacggccatgcacaccggcgggtgttctcgccaaggcccggagtgcgcgctaggctccatgtgaggcagatggctcgctcgtggccacggaaggcactacctgctccgtcgcttgtccatgcagccgctgattctgtggagttgcttcatcatctggctccgcccgtgagtactcgtg

SEQ ID NO: 15872 - DNA, 535 bp, Sorghum bicolor
  Clone ID: LIB3481-050-Q6-K1-C1
cctcgctggagccttttctacggcaccagtgcctcacgatcggcaggggccagcactgctcgccaccgccgtgacagaccgccgcagtatgtgagggggaaggcggcggcgcgggcacagtaacattacacaggtgatgcacggtggtcgtcagcttacaaggggcaacgccatactctgtgagggcacggtgctgggccgatgctggagatagagccggacctgcgaggaggacgccatcgacgagtcttgcactaacgtcatccgcccggaggactcggctttcggaaagcacgatcgacatcacacctatttcgaaacccggtacaggacgggcttatgggaggatgcgtctcgaccgtccctgcaagctgatccttctgcgggctgacgcgtcctcatgtcctgctgattccctcctgggtgatcttgggcgtggctttcactgcgccgggcgggtccctgtccctctgtgctgctggcttcttcgggggggtttgcgtcttcgtgatgcgtctgcctttcgagccgcaca

SEQ ID NO: 15873 - DNA, 449 bp, Sorghum bicolor
  unsure (1)..(449): unsure at all n locations
  Clone ID: LIB3481-050-Q6-K1-C2
cccgggtgcgacccacgcttctcttcgtgcttgcgcccttatcctcacctgcgtggtgcagccatgtgcgaccaccgcggcgcntctccaccgcgcgtccaaccccacccaccagcgtctgccggtacccgcgcctactgctgggcatagccagtgcaaggggcgttggccctgggagatgggtccgggcagcgctgcccagtagcatcatcgtagccaggtcgtgcgagtcagtcatctcccgcgcgacgcgcgtcgcccgcctatggnagtaagcgagaagactgatggaactctcctacctcctgcggcgtccatcctcgctgcgcctaccgtcggtcatgggacgctccccctacaggcgcctctctttcgttcctccgccggtctccggcgtgcgcgcggcgtgcggagacctactgccaagtgacaacgctgggtcaactgac

SEQ ID NO: 15874 - DNA, 638 bp, Sorghum bicolor
  unsure (1)..(638): unsure at all n locations
  Clone ID: LIB3481-050-Q6-K1-E1
cgcgtccggccaacaaatgatgcattaagccaagagttctgaatttgaggtctcaggtggagagtcttaccaggtaagtctcaactccctagnaacgtggagctgggaaagaactaccaaacaattgaaggaagctatttccattgccggtgaggaaactgcaaagtgcaaggcggcaaaggaagtaatcaagtcactcactgcacagttgaaggggatggcagagagattacctggaggagcagccaacaacactaagttgccacctcttcctggaatttccattccaagtgacatttcgtctatggctacagagagtgcgctcagcccaagcagctctggagaacaaatcataaatggccatactggattgcttgcttctaatggaccaagttctgttaggaataagacgagccatccagaagtaggcaagaatggaagtaggccgcctgatgctgaatcttgccatgatgctgagtgggtagagcaagatgaaccaggtgtttacattactctcaccgcgctgcctggaggcgccagagatctcaagcgggttcggttcaggcgggagagattcagtgagacacaagcagaacaggggtggcaggagaaccgagcgagggtataccagcagtaca

SEQ ID NO: 15875 - DNA, 631 bp, Sorghum bicolor
  unsure (1)..(631): unsure at all n locations
  Clone ID: LIB3481-050-Q6-K1-E9
gcgtccngagacggcgtgcgcggggcggatgccgacgcccgcgggcgcgtacggcggccccggcgggttcgcgccgattaccatggaggccgcgacgttcagctcccgctccccgcgccgcggcggggacgaggaggaggacctcaacgagctcttccgcgccctgtccctacgccaagccgcagcttcggtggcggcgacgacgacggtcccggtccgcagccggagcgtggcggtggggcggatcgacgaggacgcgccgtgcgagttcttcggcgccgacgacgacgtcgtcgtgcgcgtcggcggcggccccgccgtgcgcagggcccgcagcatcgccgtcggcagcgctcgcctcaccgcccgcgccgggtactacggcgccgtctacaagcccggagcgggcgtcgtgcgcggttgatccggcgtccgcggtcgatccgttcgtcgtcggcatcgtcggcgcatgcaggcatgcaacggcggcgccgggcgccggctaggcggcaacgtcctatgtttcttacgtgtgcataactagcttgacttcgtcagcgttcgtagctcttagtactgtaccatcatcttagttgttctttccagtttccttcgtgatgtttgtttagtg

SEQ ID NO: 15876 - DNA, 623 bp, Sorghum bicolor
  Clone ID: LIB3481-050-Q6-K1-F1
gcgtccgcaggatttgtttctgttagtgggattgagcgaagtgcttgcaataagatgcttcggtttacaatatggactgtgttctttgccaatgttctcactggtacagtcggttcagtcttaagtcaactcgagattttccttaatccaaaggaattaccttcaaaacttgcagttgttgtaccagcacaggcgtctttctttattgcatatgtggtgacatcgtggacaagcataacatctgaactcactcaaattgctgctcttttccgtcacctgtggggaaagtgtgcaaagtgttgcaagcgggatgactccaaagctccatcaatgccttattatagtgaaattccacgaattctcttgtttgggcttcttggacttgcatattttattgtagcaccccttatcctcccatttgtattggtctacttctgccttggctacttcatattccgtaatcagcttatcaatgtgtatgtgccgaagtatgatactggaggaaaattttggcctgttgtgcacaacacaacaatattttccctggtggttctgcatataattgctattggagtatttgggttaaagaaacttccccttgcatcaagtttgctgcttcctct

SEQ ID NO: 15877 - DNA, 368 bp, Sorghum bicolor
  Clone ID: LIB3481-050-Q6-K1-F4
ctttcgagccggcgtccttcctggtgtgtcttggtgttcgggttgttcgttagccattacacccattaacacactctgtacatgcagggactttctggggatgcatgctggtggcccctcgaagctgagcctgctgccggccttgaagtctctcccgttctgccccttccctcctgccctcttgttgggtatggttcgcaatgggccccgcgagtacccggaacctgggtgcggttgccagcatcctggcgttctgcttcttactgtaccgcgggcccaacacgccgcacatctttccgcctaggatcttcatcatggataggacggtccgcgacaagctcatcgccggcttctgctcctgcccctct

SEQ ID NO: 15878 - DNA, 290 bp, Sorghum bicolor
  Clone ID: LIB3481-050-Q6-K1-F5
gcgtccggcgagggcaggtgaacgacggcgaccgggccgccgggtggtatataacagctgctctgccatcagccaactgctcatcaatgggggcttaattcgagcagctgattgtctccatccggcgcctgacagttgatatttttgtaaagatactagctaatacggatgttaaaggagtatacggcagctaattgcttgatagtgctgctaacagctagccatattcattgtacataaagttctctctcttttcgatcatataaaaagtcaaattagttcatcaaaaa

SEQ ID NO: 15879 - DNA, 554 bp, Sorghum bicolor
  unsure (1)..(554): unsure at all n locations
  Clone ID: LIB3481-050-Q6-K1-F7
tcctgcgctttgcgttcgttgagtttgctgatgatgctggtgcgtgagcagcnctaacacttggagggaccatgcttggctnttctcctgttcgagttttgccttctttttctgcntttctacctgttaatccggggttgtgggggggnctgaanacgngaaagacntggtctcgaggactgtctgttgtnctcacatngncaagaaggttactgaggatgatgtnaagggtttcttccagcantcatgcggcaaggtttctcggctgtggctccttggtgactatgttcactccacatgcnttgcttttgttgcgtttgctgaagctgtttgtgcctttctggccttgaacttctgtggtgtggtccttggtttactccctctcagggtgagcccttccgagactcctgttcgtccgcggtctcctcgtgtgttgtccttctgtgcccgtttcgtgccgtcgtcgcccttgcggctgcccccaatggcgtatcttccccggctgcgctttctttctatctgtgagcggccctacaacccttgcttcgtggttt

SEQ ID NO: 15880 - DNA, 454 bp, Sorghum bicolor
  unsure (1)..(454): unsure at all n locations
  Clone ID: LIB3481-051-Q6-K1-A12
tcggtctttgtaatatgcttggcaggcgaatttgtttaggctttntaatatgtctggactgaaatagttgaatatatgaatgtattgaaatctagtttggattgactattgcaaaaaaaaaaaaaaaaaaaaaaaaaaaaaaaaaaaaagactaccgttctaaaaaaaacaaaaaaaaacgagggggggggggggggggtctttatctcttctatactctaacctcaatttcaatggcacggggactcacatctacaacgactgggactagccaaaacccttgccgttacccaacttctttcgccttgcatgcaccatcctccctcttctgcgcgctggtcgcgatagacgaacagacccgcaccccctcgccctctcctaacagcatgctcaaccttgaatgtgggaatgggcacccgcccctgttgcattcgcacttaagcgcgtgctggtg

SEQ ID NO: 15881 - DNA, 516 bp, Sorghum bicolor
  Clone ID: LIB3481-051-Q6-K1-E1
aggcggctggcgcagggcactagtaaaattacacaggtgatgaacggtgatcgtcagcttacaaggtgcaactcgtagtgtggagggccggtgctgggctcatgtttgagatatatccttactctcgagaggactccatgcacgagcatttcactaatatcatgcgccatgtaggacttggctttccgaaagtacaaacgacatcacacctatttcgaaacccaactaaaaaactgcttatgggaggatgtctctgagcgatacctagaagctgatacttctgagggctttaaagcactcatgtcctgctcatttcctccttgaatgatttttgggatggctttgaatgtgcctgtgtagtacctgaacatctgtgcagatggatttataggagggatctgcatcttcaagatgcgcaagctatacaagccgcacaacttagatccgaagatctacatgattgcacaggacggctcgcgacaagatgatcattctactacaactccatggacatat

SEQ ID NO: 15882 - DNA, 394 bp, Sorghum bicolor
  unsure (1)..(394): unsure at all n locations
  Clone ID: LIB3481-051-Q6-K1-G6
gcccacgcgttccgcggnacgcgtgggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggttttgccgttttcaaaggtccaagcttatttcctggggggtgcaactttttatatttttttatcgtgaaacctaaattaaatccattggccgacatttttaaaacttgggaattggaaaaactttgccttttccaaatttattcgctttgtaccattttccctttttgccatttggcttaataggcaaaaggccctcccctttccccttttcaaacatttttgaatcttaattgggaattggcatgccccttttatttaccct

SEQ ID NO: 15883 - DNA, 460 bp, Sorghum bicolor
  unsure (1)..(460): unsure at all n locations
  Clone ID: LIB3481-051-Q6-K1-G7
taggcacattcaatcagttagcaagtcaaaggtgaaaaagagtggacaggattagttctattgactgaactaattagacacaaccccctcctaattagatggcttcaaactaaaacattatccggaaagaagctcctacaaggaagatctccagagcgtgggccacttatttttcaaagagcagagccatggggacgggttctcaatttgagcacagagctttccccccctgccagttagaagaaggccccatgaaaatgaagttctgatggtcagttttgaccaaccacagaatgcatggattcggnctgntccaacaacatcgccgttttttccacggacaaagctttttgcggccgaggtttttttggcgatcactactaaccttgaaacgaacttgtttatttacttttcgttttctctttgtccgtaaaccaagaccttggtcccccactttttg

SEQ ID NO: 15884 - DNA, 562 bp, Sorghum bicolor
  unsure (1)..(562): unsure at all n locations
  Clone ID: LIB3481-051-Q6-K1-H1
cgtccgccccgcgtccgtaaaaaaaaaaaaaagaaggaaaaaagaaaaaaaaaaaaaaaaaaaaaaaaaaaaaaaaaaaaaaaaaaaaaggaaggacgaatatagggggtccaagttttacgtacccatgcttgcaaacggcataaactcttctatagtgactctttaatggggtcccctgtccgcagttcctcggcggggggactgggccaacccctggtgttacccttctttggggcctcgcattaattccccggtgccccagttggcctactgccgaggggggccaccccggtgggccttcccaaatgttcctttgcctgaatggcccttggggcccggcgttgggaagccccttaggcccggcgcgtttgtcgctttccaccctgtgggcccgcttcatttgccagggccctgctgccggtcctttcttttgcttcctttggctttgttgccccccccgccgggtctccctgtcctgctcttcccctggggctcctnttcgggggccgttttagggctttccggccccgggtcccgggtttttcccttggggtgtttt

SEQ ID NO: 15885 - DNA, 606 bp, Sorghum bicolor
  Clone ID: LIB3481-051-Q6-K1-H5
gcgttcgctcaaactgtgtacataccctctgggattgattaaggaacggttaactatacagagaggtgtgtatgacaacttccttgacgcatttgtcaaaatcgtccgtgatgaagggcctactgaactctaccgaggcttaaccccaagtctgattggagtggtgccatatgctgcaaccaactacttggcttatgacaccctgaagaaggtgtacaagaaggtgttcaagacaaatgagattggcaacattccaacactgctcatcgggtctactgcaggagctatctcaagcacagcgacattccctcttgaggtcgcacggaagcacatgcaagttggagctgtcggtggcaagaaggtttacaagaacatgcttcatgccctcctgagcattcttgaggatgaaggggttgggggcctgtatagagggttggggccaagctgcatgaagttgatgcctgctgctgggatttcgtttatgtgctatgaggcttgcaagaagattctgatcgaagaagaagagaatgagtgaattgtgtgcggcggatgcattacctcattagagctcagttttgcgacatcctgacagcaggcagctttcat

SEQ ID NO: 15886 - DNA, 154 bp, Sorghum bicolor
  unsure (1)..(154): unsure at all n locations
  Clone ID: LIB3481-052-Q6-K1-A1
ttgagcctaagtggtacantgcgataactgagctcccagaacagatcggagcgctacagtatttggnaaacacttaaggccttgtttggatgtanncggattcacattaatncacatgtgttgaggtggattggagtggaanttgaattaaatt

SEQ ID NO: 15887 - DNA, 234 bp, Sorghum bicolor
  unsure (1)..(234): unsure at all n locations
  Clone ID: LIB3481-052-Q6-K1-A10
gcgtccgcacttttgaaaataaagagcttcgtggaagatggagcttcagtagctgaagcaaggcctgtggctgtcactgacctctcaggagtcggcctttccgatcttcaagaagggttgttatcctcagaaagcaaagcttcaagcgttaaggaactaagagaggatgnnttgagagggtgggggggggggggtcattctctgctnctctatnattcatctatagcgatcact

SEQ ID NO: 15888 - DNA, 187 bp, Sorghum bicolor
  unsure (1)..(187): unsure at all n locations
  Clone ID: LIB3481-052-Q6-K1-A5
gcgttcgggccattgattgtgtggtggcaggaagtgattttgtgnaagccgtagccttttgtttatctactnnatgctgtnnnggcaacaaccagcaagtttgnaaggccatgcatgtgntcatgctgggtattttgtngcaagtggaggtattttgggttggtgcatggacccgnttgcatatata

SEQ ID NO: 15889 - DNA, 393 bp, Sorghum bicolor
  unsure (1)..(393): unsure at all n locations
  Clone ID: LIB3481-052-Q6-K1-B12
ttggcaatgatccaaggnaaggggtatgttangggtcccnnaacaagcaaagtcatatgaatcctgaagtgaatacgttgcatactggttaccagaacttcggtcacttgcaaaggaaaggagaaatttcccaggggcctcatacatcaggcagatagtacaactgaagtttggggggggggggggagaagaggatcagcaattcaaccggcagagaagaccaaacaatatgtacagaagacaagtaaaatagaaggctcttgattcactcgaaatagaaccatcttatcagtagtagatggaagtaacttttttacataactgattgtagtgtcaacatgcacgaatttctctatggtcttatgcaatgttcattgatgcattcagctaccc

SEQ ID NO: 15890 - DNA, 572 bp, Sorghum bicolor
  unsure (1)..(572): unsure at all n locations
  Clone ID: LIB3481-052-Q6-K1-B3
cgtccggctagngtgtgtaacggnaaaggttacgggtgggaaaaaaaaaaaaaaaaaaaaaaaaaaaaaaaaaaaaaaaaaaaaaaaaaaaaaaaaaaaaaaaaaaaaaaaaaaaaaaaagggcaaataatttaagggttaccttttttgcggtcccttgcttgcgtatgtcgtgctgttttttttcgtgtttctttgtttcatttccctggctgtcttttttccaacgtcttgtttgtggaatgccgtttcgttccctactttacttgccttgcgtgccttccctttttccctggcttgctttttggcggtctggtcctctcggggtggccttcctcttttttgccctccttggttgtgggttgggccgttgccttgtggggttgccttttggccggcgggtggggtggttcggcgcgtcggcccgcttacttggccctttcttcccgcccggttcttttgcttcccttcctttctttttttgccctttttttttggctttccctgtcttgctttacggggggtgtttcttttttgggtttcctttttgtgtttttctttttttgtttccg

SEQ ID NO: 15891 - DNA, 446 bp, Sorghum bicolor
  Clone ID: LIB3481-052-Q6-K1-E6
cttttaataatcgcccccctgttcaaacaatttccaggggggggggaaacacatagatcttttacatttaaagcggctgccgaggagcaagcaaaaatggggcaagaaaacaagggccccgaaaaagggggaggaaacaaaatgaaagcttgctttatacaaccaaagggaggggttcttccaatgcaacaaccccggaaaggttctttccttccaacaattccaaggggggcccccccccccggaaaatggggctcaaaacccccgccccccccacctttttaacaggggcaacagagtctccacctccaatgataggggggacacccctggcccttagttcggccaacttttttgccccccccccagttcctacagcaaacttgtcaaattcgaaaacacccaagggccctttccaaaaaaccggctggcctggttccagggct

SEQ ID NO: 15892 - DNA, 645 bp, Sorghum bicolor
  unsure (1)..(645): unsure at all n locations
  Clone ID: LIB3481-052-Q6-K1-F8
gcgtccgccccgcgtccggctgctgccgctctcccgtccgcgcgcccacgcaggcctcctcacctgcagctccactcccgtcgtcctcggcctccactcccactccgccgctgctccgagccggcgcgcgtggccgctcctcgcccgcaggaaccggaacggccggaccgacgaggagaccgcggcggagcccaagatcatcacggtcgggcgggcggggaagagccggcggcgccgcaacaggaagcagcagacgccgccgaaggaagaaggagacgacgaggaggacgacgacgagcgcgacgcgacgatcccggaggtggtgacgaaccggatgatgcggcgtgtgggggcgtcggtgggcctgccgctggcgctgggcgtggggttcttcccggtgttctactacctgaaggcggtggcgaaggtggacgtgccgacgtggatccccttcggcgtgtcgttcgtcttcttcggcgcggcgctggccggggtgagctacggcatcgtctccgcgagctgggaccccgcccgggagggatccctgctgggatggaacgaggcgcgccgcaactggcccgtcttctgggactcgctccggngacgctctccgtccccgcctcgccggggctaggactaggaata

SEQ ID NO: 15893 - DNA, 500 bp, Sorghum bicolor
  unsure (1)..(500): unsure at all n locations
  Clone ID: LIB3481-052-Q6-K1-F9
ccggaccggccttcccggtcgacccagcgttcgccgncttacctccgctcctacggtgtgaccacatgttcaggattcctgttcttgtgctccttcatcatcacctacaacttccgtggcatgcaagatgccatgactaagcagggtctgagcatgggcttcttcggcggcattgcacttctcggctggttctaccagctgctgttcatgcctgagaccaagggcaagactcttgaggagattgatctcattttcgagaggcctaccaggtccatcgttgcagagaacctcaagaacatcaaggagaccacctctgacctgtgccacttcaggttcaaaaaggtcttcgttgacgacaacaaggcgaaggcggctgtggcgctcactgaggagcgattcggacactagataccctttttacgatacacatagacatagactgttatgagacatactttgctctcagacccggtatttccggtcattcgtnnnnnnaaaaa

SEQ ID NO: 15894 - DNA, 412 bp, Sorghum bicolor
  Clone ID: LIB3478-058-Q6-K1-B11
ttgctgcaccggcatcgataaggacagggttctccagttcgccggtgctgtccggagctgggaacctccagaggtgtgcaaggggaaggggatcctgtacattgacgaggttatcaagactaagcccggaaagaagcaaaagaagtgacgacttgaaaacgttacaactttgtctttggcttttaaccccttgagacccatccttcttcaaatttgtagtgatccggatctggtctggttgttttgagctaggcagatcaccattgtctcttatccttacctcagttgcaggcaacaagatgtatgtgggacatgttatgaagttgtaggtccatgagttggaaaagtaccaatttctttttgttgatgtcagctggaacatcggattgaatttccgaatggaatggtttct

SEQ ID NO: 15895 - DNA, 341 bp, Sorghum bicolor
  Clone ID: LIB3478-058-Q6-K1-B8
ctctcacatactggctaggaccagcagactataggcatcagcctaggatctgctcaaactcaaccaagaggacctgcaggcagctatggggtcctgagcagggccagctaagcatttccagggcagcaatctataaccgcagctgcaagccaacctggatatgccagccaaccggctactagtgctgcagtaagctacctaactcaaaggacaccttcctatacatatggtgctccaccaccccatactggctatgacacccaaccggctgtatatggtcaggacacttatgggcagccttatccacagggacagaaacctactgcatttagaccttatgg

SEQ ID NO: 15896 - DNA, 221 bp, Sorghum bicolor
  Clone ID: LIB3478-058-Q6-K1-C3
gtggtgagtttcgccgacatgctcatagacttcgtgccaaccgtggagtggatctcgatggtggaggcgcccggctttctcaacgcgagctggggcacagtcagcaacgtcggcatgatcctctgcctcctcgggtgggcggcctacttcatcaagaagctcgagaaccactagttcctgcccatgctcaccgacaatctcctggacaaccacgtggacta

SEQ ID NO: 15897 - DNA, 254 bp, Sorghum bicolor
  Clone ID: LIB3478-058-Q6-K1-D9
gccagtaatcaaactcactcattttttcctttacctatccaagttgcttacacgggggcgccttcaacaacggctgctgcatacatagactacttgcccacagatgagttcttatcttcatctagatattcacatatatattcaaaaaagctacaccattggccttattgctattttttcaatcactacaaccatactattctaaactgtctcacttctcaatgttcacacataagatctgattatagattact

SEQ ID NO: 15898 - DNA, 515 bp, Sorghum bicolor
  unsure (1)..(515): unsure at all n locations
  Clone ID: LIB3478-058-Q6-K1-G9
cggggcgaccgacgcgnnnnnnaagacagagctggactcttttgtagattttgctcctcattacttcaggcacttgacagaaggatgggcttctagaagccctacttgcctggccaaaatagtggggctttatcaggttgattttctaccattgaaccctttgtccagttgcattatttttgatttgagctttaaccactttatactgcttgcttcatccaggttagtatcaagaattcaaaaggtgggcgtgaggtgaagatggatctgatggtgatggagaacatattcttccagagatcaatatctagggtgtatgatctgaagggttctgggcgttcacgctataattctgatgcttctggccacaataaagttcttctagattctaatctcatagaagcactacatacaaagcctatgtttttggggagtaaggcaaaacaaaaattggaaagagctgtctggaatgatacatcatttcttgccgttttggatgtcatggattacttcct

SEQ ID NO: 15899 - DNA, 213 bp, Sorghum bicolor
  unsure (1)..(213): unsure at all n locations
  Clone ID: LIB3478-058-Q6-K1-H4
gtgtagggtagctagcacattgtgtctatcagtgaacactggactgaagaggctgtgctataggtagtagcgtgctcnnnnaaaaagcatgtcgaaagatgacgtgactgctgttnnnnnagccgccgcgaatgcaccatactgagattcaccatcaannnnctctgctggacactagcgagctgaagaagtggtccctgtaccgcgcgctca

SEQ ID NO: 15900 - DNA, 184 bp, Sorghum bicolor
  unsure (1)..(184): unsure at all n locations
  Clone ID: LIB3478-058-Q6-K1-H9
acccacgcgtnncgtctactaatggccgactgcaccatgtcgatctttttcacttcgatcgccggcacccccatggaggcgggcttctattgtgagggccggatcaccaagcgcaagaccgaagacaaacacaaggtggctagagacggcagcccctgctacggacccgaccgaatcaagtacc

SEQ ID NO: 15901 - DNA, 361 bp, Sorghum bicolor
  unsure (1)..(361): unsure at all n locations
  Clone ID: LIB3478-059-Q6-K1-A6
gctcccccttnttttnnttttttttttacaccaacaaccaacgggctgtttttattaaaacaggagggttcccccctcctcgaatttatttattaaaaaaatgcaaccacttactaaaaagttcaaatcacaaaaaaaggtaaagaatgtacacaaatcatccaaaatttcaagatggtttttacccattgtttttttcaaagaaaaaattttttattattattttaaaaaaatacttcttttattttttaataacctaagcaaactccaatgccatatttttttcacattcattattgcctgagattgcattcactttttttttttctcaccccacccttcttgtaataattttttttta

SEQ ID NO: 15902 - DNA, 462 bp, Sorghum bicolor
  unsure (1)..(462): unsure at all n locations
  Clone ID: LIB3478-059-Q6-K1-A9
gtccaccacgcgtncgacactgcaatgattgttgcacttatgtatctgatttgtttatagagagnggggagaattgacatgggggctcttgtctttatcctcttatgctacataagatagtggccgccttccagcccctcctctcttcccttgttcatctgctgcagtgctgtctcctcctggaagctaaggtcgagccgtatagttgctgctaagattgatccacacagggccgcagtcccagaagtgctcattcattaatggtggggtgagtggtggctgccatgttgggcatctctgcaggcatgagcttgtctgatggcgttgacacgcggcgcttgatctttgcgactagcctgcctgtgctgctctggttgtactcaacgctgcttgtgtctgcatttgggcgagtgaatgctccaccgtgccggtggcttcaccgatcaaagcgctaaatgcccc

SEQ ID NO: 15903 - DNA, 267 bp, Sorghum bicolor
  Clone ID: LIB3478-059-Q6-K1-B2
tccgggcgaccaaaaacatttcacattgggagaggtgggacagtccacaccacccacgccacacctgcagacaccgatctacactatctgcagcgccgagaccacgcgcaactcaaagcagactcgcgtcatgcgctgcgtcgctgcaatctggccgacgaacctcacacaccgcgtctccactccatatcgcctgaacatgtgtgtcctgccccgacacacgtgcaccctcaccccgggaccggcacacttttgagcgctgctccc

SEQ ID NO: 15904 - DNA, 520 bp, Sorghum bicolor
  Clone ID: LIB3478-059-Q6-K1-B6
tccgggccaaaaagaggtgtcctccagatgcactgtcctacattatttttattgtacaaggagatgggcgagcgaggtgtaaaacctgatgagtacacctatgtcttgctcattgagtcttgctttaaggttgatagggtggaagatgcagtttcttacttcaacaagatgcttgatgctggcctgaggcccaacgcaaatgcatttaacaaagtcataggtggcttagtgaaggttgataggctcagcgaggcacaagggttcttcgatatgatgcctgaaaaggaggtcaaaccaaacattgctagctatgagttgctgttgaaggcatatgttgctgctgcaaggctggatgatgcgattaagatagccaaaggtattctgttggacgagagtgtcgtctttagtgatgaaatgaaaacacttctggaggaggcactggaaaaagaggggagagatggggaaatgacaaagttgtatgaagatgttgagagggagaaagcagaggcagctgcacgtg

SEQ ID NO: 15905 - DNA, 403 bp, Sorghum bicolor
  Clone ID: LIB3478-059-Q6-K1-B8
gaccgacgcgtccgaccgaaccaaggccttggccggtacggttcaccttatattatcggttcaatacaaagttgaaggagagggttgcatcattgctgccatcagctcatttgtataggctgaacaagcactgtttggcgctttcttccccaagattggcccccaagactcagggatgtagtatattatggggttgggcccaactgtttggcacttgcttcccaaaggttgggccttgcagatcagatggctgtggttgaggaaaaccagtgaggagtgaagaccaacttgattggatttggaattcctagttcagcctcaagtgagagccatgtttgccatttcagtaatctccctggttggaaatggtgaaaacagtttgttttaataggatcatttgcta

SEQ ID NO: 15906 - DNA, 438 bp, Sorghum bicolor
  unsure (1)..(438): unsure at all n locations
  Clone ID: LIB3478-059-Q6-K1-B9
atctggctttgctgcanngtggcaagctttttggagcctggatggtgccctcagatgccaggagaagtnnatggttgtgtcgctctcaaggcacccggaagccagttgagggagaactccagtctgttgtaaggacaccaaggattgagaagggatgattccgcaggcctacctgtaaatctaccagtgaccaatccaggnnttcctgttgttgatgcctgaacaatgtggaaggatgaaaggctctggtgaaatccacactgatgaaggttcccttcagcntgatggcaagaacaaggagacaatttgatgtctgcatgtgtgaggatcaaggaaccaaaaagactcaacatttcactccagcggcgggtcttaccaagaaccaagcgtggggtgtggtgagtcgtggttggcggcaggaaggggcctatcctaatg

SEQ ID NO: 15907 - DNA, 550 bp, Sorghum bicolor
  unsure (1)..(550): unsure at all n locations
  Clone ID: LIB3478-059-Q6-K1-C5
ccctttgggtttcccttcccaagttttaaagcgctcactatgctccgtctggtggagccgtcactacctttcacccatcatttcccacaccatatccagtgagcaattctaatgctcctggcaacgcagtattcggaattgagagcatgaggtggactatgatgggatcaaggcctgagggcttggaacatttgaggaactgcaaaagaccagcagaaacggacgattttcccatgacattaccaaagaaaccttgcaccgccgcacagaaggggctacatgtgttaccatttgcagaaacaggtttggagctccgtggatccagaccagatgtgcagccacagtcacagcctatctgtctggacgacgaagatgaagctgatcttcgacttggaaacacagaatcgcatcccgcatggtcgaaagctgtcagcactctgagacctgtgaagctngaatcctgagccaagcatgtacagcatccaagtgccaaccaagaaaatccctggcctgtgcattcgattacaccgccactagccccgggagaatg

SEQ ID NO: 15908 - DNA, 214 bp, Sorghum bicolor
  Clone ID: LIB3478-059-Q6-K1-D1
tcaacgtgcgagtgaccaccatgcatgcggagctggagtttgacatgcagccgaacacaacaagaaaacagttctttgatcatgtggtaaagactatctgccttcggtaagtgtggtacttatcactacagtcttttcattacgaacgattgactacctgggtgcaacttgataaaaaagtgtccccccaggacgtcacaaaggaaaaccctct

SEQ ID NO: 15909 - DNA, 289 bp, Sorghum bicolor
  unsure (1)..(289): unsure at all n locations
  Clone ID: LIB3478-059-Q6-K1-E11
gcaagaacatataatgaagaagagaactccaaaattttgctcnattgtccctagaaagttccacgaacgtaggatattcacaactgataggatcccacaacagctctcctccatgggtgtggatcctaacgctgccatgaatagagctcgcacagtttgctcagcaatggccccctccaccatgtcgatctcctccaccgagatggccggcacccccatcaaggtgggcttcttcggcgatggccgcatcaccatgcgcaagaccgccgtcaagtccaacgttgctgct

SEQ ID NO: 15910 - DNA, 580 bp, Sorghum bicolor
  unsure (1)..(580): unsure at all n locations
  Clone ID: LIB3478-059-Q6-K1-F9
cgggctcgaccgcacgcgtcccgtcgacacccgcaggaaccccccgccgccgaccggcggcggtttatgtctcgtacctgnncagatgatcaaatcagcaggcgagcgtccaagtaatgccaattacgctcgccatcttcgcgtcggagggttcttgagggttnncttcgccaaacccgcattaagccncnaatgatccnnnggcgctgtcgaaggcccggaccccgaaagaaagaacccgtcactcacgcctgcttcaaaggctctttacggcgcacncttccgccgaagctttgtcaaaaccnnntacgctgataccctggggaaccaggnngatgacatcgaaggaagatgtccccggcggcgcccgccaccttgttctgacggccagtgctcaaagctctatcgaaccgctacgaacctctacggcttgcgtcgcctaccctaangcanccacaagcagaaccgacgtgctcgcacatttactcgcctcgncggcaagaccaagggagtgttcattaatcctgcactcgtggagccattcggcctgacactgatcgaggctgctgcgtatggtctg

SEQ ID NO: 15911 - DNA, 711 bp, Sorghum bicolor
  unsure (1)..(711): unsure at all n locations
  Clone ID: LIB3480-043-P1-K1-E7
ccggnnccggaatgncccgaggtcgaccgcacnngcgtccgcatagacactgtgcattcagcaaagaaggggtactaccatgtacttgttcggtctgagagcctatccttctgaggttatgtttgctgttggacattgtattattgcacaggggattggacgcatttacgtctgtcgatacataatacagtgctagagagacgttagcatgtgatctcgagagtatcacgctgccatgcatgagactcaagtacaatgtcctctaggatgaaccaagtaagggagcaagaccacgcatcagnagtcgtgctacgcaaactgatagtttgaagcaggcacgtccttttgctggagcagcatgataaggagcgcgcaacaatttcacgttgtgcgtgctgcatcattaggacatgcggttttacaatataggtcagactaggctcaaagatacactgggtttgtgcgagtgagatcaatgatttacttgtagacatgttattatgaagagaacgttgtgcaccgtcttgcttacgacacattgatgcaacagcataggtggatgaatacctatatcgtgtatttaggtagcacttggttagcctttagtttattcttcaaaacttgtgagatcttgttgcctcgtcccatacattttctattttttttttagatataatggaacacgtcgcatacatgtgaacactgtaaata

SEQ ID NO: 15912 - DNA, 624 bp, Sorghum bicolor
  Clone ID: LIB3480-043-P1-K1-E8
ctacatgtgcccgccgtggttctccgtcgaagcgcgcaagctccttgccaggatgctagaccccaaccccaggaccaggatcaccatcgccaagatcacggctaatccctggttccagaaaggactctgccctcgcggaagctcagcgtcaagctgaacaaagggggcagagtcgagatggagggcagacaggactgtcggagaggtgcactcgccctcgaggcagagatcttcgaggtggcgccgtcggtgcacgtggtggagatgaggaagaccggcggtgactcgctcgagttccgcgaattctacagggaggaactgaagccgtcgttaggtgacattgtgtggtcgtggcagggcggtgattcgccgcctccggctcccgtgctcgtaccgaggcatgctaccaatcaacgttcctgatttgccaccactgcataaaagattttcgcagcgacatttactaacggttcactaaaaacaaaatatttaacctattgacactattaagggtggctagcaaatgatttgccactttatatgagagggatcaatgtgggagagggattaagcatgaccctcttgaactggcaaaacatttgtaataatatatcattgccggtt

SEQ ID NO: 15913 - DNA, 346 bp, Sorghum bicolor
  Clone ID: LIB3480-043-P1-K1-G10
cgacgtcacgcgtctacatacgcatcggccaataaacaagctgctaacattacaacacctccatgcagaactataatgggcgaggtatgatagatgaacgccaatctagctcgcattggctctacaacgtggcgctcttggaaaacactacggttactgaacttaatcaggatgaaggatattcagctttgcccagctcggctaatacggatgatgacgcgacagatcgggcttaccaacacacgctcagcctgaatggtgactgagattcgccatcaacatgcgtattcaacgcacccagtctcaagactacacgcaccaagaccaatacatttgtgaacaccct

SEQ ID NO: 15914 - DNA, 311 bp, Sorghum bicolor
  Clone ID: LIB3480-043-P1-K1-H6
gcgtcccatccactagcatactctcttcagctgcaaaccctttgagcaactttaggaagctataagaagagagcgggggggtacagtcctccaatgcacatcaaaaatgtcgatcaaatactgcgaccagtacaaggactgccaccagccgcgtttataacagcggttctacgcggggtctatcggcatcatcctgatgctacttctcatcgcgctgattataaagactgcggctccgccccaccaagttcccgctaccacctcatcgacgtgagcatcgtgtgcataaaggacagctccgtctactacct

SEQ ID NO: 15915 - DNA, 509 bp, Sorghum bicolor
  Clone ID: LIB3480-045-P1-K1-A11
gtgggggggcactttaataacacaacattttttttttaataacaacacaacatatttgactggaactacttatacaactgctcagtcatcctcacggttcttgcaagttgggttgcagggatacgggcaatcaatctgccgagagacctccctgtcgaagtaccagtcccccactgccttgccaatttgcgttttattaaccgtgggagaaccatcggctagccatgtatcttgagatcctgattggcaatgagcattgcatgagtcgatgaacatgcctacagatggagttttaggaagtgctgccagaaagtctgtcctgaaattctgcaaggttgtgagttggctgggggagcagctcttgatatcaagtttgcattgggcccaagtcttcttcggatcagctggactaggtgctaggacgttcttgacctgccatgaatcataggctgcattaagtatgaacaatggtgtacgcattgtcggtactacgtactgggggaacatac

SEQ ID NO: 15916 - DNA, 509 bp, Sorghum bicolor
  Clone ID: LIB3480-045-P1-K1-B7
cggtccgtatttccaggtttttttttttttttttttttttttttttttttttttttttataaaaactatttttgacccataccagcaattcattgggaccaggctattgaaccggcagtttgagaatatccaacgcacccttagccttttcaaggcaataaatcccaacctgcgcacatagattaggcaaagggtgggcaagggtctgcgactctctggatttcaacaagctgggcggtcttaaacaaaatgtttatgcgtctttcaaggtggtccgccataggacaaaccatttgatcgccacacagactgaaacttaaaaaaaaaaggtgaagctctcgtacgaggcttacaaaaacctgaagaaggggctgtgcttgcgcaaggaccctgcgttcgggttgaaaaaaaaaactggccccgggggtagggaccgcccccgggcgtaactgggcggcacccccccataaatgtactccttccgggtggtgcccagtcaaaccaacctg

SEQ ID NO: 15917 - DNA, 363 bp, Sorghum bicolor
  Clone ID: LIB3480-045-P1-K1-H12
acgcgtacggacacctgcaggcggagctggaggcggagcgcggtgccgccgagggcgccgccagcgaggccatgtacatgatcctgcgcctgcagcggaacaagtctgaggccatgatggatgcccgtcagtaccggcggtacgccgaggagcggttcgagcacgacgccgccgaggtggacgcgctccacgacacgctcgactgtcgcgaccacgccgtccatgcactcgcctgcaggctcagggcgtgccatgcgcgactactccaccacggcttacctggttgcgctaacaacgacgacggccgtcactactatcattgcgactgctgattctgctgctactactaataccgctgcgttc

SEQ ID NO: 15918 - DNA, 508 bp, Sorghum bicolor
  Clone ID: LIB3480-048-P1-K1-G3
gcgaccgggaaaatatcaaaaccgtatgagcgtacttgtatatgttaactatacaaaacttggagagagagagagagagagagagagagagagaataataagacattgatcacgtacatgatgcatgcatatgtctcatcatcagatctcaaaggtgctctccatctcaagctgcccacccgcggcttcctcttcatcgtcaccgacatagaggtagggattcttctccacgggctggaagttgtagaacacgaacacatagaaggcaaggctggccgtctcgatggatacgttgacggcccactggtacttgtagctgagcacggcggcgacggcggacgcggcgatccgcgtgaagtagaggtagcacaccaccaccaggtagaactgcttgaagagcgtgagcttctggaggttccgcgccgccttgccgtcggtcttggacgccttccgcaggttgcggatggaccagatgatggggaagaagaccgcgcagcagcagatgacg

SEQ ID NO: 15919 - DNA, 575 bp, Sorghum bicolor
  Clone ID: LIB3480-049-P1-K1-C11
ggtcgcttcctgtggcgacctctccgtccgtcgccgcaaaccttgcctcactcccaggcatcacgccatgccacgccgcccaacatagctccctccggccgcgctgggcacagacacagatctttcgaattgccacatctaggctgtcgcatctacagcagttctctgctcccgagattcacttccgatcccgatctgcatcgcctccccctgatctatgcgcctgtgccattctccttccccatactccatctctttgcgtgctcctttccaggtggaggtggacgcatacacgggcggtggatcctgggaaggtggaggaaaacgtgctgcccaggaacaaggtggcgctctacgaacaatcagcgtcccctcccatggctacccacgccctccactctggcgtccctatggcatgtgcatcccatccatgtccacgagacagatcatatgaatgtcaactctgatcgatgtgttgccaatggtacaagagctgaatctcggaggcagtcatggcgctgcacacaacgatggcttaactggcgaatgcaggcggaattgggggcacctaactc

SEQ ID NO: 15920 - DNA, 601 bp, Sorghum bicolor
  unsure (1)..(601): unsure at all n locations
  Clone ID: LIB3480-051-P1-K1-A7
gctaggcgtacgcgtacgcacgcgtactacacggcagctagcgcgcgatggcgaaccacctccgtccgctcgcgctcctcctcgccgtcctcgcctgcgcgctgctgtgccgccgcgccgacgcgaccgcgttcgaggtcggcggcgacgacgggtgggtagtgccgccggccagcgatggcggcaggtacaaccagtgggcgtccaagaaccgcttcctcgttggcgacatcgtccacttcaagtacaaggaggactcggtgatggtggtgacggaggccgactacgacagctgcagcgcatcgcaccccatcttcttctccaacaacggcgacacggaggtggcgctggaccacccgggcaccatctatttcatcagcggcgagaccggccactgcgagcgcggccagaggatggtcgtcaaggtcgttggcccggacgcgcccccgccggcgcctnccagccctccggcccctaccggcgctgccgcaccagtcaccaccagcggcgcgctcgccggcgccatcgcagccgtggccatggcgttgccggtcatcgtgatcggcgtctgaatgaatgaantcactcgagaggcgattag

SEQ ID NO: 15921 - DNA, 462 bp, Sorghum bicolor
  unsure (1)..(462): unsure at all n locations
  Clone ID: LIB3480-052-P1-K1-H10
ccgngggttgtaatgttcaatcatggcggtgccgctcgactctatctatggattacattacagattgccctgcaagttgcagtggtagcttagattacatatggtacgatcctatgtatatatgctcagtcatcagccggccgtcttatcagtcgacgccttcgagtatggcgagtatggcctggaagaggttgatgatgtcgaggtagagctcgatggcggcgctgacgtactcgtcgtaggagtagcgcttgatgaggttgtcggtgtcgtagatgatgaagccggagaagacgagcgcggcgatgcagccgtacaccatggtccccgtcttccccagcgggaagaggatccgcacgaggccgaagagcatgaggatgaggacggcggccaccaggaatggccccaggaactcgaagtcgtagccttgcttggccgcccagaaggtgtaggcggtgagcc

SEQ ID NO: 15922 - DNA, 368 bp, Sorghum bicolor
  Clone ID: LIB3480-053-P1-K1-E8
cgattccggtcgaccgcgcgtccgaaaaaaaaaaaaaagcgaacaatataaaaaaataaaaaaaaaaaaacacaaaaaaaaaaacaaaataaaagagggtataatgggcgggcggtgggggcgtccgatctaaggggcgcagccttgttacggttcaatccttcttaatgcctcttttattggacttccttgacttatttttttccccgtcttgattcaaaagcccgtggggtaaaccatttgaatcgcctaacagaatagccttctaaaacatactggtttggcaccctggcgcacttcctaaagggcccttactgatagggtgtcccaccggttggccattttaattggcaatggggccgcgcttt

SEQ ID NO: 15923 - DNA, 328 bp, Sorghum bicolor
  Clone ID: LIB3480-053-P1-K1-E9
cgaccgcgcgtccgaaaaaaaaaaaaaaagcgacagaaagtaaatagaggaaacaagataaactaatacgaatcctacaatataatcagtggattatgaaaactcggggcttctatctactcgccgtcgtacaacgtcgtgacggctaaaaccaccgtgttgccaaactaaatcactgtcttgcacttcatcctcttgtcagcagcatggcctagttacgaggagggcattgccgatcgaacctaacagcagcgccgcctctatcatgtatgatgcgagccgtgctgcggcgcctcactcgccgcggctgttgtaattacgcccagca

SEQ ID NO: 15924 - DNA, 399 bp, Sorghum bicolor
  Clone ID: LIB3480-053-P1-K1-H1
tcgcctttttctctctctgtgccttttttttttattcatttttttagtttttttttgtgttgtgcattttcgacgaagaggttgaccagtaggaggacgcgtactacgtggatcgggagctgcgcttcggccatttcatctttacaacaaaaacggtaacggctgtacctactaaaaaaacacccgctgtttctgtccaagggcctaggtatttaccgcctcggctcgggccttctcaaaccaacggccgctgcgggttcggtggcagcaaatagctgggggggggtaacttggtgccacccgaaaacggaagggaccgtttttgcttccccatgcactacaagaagatgatcgaggaaggcccttgccacccactctttttgaggaactatgcacagc

SEQ ID NO: 15925 - DNA, 429 bp, Sorghum bicolor
  Clone ID: LIB3480-056-P1-K1-A10
agcgttcaggcagagtacaagagatctggtccagtcccagccccggccccgacgagagtagccgatgattcgtctactcccgccggtgcgactccatagataggagctagtcatgaaccgctgatcaacaagcatacatatacatattcatatacatatacatatacatatacatatacatatacatatacatatacatatacatattcatatacatatacatatacatatacatatacatatacatatacatattcatatacatatacatttacatatacatatacatatacattttcatattcttatacatattcattatacttatacttttccttttcattttacttttccttttccttttcctttttagtttttacccacaaccttccactaccttggcctaaatacatacacacattagttttt

SEQ ID NO: 15926 - DNA, 291 bp, Sorghum bicolor
  Clone ID: LIB3480-056-P1-K1-A3
cgaccctcgcgttcggtcatagtcagtaggtaagctcatggcccttagagcctagtccatgtttttctagagatggcttcatgatctcatctggtctgcctgagtaagtgttctttgtttcggctgtgtgtctcgtccttctctgtcagggagttcttggtatcatagagttgatcatgctcgtctgggtcccgtagaggctaggtaggtcctatctcccctcttccggtcctggtgtccatccataccccgtaagtcgaggttgagctgcgccctccggtcttggcacct

SEQ ID NO: 15927 - DNA, 466 bp, Sorghum bicolor
  Clone ID: LIB3480-056-P1-K1-A4
gtccggatattcccgggctcgatccctcgcagtccgattttttatttttttttatttttttttttttttttttttttttttttttttttggtttgtcatttttaaagagttccatagctttttgttcgcgtgcgtgcgccgtttttgtggttccttggtgcgcctcttgcttccactgtccggggtctttcagcgtcgcgtctgggttttccctggcccgtcccttctcttcttccttgctggttttcccccgtcctccacctgctgtttcaccttggaggcctgccccgttcgcccttcccctctgttgccctaaaggtctggcctttgggtccctccctactgtggcgctttttgttcggcgtttgagacgccccctctttgggtgtccgtttcactggcctgggccatattacccgctccttgcccttttttctgtccttttctctcccgcccgttcggtttt

SEQ ID NO: 15928 - DNA, 409 bp, Sorghum bicolor
  Clone ID: LIB3480-056-P1-K1-A7
ccacgcgtccgaactagcacaggagagaagcttcctttcggagtagaagcaaattatatccttgagacaggagtagggtctgttagcctctccttcgtacctttactcgcacagagagacatgctgcgctcatgcttgcatagtctgagaaaatcaagatatgtatatttattcatttgcttctcgaatgcaaagttgaagtatatttgagcaatcattataccaacttgtcaatcccttatgctatgcttgtctttgcaaaaaaggtgtttagctgaattaggttctactgaggagttctaagaattacttgctggcttgattcgcccaggtaagaaccgttactaccttatcaacagctagaaaactgtacagagggatcttcatgtggtcaatctatagtcagcct

SEQ ID NO: 15929 - DNA, 156 bp, Sorghum bicolor
  Clone ID: LIB3480-056-P1-K1-B3
tattgaaacgcaccctgtttggacgcattaatcacgggcggtgagggggttacgcacagcgtgaccgttactcttactagcgagctagcgaccgctcgtttcgttagcttcctttcctttcttgccacgttcgtcggctgtccccgccaagctata

SEQ ID NO: 15930 - DNA, 493 bp, Sorghum bicolor
  Clone ID: LIB3480-056-P1-K1-F8
cagacgcgtgggcgcttacccccctactacccccagtctcatgagagataccttccagaagctcaagaatccaagagccgtcgccttcctcgccgaggaggccgcctgagatctcattttctaaggtgttgagctagttgctgagcttggttgctgtgtaggtagtctagaggctccatcttcttcacccaagagaggagatggccctaccactgtcaccggtagagtctctggcctctagcctagcctccatggtttccatgtgcatgctcttggagtcacctcctatggctgcatgtcaactggtccactctactttcctgcgagctaggagcttggacctcctttagttgtgttccgccttgccggtgttctaggttttgtgacggctggagcagtaggagttgctaacttcagggttaccgacagccagttccctctgtctgggcctaactcattcttcggcagagctgttgttgttcacgctgttcct

SEQ ID NO: 15931 - DNA, 137 bp, Sorghum bicolor
  Clone ID: LIB3480-056-P1-K1-G4
tccgggcgggttctagttccagtagcgtgttgtcgtagttctacctcttcggctgatggctggtagctgaggaaggggaggtgccggtacgggttcttcctcgtggagttcttcgtcttctcgctctggttcttgtt

SEQ ID NO: 15932 - DNA, 435 bp, Sorghum bicolor
  Clone ID: LIB3480-056-P1-K1-H6
gctctgtttctagagcttccttttttctagctgttagctgttccttcggtctgctgagtaagtcccatctgccttgttgtatttcaagtaggctttgtagtccgagggctcccatgcgcgctctttttccttgttgtgagcttcgtcctgtggctccggttgtttgtcttgtgccctcagagctagtgctccgtcttccccttcctggtcctgagtgcgttgttctttcttcggtcgtcctgtgtgccggtccttccatctgcctgtgcctgtgttgtttcttcagcttctgctgcgtcttgtttcgtgaggtcgctgccggctaggctttgctatttggtgcggttgctagggctgctgctccgccctgtccggctcgagagcgtgatgagagtcggtgagccggcggtggccttctgtcgcttggttggctct

SEQ ID NO: 15933 - DNA, 151 bp, Sorghum bicolor
  Clone ID: LIB3480-057-P1-K1-H6
gtaccggccggaatccggtcgaccacgcgtcgaaggtcaacatttatgtcgggcgcccaagaatacccgggaccggcagaaagctcgcgcggatcacatgaagaccgccctttcatgaggcgcgtcattgagaacatgggttcacacacgc

SEQ ID NO: 15934 - DNA, 468 bp, Sorghum bicolor
  unsure (1)..(468): unsure at all n locations
  Clone ID: LIB3480-058-Q6-K1-A4
cgggtcgacccagcgnccgggcgaacgngaaccnganacccaagcanacaaaggacacagaaacccaggagcaggaacgcaaggacacagngaccacgagagggcaggagcaaggggggggccacgaaaggaagggggccgaccagcancacaaggagccaggagaaccacgccaccggggggacgaaggcgcaanacaaccgagaccaccagggaccaacccccaagcgacagacaagaagacgggcagagagaagggagngaagaacccaagggaaaggcagggacgagcaacaggagngnagccaaaaccgggacaacagcggaggaacacgcggggcccacgaaagaaaagacaaacacaccgcgggacccagaacgaaccgccgaagaaaaacaagcaaagcggagcaaagggacccagaaaagaaanggcaaaaaggagacngcaaacaacagggcngacgg

SEQ ID NO: 15935 - DNA, 406 bp, Sorghum bicolor
  unsure (1)..(406): unsure at all n locations
  Clone ID: LIB3480-058-Q6-K1-C2
gcagcggccgcncgacgagctgcacccggtagggcgccngcaagcaaaggggtaaggggggtatcaagagaccaacggcaacggactgagcggggaaacacacgcaggcgagggccagcaccctgcattgctggctgtgcaaaagctagccacacaaaataaaccgtgaggtttagacacactcttaaaaggggacacagggtaccccaggcttaggcgaccgcatccagcttggtgaggcgggcgtcttcctcaaaagggggcatggcactgtgagcctccggggcctggtcctcgaaaacgctcaagcccagattgagcatgcggcggatgcggctgcccaatgcgttggggtcatcgaggctgaagccggaggtgagcgacgccctcttaaacaagagcatga

SEQ ID NO: 15936 - DNA, 266 bp, Sorghum bicolor
  unsure (1)..(266): unsure at all n locations
  Clone ID: LIB3480-058-Q6-K1-H2
aagaaccacaaaaaacacgagcagcgagggagaaagcagancaaccagccagccagggaggaagaggccaagagggggaggggganggcnagcacngacnccaccaggagggccgnaccgcagggccgcgcgccggagaagcnccncgccgcgccgnccgcgcccagggccggcaacacccacaggccggaggcagncgccagcaggccacgcgggaacaacaccggcgcncagcgccgacgaaacgaggggcgcgagacggaaga

SEQ ID NO: 15937 - DNA, 125 bp, Sorghum bicolor
  unsure (1)..(125): unsure at all n locations
  Clone ID: LIB3480-059-Q6-K1-D3
acagcagcnangagcgcacagaaagcacnncanggaagaaggnncgcagggaagaaganaacagcaacnnnnangaccccncaacagnangaaangaagnnnccgagcnagnggacagancacag

SEQ ID NO: 15938 - DNA, 409 bp, Sorghum bicolor
  Clone ID: LIB3480-059-Q6-K1-G10
tccgggctcagacgggggcgaccttctgtatgcttgggctgacacaaaaccaaatgtgctagtgacattgactaacgtgcgaatagggcatcggaagagagtggagaatggagagaacgggggtacatgggcaggaagacagcccttgcgcgtaccacctaggaggagtgaagcgggacagcatctctaccgcaagtgacatggacgccagtgaatagggtttcaccccttacttctttcttgataccatacaggctgataagggcgagctacatatagaagagacatgacttctatactactatacaccaccaaatggcaccggtgaagccagagcctattacaagatggatgatgaggtacccctatcgccagtctgtgtcactctgaagaacatgtagccggagga

SEQ ID NO: 15939 - DNA, 523 bp, Sorghum bicolor
  unsure (1)..(523): unsure at all n locations
  Clone ID: LIB3478-053-Q6-K1-D7
ggagaccaaacctttgaccgcgaattctaacccccccgncagcggccacaccagggagccatacccaaacaaagtggcaccaaaatcagacatgccacagagtgacacaaacagcaaagctcccgacgctgctgataaggattgaagaatgctaacccggccctaactactcacatccgctgggatgtccgacacgggaggcaatgcccatgctcctggagactccgaaaagatactagagcatgcagctccgcagacccaaaagaccctgaccaacatcatgcaggcccactgacaacggttggcaccaaaaagcggcttgaccaaaaatacaaagctgcaaaacaaggcactaccgatccgtgtcggacagcccaacttggtctgcacaaaggggacgaagaaattgctcactaaacgctacattggtttaggagactgccactgactgcagccgcctcactggccaggccgacagcaggccgaccctctcacctatagtaaataggacttatgtagacaa

SEQ ID NO: 15940 - DNA, 428 bp, Sorghum bicolor
  Clone ID: LIB3478-053-Q6-K1-D8
gcgtccggagataagtctcagcctactagacttttgctactgcctttatcctacggagagagattacctcagcgcgatctttcacagaatatatgggaagaacatggtgcactcaccgttcatcaggaaggcgattaaatgtcaacagatcataagtgctatatcatacaaagaaacctatttgaaagactaacatgggttagaacttcctacgcatattcaatggttagtttttgccaataaactaagaacacaatttatcattcatccgagcacataaatcattacacaaaccaaataatgtaggcatgtacaatcagcaactcgtatactaagtcactcaataataaaaaaaaaattgcaaaccatgttattcctgaataaggtgtttactcaaatattgctccataacaaatagctcaaaagat

SEQ ID NO: 15941 - DNA, 495 bp, Sorghum bicolor
  Clone ID: LIB3478-053-Q6-K1-D9
cgcgttcgcagattcattttcacgcttccaaatcttttaaactcctatgattcaacacacagggcgtctccatgagacgcatcttctacgctctattgcgcgttcatagtgcaccgtccgttcatcacgaaggcgattaataatatcttctacaggctcatatttgagacagataatcataatggtctaccagatctgttacaaaactttcggaaaataatacatgtctttgttttcccgctcactgaacaacacacatcataacagatgctaccactcattccgcttcacaaaccactataacattcactttcacagcacgcactaaattaccatgacactcatctgcgccacaccgacagcgaccaccgacatcctcgccaaagcattccacatcaagaacggggcaagtccacacatcaaggcaaacttcacgcccaagaagtaaaaaaacaagcagcttcttcatcattccaatatatatatatatatata

SEQ ID NO: 15942 - DNA, 362 bp, Sorghum bicolor
  Clone ID: LIB3478-053-Q6-K1-E8
ccacgcgttcgacccaccgctctatttccaccccaatttcctaaaccctctcttcaccccggtttcactcctaaccgcgcagttcttaaaaaagaggccgggctttgcataacaacaacccctacctccaaaacgcgttctatctcttaaagcttcctcactcaactccttacccaaaatgcccactcccaaaagatacccctacactccctatccatccacaagaaccttgaacacacatattcaatcgtctctcatactgcctatgtgattagagtgtccgacttcccaaacaagctcctattaattcacatctccacaaacttgtttttacacttaccttttgaccccaaacttgccac

SEQ ID NO: 15943 - DNA, 534 bp, Sorghum bicolor
  Clone ID: LIB3478-053-Q6-K1-G11
acctagccacctcttcccggcgccgctcctttctccctgccgccgcgaaagccaccgccagttctgcacaccccatgctctgctcactccgcatggccgcctccgccgccgtcctcctcgccgtgacctccccggcactcgcgtgcaccccctccgcgctcccacccccgcccactcccctcacggtcacggtgtcccccgaggccgacgacgccatcccagacgcctccgagaccgagtcccaccccttcgagaagctcatcatcgagaccgcctgcctcgttcgcatcggcggcgcggacgaggcgcgctcgcgcctggccgcggccggatgcggagagagctacgcccgcctcctagccgctcaggctctgttcgtggacgggatggtggacgaggcgatcgctgccttcgaggagcttgcgcgggaggaccccgccgactaccgcccgctcttctgccagggcgtgctgtacctcgtccttggcaaggaggcggagtccgagtccatgctcgagcgatgccgtgaggtcg

SEQ ID NO: 15944 - DNA, 519 bp, Sorghum bicolor
  unsure (1)..(519): unsure at all n locations
  Clone ID: LIB3480-060-Q6-K1-A4
agcacacagccggcgctancgttgcgaccggccccgagcgggcgacgggagcggccgggaagcgccgggcaacccnncacgcgcccagnggaggcgacggcatcgggagacgccaacngggacacngccgaaccaggggaacggccgggcgggggcgggcgccacaggancgcagcacgacacctacacccgcncgacgngcgcaagncaggagccgcgccggcccaaggcaaggccgcgggcagcaacgnccagaacaaggganaccccgcagggggcgcggcacgcgcggggacggccgacaccaacaaggacngcggcaagagggcgagcgcgaggcacagngggccggagagcagaggacacactccacgggccgcaaccagctcgccacctgctccaacgttccaccttctccgagctcaccgagcatgccagccaatgtcgcaaggtatgttagcctagccaccgtcttctccggcttcggcgacgatctagccatttttagcgcccgtgatc

SEQ ID NO: 15945 - DNA, 210 bp, Sorghum bicolor
  unsure (1)..(210): unsure at all n locations
  Clone ID: LIB3480-060-Q6-K1-A9
gaagcaagcggaacaagcaacgacgaaaccncncggacagggggcgcnaccacaggcacccgcgaaggagccaaaggggaaanaagggaggagggaggagaagaaaancnnccccaacncggggccaaagcngancaganngccgggcngaggaaggacagagaaaanggcccgnncaaaccagacccacgnnnngaagaagccaagcag

SEQ ID NO: 15946 - DNA, 390 bp, Sorghum bicolor
  Clone ID: LIB3480-060-Q6-K1-C5
cggcccggattcgggtcgcccacgcgtcgaaatgggtcgaccttgtgcagggacaggaattcgtcatgtcaatttttggaacggaccgtcagatcttgatgaaactagaagagttgtaaattctagtgacagggtttcattcaatgtgacccaaatgaagccttgaattgctgaaaagccgggatgctctctaagggaagttgaccaggtacgtgtcaacctgccaaatgggacatgtggcacactggtgatattgagccaccgtgtgttgcaggcactgatgaagctgtaagatatttggatgctgcgacaagttggtggattaccttgtactgccgatcatgaatgcaaagatatggtgaaaaggaacaaagctggaagccattgtcg

SEQ ID NO: 15947 - DNA, 542 bp, Sorghum bicolor
  unsure (1)..(542): unsure at all n locations
  Clone ID: LIB3480-060-Q6-K1-H2
atggatcgagccgcctncgagcacgaagcctacggnctggnaacgcgggcaacgctcgatnacgaggatcttgccggctacctgtgcgtcgcggttccacggcgcatagaggccgccgtcgaagccgccccaggcattgaagccccagttgacgccgcgcacttcaccctggtcgttgatgacaaaggtcgggccgctgtcgcggacccaggcgtcgtcgctggacatttccaccaggcggatattcggcacgtcgaggcgcgcccgggcgttttcatactgagcggcggacaccgccaccgtcaccggttcgaaacgcgcaatggcccgggccacggcggcatgggcggcctgcgccggcctgccgcccaggcgccagttgtccgggcgctcgggccagatcatccaggcctgggtttgtggcgcccattcggcgggcatatggaagccgtcagcgcgtggtgtgctgttcaaagtggtcatggcgatcaagactccagggatccgtcgagggttttcagtgccccgtacaggatcggtcg

SEQ ID NO: 15948 - DNA, 224 bp, Sorghum bicolor
  Clone ID: LIB3480-061-Q6-K1-B3
tcgtccaacttggtcggctgccgcagtcctggccgttggacaaccgctctgacgggagttccgggctcgtggacacgggggtgcggggcccggacttggcgacgagctgaggatcatgcgggcatgtgccctggtgtgttcgaatctgccagaacgtaagtcgaggcgggggtaggcgcccaattttgagggctgctcctggcaccgaacttgccccaagatct

SEQ ID NO: 15949 - DNA, 117 bp, Sorghum bicolor
  Clone ID: LIB3480-061-Q6-K1-G10
gcggatagatcgtcgtggagcgcacttgcgcactgttgatgatcaatggtatgcactctgacgcggcgtataaaggcacattaatgtcggcgaatcgggcggtttgaccgatacagt

SEQ ID NO: 15950 - DNA, 427 bp, Sorghum bicolor
  Clone ID: LIB3481-041-Q6-K1-B6
gcgtccggtaagttatgacttgtatgacccgttgatgtataatagaccttgcaaatgtgaaaaaatgtcaactgatgtgaatgatgtacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgcctatttaaaggaccaaagccttagatcaacaacatggaaactgataaaaccctttaaggccccacaaaataaagtcatgggccacattttttcataaggcagaaaaggaaaaaaccaagaggtcccccaatttaaacctttccaacaaaatcccattttcaaaagtgagtgtaataccaaatggcccggaacattaaccctttccaaa

SEQ ID NO: 15951 - DNA, 562 bp, Sorghum bicolor
  Clone ID: LIB3481-041-Q6-K1-C11
gccgtgggttttttttttttttttttttttttttttttttttttttttttttttttttttttttttttttttttcctttctagcttgccacttgttttctgcgcaaaacagcctaaacaacctcaggggcatgctcacagggcaatgagcctccggggtaccgttaaacagggccgataaatcaggggcatactcgcataaagcactccggccattttttaatttttttgcacggggttcttgccatgtttctttccatatatggagttctacacttctacttacaccatttgtaagcactatacatacataggggtacatgtccctatatgctgcccggattcaagtctccaaaaccgggattacaaactagtatacggcaaaaactagtccgttgatcaccttttggccgatttctgggggggcgagcaccacgaggacaaaaacaggcccaaaagcatgctgctgtcccccttgtccttgctaaaagccttaagcacgttttccttaagctcacaaaagcgcatccttttcaccttttgctcgtaagcagtgccccttt

SEQ ID NO: 15952 - DNA, 502 bp, Sorghum bicolor
  Clone ID: LIB3481-041-Q6-K1-F9
aactctcttcccaacttgcatatgcaaaagaggcgcgataagatggcacactcaagcaaggagataatggagagggggacactgaagaggaagaggaacctgttgtggtacgtttccaaaatgtgggagaacatcaagtcagctgactatgattcatctacagagaaggacaatgatggtcagtcacaggttgatttggaatcaaataagggggatgcaggtatacacggcaatgggctgcactcagctaaggagagcagaggcaagacatcaccaactaaacagtaccagcagcataagaagaagcctttgctgaagagatttattggtttgctgcaacaagaatagcgaaaattagcataaaaccattttatgataagtctctgctctgtcctttgagacatattaccatgactagccatctaattactgagtcttattcccacatgctatggtaactacaatgattgatgcttcaaagaatacaaagtgtccactgtat

SEQ ID NO: 15953 - DNA, 648 bp, Sorghum bicolor
  Clone ID: LIB3481-041-Q6-K1-G5
tcgtccggttgatctttggccgcatgcatgaggggggagagatagacgaaaacaaaatctaattgtatagtttgtatgtaatttacgagataaatcttttaaggctagttagtccataattaaataaaatttatcaaatacaaacgaaaatgtcacggtagccagagccaaatttttttcatgaactgaacaatgccttaattgaaagagacagagttcgcttactggtattactttttttttccgcgcgggggaaaggcctactggtattactgggccttgtttagttcctaaaaattttgcaaaatttttcagattcctcatcacatcgaatctttagacgtatgtatgaagtaataaatatagacgaaaataaaaactaattacatagtttggtcagaattgacgagacgaatcttttgagcctagttagtttatgattgcacgatatttgtcaaatacaaacaaaattggtactattcacattttgcaaaatattttagaactaaacaaggccctggtgtgtggtgtctccgtagtcgtatgctttcggcaatgtgctgcacaatgctttcaagagcttgtgttcaccattaaaaaaaactcaaatgaatatatgccgactttgattccactatggaaactaat

SEQ ID NO: 15954 - DNA, 423 bp, Sorghum bicolor
  Clone ID: LIB3481-041-Q6-K1-G8
accctttccggagcagggctacattctcttgaccacctaccttcgaacactacaagatcggaaacttcgtcagacaaactagcggaagagggttgttctttgggggagcccctacaaggataccagcggcgggcgggttttttctattaagacaccactggcgctatctgtggtgaaatcaacaagcaagttaatggtcacatcattaggatgggtgtccatgttgctgtgttagcacgtgcagcaatgcctttttgcataatagttactcctggtgagcgcacagtaatgacgaactgaacctggcttccaaaggtcttggtgaaatcattagtgccaaaaaccaggattatggttccaagcctacattcgtggttcagggcgccaccctacataccgtaactacaatcccgcacgatgatg

SEQ ID NO: 15955 - DNA, 721 bp, Sorghum bicolor
  unsure (1)..(721): unsure at all n locations
  Clone ID: LIB3481-041-Q6-K1-H11
cccgggtcgnacccacgcgttctcggcgaaggtaccgggtacaaggnacgcgggacaagtannggcgagggacttacaagaagnatgccctcttcgactggcgtcctcttnncttcgtcccggctggnagaagcatgatggnnagggataccctccgnactcggnaccgagttnncagcgtgccggnagcagtatcatccatgctccagccccgcggccannggcggcgttcctggcggggcgggggcgggctctgtcgcgaccatgtgcntccaacgnngcggcgagctgagcttctacgtcgcaggaacttcgatcgtgcccgccgcgcagtcgccgagggggctgcggctgcagctgcagctgcagtgctccgcgtcggcggtggggctggccagcggcggcgatacggtgggcgacgagctggagttcctgaaccggtgcaaggacgccggcgtggtgcacatcctcgggaacaccatcgtgcgcgcgcggcgggactcgggcgtcgtgaagaagctcgccgtcgactacatgtacgccttcatgaggagggtgtgcagggagaacagcatcatcttcaacgtgccccatgagagcctgctcaacgtcggccagatatactacatctgaatcttcttcttccgttctcagatcaaatcctccttgtttttgttccccggtacgataggatatgtaaattattgtcttggatcttgaa

SEQ ID NO: 15956 - DNA, 560 bp, Sorghum bicolor
  Clone ID: LIB3481-042-Q6-K1-A8
aaaaaaaaaaaaaaaaaaacaaaagggggaaagaaagaaaaaaaaaaaaaaaaaaaaaaaaaaaaaaaaaaaaaaaaaaaaaaaaaaaaaaaaaaaaaatttaaaaaataaaaaatttaataattaaaattaatttaaaaaaaaattaaattttaatttttttttttctaaaaaaacaactaactaaacttgtgggggggggggggttttttttttaaacccaaactttaccctcctaatttgggggggtgaaattttttttttggggcccccgacttttttcccctggggcccgttttaaacgctttttggataaagactctctcctttttgccatttttttaagccccctttgtttgccctttaaccgcggggggtttgttgaattagcccacgccctaccccccttttctatgggtctttttccttgttttttaggttgttttccttttttttctcgccattttttcggggtttttttggttttttccccccggtgggcttcttttcgggcccccctttcgggctttcttttttcggtttttcgatcacttttcccc

SEQ ID NO: 15957 - DNA, 597 bp, Sorghum bicolor
  unsure (1)..(597): unsure at all n locations
  Clone ID: LIB3481-042-Q6-K1-B4
gttgattttacgatcttgtctatttgataaagccaactttatgtgctcatcagatgccagccagtctctgactgaacacttcaacgatgaatatcatcatcatatgctccaagctgaaatatttcacatagcgtcatcatgtttaccttttccagaaccaaattcattagaaacgcttcagaagaagaggaaccatattcctctcctgtcacgacaaacagagccttcttatgaggagcgtatatcaaaagtcaaaacaaaggtggctgataatctcaagtagagcgtctgttttgaattgttacaccaatactttgaagagaactgatggaactgttgaagatttgtgcttcttagtgcaaattctggcacaaacaaaagcctacataanttggatctgttaacatgtggagatggaaactatcaggaaacatgagctgagtggatttcaccattttgaggtgctagagaattggatctgttaacatgtggagatggaaactatcagnaaacgtgagctaagtgggtttcaccattttgaggtgctagggcgtgctgcctatcttagattcttagctgttcttgtcgtcagcaatt

SEQ ID NO: 15958 - DNA, 554 bp, Sorghum bicolor
  Clone ID: LIB3481-042-Q6-K1-C10
tcgtccgtaaaaaaaaaaaaaaaaaaaaaaaagagggagggagggggggaaaaaaaaaaaaaaaaaaataagaacagaaaaaatgaaaaaaaaaaaaaataaaaaattagaagacaactaaaataaaattaactataaagaagggggtgcggcgtttttaaggggcccaagctttggcagtcccccaccttgaaaagaacttgtgggggggggggggggttagcccagcttgttttacttgccgcgttgggttgaaccggctggggtcttgtggaagagcttgcggctttctcgcaattttcgactgcggtctgcgccactcttgcgtgttcatctgggtgcgggctctttgtggcggggtcttcacacgggtggccctttgccctttttttgcgcggctcttgccgggctactttgccctcccccctcgttgcggtcttttaacgttggcggggttgttttttcccgctctttccccccgtttccctgccaggttccgatttagggtttttttttttctttcccctcggtttcttcccgggggcgctggtttt

SEQ ID NO: 15959 - DNA, 643 bp, Sorghum bicolor
  Clone ID: LIB3481-042-Q6-K1-D12
gctttcgtattcccctcctccctcggttcggggggggggggtgctactgccgcgccgccggcgacgtgagctcgcgacgacgacgacatgagctcggtggtgaagctcgggacgtggggcggcgacggcggcagcgcctgcgacctcacggtggcgccgcagcggctggagagcatcaccgtgcgggggggggaggtcatcgactggatctccttctcctaccgtgaccggagcggggagctccacaccgccgggccctggggcggcaacggcaaaggcgagggcaccgagacgatcacgctggagccctcggagtatgtgacgggagttgcgtggtcagtgggcccattcacgttcaagaacgtggagtgttgcatcacctccatcaaggtcgtgagcaacctccgcagctacgggcctttcggccatggggtagacagcacgcaccacagtctgcccgtgctcgacggcagcgtcgtcggcatgttcgcccgcgcaggggattttctcgacgccatcggcttctacatcctcccagctgccctcccagctgctgtaaaacctacggaccctaataaccaggaagaaaaagagaaggactctagccaagaaggaaaccaagaggagaagggggagcaatctg

SEQ ID NO: 15960 - DNA, 395 bp, Sorghum bicolor
  unsure (1)..(395): unsure at all n locations
  Clone ID: LIB3481-042-Q6-K1-E11
gcgtccgnccgctctagctcctcttatacacgtgggggtgagctgtggagcgtcttgcagtgacgctgtaaaattttccaggctgccgcagctaatgtaagctaagctgcgagtggtccaccatgtgtgccgaagcctctaatgttgcaaacttgctacggctgtaacagaaacatgtacgggtgaaataaactgccctactgatgatctaatataacaacgagagtctgacgcggcaagttcgaaattgccgtcagggtttaaataaagttcagacattcatttgtcggattccttcaataggacatactaattagttgtaagcagcgaatgagcctgacggttatcntgaaaagtcatgaccggaagtttgctgatttattatgagagaaaaa

SEQ ID NO: 15961 - DNA, 656 bp, Sorghum bicolor
  unsure (1)..(656): unsure at all n locations
  Clone ID: LIB3481-042-Q6-K1-F5
gcgtccggcatgtcttcttatttcacatatgtgtagccattttccagatagaaaggttcaaaccatgtcttctttatttaaatactgtataagatgcctaagatgcttgtctagaatcacaactatgtgtagccattttctagattagaaaggattcagaccatatcttctttatttaaaatctgtataagatgttatagcacgacacaggtacgaatgcttcgttggccaaattcggttgaattttctttccatgtctatattgcgtgtttgcatgggtggttttagtgcatttgtgttttcatctatctatcattatggtccatacttagatgtcatctcttagttttgtggaggcaaggtttgcatcaagcaatacccatataaaatcttccacattatcttcaatcattcattcattataatgataaaaaggtaagatttcagtgatataaataagtggcatgaatgaattccacctgattgaaacataactggatcaagaagtgcagtaaacgtggaaccaaaatttgaaatcatgtttgacattgtcgaggaagacttcacaatgagatttctttatgtgttctagttcagttatgaagatgggcaggagaggatgaacctggggttgccngatggacctaagactggta

SEQ ID NO: 15962 - DNA, 220 bp, Sorghum bicolor
  unsure (1)..(220): unsure at all n locations
  Clone ID: LIB3481-042-Q6-K1-G6
cgcttccgnaaaaaaaaaaaaaaaaaaaaaaaaagggggggggagggggataaaaaaaaaaaacaaactaacatacacaatgcatacaaaatacatacactcttatatagaagaaacctaacattctctttcactggtccgccgaacttacaacgtcccggcacgtgggttaatccctcggccttacctcaacttaaacccctcttgcggcggggggggg

SEQ ID NO: 15963 - DNA, 241 bp, Sorghum bicolor
  Clone ID: LIB3481-043-Q6-K1-C6
ttttggcgatggggactctccctgaagcgcccctttaagcgcgccttgtgtgggggttacccccagcgtggccgttggctttgcctcctccttagggccctttccttggggttttttgggtttctttcccgccgggtccgcctgttttccccggcaagttttaaacggggggttccttttagggttccttttttgggctaaacggccccttttccccaaaaaattgtttagggggggggtt

SEQ ID NO: 15964 - DNA, 523 bp, Sorghum bicolor
  Clone ID: LIB3481-043-Q6-K1-D5
aaaaaaaaaaaaaaaaaaaaaaaaaaggaggggagaaaaaaaaaaaaaaaaaaaaaaaaaaaaaaaaaaaaaaaaaaaaaaaaaaaagggggggccgtttatagaggatccaggcttacatccccgggcctgcggcgggggggcttttttgtggggcccccttaattcacttcgctggccgtttttttgggggggcggggctggaaaaccccgggcgttccccgacttagtcgtgtggcgggcccatccctttttccccggggggcgtactgcctaagcggcccgccccgttcgcccttcccatcagtggggccgcctgagtgggcggtgggcccccccctgttgcggtttattaaccccgggggggggggtgtttccccccaccgtgaccggtgcacttgccggggccctaccgccggttccttccgttttcttcccttcctttgtcgcgccgttcgcctgctttccccttcatgttttaattggggggctcccttgcgggtcccgttttactgctttgcgg

SEQ ID NO: 15965 - DNA, 559 bp, Sorghum bicolor
  unsure (1)..(559): unsure at all n locations
  Clone ID: LIB3481-043-Q6-K1-E4
aaaaaaaaaaaaanaaaaaaaaaaaaaagaggagaaaaagggaaaaaaaaaaaaaaaaaaaaaaaaaataaaaaaaaaaaaaaaaaaaaaaaaaaaaaaataataatataaagaacaaaaaaaaaaaaataagggggggccccctttaaaagaacctagttttctgtgcaaaaccctggcgtttccctactttttttgttgggggcccttttttttttcgcctggcggtgtttttcccacggggggcgggggaaacccccgggccaacccattttaatcctttttggcaaatggccctttccctgggtgggggtttttaccccggggcccgtgctgttttcccttccttgtggttntgcacttgccttggccttggcgcccccccttttcgctgcctttcatccctttgtggggtggtttttcctctttccctgcccgtttcttttgcgtgggctctctttccggttcttttgtatttttttcctgcttttttcccccctttcgctggttttccctgatggtttttaattcgggggatcctttttgggttcgttttttt

SEQ ID NO: 15966 - DNA, 350 bp, Sorghum bicolor
  unsure (1)..(350): unsure at all n locations
  Clone ID: LIB3481-043-Q6-K1-F9
gcgtccgactcattactttcattgagcttataaagaacccagctacagcttctggactcgatcctttcacactgtgctcctgagatagagaagctttttgagtcggttgcaaggtcctgtggaggtaaaggcgcggacgatggaatgggtctagcggacggaggccactaggggaacatgcctagcatcgacgaaagcatcagatgtggttttgctgatattgtatatagattagagtaggacctgggtggtttgctttggatgtaagatgggcttgtgctatgctggaagttgaggctatctctntctctctataacacaaaagtcaggagaaaccgtgggcaatggat

SEQ ID NO: 15967 - DNA, 611 bp, Sorghum bicolor
  unsure (1)..(611): unsure at all n locations
  Clone ID: LIB3481-043-Q6-K1-G5
gcgtccgcaacatttgttgatgcttcatgttggagagccctgagtcaagnaagatgcattccatctgcctgaggttcaccacaatattttggaacttgatcattgcgccttggaaatttttgtttgcttttgtgcccccatacaagattgcacatggctggattgcttttatatgctcactgatcttcataagtggtattgcttatggtgttactaagcttacagatcagataagctgtgtcacaggagtaagtccatatgttattgcattcacagcactggctgctggaacctcatggccagatctagttgccagcaagatagctgctgagcgtcaagtcactgcagactctgcaatagccaacatcacctgcagtaactcggtgaacatatatgttggcattggtgttccgtggttgattgacacagtgtacaacttctttgtttaccaggagccattgtacatagataatgctgctggtctcagcttctcccttctagtcttctttgcgacatcatttgtatgtattacggntttggttctgcgccgcattatactcggtgctgagcttggcggccctaggctatgggcttgggttacatcagtctac

SEQ ID NO: 15968 - DNA, 441 bp, Sorghum bicolor
  unsure (1)..(441): unsure at all n locations
  Clone ID: LIB3481-044-Q6-K1-A10
gcgtccgccccgcgtccgccccgcgtccgcttacgctnggggcggctcgcgtacactgggcgcgcctccccgctcgccgccgccgctcctccacctcttccatggcgttcctccaacccgaacccctctagccctctcctcattcctctccttcctttcgctctcttttcaccaccggtggggggggggggcgcctccatcgctcctctgtcgcctccagcatcgcatccggaacgacgacgtcaaactgttccggcatctaccgagcccagtcttacggagtaactcctcatgatgcccactgagcgaatccgatcagcttcgtnatcgatggcggcagatctaggctcgagggcagcggatccagttggctccttcctcgatggcggnngatctgggctcaggggctgcgtgtccggttggcctacgccgggtgctccg

SEQ ID NO: 15969 - DNA, 268 bp, Sorghum bicolor
  unsure (1)..(268): unsure at all n locations
  Clone ID: LIB3481-044-Q6-K1-A8
tctttcggtaagttatgacttgtatgacccgggnatgttgatagaccttgcaaactgtgaaaaaatgtcaactgatgtgaatgatgtacaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaagcgggggagggggggggtttttttatagggaacaccaaaattaaattcacctggccgaaaaaaaaaaaacttaataaactggcc

SEQ ID NO: 15970 - DNA, 660 bp, Sorghum bicolor
  unsure (1)..(660): unsure at all n locations
  Clone ID: LIB3481-044-Q6-K1-A9
gcgtccgcccagcgtccgnttttttactggggagggggggggcatcaccgatctaaagttcacaggcgacggacaataccttctaactcgcgactacatgaacctcaaactctgggacctgcgcgtggaaacctcacccgtcgcaacatacaaagtgcacgagttccttcgcccaaagctgtcgggggtgggcaccgacgactacattttcgacaggttcagctgctgcgcaagcaaggatggcgcctacttcgctactggatcttacagcaataccttcaaagttttctcccgtgctgctgcgcagacaagcggcactacgttggaagctagcaccaacccttacaggatacaattacaggctcctacaaagcttccagcgctgctcagcaatttccctcttggagttaatagaaaaggtcatgatggtccgaggtccgacggcaaggaggaagtttcatgcaacatggcatcaaaggtgaagcatctagcatggcacccggcagaaaaatcatagtttgtgcagccaataacaacttgtacatgtaccatacataagcatactccagttatgtgtacagaccacagaacagcattcaaaactaaactgatgccagaaaagatatgcttttccatgttaaaaaaaaaaaaaaagggcgg

SEQ ID NO: 15971 - DNA, 647 bp, Sorghum bicolor
  Clone ID: LIB3481-044-Q6-K1-C5
gcgtccgttcagtgagaagatgctcttggtatggcaagcactggtggtgcaaaagtggtgaggtcatgtatgatcagcggctgttcaaccaggacaagggaatggactcaggttttgccacagatgatcagtacaacatctattctaagggtctcttcacagctcagtccacgatgtccacactatacaggcctaagaaggatggggattcagatgtatatggtgatgcagatgagcagttggagaaggttatgaagactgagaggttcaagcctgacaagggatttactggtgcttcagagaggactggcaagcgagacaggcctgtggagttcgataagcaggaagaaaatgatccatttggtctggatcagttcttgactgaggtgaagaagggtaagaaagctgtggagaagattggaggtggaggaaccatgaaggcgagtggtgggtcctcaatgagggacgattatgatggtggatctgggaggtcccgcattaattttgaaagggggcgctgaggtatctgctctgcttctgcagattttgaatgctttctcaaatatcttctagcaggaggtcataagaagctgaactctgataagaaaagtgtggcacctgtgctgttactcatgtgcctactttca

SEQ ID NO: 15972 - DNA, 564 bp, Sorghum bicolor
  unsure (1)..(564): unsure at all n locations
  Clone ID: LIB3481-044-Q6-K1-E6
gcgtccggttttactcacacaaacccattcttctggccgttgttcactacctgcaccaaaaactccaacaaatggaagtgatatcaactgcatcaagggctcttcgattagtagaggtgatgttagcttcacgaatggctcatttgtcaatagacccatcgacaacaatgaaccaaatgttgctaggtttgacttcaggtgatgggaaagttgaataatgagatgcaaaaccactataatgatcatgctcctggttttgacactcatgctgcagctagtgctagccggaatgccaatggtcttgtatctatgcaggccagttttggtcgcatgtcctctacagttcaatctgttgctgatgtttcagtgaccagcacatctcaagatcagtgtgantttgcgacttggatttggtgcacagaagcagcagatattttctagccatggacagcttagaacggctacagttgggatcccctccgccgagcagtgccaaaaaaagttctgtacccactgaatcctcacagtttgggagcatggatgggcctaaaatcttccccactg

SEQ ID NO: 15973 - DNA, 648 bp, Sorghum bicolor
  Clone ID: LIB3481-044-Q6-K1-E7
gtctttcgcaacacattttctctttgttattgggtggacatggaatcacatgctttttgtgaaacaaggggaaacaggctaggtttacttgagcatgcctcagtcagtgccaaatgttttaaatatttataagttctttcctttctaaaaaatgaaaataaacagtaacttagtacccttacgtggttatgtgttaatgttaatcatagttaaggttcattaaactaatgctggatgttttccccttctgaaattttgtaccattttatctttgcagttaaaagttgtgaagctacaccgttattttggatagtttatgttaaaaccgtatcctgaatcactgaaagaatatccgtttcatatagttaattgatgaaatttgtaacaaactaatattttttttgcagtcgcatgtgttcaatattctggctataaattaatcctatttatatacaataatttaatgattcctatttatgtacaataatttaattaatcctaatttaatttgattaaggtccgaattataatcatcttgcaaatatgttccttttggacctagtaaaatcctcataatcaggattttgatttgtacagccatgcccacttcgcgggctccatgtttagatcatgtgaatcaatgtaatc

SEQ ID NO: 15974 - DNA, 406 bp, Sorghum bicolor
  unsure (1)..(406): unsure at all n locations
  Clone ID: LIB3481-044-Q6-K1-F8
gcgtccggnaaaaaacagnatatagcttggaccccttggttcggcaagttggcgcccctattccattgaagaggccagctcttagtgctgaaccatcagttcaagtacgcaagctgaaaccaaatgacctatttctgatatttgcttcggatggtctttgggagcacctcagcgacgatgatgcggtgcaaattgtcttcaagaatccaagaacagggatagccaacagattggtgaaggctgccttgaaggaagcaaccaggaagagagaggtcaggtaccgtgacctgaggacgatcgacaggggagtgaggcggcatttccacgatgacatcagcgtcgttgtggtctaccttgatcgccaccgcgagcgccgccacaccagggtcatcgattcgagcagcaa

SEQ ID NO: 15975 - DNA, 559 bp, Sorghum bicolor
  Clone ID: LIB3481-044-Q6-K1-H12
gggtttgttggttttttttttttttttttttttttttttttttttttttttttttttttttttttttttttttggaaccaaaagcgatttgagcccctcggggaagaaagggttaaataaaacttatgggacacacgagttccaccaacccaagaggggggggggggaaaaaaaaaaaaaaaaaacgggggcaacacattgactcccaaaaatgaatgatacatcgccgccggtcctggggacaaagggttctccggggaaaacaatcccgggcggccaaaaatagtttaaacgacggggtaaaggatgatttttgagggggggtcaagcctttgcccctggtggtttttaataataatcgcggccgaggccggggggtcccccttggggccgtcccccccggatgccgcaaccgcgtgggacccggggcccccggggggcgggtggtaaaaaaggcccccggtctgcgggcaatgggaggggaaccccgccccgatgcgcacccccatgtccaggagctccacgtacttgggtgaggaaaaaggcatggggatctgct

SEQ ID NO: 15976 - DNA, 527 bp, Sorghum bicolor
  unsure (1)..(527): unsure at all n locations
  Clone ID: LIB3481-044-Q6-K1-H5
gcgtccggtggcacggcgcttctgctcggggggggggggggcggcaagnacatccggcaggcggcttcgcgcgggtcgttcgccctcctgtggtgagcctctccccatcgcatagcttttcctctgcgtcaacgccatctcaccggcggcgggcgtgcggccggcggacggaggccggaggcgatggcgagctcgtctgtggcggcggacatggagctagaccgcccgaacctggaggactacctccaatccgtctcgctcccgcaggaggcgccccattatctccatctgcgtgatctgctggacatctcgccggtgctaacccaggcagcgggtgccatcgtcgatgaaaagggatttggtgaactccacatcagaaagcacttccagtaggtatacaagatttcagagggaggctcgtcaagcaacaacattggtgagatgatgacatgtggcgctgatagaaatctcatctcacgggctgcatagatgttaggaagtctagcctagttgcatattttttaaaa

SEQ ID NO: 15977 - DNA, 213 bp, Sorghum bicolor
  Clone ID: LIB3478-054-Q6-K1-E3
cttactggtcattagctgggctaccctgccgcgctgctacgcaacaccgtggaccgcggtggcgtgtgaccgtggcttctgcgtctctgccgcgttccggcagccgcgtgtggggctcgtggcgcgcgtgccaggtctccgcaaggccacgtacgtaaggtgttttccacagggggcgctatgtactgtcgttggtgcagtatttagacggct

SEQ ID NO: 15978 - DNA, 563 bp, Sorghum bicolor
  unsure (1)..(563): unsure at all n locations
  Clone ID: LIB3478-055-Q6-K1-G7
aattcccgggtgcgacaccaacgcgtgcgcgggtaaaaacacaaacatttgtnngaaaagggcanntcttactngnngcgagatgtcgagaaagaaaatnnatgaagcccacttannttggtgtnnggaagtgtcacgcgctctcggnaattttagcacataagctcgtggcgaaaaataccgcttcttattgcgtgggacacatcgctgggcaaagaaaaaggttcggtgggcctcangaggatggcnntactacattcataggtcaagtggtgccactcatnnntatgtttgatggttacccttcgaaggcnttgacatnnacaagannatgttccaaccanntggcacnaagggaccccctgtgcnnagggtngtngcngangaaccatntnncccattngnnttctcnntgtggtaaaccaagggttngnnatgtaaangaaacccaggcaagnnntcaaagccccaagcannnagttaccatnntccaaacaggannagaagaaannnttgcagtacttttatgagaatttnnctgcaaagaaagcaattacccaact

SEQ ID NO: 15979 - DNA, 285 bp, Sorghum bicolor
  Clone ID: LIB3478-055-Q6-K1-H12
accacctggccaccacaggaaggacgaggagcagctggagcagcccgtcgccggcggcgggtacgggtacggcgaggccgccgagtacacggagaccacggagacggaggtggtcgccaccggcggcgaggacgagtccgacacgtgcaagaaggaggagaaggagcacaagcacaggcagcacctcggcgaggccggggccatcgccggcggcgcctgagcactctacgagaagcacgaggcgaaaaaagacccggagcacgcgcaccggcccaagaccgagga

SEQ ID NO: 15980 - DNA, 241 bp, Sorghum bicolor
  Clone ID: LIB3478-055-Q6-K1-H5
gaccacgcgtccgatccagggctacgcggcggcagtactactacgtccatcatcatgatggcattactactacgcggcctgctatgcccagcggggggtactacgggctgcgggtggacagaactttcagaacccgcaacctgatgagtggataccggtctttagcgccgacagcgcggagcaggactagctaggcatatcatgaattgttgcaatgaataatatatgcttgcactcaaaa

SEQ ID NO: 15981 - DNA, 517 bp, Sorghum bicolor
  Clone ID: LIB3478-056-Q6-K1-A6
ccggagatgagagcaaactgataagcgaccggatgaagtaccttctctacgaggtcccagttagagttgcaggagggctgttatttgagcttcttggtcagtcaattggagatccaaatcgtgaagaggaagatatacctattgtgcttaggtcttggcaagcacaaaattttcttgttacaacaatgcatgtcaaaggcccttcatccaatataaatgtgttaggagtgactgaagtgcaggagttgcttcttgctggtggaagccaaacacctagatcagtgcatgaagtaattgcacatttggtcagccgtctttcacgttgggatgacagattattccggaaatatgtatttggggaagcagatgaaattgaattgaaatttgtgaataggagaaatcgtgaagatcttaatcttatcagcatcatactaaatcaggaaatcagaaggttagcaacacaggtaatcagggttaaatggtcacttcatgcaagggaagagatattacttgagct

SEQ ID NO: 15982 - DNA, 594 bp, Sorghum bicolor
  Clone ID: LIB3478-056-Q6-K1-G6
ttaatgtcactcgatgtccaaatatcattaatgtggcatgctaacatggagtgggagatgtttggatgccaagtaggctgatcaacgctaactagagatgtgatctcgaatgaagcccttagcaaatttaggttcccagatatgcaaattaatactttaactatctagatgacagccctaaacccggtttaactcctggtgcattttaatcatatggatgttcttggaggactaaccataattatgaagttaagtccatttggtttatattatattttttttactgtgttcagtttgattgttgatccagataggatgttccttcactactgcagcattgtttttccccttgatatttgaagcctttcatctgtgatagtaaataatgtgtcttcacaacgactgtttctgctgattactatttactttgattttagttttgctgcaggcctggttgtagttatccatatattaaaaaaaaagttcaagcctcctatatgcttgtggtaattcttttgtagcccgaagttgaatgtacttaacttgcttttcttgcagatcataggagtcagcaaatcattggatgtccctggg

SEQ ID NO: 15983 - DNA, 402 bp, Sorghum bicolor
  Clone ID: LIB3476-001-Q6-K1-A3
ccgggccgggctcaccagctggcccagtgaaggcttaaagacatgtgccaggagaaggggccttgaacttgtgtggtctgcaccctaattattgctcagatgtggcaatggagcttctatattaagcttcgatgagaagaaggaaaggagatgtcaaggtcttcacagagaccgaggaaaacaaccagattccagggccaagggcttggaatcccatatttcctttgacttcaggtggacaattttagaaggcaatatttaaatctggaaggggtaaagaacaatcagatggtgttaattgtggaggttcagatcataatgccatctgatgcattccatttctggtttcttttgaacacaagtacaaaaaaccaacgggaggggcataacttcctgtgttcc

SEQ ID NO: 15984 - DNA, 277 bp, Sorghum bicolor
  unsure (1)..(277): unsure at all n locations
  Clone ID: LIB3476-001-Q6-K1-F12
cgtccgaattcccggtcgaccagcgtccgttcaccaccgctcccgggctggggatggcgcgtgcctggcctcgccgcgcccggccgccgcgtcgcctgggcgcctgctcgcccggacagcccagcacctcgtcctgcgcggcgacaccgacagcgcccgggcgtcgctgcagcgccttcgtggccccgggggggggagggacccngagctcaaggacatcttccgagccgaggaggacgcccggcggaacaaccagggaacgtacgagaggatggtg

SEQ ID NO: 15985 - DNA, 311 bp, Sorghum bicolor
  Clone ID: LIB3476-001-Q6-K1-G1
gggcgaccacgcgtgcgagcattatcagattcttcgtctgcatttgtggggagattattaggagtaggagtaggattactacgttattattactagtgagtgagtgagtgagtgatcgagcgaggatgctggcggtgttcaacggcggtgtggtggaggtgccggcggagctggtggcggtgggaagccggacgccgtcgcccaagaccagggcgtacgagctcgtcggccggttcctgggtgcctccgagccggccgtcttcgtgcagattggcgacctcggccacctcgcttactaccacaacaaccag

SEQ ID NO: 15986 - DNA, 269 bp, Sorghum bicolor
  unsure (1)..(269): unsure at all n locations
  Clone ID: LIB3476-001-Q6-K2-C2
cctgcctaccgtccgcatcccggtcgccacgcgtccgcgctacccactcgcgagcggaacggaattngttagagagcggaagcggcgccgaccacccagaccattcatatattggcgacgccggaggccaatgatggcacggacgctgctaccgctgtggggggggccgagccgccgctacctagactgcaccttcacaggccttctcaccggctgaaagactgaagtatgctaacactaagatggctgaggcgagggtgatcgcaaca

SEQ ID NO: 15987 - DNA, 188 bp, Sorghum bicolor
  unsure (1)..(188): unsure at all n locations
  Clone ID: LIB3476-001-Q6-K2-G2
gtcccattccggtccccttgagatggtcatgatggcagtgaatgtgatggcctggcttattagatgcactcgtgagcacaatgtgcagcccattactgcttgactcttttggtatggctgagaccttatgctcacaattttgcanattggctggggacctatgacatccgagattagtccttttgagg

SEQ ID NO: 15988 - DNA, 303 bp, Sorghum bicolor
  unsure (1)..(303): unsure at all n locations
  Clone ID: LIB3476-001-Q6-K2-H8
agcgtccgtacagctgcaaaattctgatcgaccgttttccgactttaccccccccccccccgcccttcaccgtcggaatccacccgcacgcgcgccgcgggagatggccacggccgccgcgaggccgcctacggctccgccgtcggctgcggcgggagatgtctccgaggtggagctctcggaggggggggggccggacctcggcagccggagcagcgggagcggnagcgggggcagcggccggagcgcggcggagtactccgggtgggtgtaccacctcngngngaactccatnnnncacga

SEQ ID NO: 15989 - DNA, 129 bp, Sorghum bicolor
  Clone ID: LIB3476-002-Q6-K1-B5
aatcccgggtcgcccagcgtacgcacttctattgagagacatacggtgggggggggcatgcaactgaatctgacatgacagaagctgccaggatctcagaatgcccatcactccatcagcagcctgcct

SEQ ID NO: 15990 - DNA, 104 bp, Sorghum bicolor
  Clone ID: LIB3476-002-Q6-K1-G2
ccttctatattcagctaggatgagcagactggatgagatgtctagttcttcacagagacagaggagaccagcctgatgcgaggcccaaggactgcagccccata

SEQ ID NO: 15991 - DNA, 191 bp, Sorghum bicolor
  Clone ID: LIB3476-002-Q6-K1-H2
cgccgcaccagcagcgccgacgcccacaccgaccctaccgcgagctggtgccggcgctgctctcgactgctctcgtagccgccccggcaataggtcctacacacccagcggcggcatggcggaggagctggtgctggacacggagaaccgagactggaggctgatcgcgctatccgtgattatggacctga

SEQ ID NO: 15992 - DNA, 171 bp, Sorghum bicolor
  Clone ID: LIB3476-003-Q6-K2-E8
cggtccgcattcccggtcgcccagcgtccgccactttcccatcccttgccgtgtcttcgttacctatacaccatcaacctaaatccccgtcatcttcttcgccaccctctatgaaagccgccataaaggctcccgtagaagctccaggaggaggaggaagacgaagaagga

SEQ ID NO: 15993 - DNA, 263 bp, Sorghum bicolor
  Clone ID: LIB3476-004-Q6-K2-E6
ctgcaatggctgctccacgcctcgccctggtggtcgcgaccacggtggcggtcctggcggcgctgctgctggctgttctagagccggcatcggcggcggtgagctgcagttattttacatcctggggggcgcgcgtgcctcactactctatggacaccacggcgtccccctccccggtgtgctacaccggagtgcgctcgctcaacagccgcgcgtcatccattgtcgagcgtcatttcacttgtgcctgtctcaagagcatt

SEQ ID NO: 15994 - DNA, 435 bp, Sorghum bicolor
  Clone ID: LIB3476-005-Q6-K1-C4
cccaaagttccttcccttccccgtctctttctcccccctttcaacttttttggcccttgcttttcttggccattccttggttcaatccgaaaggcttggaaccagggcaaattggaaggtggcagaaaaaacggaaggggctttccttctggctccgtgggaaaaggaacaggggaaaaccccaccccaccaaaaagaggctgcaggttcccgaggcccggccttttttggcgggggcaacatgaaaaagctgttcttcgtctccttcgtcctcctgctggccgttccagcagttaacggggaaaatggggcgtccattggcgtgaccattggcacggccatgtcgtcggtgccagcgccgacgcaaatcaccacgctactccgttcgcagaacatccgccaggtccgcctttacaacgccgacccagcgatgct

SEQ ID NO: 15995 - DNA, 243 bp, Sorghum bicolor
  Clone ID: LIB3476-005-Q6-K1-F2
cgccccgcgtccgggactgtgggtcgactaggcgtgggggtgggttacacaagtatgcgatcatcccaaagcgaactgcgttgttacctatatacctccatgggcgtcgcactgttgatatgattacaggcctctatcaagacttgccggaacttgggggagatttttcgcagaggggggtgggagaacaccatcttctaccgcatcatcaaggattacattgggctacgtggtgatcctact

SEQ ID NO: 15996 - DNA, 213 bp, Sorghum bicolor
  Clone ID: LIB3476-005-Q6-K1-F3
acccagccttccgaagaggtaagtgatgctggcatgacatcaacacttaatacatgcctgggatggatggacacccgaacatagtttgctttctgtggctttgagggggcataagggtcatatgaagagataccaaggaccgaactacattgctgggagataataataacggaaatgtttgatgagcctcagatggcgataactgatggacct

SEQ ID NO: 15997 - DNA, 342 bp, Sorghum bicolor
  unsure (1)..(342): unsure at all n locations
  Clone ID: LIB3476-006-Q6-K1-B12
cagccatataatcacactggaaggtctatagccactaaagagcaatgctgtagatagcgcacttgagggcactaagggaaatgtgagtgttgttccaactaataatcaaactgggagtctggcattggcagggcagaaagatgttggatctcccaggaacaacaacacagttgtagcatctccctctgtaaagaatcaggagcagaccgggagccaagttgctcccagcgggagcactggtacagcgaataatccgaagggggatgctgctcanggcagtgctggttcatcagagaaccattcgacccaagcgaactcctcaaaatctggaaataacagtga

SEQ ID NO: 15998 - DNA, 156 bp, Sorghum bicolor
  Clone ID: LIB3476-006-Q6-K1-B6
gcgtcgagctttccactatccctccatgtctcagcgcactgatgtcgtatctctgagtatcctaagaaggtaaactgggcccataccgctggctctccctttttgatctacatcttcttcaggctctctttactggtacaatcgatacatcagcat

SEQ ID NO: 15999 - DNA, 243 bp, Sorghum bicolor
  Clone ID: LIB3476-006-Q6-K1-C6
gcgtccgcaggactcatgtgggggcgcttctttttcaaaatccacacaggagcgaccctttctcggcagatcatgatggaactctttttttcagcgaccacacgggggcggcctttcccagcagaccagcaggaactagaagtcgcgctatctgagccagctacccttcacggggccacacccgccgactgacagtgccattctacggaacatctttccattggccaagcagttacactaatc

SEQ ID NO: 16000 - DNA, 328 bp, Sorghum bicolor
  Clone ID: LIB3476-006-Q6-K1-F10
accgtcccgattcccgtcgaccacgcgtccgttcgccactctccccgtgcgcaaatccgtagatggaaggggacaaaatgcccagggtgaggctcggtaagcagggtcttgaggtgtccaagcttggcttcgggtgcatgggcctcactggtgtatacaacgcccctgttcctgaggaagctgggatcgccataatcaagcacgcgtttgaggccggcgtcaccttcttcgacaccgctgatgcctatggaccacataccaacgaggtcctgcttggaaaggcattgaagcatttgccccgtgagaaggtgcaagttgccaccaaatg

SEQ ID NO: 16001 - DNA, 213 bp, Sorghum bicolor
  Clone ID: LIB3476-006-Q6-K1-F7
gtcgatcgtcgaccacgcgtttttgagtgccaaattggcacaaataattagagatatacaacgactacgttctaaggagcgtaactgagcacaaccaccaaacacatcttatgtgggtcggcacatggccatctgaaaaaaaacaaaatggataggccaagccagaaaccgaacaatacaccttgcactgcatccagactcataacatacacc

SEQ ID NO: 16002 - DNA, 193 bp, Sorghum bicolor
  Clone ID: LIB3476-006-Q6-K1-H10
tctttctcaaatggttctgcctagacaactttatataatgatcacacttacgcctaccaattctgcttgggcttagtataaacacattttataacacaaacctgcatataccttcaacataattataacaatatatgctaaacctctgttgccaaatacctccctaaacagacataatagttatattacctct

SEQ ID NO: 16003 - DNA, 202 bp, Sorghum bicolor
  Clone ID: LIB3476-007-P1-K1-A2
actatgtccaccgaaaccatccgaatcttatccaaagccaaaaaacctacaagaccatcatcgttgctggcagcacggccaagaggctgctgcgtggctttctccatggtctcacacatgacctagacgccggcaggtgtcaccacactgacactccacaacctgtgcctgtaccctacgtggccgctgatgaccccgaaca

SEQ ID NO: 16004 - DNA, 151 bp, Sorghum bicolor
  unsure (1)..(151): unsure at all n locations
  Clone ID: LIB3476-007-P1-K1-A3
ccacgcgtgcgcgcacacctaccctacccgccgcccgccgncgccgtcgaaggcgaagaccacctctcggtccggcgcgatggtcgccgcggaccgacgcgaccgcgggacgcgcctcctggtggcgctcctgctactggcgctggacgtc

SEQ ID NO: 16005 - DNA, 248 bp, Sorghum bicolor
  Clone ID: LIB3476-007-P1-K1-B5
ccggtcgaccacgcgtcctgtcgccaccttcgcggtggtcgggttcgcggccgggctcgccgggacagccatctccaacgggcttatcgcgatgcggaagcgcgtggacccggcgttcgagacgcccaacaaggctccgcccacgctgctcaacgccgccacctgggcgctccacatgggtgtcagcagcaacctgcggtaccagacgctgaatggggtcgagtacctgctcggcaaggtcgcaccgg

SEQ ID NO: 16006 - DNA, 416 bp, Sorghum bicolor
  unsure (1)..(416): unsure at all n locations
  Clone ID: LIB3476-007-P1-K1-C4
aagtctggctggcactgagttcctgaatgatgtcttaaatgtatataattgaaactatatattcctctatattatgcagacgtgcctcggttttacatggctatacttatttcgtttgtgtataattttctgtaggaccgtaattgtttcaggtgtgttcacctttgtcattgctgcagaactggccagtcccctgattcttgtttttttctgacaagtaattccaacaactaccaaaaggtgaacacatatttcagctactacgtcgataactttgttatgttgcattagctctcaaattcagtttatatatccaaatgtctcacaactcattaggttcagcctatttttttaacttacagataattaattacttangctatcctattttttaacttacagataattaaatactc

SEQ ID NO: 16007 - DNA, 158 bp, Sorghum bicolor
  Clone ID: LIB3476-007-P1-K1-D5
cgactccgggtcgcccacgcgtccggggctgcagctaacctacctatagagctctgcccgcgcgacccgtcgctttccgtggaccggtagctgcgcaaggaacgcgtaggatgcggcatactgcgccgcgactagcagcagtaaacacaaaaaggggc

SEQ ID NO: 16008 - DNA, 265 bp, Sorghum bicolor
  unsure (1)..(265): unsure at all n locations
  Clone ID: LIB3476-008-P1-K1-B7
gggtcgacacgcgtccgactgttctagctcggagcgcacgccatgttagcatcgatccgagatccgacagcggcagcgccagcnagagcgagagatgggggctaggatattcggtcttgagaccccgctgatggtggcactgcagcacctgctggacgtgcacgacggcgacgcctgcgctgcgggcggcgacaaggcgggcgccggcgctggcggaggggacacgcgcacctacgtccgcgacgcgcgcgccatggcggacacc

SEQ ID NO: 16009 - DNA, 161 bp, Sorghum bicolor
  Clone ID: LIB3476-008-P1-K1-C3
accgcggtgcgccaaaggatcagatccccaactgccgaactgcgaaggagaaggagattggggaggaggccgtggcttcgggcacgcaaatcatcacccgcaaggatgaacgcgacccactcggtgagcattgtggccgagaacgtcaccaatccgagacc

SEQ ID NO: 16010 - DNA, 458 bp, Sorghum bicolor
  Clone ID: LIB3476-008-P1-K1-D3
cggcttgctgtaagtctgctgagtgtctgaattgtcgtttgaggtcttttcctcaagttttgtatcgattgtgaggtccaggtggacctttgacttttctaaactgtgctgtaacagatacttggtttttcgatgttaattgaaaagccggggcattagcccttgaactctaaaaaaaatttggacgctaatatgctcttggattggatgtgcaggggatattgtgaagtacctgttcaggcagtatggacaaggaaagagtccttctcctggacttcttgagagtacaattttcacaggatgggtgcccactcttcttagagctggaagaggaatgacactgtggaacaaagctggtgctgtacctgcaaagaagttggagctcttctcatatgagaataattcttatgcaaggatagttcgagaggctttctgtgaattggagcttccttatgttc

SEQ ID NO: 16011 - DNA, 222 bp, Sorghum bicolor
  Clone ID: LIB3476-008-P1-K1-D4
cgtccggggaaggtgggttcggatcatgtgtataagggctgcttggctgatggaagagaggttgcggttaataaactgaaagatgctggcgggcagggggatctcgagtaccatgctgaggcggatattatcagtcgtgtgcatcatcgccatctagtttctcttgtagggtgtcgctattcacatgaccagagactgcttggctatgatattgtgcccaac

SEQ ID NO: 16012 - DNA, 363 bp, Sorghum bicolor
  Clone ID: LIB3476-008-P1-K1-F4
acgcgtccgcataatatttgttgatgaggttgacagtttcctaggaaagccagaaaggccaggagagcacgaagcaatgagcgagttcaaaaatgaattcgctgataaactgggatggtttgcatactaaagagcaagaacatgttaccgttcttggagccacaaataggccatttgaccttggtgaagctgttattcgaaggtttccttgcagattaatggtgagcattcctgatgcgttaagtatagagaagattttaaaagtgatactatccaaagaaatgttggcgccagatgtggacctcatataagttgccagtatggctggtggatatatatggactgacttgaagaatctgagtg

SEQ ID NO: 16013 - DNA, 212 bp, Sorghum bicolor
  unsure (1)..(212): unsure at all n locations
  Clone ID: LIB3476-008-P1-K1-F6
gctcggcgtctctacctgtgtgggcttacgcggcccatcttcgtgcagagcagacacgggtagactggactgacaagccaaggcaagcgcgactcgaccgccagacagcctccaccatcgcgcgcgtcgccgagcccagaaccccagccacccaaaggccccgcgtacccggcgccggggcaccagcaaccgcccaagagcccctnctaccc

SEQ ID NO: 16014 - DNA, 196 bp, Sorghum bicolor
  Clone ID: LIB3476-008-P1-K1-H12
atcgtacacctcgcagctattgcaccctgcagctgaacacccgacgagggtaccagacggccggcagacccacctcaggaagccgggcgatcagacacgggagcaacagtaccgagagagagaatctactgtcgcaagagagactgagactgtgcattacagcgcgttgagaggcagtctggcgcacacttacatg

SEQ ID NO: 16015 - DNA, 370 bp, Sorghum bicolor
  Clone ID: LIB3476-008-P1-K1-H2
gagtactattgccatgtttcacagatagcattacaggatagcaaggggaatgaggatgtcagagtttttgtgaaggctgatggcagagtgtttctaattggaacactatcagttgacaaataccctcagtatacaactagtttggtgttctagaaggagtttgagttactacacacctcaaaaaccagcaccatctctgcccttggctacaaatttaggcattgcaacagaaaatatgacagcgaaacaagtactgaagagggtgatgaatctaatgaggaggttccacaggctattccattataccctaacgcagatgatgataaaagcatagaaagtaaatgtggtgtggagaatcctgctgctactg

SEQ ID NO: 16016 - DNA, 466 bp, Sorghum bicolor
  unsure (1)..(466): unsure at all n locations
  Clone ID: LIB3476-008-P1-K1-H3
ctccaccaccgaatctgaggaactagccgttggtggccgctcccttccacctccacgtcgccccccgccccccatggaatccgccagcgtggcgctcgccagccccgcctccgacgaccgacggttctgggaccgtctccgcacccgcgtcgacaccatcctcgaggaccgccgtgacctcccagccgccgccgcccccacgcgcgtggtggagtccgagcggnggaagcgcctccgggaggactccctgatgctcgtccgtggcctcgactccgtcgtggcgtcgctggcgcagctctccgacaccctcaccgncgcgcagaagggagtgagtgctctggcgacatgctcttcccaggcgaggggatgcgagggcggcgcctgccccgaggaggttgaggaggaggagcccaaggcgaagcggatgtgcggcggctccaccgaagattcaccacggaacagcaat

SEQ ID NO: 16017 - DNA, 234 bp, Sorghum bicolor
  Clone ID: LIB3476-008-P1-K1-H9
gcaatggcttctcaccagggtcaggtcatacctgaaagcggggtagcgtacgaggcgacaagccgtcgtatcaggacgtcaagttgccctcaccgccggcaggtctggtaagatctttaccggctctgccaccgaccactaacctgggcgggaggatctggggtctgtccttgattttggcacaagctgcggagtgggaaggtcccgaaagatactgagtcaactgggatcatg

SEQ ID NO: 16018 - DNA, 466 bp, Sorghum bicolor
  Clone ID: LIB3476-009-P1-K1-B6
gtcgaccacgcgtccggagacgcctcgctgaagctggtgcttatgcattggaaaaattaaatgtcacgagtcacagtctgtcctaatatcaaaacagaacgtggggtggatattgtgggtaaatatatgtaaggatcgatatacctcaatctaactacttaataagataattcttatactgtgtggactggctgacatgtgctttgcgctcattggtgcaccaagtgcttgatggaacagtgctcccagacccactgcagctgctgcgccctctgtgcactagcatacgcccagccactctactacaggctcagattcaacatcatggcggacaggctcacctgagcgcagcaacaccacggtcagaggcacgtgcctgtacatgtccaacacctaccactacggcgcctaccacttgacagtcattctcttggtcaaccccaacaaggtcgaaaggattctgctc

SEQ ID NO: 16019 - DNA, 275 bp, Sorghum bicolor
  unsure (1)..(275): unsure at all n locations
  Clone ID: LIB3476-009-P1-K1-E12
actaaaactgatactcactctgtgcacctgacgacgagacccactacactagacacaataattaatactaggcacaagcagctcatcatacacacatgatgactccggcggtgctgttcctgtggtcctgatgtagagcagcngcagcagcgaggacgcggcgtgcggcagctgccccacaccaccatcatatcctgctacaccgtcgaccagcagacggcggcacgcactgccctccggcgacgacaaatacggaaagagccccaaaaacgcgc

SEQ ID NO: 16020 - DNA, 392 bp, Sorghum bicolor
  unsure (1)..(392): unsure at all n locations
  Clone ID: LIB3476-009-P1-K1-G6
tatatctctttttgatgcgacatgaagcaagtaatttgcagtacagtgatgaacgtagtaacatgagtaacaatgtgttanggatcgcaaggctcggtgttagatctccaaatggaatccctggatttccctaccattgctcaggctgtggggaatctcaaagattccaaaaggtcttgcaaggtcaagaagtgcctcgtcctttccgaggaggatgtttggctgatggccatataagaactgctggcatgtatcaacctaaatggcctgcaccacaagggtgtgattttccacagccagcaaaacccgtacttgtgttgcaagcatacctcccatcatctgtgctgatgtttacacaaactgggtctaagataacttcattggaatatgag

SEQ ID NO: 16021 - DNA, 238 bp, Sorghum bicolor
  unsure (1)..(238): unsure at all n locations
  Clone ID: LIB3476-010-P1-K1-F4
gaaaccagaagacacagagaagccagccaacgaggccgaggaggcaaacggaccaacacaaagggaagaaaacacagcacaagcaccaagggaagaagacaagaaggaaacgcaaaagacagcagggagccgaagaaccacgccgagcacaaacgagaagaaacaaaggacangcgaagacagccgaacacgaaaccgacaggacaagnccaggaaggaaccgaagagagaacgcaga

SEQ ID NO: 16022 - DNA, 243 bp, Sorghum bicolor
  Clone ID: LIB3476-011-P1-K1-A6
gcgtccggaaaaaaaaaaaaaaaaaaaagaaaattgccataaataaacagtactacttgctaaaaacatttataaaaaaatgcccagctctcttaaagggtgaggctccattagagtgtgttggtccttaaaatgttgatcatgcttacacttaaactaaaacttagagtgccttaaaatactggggcggtcgttttattaatacacatttcttcttcctgaaataacatgctatatatttta

SEQ ID NO: 16023 - DNA, 559 bp, Sorghum bicolor
  unsure (1)..(559): unsure at all n locations
  Clone ID: LIB3476-011-P1-K1-B10
agtaccgtccgnattcccgggctcgcggtgctctgcgacgccgacgtcgcgctcgtcgtcttctccgccaccggcaagctctcgcagttcgcgagcaccagtatgaatcatatcattgacaagtacagtacacattctaagaatctggggaaatcacatcagcagtctcctattgatttgaatgtagagcagagcaagtacactggtttgaacgagcaacttgcagaagcaactcatgggcttagacagatgagaggtgaaaaccttgagggattgagtgtcgaggaattgcaccaaatggaaaggaaacttgaagcaggattgcatagagtgcttagtactaaggaccagttattcacgcaacaaatcagcgaactacaacaaaagggaacacagctggaagatgagaacaggcgtctaaaagaacaaatgcctcaggtgttaacgcctggcacaatggtggttgctgctagtgcagaaaatatcctcactgaagatggacaatcgtctgaatctgtaatgactgcattgcattcaggaagctcgctcgacaatgatg

SEQ ID NO: 16024 - DNA, 113 bp, Sorghum bicolor
  Clone ID: LIB3476-012-P1-K1-A6
cacggtcaccctctctgacttgaccgtgcaacatgccgtcatcgcgtggcgctcgcactcagaccgggcttgcaacgccgcatgactggaagagaccccgagcgcacgtgttc

SEQ ID NO: 16025 - DNA, 242 bp, Sorghum bicolor
  Clone ID: LIB3476-012-P1-K1-E3
ctcgcgcgcaatacgcgtcactcgcgcgcaatggcgcgcgcgcctgtcagcctggggacatgccgctcgcgatccgtgggactctcgcgcgtcgctgcatgggtcgcacacttgctgaagcgcagctaccggtggcagcggcacaactcgggagtctggccggcggcgggccgatcccggtctgcggggaccacggccgcaggcagcttggaacatgtgccgtgcggacgcatgttcgcgcc

SEQ ID NO: 16026 - DNA, 401 bp, Sorghum bicolor
  Clone ID: LIB3476-012-P1-K1-G7
gattcccggtctctccaacgtaggtctgctcagcctgcggtacatctaatttgcacctggcaccatactctattatattatatggatatggattattagtaatcgaaagtgaacttctgcccaattctgcccactctgatgggaagtttcatgctgcagagttcataaatctagtaatttactgcttttcttcgaatattttaacgctaaattatgactactataagtaacatctgacaccattcaggttatcaaaactatatcctactgcactgaccagttactataataataataatgagttatggtaattctccctccagatgttcgcaaaaaaaaaaacttcttagtggcagctagctaatgatgttattctcacacatgtctaacgagaaatcttt

SEQ ID NO: 16027 - DNA, 300 bp, Sorghum bicolor
  Clone ID: LIB3476-012-P1-K1-H6
cagtgtcaacagtatgcatatgctttaatagctggctaattctcgcaagaagatccgcacgtaccactacaagcgcgctgtggaggagcgccttgcaactatgctggctatgtcaatggaaccattgcaacatcgctatcctcaggtcttcaacccatgtgtccaggaccacatcaattccccccactcacggcggttccaactgtggcaaaccatgggtcttattctccatcacctgcaccgggacctggagacgctggtggtgccatcccaggaggttccggcgtttcaccttcaaat

SEQ ID NO: 16028 - DNA, 316 bp, Sorghum bicolor
  Clone ID: LIB3476-013-P1-K1-C11
cgtccggattccggtcacccacctccgcccactgagccaacctgtccgccccttttcccctttcctgaagttttctccctcctccgtcctcccccccgagtccacacggcagaggacgccgccggggggaggagaggaagggagcaggtggggggtgggggagatggcgatcctgtacgcgctggtggcgcgcggcacggttgtgctggcggagcacagcgcggctgccaccaacgcggtcgccatcgctcgccaggttctcgagcgccttcccgacggcggtgccgacagttttgttttctacacgcatgaccgc

SEQ ID NO: 16029 - DNA, 460 bp, Sorghum bicolor
  unsure (1)..(460): unsure at all n locations
  Clone ID: LIB3476-013-P1-K1-C4
cggcatcccggtcgcccacctccggtttctaggtagctgccatcattcacatttncccatctagcagaccaaggaaggcttgcggcatgatcaacaagatcaacaagcttttgaataactaattattaattatcagatcaaaaccacatagagagagtaatccaggggcatgaacagctcttgatgcgtctagtagcagttaatattttgtgttctgatcctgaaaaatgctctgatcctgaaaaattgttagatgaatgtgctgatcctaatattgtgttctgtatctatgaaagttaatattttggttggtaataaaaggaatgttcatcatctatcatctattaaataataaacactactatatatgatttgaattatgtcaatctaatttagcacatgtaacttccatagcctattcactgaaagatattttgacaagcctctgttttttacagga

SEQ ID NO: 16030 - DNA, 290 bp, Sorghum bicolor
  unsure (1)..(290): unsure at all n locations
  Clone ID: LIB3476-013-P1-K1-D2
agaatcactgtgcaagtttcgagacagccacagcaatggctgtcataagctggtttgcgctggcgccatcctgtatcttgaatttctggtcgatggcctccagatgagaaatataggatgttaaaacatacttttgaaccgtttcggcacaagatcggtgcttgtggtagcagcaatgcagtgtcgtaaagctaattgtaatatgcagaaattggtgaatggatgtggaatgtantgcgtggtcgaattgtctgtacaaaatacggagtgccttctttggatctgaaaag

SEQ ID NO: 16031 - DNA, 447 bp, Sorghum bicolor
  Clone ID: LIB3476-013-P1-K1-E11
cgtccggatcccggtcgcccacctccgtgtatatgcagaatgatatgaaagcgttaactaatacggcgattttattatcgacggacttaaataaacgaaagggttgtccatatcttgatagcaatgaaaatattggaagtccaagtgactgtaccataatagaaaacccaaagatggctcatcaagcatctatgaaaaagagaaaacattctaaggaagtcgaatgctcagtggttcaaacggacacccaacatatacagacacacaacaaatcctcacaagtccatgtcctccaagaagatgatgagttttgggcatttgaggtcatgaaagttatgccaatgagtaatgaagagatgactgaattactattactatgtgactatgtcatggcaattcaggatgaagcgattttgaagtaagctacttgcttattttaattacttt

SEQ ID NO: 16032 - DNA, 456 bp, Sorghum bicolor
  unsure (1)..(456): unsure at all n locations
  Clone ID: LIB3476-013-P1-K1-H8
tccggccgaattcggtcgcccacctccgagagtggctgcaaataaccagaacannaaattggaactgcccgcattactatagagaaattacgacaacgagaacactttatggtagctgaaatagagttgttaaaggctgagaattcaaactacaaaactatcatccttaatcttgaagctgatgtgaagaaccttaccagacaacagaatcttcagcttcgaataaatcaccatgtcaaaacaaaggaagagaatatcctgctgaaaaggcagaatgaagagctaagtgcaaagctgaaacagctggggggcatccttacccgtacaaaggaagagcttgcccgctacaaggtttcagatggaaaagatccacacgaacagatagaagaggaagagcttctgaggaagaaattagatgagagcgaacaagatagaagtcagctggtagaaaatcta

SEQ ID NO: 16033 - DNA, 393 bp, Sorghum bicolor
  Clone ID: LIB3476-014-P1-K1-A8
tgcgacccacgcatgcgcgcagtgctaggccgggtgcgcctcctgctgctactcgccaactccacagtgttcaaggcaacgccgctgccgccgcggagttctggcttcgcctcgcccacgccggcaccaccaagcgccacgtgggggatggcacctgcctcttctaattcaccaccaccaccaccacccccaccttcttcttctcttgtgacgacggcggcggcggctctcgccctactcgacagcagcaaccaaggccggatctgccgtgggaggaagagaaggacggggcgtctggaggtcggctatagaggccgcgagaaggaggcagcccatagggcgcaaacggccagcgaccaagccaggcaaccagccggcagcccccaagccaca

SEQ ID NO: 16034 - DNA, 172 bp, Sorghum bicolor
  Clone ID: LIB3476-014-P1-K1-F11
tcgatgagtttacacaaaagtattcctctattgcaccctcctttgcctctacattttcaggttcaggctctggactcatctattcctcaattatccacatctctccttccattacaccttatacgctgtacattctgaacctctgcttaacagaacacgaacctgatgatct

SEQ ID NO: 16035 - DNA, 409 bp, Sorghum bicolor
  Clone ID: LIB3476-014-P1-K1-H2
gcgtccgaaaaaaaaaaaaaaaaaaaaaaaaaaaaaaaaaaaaaaaaaaaaaaaaaaaaaaaaagaaaaaaattaaaaaaaaggccggcctttctaggggaagcgagctaacttacacgtgcttgctaacgtctaacctattatataatgtaaaattaaaggcgccccccttttaaaggttcaaacattcctttcccctgggaaaaccataatttttttctatttaatccccttaaatcaaatccccggcccgccatttaacaccattgccctggggaacccccgggtccccccttcctaaagcggttaaaacaaaaccccttttcccaatctccctttaaaagaaaatgccccccccaatgcccttttccaacccctttcaaaccctatattataatcggcccccccc

SEQ ID NO: 16036 - DNA, 424 bp, Sorghum bicolor
  Clone ID: LIB3476-015-P1-K1-A2
agtgcagagacgcgtgatcatgcgtattgacggctaagtctacctggcgggcatggtagatgttcaagcttcttgtagcacccgatttggcattcagaaggtcataatttggtaatacctgccaaactgatgtgatcttacagaatagctcttttatagtttcagaaaaatattacaatgtgcatgcttgctaacactgtttcttgttgttgtctttaccatgtgcaaaccagaccccatcatccctggcatgatgacataacttatctccaccaatgcaaaccagagtggtcatctctattgatggctaagtctacctggcgggcatggtagatgtccaagcttcttatagcacccccatttggcattcagaaggtcataatttggtaatacctgccaaactgatgtgatcttacagtcatat

SEQ ID NO: 16037 - DNA, 171 bp, Sorghum bicolor
  Clone ID: LIB3476-015-P1-K1-B2
gggaagacccaggcgtacgcactgcgtgcgcgggaagatcgtgtccaacgtggacctaggagcatctacgacgtacatactcacgacagcgctaccaatgtaggaagctcgatgggcgtacaggtaatgtatgagcgtatgatgctcaacaaggccacctgccaacacact

SEQ ID NO: 16038 - DNA, 389 bp, Sorghum bicolor
  Clone ID: LIB3476-015-P1-K1-G12
ttccgcgaacgcttcgagcccggacgagccctataagcccgcgaagcccaagcccacccgcgaagcgtatcgcgacactggacatccacatatctctcaccgtcttctttccgatgccgcctgcaatgaccttcgacgtactcaccgtgcggtatgaggtccaccacgcacacccgcaccaccaccagacactggggctggctgcccgcgttccgctgatgcccatgctagttctccaaccctgactctatgcaccaccatcgtgctgagactaacactatactgacaggctcgccaacagcgtggttcataattgaagtagaggaaccacccatgtctgaatgatgatcaactcctaaagcttaaaacgttgcaaaggatactccaag

SEQ ID NO: 16039 - DNA, 478 bp, Sorghum bicolor
  Clone ID: LIB3476-015-P1-K1-G3
ccggtcgaccacgcgtccgcatacatggagagggcagatttgttctcatttttctaaggtttggttccttttcagtttgacattttgtttgcctgatgggtggcaaagcatttgatgttgcttttgagtgacacttcagagttcagtcacaccctatagttttatcaagtgaaactattccattttagggcctgttcggttaaccattcccagcctggaacggtccggaatatttccaaccaagtataaaatatcgaatgattctaggtccggaacagtttcaggccattctggagaaacgaatggtttcaggcccagaaacgaacagacccttaagatagcactcatctgtactaccataagcaggagaatgcaatagtgaaatgtgcatgcaggggaaaaagtcaataaactaccttctctttttctgcatccctatccagcattgtaccacagaatttacatatggacatatgat

SEQ ID NO: 16040 - DNA, 392 bp, Sorghum bicolor
  unsure (1)..(392): unsure at all n locations
  Clone ID: LIB3476-015-P1-K1-G6
gaccaggcgtgcggatgcgttcgaacctggctcattgctagccacaccaccagccggttacttggttcttcgtacgtacctggtggtactgcaaattagtccgcagaggcacgagaaaattctgtacctagctagctccctcgtcgcctcgctccaccgtacctagctgcatgggcagcggcggcgaaggcagcgacggcggcgccgcgagctttcgggaggctcatgacttcagcaacgtcgcgtccttctctgagctgccgttcctgcgctccgccccggcccgtgaaagctccaacaactccggcatccgcatcttcggtaatgacgtcccacattcaccgccggagagaaaggctaaagaggccaccgncaccacgcccgctactacc

SEQ ID NO: 16041 - DNA, 483 bp, Sorghum bicolor
  Clone ID: LIB3476-017-P1-K1-E8
ctcgaatgttctctagatttcccaactaccgcatttttcgtttgtttagattagaagagtctactttgcagattagcagattatatatcgagtgccttgtcatcatgccatggttcctgctacaacagctcttctgagtcagctatgacagtgtgcttagaccaaattgcagacaggattttgcattttgattctgggttggttggaaacactggagtttgaagtcttcggttggaccagagtgttgttcaagtccccggtagaatctaattgctaggtgcaggccctgttcggctggctgaaaaaaaggccattgccaatgttgatgctgatttgttgtgagagaaaaacattgttccggttgctatgtgctgcaaaggacgtccaagccctctagtttattcgaggggcaaatggtcgtacgctcattgtctttcttttggctattctgtatgcgtattagatctgataaatcgactccaa

SEQ ID NO: 16042 - DNA, 397 bp, Sorghum bicolor
  Clone ID: LIB3476-018-P1-K1-E3
ctggcttcagtcgcttgtgccccatcttagccgtaggcagtaaaaatcgccggcggcgttgctgagtgctgcatccaagccctaaccactgaaaatcgccgggtccgtcgcttgggggtgcaatgccatagtcagattgggagaagcgcaggacactactctgactgttgtgcctcggctggattatgagaaagagcttgctgccctttcagacccagttacttcagagagtttttctgaaattgaggaaattactcggactgttgtgcctgggatccattctgaaaaagcgttgcttgcctatctgacgacctcgcttcagatagttgttgtgatgcttatgccttgattgattttgcaaattaagatcaaaggcctccatgcctggatccgttcg

SEQ ID NO: 16043 - DNA, 346 bp, Sorghum bicolor
  Clone ID: LIB3476-019-P1-K1-G10
cggacgcgtgggggaggcacctcggtcggcggtcaagacagctgcgtcaccggcgcggcgcctggccgcggcgcgcgtagcaagcggtcccgcgcgaccgccgcggcagccgcggcgtggcactccctcgtgccgcgcccgccgtcgcagtcgtcgccgtcgtcgtcctgctcgtcctcggacttcccgtcgtcgaacaagccgggcggtgcacggggcggcaactgcagccgcggcaagaagagcccggcgagccccggcggttgtcccgctggggtcgaggtggacttggagggcggtattcgtcagtgcacgcactgtgcgtaagaaaagaccccagattggc

SEQ ID NO: 16044 - DNA, 121 bp, Sorghum bicolor
  Clone ID: LIB3476-020-P1-K1-E4
tccggtcgccacgcgtccgtttgatagacgacccccaggcatactcgtttgatatgcaaataaacccattgtggacaaacattgactgagtgatcaagacgccaggactgagccatagacc

SEQ ID NO: 16045 - DNA, 286 bp, Sorghum bicolor
  unsure (1)..(286): unsure at all n locations
  Clone ID: LIB3476-022-P1-K1-B2
tgagggnnagttcgcggccccattaatggccagcggcacccgctgcgtgccagnncgaggcggcggcgctggccatgcgccgggtcatggagcgccacggcgacggcgccaccatgcagcaaggctagacggcgcgtcgtggatagactgcgccggcctgctgacattggagctgcgtggtgcagctcatggaattgcgccgatctttgtgcgcgatggaaatgcgagtatatgtagtcgtgtgggtaacgggacagtcacctaaataacatgttcaagctgctgc

SEQ ID NO: 16046 - DNA, 228 bp, Sorghum bicolor
  unsure (1)..(228): unsure at all n locations
  Clone ID: LIB3476-022-P1-K1-D4
gcacgaacactgattagagttcagaggtgggaccaccatggcggcgctgctagcccggtatacattcgtttccgaagatacatttccataccacagcattgtnnagacggtcgtgtcgtctatgcatgggcacctacgtacctacatgaacgcggtgattcccaagctgttcaaagaggatgaggagaaagaacagcttgcaaaagatgtctcaaaagattggaatgc

SEQ ID NO: 16047 - DNA, 299 bp, Sorghum bicolor
  Clone ID: LIB3476-022-P1-K1-F4
attcccggtcgaccacgcgtacgcgaggcgcacttggcaagcaccaggtacttggccgccgacaagttaacgctggccgacgccaacaacccttcttacttgttttacttaacaaaaaccccaagggttggcttggtaaccaaccgccccaatgttaaggcttgtgggaggggattcgccagccccccgcggttcaaaagaacggtggcggcattccaattccaacggcggccttcttcggttggggtggaccttccgttggtccggcgccgtcaacgaccccttccaagtggattaaa

SEQ ID NO: 16048 - DNA, 135 bp, Sorghum bicolor
  Clone ID: LIB3476-025-P1-K1-A10
ccagcgtgcggctctcggttcgtccactcccagctccacttccctccggctcccacaccacacaacgcctctactcccacctcgtagtctgtgtcccagtgccccagcgtctagctgcgacgcgcgcgcccgccg

SEQ ID NO: 16049 - DNA, 187 bp, Sorghum bicolor
  Clone ID: LIB3476-025-P1-K1-A2
cacacttagataagttgaaaatcattgaccttacatgtgtatatgaattttcttggttgcaccctgcctcacacagtcacacgcttagacaagttgaaacttgttgaccttacatgtgtacctgattttcttggcccctttaaacatattaactcttgacctctcttgtttgcagtgtagtcgaaga

SEQ ID NO: 16050 - DNA, 107 bp, Sorghum bicolor
  Clone ID: LIB3476-025-P1-K1-C2
tccgtccggaatccggtcgccacgcgtccgcagagagagagctgcaccgtcaacacttacgctcgaagttgtagatggcgctcacatgtcgactctcacgggatggc

SEQ ID NO: 16051 - DNA, 247 bp, Sorghum bicolor
  Clone ID: LIB3476-025-P1-K1-G5
cacctcgcaccgtcgtcgaacagacatgacaggcacctttgactgctcaagctaagtcgtactctcgacgctcgctgcgccggagcgcgcataagacacccgtgtgcaacccgacggcgcgtctactacggaacatgaccgcatcggtggcaggaagggggccatccgcgcgcgctgcgtcgaccgcgcggggcggcacagtgctcgactcggaccatttcacccggctggtggcgccggcgtacgt

SEQ ID NO: 16052 - DNA, 159 bp, Sorghum bicolor
  Clone ID: LIB3476-027-P1-K1-A9
gcgatcgtcgcaccgcggcgtacaaagctactgaaatatttgtgataggggtatgtctgctttgctactacatgagtgcacatatggctgagtggctgacactatcctgctactgactgtctttgtggctcgccggtgctaaagatcggggttggatca

SEQ ID NO: 16053 - DNA, 474 bp, Sorghum bicolor
  Clone ID: LIB3476-027-P1-K1-D3
cttgaccacaagcaggaagaacaattatttgaagatatatctaatgttctcttggagctttcacaactacatgatagccagggccatgcccagaatgaagttaatgaagtaaagcaaagttgtttgcattcatctaatgatgttgattttgctagaaagtataacgagcttgccacaaaacttcaaggcatgtgcaagtctatccgggttgccttgactaatcatgtccatagagaagaacttgaattgtggccgttgtttgacaaacatttttctgtggaggagcaagacaaacttgtaggtcgtataattggttcaacaggtgctgaggttctccaatctatgttaccctgggttacatcagctctcactcaagaagagcagaacaaaatgctcgatacatggaagcaagcaaccaagaatacgatgtttggggaatggctaaatgagtggtggaagggagctggaacaaca

SEQ ID NO: 16054 - DNA, 360 bp, Sorghum bicolor
  unsure (1)..(360): unsure at all n locations
  Clone ID: LIB3476-027-P1-K1-D5
ctggacactcgagtaccgaacgcaggacactcgcaaggtcggcggcggcacagaagcactagggcatccacctcggcggctgcggtggcctccatgtcgaccccttccggcaacggcaacggcggcggcgcctactactactncgngctctacgacttatacggccctaacgcgaagcctgatgttattttcaaggaggctgctttaaacactacattaaatctgtaggacattcanggtctagttacttgggttattggtgacggcatgctgccttcttgggtgtttgttaaagtactttgtcctttttgagattaaggtatcgaatgtaattacatacaaaattgtatccagtagtta

SEQ ID NO: 16055 - DNA, 453 bp, Sorghum bicolor
  Clone ID: LIB3476-028-P1-K1-B1
acgcgtcacgcgagcggtgtattcgacgtggtactagatgattgggatgaggacgatgatgcacttgatgaagacggaacatcatgtcctgtgtgcaggagatgtgtgtgccgaacaacttgatggtctaatggtcgttgtgtgcaagatcctcatccgaaacgacgacgagcttcatgccatgcgattggaatacagacactctggaggctatattcaaataagatgtgattagggtgcacaaatgcacatgtgcacagtcaatcatgtagtatgcttcggctctgcctccaaagatgtgatgtaaggcctttgctttttttctatgaaatatttttattgacaagagcaaagaggatgatgcactagctagactgtctgcgctttcatatgttggatgctatctgttccagccaaggctcattttcgtgaattcagttgttgctgtacttc

SEQ ID NO: 16056 - DNA, 356 bp, Sorghum bicolor
  unsure (1)..(356): unsure at all n locations
  Clone ID: LIB3476-031-P1-K1-A7
cacgcgtcacgctgtgtatggctctagcgataaggttgtgcagcacaattctatgtcttntgtatcatcaccaggacgagttagattaaaccatgcgatgaatctgtccactgggtacagcattcttgaattgaatcgacctctagtcggtttctctagtattttcctttttacgttgatgacgcgacaaaaaggaggcaggcaaggcagcttgtaaggttagcattttccttagatattccttttgggcagcttcatctagattctagagtgtgcctgtggagatatttcttcttttcattcacaggacagaacaaaaactcatgctgtaatcaagcttgaaacgccattccttt

SEQ ID NO: 16057 - DNA, 178 bp, Sorghum bicolor
  unsure (1)..(178): unsure at all n locations
  Clone ID: LIB3476-031-P1-K1-B6
gctgacattnntaaccattggttngctatgctacaacaagttaaaaagagtggagcacgggttaatttcaagagagagcatgataagaaaggttgctgcttgggcctgacctctcttattgcgcttccagctgataagattccagcagaaagcttagatcggatcttcaaagcaacac

SEQ ID NO: 16058 - DNA, 505 bp, Sorghum bicolor
  Clone ID: LIB3476-031-P1-K1-H11
ttcttggagaacatgagtctcgcatacatatattcctgaaagaaggtgaccaaatggaaatttgtacatagataactggatctcaaggcctccattgattatcgttaactgttggtcttcattaattcaactggaagactggaactgcttagtaagaaccaatgagaacaaggaaagtgcttgctaaataggttatgcatgtagacccctgtttatacccccctccctagttttctgtatctgctgtccctatctgttagagtgtgattcaatcctactcattcttgggttggcaaaatgttgcctgatctccttggtgtcctatgcatctaaactaccgaggaaaccttggaacacctcttctttaagtgtgtcttcgtgcaagcttgatgtctcagtcataatcttagtgttgacaaccgggttgaaccttttatcactttggaacatttcaaaccataagtttggagtcctctctacatggaaattatcatactactgagct

SEQ ID NO: 16059 - DNA, 101 bp, Sorghum bicolor
  Clone ID: LIB3476-031-P1-K1-H4
acgcgaggcgacttgtactagtgtcatcaagttcagacccacatcgtgcagcagctggagtacctcaacaattctcggaatactaacccaccttccaatgt

SEQ ID NO: 16060 - DNA, 127 bp, Sorghum bicolor
  Clone ID: LIB3476-031-P1-K1-H6
aaaactctcccttgaaggtcatagatgctggcttgtctgactttgtgtagccagatggaagactgaacgacattgttggaagtgcatactatgttgctccagaggtgctccacagatcttatggcac

SEQ ID NO: 16061 - DNA, 404 bp, Sorghum bicolor
  Clone ID: LIB3476-032-P1-K1-B12
gacccagcgcgggcggggaggtctattctcagttttgcaagatgtacagcatgcagcagtcactgttcttgacagatgtaacatcacaataaagggcaggccaagtaaacttatggtaccaccaaaatttatgaacaactactttaggttcgcctgcatatccatacgatgccttatatatacacaatttcacgtaaaagaaccctgaatggttttatatccagtttatcaacatggttctgtttgcaagataggaatcatataacattatttcatacacatttcattgtttccctttctttgttaaactctatatagatttattcaaattttatatttttcatgtatttgaatgtattctattcaccttatatcacgttcttcatgtgacggtgtaattcttt

SEQ ID NO: 16062 - DNA, 249 bp, Sorghum bicolor
  unsure (1)..(249): unsure at all n locations
  Clone ID: LIB3476-032-P1-K1-F4
ggttgacccacgcgtgcgagcccaccgaattccctgcctgcgattcctatcccctcgcctcctcgtcttcccctatgggatcgccggataggaatctcaaagagggccgttttattcaagttaagggagccatgtatcacattgatactgtatgcctatcacctgtaggaccacatccttagaatcaatatttnnnnnttcttcggtagctcagcttaccatgaacatgtgcttccaagtgccacatgg

SEQ ID NO: 16063 - DNA, 250 bp, Sorghum bicolor
  Clone ID: LIB3476-032-P1-K1-H2
acccacgcgtgcgcgacatacgcatatcgccatctaatcttctcgtctcgtctcgtcccctcccttctcttctcttactcgcccaatcccatacaaaggcaagtctgtaatcatctccccgctcgcctcgcctttcctaataatatcatatacaatcgactcctctttccttacttccccttctaactctatcttcccctatccacctctatatgctcaaacttttgtacaacctctctctctcttccta

SEQ ID NO: 16064 - DNA, 399 bp, Sorghum bicolor
  Clone ID: LIB3476-033-P1-K1-B10
aagagtccatcagaaacgtgaagaagcacttgcccctgcatttagcacagcacaactgaagcgttatatttcttttgcaaagtctttgaaacctcagctgagttcagaagcaaagaaagttctggtggagtcgtatgttacccttcgtagaggggacagtactcctggaactagggttgcttacaggatgacagttcgacaattggaagcattgattcggctgtccgaagctattgctcgaagccatttagaaagagttgttctcccagctcatgtccgcctggcagttaaattgctcaagacatccatcatcagtgttgaatcaagtgaagttgatctctctgacttccaagatgctgaagatggaacaaatgtaccttctgagaatgatgctggaca

SEQ ID NO: 16065 - DNA, 112 bp, Sorghum bicolor
  Clone ID: LIB3476-033-P1-K1-G5
tacctctgctattttgacaccaaaaaccaatacacttaccacggcctgtactattttctgactaagaaacccctggccccacccaacttaatcaacttgcatcacatcccct

SEQ ID NO: 16066 - DNA, 335 bp, Sorghum bicolor
  unsure (1)..(335): unsure at all n locations
  Clone ID: LIB3476-033-P1-K1-G7
agaggagagcgagacctgtgctagaggctgcctngtagagaccgtttagtttttaactgcaaaggagggagaggcggtggggagggtcgtntctatcaggcaagactgtcacaccctcaccgttcactaagaaggcacccacagcagcgctcaagattcgtgagaaggacggcaactgtgcgctccacgctgtatgcgagctcgaaagcatgaaaaatggcaacgctcatacgaacaagagccgcgtgcagcggtacatccctcaacaccaagagtcttgacgacaactcggaaaacctcgcatatgagcgagtgtcatgtgaccgcgagaaaaa

SEQ ID NO: 16067 - DNA, 170 bp, Sorghum bicolor
  unsure (1)..(170): unsure at all n locations
  Clone ID: LIB3476-034-P1-K1-A2
tgccgcatcgctncgccatggccgcgggtcccggcgcggggcgttccgccgttcggggcgggcccgaatcgagcctggagggagctgttcgtgctgattcctgcggggtcctgtggtgtggctcggacttctgggcccgcngagtgggaaaggttttgactcctgttggg

SEQ ID NO: 16068 - DNA, 342 bp, Sorghum bicolor
  Clone ID: LIB3476-034-P1-K1-A3
tccgcccacgcgtccgcgcaagatcctcgagcgctccggcctcggcgaggacacctaccttccccccgccgtgctccgggtgccccccaacccgtgcatggacgaggcgcgcaaggaggcgcgcgccgtcatgttcggcgccatcgaccagctgctcgagaagaccggggtcaggcccaaagacattggcgtcctagggtaactgagcctgtcaaccgacgcgcgtgcagcatggggaactacagtgggggaattgggctacactcgggatggtgacgtggtgtgcatgactgcaggctgtgaggcacaattatcctgtgacgagggacatacactgatgtc

SEQ ID NO: 16069 - DNA, 320 bp, Sorghum bicolor
  Clone ID: LIB3476-034-P1-K1-A5
tcccgggtcggacccgcgtccgcgtagaactcatgccgagaattagcgccacagcctcggtggtcgcgtccgtcgcacgctggcgagtggaggcgtatctccgttccttcagcactggtagacgcggaatcgtagccctgactcggatctagtagggggcctggccttagcgcgacggagaccctggagtggcccctgcggctggggcggcccatgaagggaaaccctaaccgaagcccgggcaggacccttagcaactcctcaggcaggtcgggggcttctaccaggacaagcgctaccttaccatgcaggggggccac

SEQ ID NO: 16070 - DNA, 327 bp, Sorghum bicolor
  unsure (1)..(327): unsure at all n locations
  Clone ID: LIB3476-034-P1-K1-B4
atctccgacacggagcancagcccgcaaccaagcagcaaggtatgggtagtgactagacaagatggtgcaccagggctacgagctgcgcgaggcgtggtggttcgacagtcacaaccgttactaggccatctacatggctgaacaacacgctctcagagctggatgacaagacgaagcaaatgctgaagctgatcgaccaaaacgcggacttctttgaccagagcgctgagatgtactacaagaagcggccggcgctggtggacatgctgggcgacctgtaccgcacgcaccgctacctggctgagcattacgacctgctgaagcac

SEQ ID NO: 16071 - DNA, 326 bp, Sorghum bicolor
  unsure (1)..(326): unsure at all n locations
  Clone ID: LIB3476-034-P1-K1-B6
gtcgacccgcgtccgctgaacttcattntgcctgatatattctcgtcacatcaagaatttgagtcatggtttgatttttctgggaaaggaaatggagaaaaagatgaagaaactgatgagaataaaaggctgcatgttgtttcaaagcttcatgctantttacgtccattccttctaaggcggatgaaggaggatgtggaacagctgcttccacggaagaaagagataatcatttatgccaacatgactgaacatcagaagcaaatccagcatcacttggttgaaaaaacatttgacaactacttgaatgaggaatcggatattat

SEQ ID NO: 16072 - DNA, 398 bp, Sorghum bicolor
  Clone ID: LIB3476-034-P1-K1-C3
tgtaaagccgttgactaaggaacttgttgattaccttgaagtgagtgatcaagatttcaaggaagacctcactgctaagatatgctcaatagttgaaaagttttccatggacaagctatggtacttagaccagatgttcagagttttatctctggctggtaattacataaaggatgatgtatggcatgctcttatagttctaatgagtaatgcatctgaactttaaggatattcagtcaggtcattatataaggcattgcaagcatctggtgaacaggaaagtttagttagggtggctgtttggtgtatcggtgaatacggagaaatgctggtcaacaatcttagcatgttggacatggaggaaccgattacggtaacagaatctgatgctgtggatg

SEQ ID NO: 16073 - DNA, 349 bp, Sorghum bicolor
  Clone ID: LIB3476-034-P1-K1-C4
cgcgtccggcgcgcccgccaccgacccccactgtccgcggggcgatcaccgaccgaccccatccaccttcttccctcgctcgcatggcgatgctgctccgcagggtgtggggctccgtgctcgcgcgcgccgcggcgccgggggccgacccgccgccggggtcaccgagggcccgccgcgcgcaggcgcagcgcgtggagcagtaccagtaccacggctcgctgtcgctgggcgcgctcgacgccgtccccaccgacgtgctcgcccagatcctgcgcctgctgggcccggtcgacgccgcgcgcttcaacgccgtctggcgcgcctggcgcggtcttgccttcgacaa

SEQ ID NO: 16074 - DNA, 461 bp, Sorghum bicolor
  unsure (1)..(461): unsure at all n locations
  Clone ID: LIB3476-034-P1-K1-D2
ccggtcgacccacgtccgcagacgtttcatgggacaccatattggtttggccactgaaaactatttggatgctagaggtacctattcaagattagatggaggtaactttcagttcggcacggacaagggaagcagtgatagtgattcccatgtctcaagaacttacctttcagactatccatatcaatcgtttggcttgtctgtttcatctgatcctctccaactcggtgagaagctgtcaccatatggtggagcgacaaagactattcctaacatacatcagaaagaacatcactcattccatgcttcatacagctcacatagcttaacagggtccagaaatccttgctttgctacctctgaacgttctttcggtagcccatctcttctagcaacttctcatctgggaatacagncccatcatctgctcacatctgatattgagaactaatctagcaagc

SEQ ID NO: 16075 - DNA, 347 bp, Sorghum bicolor
  Clone ID: LIB3476-034-P1-K1-E5
cgcgctccgcaccctccaggcgtttctgaccatgatgtgattaaacaggaggatgactgcaacgcatgtagaatatgcagaatgctgaggacggaaactctgtttcattgttcaaaatgcggatgttgctctgcaattggtctgcagaatagctatgcatgatttgaagcgctgatgctatatgactgttcaatttgattttatcttattcaagaatataatgattgtttttttttttttggctatacataaatgttaattcataaaaaatgaggagcactgcagtttgatgcctccttgctccaagtcgggttgtgacatgtcaaaggtatgggagagacttgata

SEQ ID NO: 16076 - DNA, 266 bp, Sorghum bicolor
  unsure (1)..(266): unsure at all n locations
  Clone ID: LIB3476-034-P1-K1-F5
cccgggncgccacgcgtccattggacagcgggctgagagtnnaggattcagggcacttgttttgacagttgacaggcctgtgcttggtaggcgtgaagctgatatcagaaacaagatgatttctccacggtttgtaaacctcgaaggtttaatgtcattagacaaggacatacacagtgctgaaggcggctccaagctggaacgattctcacggaagacgctggatccatcgttgtcgtggaaggacgtggagtggcttaagttca

SEQ ID NO: 16077 - DNA, 554 bp, Sorghum bicolor
  unsure (1)..(554): unsure at all n locations
  Clone ID: LIB3476-034-P1-K1-G1
tccgtacagattcatgcatgtctatgcattgattactaaacttataactaatttctatcctaataaattgtatgagattgttcataattcagcattatgaactgataacgcgcgcgagggcacgcgcctgctactagttgtctttaagacatgagcaaggtagtgaaaactatgtgatgaacaatgcattttttttattgacattgacactccagtatttgcttttgttttccatgttgcaatggctgtcagagagtagcacacaaaggcaaaagaaagagttgtgacaggaactgattatgcagcaacctgcaagaaagagttgtgacagaactgattatgcagcaacctacacttgatgcgtttgattaaatgcatgtttttttttacaattaagttctgatgtgcttgtagccgaatgatgtaactaggacgacttgcacatcatgctctatagtgatattctatgaacttattatatntatatttgtggcaatgttgtgggtatgtaacttcaataattgtattaattaattattacgatggtaatgaga

SEQ ID NO: 16078 - DNA, 304 bp, Sorghum bicolor
  Clone ID: LIB3476-034-P1-K1-G12
accttctttaagcgcaaaattatattttatatgacatacatgtgtgagaagatagggtactggaggtgcataacaatatttatggacatcaaagcgaacccacagtagtaggcgtgccctattttcaaatacttataaaactggtgccttcacgagaacaagaacggtgactacttctctgctctgctcaaggatgagccgcagctgctcaatgattggaaggacgcgctgctgtcaccgctgttctgcctctcgtagaatgagaccatgttcctgaatgactgctaacgcactgctttatatg

SEQ ID NO: 16079 - DNA, 130 bp, Sorghum bicolor
  Clone ID: LIB3476-034-P1-K1-G4
cacgcgtccgcggacgcgtgggctattccaagtcatgagcctccacatgagcaggctgtggaatccatatgctagatgtggcggtaggtagtactatcgtaactggtctgcaggatgattcgagggcaat

SEQ ID NO: 16080 - DNA, 430 bp, Sorghum bicolor
  Clone ID: LIB3476-034-P1-K1-G5
tcgacacgcgtccgggaggatagacttcagcatgcaaatggagctgttgttctggcaacaattaaagtttttctccatttgacaatgtctatgactgatgtccatcaacaggtttacgaacgtatcagagcacccttgcttactctggtgggtgctggcagtcctgaacagtcatacttcgggcctatgccatctacatcttcgggggagccgggctccaaggtaattttcctcggcctataaaagtttttactgccaattaagggatccttcgtatgtgaagaagttgaaactggagatgttgactgttatagcaaatgaaggcaccacatatgagatggtcactgaactatgtgaatacgctggaaatgttgatgtaccaattgcaggagagtctatccggccagttggaaaaatagcactacagcag

SEQ ID NO: 16081 - DNA, 619 bp, Sorghum bicolor
  Clone ID: LIB3476-034-P1-K1-H3
cggtcgacccacgtccggcgtctcatctttgccgggaagcagcttgaggatggccgcacccttgccgactacaacatccagaaggagtccacccttcacctggtgctccgcctgcgtggtggtatgcagatcttcgtcaagaccctcaccggcaagaccatcaccctggaggtggagtcctctgacaccattgacaatgtgaaggccaagatccaggacaaggagggcatccccccggaccagcagcgtctcatcttcgctggcaagcagctggaggatggccgcacccttgctgactacaacatccagaaggagtccacccttcacctggtgctccgcctgcgtggtggcatgcagatctttgtcaagaccctcaccggcaagaccatcaccctggaggttgagtcctctgacaccattgacaacgtgaaggccaagatccaggacaaggagggcatcctcccggatcagcagcgtctgatctatgctggcaagcagttggaggatggccgcacccttgctgactacaacatctcagaggagtccaccctttacctggtgctgcgtcttcgtggaggcttgcagatctttggtaagacgcttaccggcatgacctata

SEQ ID NO: 16082 - DNA, 446 bp, Sorghum bicolor
  Clone ID: LIB3476-034-P1-K1-H5
gtaatgtgcagacctatttacagtcagcttctgtgcgtatagaagaaatgagagtgaaaaggcgtgatacagagcagtggatggcacataggttactccctgagaatctcaaggatcggattatgcaccatgaacaatataggtggcaagaaacaagaggggttgacgaagagggccttcttaaaaatcttcccaaggatcttagaagagaaataaagagacatctttgtttgtcgcttctcatgaaggttccaatgtttgaaaacatggatgaacaactgttggatgccatgtgtgatcgtctgaagcctatgctgtacacagatggaagctgcatcattcgggaaggtgacccagtgaatgaaatgctcttcatcatgagaggaacactaaagagtaccacaacacatggtggacaaactgggttcttcaactctaatgttcta

SEQ ID NO: 16083 - DNA, 450 bp, Sorghum bicolor
  Clone ID: LIB3476-035-P1-K1-G3
tcccggtcgaccacgcgtcgagccgctcacctcggctcgtccatctcttgatctagccgcggcgccgcgcgacctcgaggcaggaaggagagcctagcctaaggtcgtaagatttgggcgtcccagtttcagcccatttgctagatgcctccccacaacattgaaaccgggcaccaggacgtggtgcacgatgtcgccatggattactacgggaagcgcatcgcgacggcctcctcggacaacaccataaagatcgtcggcgtcagtggcacctcgcaccagcagctggccaccctgagcgggcaccaggggccggtctggcaggttgtgtgggcacaccccaagtttggctccatgctcgcgtcctgcggctacgatggctgtggatcatatggaaggaagggggcaggcctgacgagtggttcaggctcatacatcaccgagcacaag

SEQ ID NO: 16084 - DNA, 467 bp, Sorghum bicolor
  unsure (1)..(467): unsure at all n locations
  Clone ID: LIB3476-035-P1-K1-H6
acgcgccgcgggctacctgcagtagaacggccaccgactccgtatgtgcgaccacacgctccgcggcgaggccgacggatatgaaggacgcgctgctggcgtgcttcaagatcgccttcgcgtgctgcgccatggccatcagtaaggcgctcttctttaaggaccgcactgaggttgttcaaccaaacaacggccgcctccgccacaagcggaagtgccgccgccgttccttgaggggaacgaaaaaaaaaactgaccttgtagtgagtgcttgtagtcgttactgatcacaataatcttactgcaagtgcaaggacggtggcggtgatcaccggcggcgagcttgtttgttagggcgtgtacgtagatctgtcactaattttggaggtactgcgactgcgagaattaattaacctactaaaaaaaaaaaaaaannnnnnnnaaaaaaanaaaaaaanaattttnta

SEQ ID NO: 16085 - DNA, 295 bp, Sorghum bicolor
  Clone ID: LIB3476-036-P1-K1-B3
cggtcgaccacgcgtccgctcgaatcacaccatctacaatgccgcgctgggcaagaagaagatacatattgtcgagtatgggatacagtacggcttccagtggccgtgctgcctgcggtggatagcggatagggagggtgggccaccggaggtgaggattactggcattgacctgccccagcctggattccgccctactcagcgcatcgaggagacagggcgacgtctcagcaagtatgcccagcagtttggtgtgccattcaagtaccaggcgattgcagcatccaagatggag

SEQ ID NO: 16086 - DNA, 182 bp, Sorghum bicolor
  unsure (1)..(182): unsure at all n locations
  Clone ID: LIB3476-036-P1-K1-B7
cgcgttcgcacacactcgagagcccagcacgcacacgagcacgatggcgttcaccaccaccgncaccttcctagccgtctttctcctcgtagcggcggtcgtgctctgctccagcgcggtcctgcgcaccgagcgaccttcacgcgctgctgagcgtgaagcaagcgcttggcaacccggcg

SEQ ID NO: 16087 - DNA, 462 bp, Sorghum bicolor
  unsure (1)..(462): unsure at all n locations
  Clone ID: LIB3476-038-P1-K1-A10
ccaatctcaagttctaactgctgctcgttggctgcttccgatccgtaccgatcacaggacgcgacgcagccacagcccacaggcacctgcaagcacagcgtgctattcctggggctcgctgctcagaccgggcagggcaagagcagcaggcagcgagcatgacggcgaaggatgccaacccaagcgggccatcatcggaggtgaccgccgccggcggcggcggctgcggctttggcgaggagcaagaggcgctcgtgctgaacgcgtggaacgccatgaagggcgagtcggcatcgtttgcactcaagttcttcctcaggatctttgagatcgcgccgggcgccaagcagatgttctncttcctgcgcgacgacgccggcggcgacgcgcccctggagaaccaccccaagctcaaggcccacgccgtcaccgtctttatcatggcttgcgagttcgcgacgc

SEQ ID NO: 16088 - DNA, 320 bp, Sorghum bicolor
  Clone ID: LIB3476-038-P1-K1-A8
cgaccacgcgtccgatcgggctggagacggcgcgtgttctggcgttgcgcggcgtgcacgtcgtcatggccgtccgcaacgtctctcgccgggcgtcgaggccagggaggccatcgtggccaagatcccccgcgcaaggattgacgtcctggagctggaccttagctccatagctttcgttaggagattcgcctcccatttcgactctctgaacttgccccttaacattctcatcaacaacgctggagtgatgacaaggaactgcacacgttcctgcgacggtctggaactgcattttgtgacaaatcacattgttgtgt

SEQ ID NO: 16089 - DNA, 408 bp, Sorghum bicolor
  Clone ID: LIB3476-038-P1-K1-C3
atcccggtcgaccacgcgtccgctgtggcggccatcgctgtcgtcgccgctgtagcctcccatgtcgtcgtcgtggtccacccgaggcggcgagccccctggcggcggcggtggtggcagccatgcccatggcccgcgccccgtccatgagccggagcggagccacctcgacgctcgccagacggaggaatcgccgactcggagcggacgcgctcactaccacgaccagctccgcttacacgagcagcatactctgccgacgtacaacttcaggaggaggcaccggtcggacgcgctgcaatgggcgacggcggtgctgtgcactgtgctggcggtggtggtgctggaggtcgccgtgtcaatcctgagtggggagctactgctgcaaccactggcgccgtactgtgg

SEQ ID NO: 16090 - DNA, 424 bp, Sorghum bicolor
  Clone ID: LIB3476-038-P1-K1-E12
acgcgaatccgtcgccacgtcgctacttggcaaggctattttggccgtctgtcttgcgacctgagctggaactggagggagtggagaacactgatgctgtgagagaaagaactgcaattgcggaatgtgggatcttctacattaactgagaaagataaaagacattggctggggttcaaatgatattgacatgatgtctatcttgtcgaaaggacagattgggactgcaacagtttggcagatgcaagccataagtgatgtaaaggtgaaaccaagagggtgaacttgaggactgaggaacgtctttatgtgtagagggatctgaagggattcgtggaaatttctgacaaaagatattacaggacatgtgcaacctgtgtactgtaccaactgataagacaattctagcacactgctgagcact

SEQ ID NO: 16091 - DNA, 472 bp, Sorghum bicolor
  Clone ID: LIB3476-039-P1-K1-C1
gcaagggagaaggcccaagctcatattaaagagcttgaagaagaagtgaagctgctcaagaacctgtctcaccccaacatcgttaggtatcttgggactgttcgggaggaagatacgctaaacattttgctggaatttgtccctggagggtctattcagtcacttttggggaagctcggttcattcccagagcctgtcattaagaaatacactaagcaaattttgcaaggattggagtatctgcatagcaatgcaataatacatagagatataaagggtgcaaacattcttgttgataataaaggtagcatcaagcttgctgattttggggcatctaagcaagtggcaaaggtggctactgtgacagcagccaaaacaatgaaaggcacaccgttttggatggcaccttgagtcattggtgggagtgggcatagcttctctgcgatttattgagtgtaggggcacagtaatt

SEQ ID NO: 16092 - DNA, 413 bp, Sorghum bicolor
  Clone ID: LIB3476-039-P1-K1-C6
cgcgtccgccacgcgtccgcccacgcgtccggacctggcaagctcaaatttgtttttgagggaaaagaagagcaagttgaactggaggtgttcaagtgcactggtgctggaggagttgccttatccatgtacaacactgacgagtccatccatgcctgtgctgaggctcctatggccactgcttatgagaagaaatggccattgtaccttagcaccaagaacacaattctgaagaaatatgatggcagcgttcaaggacattttgcaggaagtcgacgaagctggttggaaaaccaaatttgaagctgccggcatatggtatgagcatcgcctgattgatgacatgggagcatatgcactcaagagtgaaggagggtctgtctgggcttgcaagaattatgatggagatgtgc

SEQ ID NO: 16093 - DNA, 149 bp, Sorghum bicolor
  Clone ID: LIB3476-039-P1-K1-H6
cggccgatcccagttcctgatccctccatctacggaaggcgaaggttggcggacgcgcggtgtctctctcctcattccccgtcgtcaaccctacgggcactctgacacaccatattttaccgccacactggcatagccacactgctcac

SEQ ID NO: 16094 - DNA, 192 bp, Sorghum bicolor
  unsure (1)..(192): unsure at all n locations
  Clone ID: LIB3476-039-P1-K1-H9
gacccacgcgagcgacgacatgaccganccacaccnaaatgcactttctgatccttcggacgcggntgtcctattagtataggaagctcatgcacgggggggtgaagagtctcaccacttccatcatcctggatcctacctaattcgcaccttgcacaacaaccattttcctactggagaagcgtggggctt

SEQ ID NO: 16095 - DNA, 132 bp, Sorghum bicolor
  Clone ID: LIB3476-040-P1-K1-A7
tacatgcgtccgtgcccggcaccatagcacattgcaccttccagggaatatgccgaagcatccttaatgccctactcattatatcttgacaacgtggccaactattacgccagcgataacctgactgaatac

SEQ ID NO: 16096 - DNA, 216 bp, Sorghum bicolor
  unsure (1)..(216): unsure at all n locations
  Clone ID: LIB3476-040-P1-K1-D9
gggcgcgagggcggaagcttgaacattgtttccacctgnatcgcaatccttaatgccccttcacacgccaacgcagcactcctcgctgtggcctgtgtggccatcttttctggcctattcaccccccacgattatttttaatatctctagaaatgtcaatggttcaattctgagtgtatgatggtcgataacatagccgttttttggaaccacacc

SEQ ID NO: 16097 - DNA, 205 bp, Sorghum bicolor
  Clone ID: LIB3476-041-P1-K1-A8
cgcgcgcggagggcaataagtgagaataagacgcgcgtgtgttcgctggcgagcctgtagaacaacgcccacacaccggaggggctccgcttgcacccgcacaaggaacaaccgatgacacccgcgcatggtggttcggctcctccgcgtgagtgcgtcttgtgttatgtctattaggcccacaaggccggtgaatggcaatctc

SEQ ID NO: 16098 - DNA, 253 bp, Sorghum bicolor
  Clone ID: LIB3476-042-P1-K1-C10
aagcaaagaagtgaaatattgaaacaaagctgtagctttctagtccagtacttcataagcactagccaaattttggagcgcctgaactattttgctgttatataactttttgtcttgatattcgaatatcatatctggatttttatgttggataatgtagtagagatgtctatgcagagttttgttgggacaggaatccccaaaaatgtttatttggatcagattatctcgggaaatgggggtatgttttatg

SEQ ID NO: 16099 - DNA, 134 bp, Sorghum bicolor
  unsure (1)..(134): unsure at all n locations
  Clone ID: LIB3476-043-P1-K1-C3
ggggctatggttgccaggggtgaccttggagctgaactgcccatcgaggaggtgccgctgttgcangaagaaattatgagaatgtgtangagcatggggaaggctgttattgtcgctacaaatatgctggaaag

SEQ ID NO: 16100 - DNA, 153 bp, Sorghum bicolor
  Clone ID: LIB3476-043-P1-K1-C8
accgtcgatttccggtcgaccacgcgtgcgcgccgacgtctccggcggaccttcgcgcgccctccgctcccctctaccaccaccgctgccgcgaccccgcctccggagcatcctggttctggcttcccgcgccggcggacgtcctggtggcgg

SEQ ID NO: 16101 - DNA, 197 bp, Sorghum bicolor
  Clone ID: LIB3476-043-P1-K1-G8
gatcgcaacgcgtaatgcgctgtctgtgagggctgctcccattttcatgcggtgtttggcggagtccagctggcccagcagagagcgcgccggttgtgcattgctatgctgtgcctgaggatacacaatcggctttctttacactagggaagagaaatagcaatctctttttctctcctttgttggtttttttcctt

SEQ ID NO: 16102 - DNA, 165 bp, Sorghum bicolor
  Clone ID: LIB3476-044-P1-K1-E6
gcacacacactcctgtcttcgtctggagtcgtcgccagcgggcggactgagcacggcctgtcgcgcgcagagcatccgcatacggcccgaatagatacgcggaccaggacacccactcaaatgactttactaaaaacacaggagggcttgtgcctgcggattacc

SEQ ID NO: 16103 - DNA, 235 bp, Sorghum bicolor
  unsure (1)..(235): unsure at all n locations
  Clone ID: LIB3476-044-P1-K1-H6
cgcgtccgaaataccgtatattattcaagccgattccccatctccgccctgcctgacggagagcacgagcacctgcaccgccgtcacgactgctctgagcgcggtacgctgtgtgactgcgaaattgaatatgcaaacctaagctcctctanggnngtccttgcaagggatgattagcgtggggtggcatcctatgggggaagggtaaaactagattttgtttggggggtggctt

SEQ ID NO: 16104 - DNA, 266 bp, Sorghum bicolor
  Clone ID: LIB3476-045-P1-K1-A5
agtattctcgattgtttcgcgctcaatcacaccgtcaagagctcatttatgacctttaccaaacatgttatgatccggggatgaacactgtaacatgcgatatgatcacttagctcttaatatcactcatgaaggccactgctcacaatccatttagaattatattctacatgtactgtgttagtgtacgccaattttaccaaattctcctttacgagttagatgccatccattatgtatgttcatttcctttaactaacttacca

SEQ ID NO: 16105 - DNA, 231 bp, Sorghum bicolor
  Clone ID: LIB3476-045-P1-K1-A7
ttaatctccacctaactaatttaattcgaaccttactatctctaatctttcaatgtgcgcctgcggtccatttctttacattcattcaccccccacattctcgttttcttccattcctttccataaactaagttccttaactctctttctacacctctcttacacataaagcttttgcatttacaaataatatcttgacactctcttctctccatccttttttctattttc

SEQ ID NO: 16106 - DNA, 411 bp, Sorghum bicolor
  unsure (1)..(411): unsure at all n locations
  Clone ID: LIB3476-045-P1-K1-C4
cagtcagcggcttctaacttatctgtattaaatcttaaatgtgctcagccggttagtcgtagaagctcaactgacatgagtggtgaggtttgaccgtcccagtatatatccatcgcacgttctgaccaacagatgactgccttatatctctgcaatgctggcagatctattctgctatcatgttgaaccagcttttgtttttgatgtgtagccaatatgatgtattcataaatttaagtaggtgtgtcctaatatgtacctttaacaatgaaatatgtgtgccttgagtagcanagatgtcatgcaacttttactttaatttgctctgccccaattgttttttctttgtaggaacaggaggggcgagcccctatccttttatttgctcttttattcccactttttttttag

SEQ ID NO: 16107 - DNA, 413 bp, Sorghum bicolor
  unsure (1)..(413): unsure at all n locations
  Clone ID: LIB3476-045-P1-K1-D11
atgtgctgaggtacctgacgttcactttgaagtgtgtactgctgagacacaggctctgctatgagtcatgccggcggagttggagacncattgttaggaggagctcctattttcagccactgtcctggaacctacgaatgaaaatngcccttggagcagctaaaggtcttgcatatctccatagcgatgaggccaaagtcatctaccgtgatttcaagacctctaatgtccttctagatgcgaacttcaatgcaaagctctctgattttgggcttgcaaaggatggtccaactggtgacaagagccatgtctccaccagggtgatggggactcatgggtatgcagctccagaataccttgcaacaagtcatctgaccaccaaagagcgatgtgtacagcttttggagtagtac

SEQ ID NO: 16108 - DNA, 214 bp, Sorghum bicolor
  Clone ID: LIB3476-046-P1-K1-C10
cacacacacaacagcctctagctcccaccctcggtatgtctgtgtcccatgtgcccatcagctcgactcatagcttcgcgagcggcgcgcgcgcgcgcgcgatgcacacacctgaggaccgagctcgctggctgcaggtcgggtcgcgacgcgtgtcgggtgcaccgtaccaccctggagctggtccggcaaggcgccagcgcgggtttttgac

SEQ ID NO: 16109 - DNA, 103 bp, Sorghum bicolor
  Clone ID: LIB3476-046-P1-K1-D3
tattactcatttcggctctactctgaataacgatacgtcgaggcgcgtggcggccctaacaggtcactgcgcgaacacctatacacgctcatacacatgtcag

SEQ ID NO: 16110 - DNA, 206 bp, Sorghum bicolor
  unsure (1)..(206): unsure at all n locations
  Clone ID: LIB3476-046-P1-K1-E7
tatatcctgngatcaagtgcgcacagagttttccaggacaaccattacgggtgcaagttgttccagtgttgaccactcctcagttgattcaggaattagaagaacgtctcctgcgtgtattcactggccaagtaaggcttgcccaccaagtcctgcagaaagttgtgacccggtacctccgtcgcgcaatatcttgatatctagca

SEQ ID NO: 16111 - DNA, 138 bp, Sorghum bicolor
  unsure (1)..(138): unsure at all n locations
  Clone ID: LIB3476-046-P1-K1-G4
tccgtcgatcccgtcgccaccgtcggtttctggctcgagcgctcggtcttgcttggtgccgcgcctgggccgagcttgctgctgacggcttcgctgtcgcggccagctcntttctcgattnncgcgcaccgaagaggc

SEQ ID NO: 16112 - DNA, 378 bp, Sorghum bicolor
  Clone ID: LIB3476-047-P1-K1-A1
gaggtacaagaattggtagtacttttatattggcccccttctcctttttcttttgcttctgatgttgtaaagctatctttccatgccctacttgatggctaaactaatggtcctgatagatcagtttaggaaaactgggataacatatgtgccaatgtgtctcttagttttgaaatgccttatttgaagttcttttatacatattgatattcgccttaaaattcttctgatcctctttaattagtcatgatgtagatgcaatatccctttcacacccttttagaagaacatagatgagaagaccactttctctcccttttagaatagcattgatggcatcaatgacatgattactttctcatccttttagaagaacat

SEQ ID NO: 16113 - DNA, 237 bp, Sorghum bicolor
  unsure (1)..(237): unsure at all n locations
  Clone ID: LIB3476-047-P1-K1-A7
acgacccacgcgttcgtccacgcgtgcgggtggacgcacccaacgcacttgcctccgacgccgatcaccccgtcccgccgtcccgcctcctttctaagcaccgnccgcgccgtcgcgccgcggcccctcgcccgcccctgccaccacctgcgccgccagcgcccgcgcgtgggctgcccgatctcagcctgtgccactgctgggcgtccgcttcaacgccccaccgggaccggccag

SEQ ID NO: 16114 - DNA, 253 bp, Sorghum bicolor
  Clone ID: LIB3476-047-P1-K1-F4
gcgtccgcccacgcgtccgaaaaaaaaaaaaaaaaaaaaaaaaaaaaaaaaaaataaaaaaaaatcaaatataaaaaaaataaaaaatgggcagggggtgtggaagatccatgcttacttacacgtgcttacaaaaattatattttttttattgtttaaacctaaatttaattgcctggccgactcttaacaaccttggttacttttaaaacccttgccattcccaactttatcgcctattaaaacattccca

SEQ ID NO: 16115 - DNA, 209 bp, Sorghum bicolor
  Clone ID: LIB3476-047-P1-K1-H11
cacgcgtatcgccgtggccttcgctcgacatggccatggcgacctccaccttctccccgcgccccgccaccctcaacaagcccctgcgacctggcgccaagcccgccagcctcctacccttccgtgccgcggccggagactcgttgcgccacgtgcgggagcccgccgcaggtcacagcgacaggcgagcgcccgcgggctcacgggcg

SEQ ID NO: 16116 - DNA, 345 bp, Sorghum bicolor
  Clone ID: LIB3476-048-P1-K1-B4
tcccggtcgaccacgcgtccgcccacgcgtccgcccacgcgtccgaactgacatctgtgacttcttagagaatccccagatcaatcgagaaatgatggagctgattgagactttgcaacgcaaggctgttgaagaaggcaaggtggcttcagatgatgctgaggaatgtggtgatggtgactcggaggaaaatgatggtgctttggtgaagggagaggaggatgatagcggcttgaatgaggaagagcaagacagtgcagatgctgatgctaatgctgatggttctgtgaagaatgtggtgaaatcaaggaggaggaaaagatgataaaaagtcagagatgggtg

SEQ ID NO: 16117 - DNA, 172 bp, Sorghum bicolor
  Clone ID: LIB3476-048-P1-K1-B9
cctgtctaacgccaccggtcgtggggccatctgtgaatggcgtgggatctatcgaaggctgcgatccagaacggccacaaggaggattacatattactgtgttcacccacatgggtgtatgatggtgccccgggtactttcggccacgcggcagcgtgcacactactgcagt

SEQ ID NO: 16118 - DNA, 466 bp, Sorghum bicolor
  unsure (1)..(466): unsure at all n locations
  Clone ID: LIB3476-048-P1-K1-D6
cggacgcgtggggtagtagtacactcgccaagggcagaggcggccggacgaggggcggcggtggcgcggcagagccgagcggagcggagcggttcttctccacgcctgacgtctccctcttccccgctctccgcagcctcggcggtcggtgctcctcccttctcccgttcaggagccttgtttacttcctgtcatgggtatggaacatttcatgagttctgcanacccttcagcaggttttgcattgtatggaaatgaagcaacagaggaaatgaaaaggttacaaggtctaagagcagaaacactgatggaaacctaccaaagcaccagaaagcagagatgtagcgatcaggtgtccaataccatgcaaaagcagcaggcggtatagggaacatgactngagagctgcacaagatctttctgaattcattctgaggcaagctttacctncatactttatgggatc

SEQ ID NO: 16119 - DNA, 353 bp, Sorghum bicolor
  Clone ID: LIB3476-048-P1-K1-G7
attccggatcgaccacgcgtccgcgcacgcgttcggtttgactatcatctacacaggcagaatacttctatgcattggtgcttcatgtatgatttatcctactgcggaaactgtaacagattatatattttctatcacatgtgacataagtagtgttattagcaagctttgattgatattagcagagcagggagggcgacggtgaaagcagggagcatcttgcaagcagcagcatgagtgaggtgccctgctagcgcgacaggtaacaaataatggcgctgtgaagatcagtttcaagtgtttataatgccccttagaaagttacatcggctatcaatgtggtcaccctcaat

SEQ ID NO: 16120 - DNA, 134 bp, Sorghum bicolor
  unsure (1)..(134): unsure at all n locations
  Clone ID: LIB3476-049-P1-K1-A3
cccgcgcgtctcgcctcgcgcgtcgcgcgtgcctgctctctcccgccgctcggtcgcacctncgtcgactactgcagtagaaagaactacccggtgaaggtcagcggggtggagatcgtgcccgatccggtcga

SEQ ID NO: 16121 - DNA, 160 bp, Sorghum bicolor
  Clone ID: LIB3476-049-P1-K1-B7
gatcgtgccacgcgtcgggaggagcgcacttctatgatacgcccatgatgcttatgccaaccctatggagggtgtggagcatatggatgcaaggtctggttggtaggatctgaaggctacgacagctttatggatgtgtatggcagaatgaggtgtgctg

SEQ ID NO: 16122 - DNA, 124 bp, Sorghum bicolor
  unsure (1)..(124): unsure at all n locations
  Clone ID: LIB3476-049-P1-K1-C9
ttcccggtcgccacgcgtccggtcgagcagtggtgacataggaggccaccagctaaagtcacatccgagacctnctgcctggagatccatgatgtcaatgacgtatttcttggtcgcaacacat

SEQ ID NO: 16123 - DNA, 178 bp, Sorghum bicolor
  unsure (1)..(178): unsure at all n locations
  Clone ID: LIB3476-049-P1-K1-D11
accgtccgaatcccggtcgacccaccgtcggcaagagcaccagccgtttaggatcagcacgcctgacccaaaatttttttcttccccgctgatgccaatttcacttatcaggggcccgaatattcctcaccttttggngcattctttgtcccattctcctacaaaccttatcgcccga

SEQ ID NO: 16124 - DNA, 273 bp, Sorghum bicolor
  unsure (1)..(273): unsure at all n locations
  Clone ID: LIB3476-049-P1-K1-D8
tgtgtagagatgtgtggagtcactttcgtgcctaagcatgcatcaaatcactgaatgtagcaagtgactaatatagaggcctgactccactaatgatgctaaacctgtgaatgcaggtgcatgaagtctttacatactcagttgtcatgtgtctgacagcagactgtggtgtgatatgcccacagtgtagagtgtgacatcgnatggcaactctgctaatgtggcggttagacgagcgcctgtacgtgcacttgttgtcgtatgtagtttgca

SEQ ID NO: 16125 - DNA, 201 bp, Sorghum bicolor
  Clone ID: LIB3476-049-P1-K1-E4
tccgattcccggtcgaccacgcgttcggtggccgggccggccttatattcttcgtcgtgctttggccttcctcaccgcaccgggctcgtcgttgttggccattaagatacagtgcgacacgtgcgagggcgcggcggccacagtggtgtgctttgcccaccaggccgcgctgtgcgcgcgcttcgacatttagattcacac

SEQ ID NO: 16126 - DNA, 301 bp, Sorghum bicolor
  unsure (1)..(301): unsure at all n locations
  Clone ID: LIB3476-049-P1-K1-G7
gcgtccggacacttcgaacccgccgcagcccgcagcaagatttcgtcgcgccggcgctcacagtctcgtactcctcgcctacaatggcgtctccctccagctcctgcgaggtcgtggacctcgccttgcagcaagctgcgacgatgcatcctcaaagctcttcttcagcagagacggcggcggcgacttgtcttggccggcggcggcggngatctcgtccgcgctgaccgaccaaaaatcgctggttgccctgtgcggcanaatacggngtgccccagggaagttgaagcccgtgtgcgcc

SEQ ID NO: 16127 - DNA, 117 bp, Sorghum bicolor
  Clone ID: LIB3476-050-P1-K1-A9
cacggagacctagacgcccgcggaggccactacgctgacgctccacaacctgtgcccgtaccccgtgtggacgctggtgaccacgaacaccgtgttcccggacatctacgagaacac

SEQ ID NO: 16128 - DNA, 152 bp, Sorghum bicolor
  Clone ID: LIB3476-050-P1-K1-C1
ccctcgctgctgtgttgtctagtgtcccgccctctcgcggactgaccccgacgccggctgtggtgagccctgcaccgcgcttctggtgcgtccactgtgcgggcccgcggtctgcaccggggccgcgtacgggctgcactctactccctccc

SEQ ID NO: 16129 - DNA, 457 bp, Sorghum bicolor
  Clone ID: LIB3476-050-P1-K1-G2
tttaatccagtctgcttttcttgcaagtactttgtggcttacacgtttaattcgtttagaattgatgagagcaatgttttttttcttgcagatgtattgcagaattttaggataaaaacctgtgtataaaaacggcaatacttatttttattatttttattattttttttataatgcacatcattcacaagtagcatgtctgtatggacctcctttgctttcccctggctttacatgaacctttagaagctcgttctactttctcaatcaagtgcctcatcatcggtatcactgccaagtgcgaactggtcaaaagatggttgtaatcagcgtttgtttcagtggatttacgatagtgacctctgatgcagcaccttaatcattacagcctatgttggactggcatgtgtaccgaatttttgttgggtaatggatattggatgctgttacattattg

SEQ ID NO: 16130 - DNA, 165 bp, Sorghum bicolor
  Clone ID: LIB3476-050-P1-K1-H11
ccgcgcgtgttacagacgaggcaccggatggtggttgtgaaccagacacaatggtcttaagcgttcaaggagtaaagaggtcctggtagacactcaggcagataggtataacagacaaacagtcacacaccaatcaattgtggcatgacacaagcatactgacaa

SEQ ID NO: 16131 - DNA, 399 bp, Sorghum bicolor
  Clone ID: LIB3476-051-P1-K1-G2
gctcaacagtaataccatgtaccctgtctatttattaaagatgatccataccacaatctcaagctgatatgacacaatctattgtccaagagctaaaatgtcaaattttctagggcattttttcagtcgtagaacatttttttagatcaaaagacattgcccagctttactaaagtatatcaagccaacaaactacccccaccggggaacccaaagggcagcaattgaagtcacactacagaacagattacagattattagcattggtcatgataatctgagtcatctcctctgctaagggtttgagtttcggcttcagtaatgggatctatgtcttcatcaaggaaatcgacttgtaaaccatcaccaccggcatagatagcgtcttcttattaaaca

SEQ ID NO: 16132 - DNA, 347 bp, Sorghum bicolor
  unsure (1)..(347): unsure at all n locations
  Clone ID: LIB3476-052-P1-K1-A7
gtacgcgtacgcgcacccgtccggacccacagcattcgccgatcccatcgtatgtattttgttgtgtgggttattaggagttctgggattctggatctaattgcctctggttgctgggtggggtggattcgaacccagagaacacggtaggcgtgatgacgatggtcgggattccgggaagggcgtccgcgtgcttgtcactcccaccagcgacctcgtgaagattctcgcttgtatgcaagcatgcttgacgcccaactatgcatcggcatcgccgttgagctcaattgtcagagcattgttcctgggaggcaaagcaccatgtgtgcagntttagttcatgtgga

SEQ ID NO: 16133 - DNA, 264 bp, Sorghum bicolor
  Clone ID: LIB3476-052-P1-K1-A8
cccacgcgagggcaccgtccaaaatacattcataagaaaaccgagactgacctcttcaagcaccggtctaacaaagagcagagggagtgatattacacaaagcagacaaggagagagagatactacgcttttcttcatctttattgcttctatgaccgataaggaagctatggtgtatccttttctggttaaggctcttcaaaattctcgtcatcttctcaccattttgcgaatggagccaatcgaggaaatccgttgttcaac

SEQ ID NO: 16134 - DNA, 546 bp, Sorghum bicolor
  Clone ID: LIB3476-052-P1-K1-H5
cgacccacgcgtacgcgtacctttacaccagggcagtccggatctggtacctctcagtcaagtgaaggaggttcagataaacctgcaggatggagaaatcagagctggttctacatagttgtgagaataagtttgttcctttgggttgctttgctaaatctcattacaatatcgtcaacttgggcaagggtaattgatgtcatggacagtgagtcaggttcaagattatttggttttattggggctggtgctacgctagggcaactttttggttcattgtttgctgcaagtatggcatggctaggaccatttctgcttctattttcttcactcttgatggaacttgctgctctgtcatcaaaaggaatttgtattgatgatggaaattatgcttcgactgaattatgtcaaacaggggcaggacaatctcctaataccgtggctgatgatgaaatgtcttcactggtcactttacctagatcaactacccaatctcaaaaatccaaatctgaatttttcataatgtttgaaagtttctggctgatc

SEQ ID NO: 16135 - DNA, 530 bp, Sorghum bicolor
  unsure (1)..(530): unsure at all n locations
  Clone ID: LIB3476-053-P1-K1-F4
ccttatgcttctagggattcaaggcaatttggagccgtgccttatggtctcattacagggaagatcttttgtcgggtttggccactggagggctttggtccaattgattcaaaccagtcttaacaggggtaatttagcttctttgttgcatcttgttttctaaaggtaactggttctatctgatcgtcatttgtgctaatttctttgttgtccatttctgaccacagcagatggacccatattattgcttgtgcccagagatttaataacgaactcagggcccttgagcttgaaagctttcgatctactagagcacattgctacagagaagcagattttatcttgacgtctaatgttttgagttttattgtatgtgtagtaacagttttggttatcagacctgaaaccccaatcagcacatgttctgatacagtttcttgtgctaatgcgggttgtaactttactgccagtggatcctgaaaacctgattgattcatgtaaattgaggcacatnttgtttgacttctgag

SEQ ID NO: 16136 - DNA, 156 bp, Sorghum bicolor
  Clone ID: LIB3476-055-P1-K1-G6
ccggtcgaccacgcgttcgccacgcgtgcgatggcagaggcagatggtatcattatgccaagaggaaacctaagaattgaccttccaccagataaggactatgtgcagggaaggtttgcgcttaacaagtgcaacatggctgcaaagcctattgat

SEQ ID NO: 16137 - DNA, 229 bp, Sorghum bicolor
  unsure (1)..(229): unsure at all n locations
  Clone ID: LIB3476-056-P1-K1-C1
aacgtctgtctcgaggaacatgttcgtcccaaagaaagatgatagagacattggaaattaagcttgcagctgccaatgaaaagttaaagaggtctgatatgacggcctcagaaaccatgactgagtatgagaacatgaaagaaaatgtggagagtgctctgtcacgcccttgagaggctgagcaaacaattctggatggaggagaagtacnnngaaaagtacataacac

SEQ ID NO: 16138 - DNA, 327 bp, Sorghum bicolor
  Clone ID: LIB3476-056-P1-K1-E6
actgacagcaccacgaggacgaggacgacacaccaccaagcgacgacaacaaccaagggggcgctctgaagctcatccttggcagggaacctgagagggacaagctgagggtgaatctgagctgccgtctagtatgcccaagccagaggcatttggatccttccaagaaaaatattaggtcccatgtatatcaccgaggctccaattgctcggctagacctctccttacgacgaaaggtgatatacacatcaacaggttatgtgatgaatgactcactgaccgcgaaatgcacaatcaccgcgctaggaggagatgaggagcatccc

SEQ ID NO: 16139 - DNA, 104 bp, Sorghum bicolor
  Clone ID: LIB3476-057-P1-K1-C5
tgtattgggacgcgcgctgtagcgactcatataagctgcagctgttgtgctgttacgcgcaactggaccggtacacttggcagcggcctagcgctcactccttt

SEQ ID NO: 16140 - DNA, 222 bp, Sorghum bicolor
  Clone ID: LIB3476-057-P1-K1-G5
cgctagcagagtgttcaacggaatacgtcgacatatgtatgcgctcatgcgacactacctgtgctaagcgcttcaagattctagataaggggcgcgtttgagtatcatacatctgctggctgtcattataaagtttttcgccggatttagccttgctgggcctggtcaccccgtaacgctggcgataggctatgacgctggcgatcaagagactgcacgagt

SEQ ID NO: 16141 - DNA, 262 bp, Sorghum bicolor
  Clone ID: LIB3476-059-P1-K1-F7
taccgtccgaattccggtcgccacgcgtcgactcctctgatagcttgcctcattccatctctggttcagtggatggccccactctctggagaatagctactattcttccttcttttcttcttttcccaaatggttaagctgactataactcagctcgttagattttctttgttctcgatcaacgctctcctgactcctctgcaaaaaaaaagagaggaaaccgaggcgacaagcaagcaatgggtgtcaagggattcgtcga

SEQ ID NO: 16142 - DNA, 159 bp, Sorghum bicolor
  unsure (1)..(159): unsure at all n locations
  Clone ID: LIB3476-059-P1-K1-G12
cccacgcgtacgcagacgcgtggngtctcgcacgcacacctgagattccttctcaattcggttcgtgcacaaatctgctgtgcgggcgcgaactgtacattcgtatcactgcttcaaatccttagagactatacttaacagtcggtactatctgatctc

SEQ ID NO: 16143 - DNA, 260 bp, Sorghum bicolor
  Clone ID: LIB3476-059-P1-K1-H5
ttgaccgcatcgatccacgcgtgcggtctgactgagacgcatgcaaaatctgcctccatcactagtgctgttgttatgcgggatagtgatgggaaatgcaggtggttgggatatgccaatcgtgataaagctcatgatgctgctcatgctgatcaagagctgaacggcatgatattcaatgataaggaactgcacggtgcaagagcacagaagaagtctgaaagagagacggagtagaaggataaatccgcaacgaatat

SEQ ID NO: 16144 - DNA, 361 bp, Sorghum bicolor
  Clone ID: LIB3476-060-P1-K1-C5
aaaaaaaaaaaaataatataaaaaataataaaataaaaaaattaaaaaataaataaaaataaaaaaaaaaaaaagtgcgaaaattaaagaggattgaggtggaattttgattgcattcgacttcttctcttttcaaaagaaaaagggggggggcttttttggggtaaccaaatttatatcgccgggcatgggaaaactttttttttttttgggttactctaaattaaattctgtgcccgtttttttaactggcgttttctggaaaaattttgggttttccaaattatatgcttttgggcaatattctttttttacctggggggataaaaaaaaaaggtgtccatcctttttcttttttaaa

SEQ ID NO: 16145 - DNA, 363 bp, Sorghum bicolor
  Clone ID: LIB3476-060-P1-K1-C8
gacgtacgctcacgcgtgcgtgcaacactacttgttcataaagatatttaacaagagtagagggccttgattatctattagtggacctcgaaaaggatggagaaaactatttatggtgcccactgtagcacatgacaaatagatagtactaaaggtagattcattaatacatgagtatagctcaatggcatgcactctcaaatttggtgctgatgtgcaggcaaatatcactcacataaatccgtatcgaagagcacacacagactgcatcataacaactgatgaacgtgttgcctaggcttttctgtaacaagccgatagtgctgttgcgttccataattgaagcccaaggttttcggattg

SEQ ID NO: 16146 - DNA, 270 bp, Sorghum bicolor
  Clone ID: LIB3476-060-P1-K1-D2
gtccgttccaaaataaagccggcccggctttgcattcgaaccgtcgtcggagactacagtttacaggagtaatgtgaagagacattaccgacaagtgagcgcgtgtgagggtgatcaatcgtccaacctgaaacgtttgaatcgtaatttttccttttggggcaatcaatctttggcttcttaattgcaaatcggcttggaattctttttcttcttttaaacaaaattaaaatattcgcccggggtacttctggtcgaagggggaaggaa

SEQ ID NO: 16147 - DNA, 218 bp, Sorghum bicolor
  unsure (1)..(218): unsure at all n locations
  Clone ID: LIB3476-060-P1-K1-F4
gttttcctacaacgtactgttcagaaatctcaagagctagcagaaactttggccacagataactctgcattaactgataagttcaaccaacaggcacatataatcagccagttgacatctgacatggagagattgcangaagaaattcaagctcaactgctggcgctggagtctgtcaggaccgagtatgctaaatgcacaaactagaatgcaaatgc

SEQ ID NO: 16148 - DNA, 497 bp, Sorghum bicolor
  unsure (1)..(497): unsure at all n locations
  Clone ID: LIB3476-061-P1-K1-E10
aattccagctacgacgtacgcgtacgcgtacgcgtacgtgactgctggtgcaccagatcctgctgccgcgcatttttttagcacagagaagtctccgaaatcggcaaagcctaaagaagggatgtctgctgtcttccaagagattagtacaaaacctgtgcctgcagggttgcgaaaggttaccgatgatatgaagactaaaaaccgtgctgatagaagcggtgttgtcagcagtagtgttgctgctcctgctgcagctnctgaaaagacttctcgtgcggngtccttctctttcaaatctgggacccccaaactggaacttcagatgggacgcaaatgggtggttgagaatcaggttggcaagaaaccctngctatngatgattgtgattccagacaatctgtttatgtgtatggatgcaaggattctgtccttcaagtaaacggcaagggtaacaatattactgttgacaaatgcactaaatttggaatcgtttc

SEQ ID NO: 16149 - DNA, 277 bp, Sorghum bicolor
  Clone ID: LIB3478-001-P1-K1-B12
tcaatgacgtgtgtctatcatgcagacgacatgtatcttagtttctgagatgacagcactgtgactagctcttacactcaatgcgatcacgtatctcatggtacgtgaaagctcttcatacttctgatgagatatatggcgaaggatgagtatttagtgccgccatactagcacctactgctgaagccgatgttgtgacgatggttccagggacgtgtgggtatctagatcctgaatatatgcaaacatggcctgctgacagacaatgagtgacgtt

SEQ ID NO: 16150 - DNA, 209 bp, Sorghum bicolor
  Clone ID: LIB3478-002-P1-K1-E2
gccacgcgtcgttcttcttgtgggtatatgtgttgggtcacttactgcttctaccgagatgaagactgcagaatgcaatgcaaccgaaggggcgtacactggctcctgtcaaagatgccctaatcaaggggcactgtgactatatagtctagtcctgaaatcagaaacagtagctcgggtgtaaagctagagtgttacatatgcacgtg

SEQ ID NO: 16151 - DNA, 422 bp, Sorghum bicolor
  Clone ID: LIB3478-002-P1-K1-G6
accacgcgtccggcactggaatcttatttttctaaactctatcccactccacagctatactctttacctcagaagaagcacaaaagtggtcaatcatcgtcaaatgaagttgatgaggatgccaatttcaagaacagggtagactctttgcaagtacagattgttagaggaaacacaggtatcaagagttatcaaagtctcctggacatgcatacagatgatcaagcgtctggtttctatttgacttctgttattcgaaatagcaagtccagtgaaaagttctgaaaatgaatatttgtctctccctttgttgtatggtgccaagataaacaacttaatactttcaggggagtggtggagactactaacaccaatgtgcctggtattgcttctccctctattgctagataaagtatcacaaa

SEQ ID NO: 16152 - DNA, 302 bp, Sorghum bicolor
  Clone ID: LIB3478-002-P1-K1-H4
gctagacgtcctaacacaagaactggagggagcgaaaagacagatagaggcactcaaaactgaaaagtcccagattgaagctgaagctaacaaccaaagaaacctttcggtaaaactggagtctgatctcaagagtttgtcagaagcttacaacagcatagagcaggccaactaccgtttggatgccgaggtaaaaaccttgcggcagggaggcagcgtgccgtatcctgacgtggaagcaataaaagcgcaagccaaggaagaggctgagaaggacagtgagggcgaactgattgatctac

SEQ ID NO: 16153 - DNA, 342 bp, Sorghum bicolor
  Clone ID: LIB3478-003-P1-K1-C3
caccgtcaacacttacgctgcaagttgtagaatgccgctcaccatgtgactctcacggatggcgcaccccataggggctccttggaggccgataccatgccagacgggcaacccaggtgcggcgtcgcagccctgtacggcccaccggtaagactggcctttcgggagcccggctacctaccgcgagttcccgcgactacgtggacaccgggggctgtcggccgaccccgagaccttcgccaagaaccgcgagcctggagggatccactcccgctgggccatgctgggcgcgctcggctgcgtcttccccgagctgctcggccgcaaacggggtcaagtttc

SEQ ID NO: 16154 - DNA, 125 bp, Sorghum bicolor
  Clone ID: LIB3478-003-P1-K1-F1
accgtaccccacatacgctgattgctaccgcaccgagcttgtaaaccgcctgccccaccggtccctttatggattgctctccgaccttggtcaccaatgacattatctttaccacaacgacgccc

SEQ ID NO: 16155 - DNA, 223 bp, Sorghum bicolor
  unsure (1)..(223): unsure at all n locations
  Clone ID: LIB3478-003-P1-K1-F2
cgaccacgcgtccgctgtcactgatcctacgacctcgcgttccttcggcggggctcaggcggtggctgctagctcgctgctggttcagatccttatccacttcggtgcatctaggccattcggagctagcagtttggagcaatcctatttgctttacaatacaacgacangatggggctggcggactacctcgtcgaagtacagtgcgcgtctaattgcacgc

SEQ ID NO: 16156 - DNA, 204 bp, Sorghum bicolor
  Clone ID: LIB3478-003-P1-K1-G1
actcgataaaaattcttcgtacaaacactgcatggcatcggcgcaggcttgggaagagtttacaggattggagtactatttccatacagttggagcttgctctgaaaagagagttcggtgaaactagaaatgtcttgcagaatgagaatatgtgcatgagagtataaaagcgactccttatctggactcacgagcatgcatact

SEQ ID NO: 16157 - DNA, 406 bp, Sorghum bicolor
  Clone ID: LIB3478-003-P1-K1-G12
tccgattccggtcgccccgcgtccggttcggggaagaaggtggtataggagctcagattcttcgatgcctagaagagaggacgtggttgctcaacacagcataacacaggtgattgaacaacgaacccagacgatatgaactatacgatgttgatcacactggccttcactatgttctacactggggatatgccattcatgcatactgacacataccttgtgatccttggcacgaaactagacttcggatctcttactgatctagaatacgtgtatcttggcacggttgcatcacttataacatcacgctattgttgaaagaacataatgggatcagcccttacatttcctaagaatctgtgcagactagctgttgcattacaccaagccttatactacagggcgc

SEQ ID NO: 16158 - DNA, 164 bp, Sorghum bicolor
  Clone ID: LIB3478-003-P1-K1-H2
cgcgtccccgttgaatctgttagtgctggtgacatttgtgctgtatgtggaatggatgatatcatgattgtggaaactatagctgataaagttacaggaacaccatttgccactatcaaagtggaggagccaacagtcagaatgtctttctgcatcaatacatc

SEQ ID NO: 16159 - DNA, 325 bp, Sorghum bicolor
  Clone ID: LIB3478-004-P1-K1-G12
agacggcattcccggtcgcccacgcgtcggtatctggacccggagcacgcgccatggcccaccagttgcgctggcatccacaggcggtgacagagcgggtcagcagaggggacttcgcgactttcgctagccagatcttgtcggagcactgcggagggagctctttcgacgtccttgggccagtcgcgcaagccactgaagaaccggggggcccgtgagcaactgaagcgcataacggttcgcgatggcgacttctcgggctgacgcggagactccgtgacgcgcgcggaacaagggagcgtagacgcgttactttaaatgactc

SEQ ID NO: 16160 - DNA, 259 bp, Sorghum bicolor
  Clone ID: LIB3478-004-P1-K1-G9
gaaagcgagcagagaggagaagccagagcagggcgaagcacagcagctgacagaagctgagcacgccgcagcgagacagagaacgcagagagggccacagcacgaagaggatcccgtgtgaccctaagaggccagtcagttcaccgggggtggcgtacaggcgtctacgaacggccgaccgacccgcggctatgacgcgcacaggggcgtgtgggagcaggggtgcacggcaggccgggacccgattgaccagacagca

SEQ ID NO: 16161 - DNA, 441 bp, Sorghum bicolor
  Clone ID: LIB3478-005-P1-K1-C1
gaagaaaattttttataaaaattataacactcaacaatctataactttatagttctcagttttataaggtcttgtttagttcgcaaaaattttcaagataccccatcacatcgaatctttggtcgcatgcatagagtattaaatatagacaaaaataaaaactaattacacagtttacctgtaatttgtgagatgaatcttttgagcctagttactccatgattggactatgtttgtcaaataaaaacaaaagtgctacagtagctaaaaataaaaaattttgcgaactaaacaaggcctaaattaagatcattaagatgctaaaaaattaaacaaagtattcggtagtaatattcttagcttattttcttaaccccaaggtaaaatattcaacaccttcgaagtcatttccttttcatcctgtacacagtgcacgagaga

SEQ ID NO: 16162 - DNA, 248 bp, Sorghum bicolor
  Clone ID: LIB3478-005-P1-K1-H5
gcgtcgcacgcgtcggtggttgcttctctccctctacaagtcctcgtctcggtagggtcttagggtttgggagggagagtggcgcgcgacgggagtaccgtgcttctcgggctcgctggccaccaacaacagacctcagcagctcgcaactcgcagtatgctcaggcataccgccggagacaggaggcccgcgttcggttcgtaacttgtctctgagcagtcatgctgacgccatcgaaaacatgaac

SEQ ID NO: 16163 - DNA, 405 bp, Sorghum bicolor
  Clone ID: LIB3478-006-P1-K1-F7
cgtcaccacgcgtccggctgagatttattgacaaaataaaataatcgcacagtttacctgtctataacgatacgaatcttttgatcctagctaggtcatcggtggacaatagatcgcacagacaatcgacagtgctacacttcagaacgaggatgtctagctggacgtcagtcaacgactaatgtatctacacggactgcttgccactacttgttcgattgtgcataggtgcacagtcattgtcatccatgcatccttacatctagagactgctagacccatattgttgaacagaagctggtaacagtggtttgattaactatctgtgaagtgttcacgtgaggctgaactgtgacatactaattaatgttaatcaacttgggtcgatacctacaatgaaacaca

SEQ ID NO: 16164 - DNA, 469 bp, Sorghum bicolor
  Clone ID: LIB3478-009-P1-K1-A3
ttccgatcgaccacgcgtccgccgaccaacaagaattagctcggtagaagaacagtcggcgacgaagcatcggcagatggatcgactgatctggaccggcagaaggtgcagaagacagcagaaggccgcgtgccgaggacttttcgagtgcctgctcaagctgctcaactgaatacacaccagacgatggcctaggcatggactgctactggatctacctactggtctcgtggactaagatatcctacgacagtaatgccctgggatcgaccgctgaggtgctcttctccgaccggccactatgggagactgtcgctcttgataactgcttaatgacgacctacccaaatcatgcaccattcatgtgaccatagctgtgggtactatcgacatcctattgacactgtatggctacattgcatcaggcacaacaaacacatgctgtttgtgccattatgctatcttggtc

SEQ ID NO: 16165 - DNA, 177 bp, Sorghum bicolor
  Clone ID: LIB3478-010-P1-K1-D4
tcgcgccacctcgctgctctccggcccagggttgctttgtagggtccgtgtggatatgttggacaggagggctgatctggaacctcattagccgtgtgtagaatctgagaatgaaataagctgtcacaagcgaataccctgcaaagctgagcaggcatgacacctgatatgcgagac

SEQ ID NO: 16166 - DNA, 145 bp, Sorghum bicolor
  Clone ID: LIB3478-010-P1-K1-G2
gattccgggtcgcccacgcgtccgtcgaacgccgccccgttcctcaatcacggcggccgaccacccatttgtgcgcgacagcacgaacatgcctagcatggtaggaagactacatacatggtatgcatggcttgcagtacacatg

SEQ ID NO: 16167 - DNA, 252 bp, Sorghum bicolor
  Clone ID: LIB3478-011-P1-K1-C6
gttcgtcatctgagatcgtcttgtcgctgcagaaacctgcagttgtacatagactccagcaacgtcgacgacttacctggtcggttcatcacggcgccggcggcggaccccaacgccggcgaggtgtactacaggctgatgcgcggtcatgtcgaacagagccggtcacgctggacccgctgttggggaagctgtcgtgcccgctgctgctgctgtggggggccctggacccgtgggtcggccccggccaag

SEQ ID NO: 16168 - DNA, 384 bp, Sorghum bicolor
  Clone ID: LIB3478-012-P1-K1-F12
agaggatcatcctacacagatccaaatgttattttcacacatgaacatcgcacactgacattgcagcggagctgggttcttctaaatagtgagaatctggcatttcaggctgcctggggaatcctcatgtacggctgaagaaactgcagccagacaggagaaggcagcgccaccggcttcttgatctcgtcggcgttgttgtacaggtcgccgtggcgcagcacttccagcatctggttttggttttgccatggacaggacagaccagcaactcgtgtcagcaacggattatggtagcagagttggagttagaaacatcttactttggtgatgacggagaggtccggcgggcaggccccgccatggagcgttgccgccagcgcc

SEQ ID NO: 16169 - DNA, 205 bp, Sorghum bicolor
  Clone ID: LIB3478-015-P1-K1-B8
aaaaaaaaaaaaacaaaatacacacaacacaatgcgtgtgaaggaccggatagacggcgcgaaccgtgtgcacgcgctggtgaaggagaagttcgtcgcgctgacggttcatttccttgccgtcctcaatttgatcgtcgccgccatggtgttcatgggctgagacgatgcgtacctactctttttgactagccgaggtctattt

SEQ ID NO: 16170 - DNA, 397 bp, Sorghum bicolor
  unsure (1)..(397): unsure at all n locations
  Clone ID: LIB3478-015-P1-K1-E10
gcgctccggggcgggacaaggttctttctactttcctggttcttttcttcaccctgtttgccntccttctactttttaactggttggtgccatggctggtaccttgactcctttcggaatggttcgaaggtttggtggtcttcgtcaagcttaaccgcttgaaccatttcccttgaatcctcggaccccgaccggcgttggctatctggtggcgatgggtctactggtgtaacccggtgttctggaccatctacggggtcacggcgtcgcaattcggcgacctaagcgcgaacgttaccggtactggcagaagcactggcacagtcgtagtgaaggaatttctggaccaaaccctgtgcatgaagcacgactttcttggctacgtcgtgctggcgca

SEQ ID NO: 16171 - DNA, 160 bp, Sorghum bicolor
  Clone ID: LIB3478-015-P1-K1-H10
gatcccggtcgaccacgcgtccgcggacgcgtgggtggcggtgtgcagcttcaagatgtaaagcctaatccatccttaggctcttctatagcagtaatcggggaggattgatcgcttggtgaagctcttgaaccttatcaataaaaccttgagtgttccg

SEQ ID NO: 16172 - DNA, 362 bp, Sorghum bicolor
  Clone ID: LIB3478-016-P1-K1-B8
gtccgcggcacgcatagttcaaacgatattcaaagcaagagcctgggtgcttcgacatggagcggcacagggatataatcagggttgcgcttggcagatctagggacctctcaaaattcactgactacggtgcacttaaagcataattagacacgaggtgtgaattgaatggccaattaatatctgccaacagacgctggcagatcgggtatactgacactgaagctgacatgacgcttgcgtcggatgacccgcgacaagagttctgtagcataaggcgcaagatctacatcgatacgagcgtggaaggccagaagatgaactctagatcatctgcgcccaggaaggaagagcctttaaca

SEQ ID NO: 16173 - DNA, 300 bp, Sorghum bicolor
  Clone ID: LIB3478-017-P1-K1-B9
cgattcccggtcgaccccgcgtgcgcccacgcgtccggtcgatctatcagcaaagcacccacaccagcgaaaaagcaagcagcgatggcggcctccatgatctcgccgtcagctctggtggcgccgccgtccagggcgcagggcctgccgtccctcggccgacgcgcctcctccttcgccggcgtctgcggccccgtcgtgaagctcaagaccgtcctgcccttcgcgattggaggtggcctgtccgtctttagtgctgtcctcggagggaatgtgccggatctggtcttttgtgaggta

SEQ ID NO: 16174 - DNA, 342 bp, Sorghum bicolor
  unsure (1)..(342): unsure at all n locations
  Clone ID: LIB3478-017-P1-K1-D6
cggacgcgtggggtttgagggcaagaagcttgtctctgccaccaaggagggcctgaagcttgatgagagcgaggacgagaagaagaaaaaggaggagctgaaggagaagttcgagggcctctgcaaggtgatcaangacgtgctgtgcgacaaggtggagaatgtgggtggtctctgaccgcgtgatggactcccctgctgcctctgactggtagtacggctggaccgcaacatgagaggacatgaagcccagcgctcaggactccacatgttggtcatgcctccagaagacaggaatcacccgaaacgcatatggagctgtcagcctcgagctgcagacac

SEQ ID NO: 16175 - DNA, 289 bp, Sorghum bicolor
  unsure (1)..(289): unsure at all n locations
  Clone ID: LIB3478-017-P1-K1-E5
tttcacagacgcattaccatctgatgaaacattatctaacttatcctctactcgcctccatgatcattctaagaacggacagggtgttctgcaatcgagatcacatctgtaatctgttgatgaacataatgttcatacatgtggacatgctcgttcatatttggagtatgttaatttctgggcaagacgtcctgtctatcttttgtnannctacacgaacgtggacagtttcactactattgtgttatatatttaaacattacatatatgttacctgttcatactaatt

SEQ ID NO: 16176 - DNA, 354 bp, Sorghum bicolor
  Clone ID: LIB3478-017-P1-K1-G7
tcgaattccaggtcgaccacgcgtgccgcttaaggtgatgaagtagaagaggaggagaatgaggcagctgcctctgttcaggccaaaataaaaagtattcatgatgtgttggatgatcctcgctttcttaaaggggaaccagaggatgtacagttgtccaaggagcaagaggagcagaaaaaggatactgttcaatctgtcagggatgctttgatctcaaagaaagttgaatcaagagagcaacatcatgatccactgtctgatgattatccttaagactagaatgaagaggatttttgcaacctgatgcccctctggttgacatcataagcggaccaacttacacttatggcc

SEQ ID NO: 16177 - DNA, 247 bp, Sorghum bicolor
  Clone ID: LIB3478-017-P1-K1-H1
gtcgccacgcgtcgctcaagctcaagcacgcacagcctcagccacacaccaagatcatggcggcggaactccagcgtgtgactcaagcggcgggaggcccagcgcgcgcgcgctctccagcaacggtgagtggtcgccgaggcgcgccggctgtcgctgcggcgtttgcgtaccgcacacgtcgccaagccggatcatgacagtcctgggagagcaaggccaacaaggagctgaatgacaagaaaga

SEQ ID NO: 16178 - DNA, 138 bp, Sorghum bicolor
  Clone ID: LIB3478-017-P1-K1-H5
cctacgcgtgctgtatgcctctttattccctggttgttcttagagaagccaaagatggatgatagtatttcatggaacttcccgccattcacattgttcttaaattgcctgtccactttcatactcaacatgtcggtt

SEQ ID NO: 16179 - DNA, 263 bp, Sorghum bicolor
  Clone ID: LIB3478-018-P1-K1-A7
gttcttcttcgcgaaccgccaccgccacgccacctcaccaccagctcgccggagatcacgagaggggccaggacccgcccgcaatcctcgacgccgcccgcccgaccgccatgggggacgccgcctgcggcctgggacacgtcgtctaccctccccgctccgccgaggacatctataaggactaccgcgcccgccgttccgacattctacgcgccctcacatcacgaaggtcgagggtctttttacgcgtgcagtgctgatcc

SEQ ID NO: 16180 - DNA, 478 bp, Sorghum bicolor
  unsure (1)..(478): unsure at all n locations
  Clone ID: LIB3478-018-P1-K1-G2
cgtccgaatccggtcgccacgcgtccggtgatgtcagattaccagcccgggatgagatacatctggggcaagaaaaataaccggtatgcagaacttacttattccagtccagctctctggttttctctgaatcctggctgaacacactgcataaaactaacctggaacccttcatgccaacatcttatcatcaggttaggcatccacctgcaacatttgtcaaacaacccaacgttcatcgacgaaagatcagccaagccgccgatatggcggngatcggagatgatctccgacgagcgatactatgagccggtccagtggagaatgtttgcccatgtctgcacagtgccggtgaagtacgaccctctctgggccatgcgccggctcgcgtcgggcgggtacatcgtctccggcgcccagcttcacgtgaaggcccacgactcgaccaacatnctgcaccttaggcctctgtacacgc

SEQ ID NO: 16181 - DNA, 335 bp, Sorghum bicolor
  Clone ID: LIB3478-018-P1-K1-H12
gcacacgaatgatcgaagagaacacagacgtacagtggcagaagtcagagcaaaagtagctcttgagcatgagcagaaagagctggaacgatatttggagctggaaaggatacaaaagcagagagaggaagcgttgcgcagaaagaaaatggaggaggaagaagaaagagctaataagctgagattgctggggaaaaaccggggttgagaactgggatcttcatacacaacgtatgcggcttatgtgcctggaaaaccatagactggtatactatttttgccatgacctggattggtgtttctggagcattgatttttctcttgcgaatgggatg

SEQ ID NO: 16182 - DNA, 446 bp, Sorghum bicolor
  unsure (1)..(446): unsure at all n locations
  Clone ID: LIB3478-019-P1-K1-A9
gtcganacgcgtccggtatgagcagttattttcatgaccagcatgacagaaagctgggttgttatttttttgctatgaattactattatttttgttattccaggtgttgatccagttgcacattatatggagtggttacttatttntgttcattatgtattatggaatntggtactcctagtttacctgcatctgcatgtataatgtccatacctgttcaattttcaagttttatcaaaagaatggacgtttgatgaacaattgaaatgaggaacaactcctacaaacaaacatacctatgaactaatacctggagtcatgatctttagatttcttttcctttcctgtagtagatgtctgacatactttcttttattgacttgcttgtctgggactggggtctagtggtactggtcaaaatatttagcattatactctatacttgg

SEQ ID NO: 16183 - DNA, 338 bp, Sorghum bicolor
  Clone ID: LIB3478-019-P1-K1-B6
tacgcgccacacagctcaatggcactcgtctccgccttctcgtactccaccaccgacgtcgcggcgctccccaggaatgggcagcagcgcgcgtcgtatacgtccttactgggggggaagacgctgctgaggcaggccaactacgccttccggccgtcgttcgccgtgcgcaccatggcagaccccgacaggcatgatcagttgccggagcgcaccgctgcgtttgtggtcaagtactgccttccgggcgacttcagctttgatccctgaggccctcgatctgacccgcatagcatgagttggacaatgcaggagctggtagaccacaggcggagcat

SEQ ID NO: 16184 - DNA, 344 bp, Sorghum bicolor
  Clone ID: LIB3478-019-P1-K1-C6
tccgcggacgcgtgggcggacgcgtgggcaagactgattatcctctgccgacttctactccaaaacattcgacaattgtcgaagctgaccttccctggagaggattcccacccagcctgtagtatttacacaaggatgtaaaaaaagcgaatatgtaactattacttatttttttttcagattcatttgcatatttctccaaatcttctcttttgctgcgcgttgggtatcaattaggttgtaatcttgttttcccccccccccaccgatattgtgtgagttacaacgactcatttttggcccttgataacgcccacgagtatgtaatacggactaatgaatca

SEQ ID NO: 16185 - DNA, 190 bp, Sorghum bicolor
  unsure (1)..(190): unsure at all n locations
  Clone ID: LIB3478-019-P1-K1-E5
tccgtcaagggcgacggcctgaacgctgaaatcgccggctccagctgaatcatatacaccgcttgntaaggcaccgacgccataaggaactgcgggaactcatatgtaccgattcttgatgccctcccaatctggatggcggtgtttctagtccaagtgagaccacatggcataaaactcaccctcatga

SEQ ID NO: 16186 - DNA, 506 bp, Sorghum bicolor
  unsure (1)..(506): unsure at all n locations
  Clone ID: LIB3478-019-P1-K1-F5
tccgcttgcttcatcttcttcagcttgcagtgggctgctggattttggaccttttggtaccccggtggatcaagaagtggccgtgcatttttgcttccctggcatgtcttctttggtatattcatctatgttcttgctatcgccactagtgtgactggactcctggagaagtcaatctttatgcagagcgccaaaatgattgagcgcttctccacagaagccatgtttatgaactccctgggaatgctgttggtgctgttgagcggccttgttattcttgcaattgttagtcctggacccagcaagattgacacatacagaggctcttctgagtgagaggaaatgattacagcttagtttcttaagctacatttttaaccagtagctgagcaattnttatgtacacagaattatccctttgttcctttgacaatgagttaagtcaggttgagataatttcaatcctgttagagtgaacgacttcatttcaagttgggtaataaaat

SEQ ID NO: 16187 - DNA, 518 bp, Sorghum bicolor
  Clone ID: LIB3478-019-P1-K1-G1
tccggccggtaggcgcgctcgcgcgtgcagggcgacggacggcgcatggtcatcatggccggcatgctccccggcgtggagagcgcgcggaggcggcgggtgcggcagtcgtcggagtcgggggcggcgcggcggccgtccctgtgcctgtacgccggcgggcttggttcgtcgtcgtcggcagcagcagcagcagcttcgtccaaggcaagaactttgctcgccatcacccatcagtctgttcgttcatgtcgtctgcatgtggtgggtggcgtccttgtgatgctttgcggttgcctgcaggtgtggagcggcgcgtgcggggacacgacggcggcgatggcgtgcgcgtggatgacgacgctgggcagcgacgcccgggactccaaggagaggctggatcacaagctcaggggacacagacagcctgtggtgctcaagaggcatcagacgacgagcacgcgaccaccgccggcaaaaccgcaggacgacgcgacgcgcggcgccggcggaagcga

SEQ ID NO: 16188 - DNA, 235 bp, Sorghum bicolor
  unsure (1)..(235): unsure at all n locations
  Clone ID: LIB3478-020-P1-K1-H1
gacccacgcgagcgggtggcttctcctccccctccagttcggttcggttcgcattcgacaggttcttctggggttccggttcgngggttagcggaagagatgggggggtctgtacgtcagtacccctacttcctcagcggactctcctgggccaccgacgacaacgcccttcacttcgtcttcagcacctacggctaggacctcgagtccaatatcatcccgcatcgggagacgc

SEQ ID NO: 16189 - DNA, 214 bp, Sorghum bicolor
  Clone ID: LIB3478-021-P1-K1-A9
accgcgtccacctccccggacgcgggcgcggaggcggctgcgcacacactgtagtgagtcaggaagagactgttgatcattacagaaggcacgagcaaaactctataatgctttaccaactggagagaagtttatgcatctaataaaagaacacaacatgataaaactcacctaatcactttctgcatgagattcatatgcatcattattaaca

SEQ ID NO: 16190 - DNA, 226 bp, Sorghum bicolor
  Clone ID: LIB3478-021-P1-K1-C4
aatcactttgtctactaccagtctgtttgtgagtactgaaatattttcatacaaaaatctacgtgctactataagaatgcataacttatgccaatatttgtcatctatgatctggaactgcgatttgatagctaggagctttcaaatcattgcggcaacttaggcagaggaactgtttattggaatggcacctggagttgtcaaatcaaagaagacatatggacct

SEQ ID NO: 16191 - DNA, 125 bp, Sorghum bicolor
  Clone ID: LIB3478-021-P1-K1-E10
acgcgtccgcggacgcgtgggtatggttagtgtggctaaatattttgatgctccgataaagcttctgattccaactgcaacaccttggtgacattgcaatacccgtgctgtgcactggccaggaa

SEQ ID NO: 16192 - DNA, 170 bp, Sorghum bicolor
  Clone ID: LIB3478-021-P1-K1-E4
atatgcctgcaaccacattcctcgccacgctgcctctcgcgcgccacggccgcgctgtttattgcgactaatcccgcagcgctcgaccggctggagagcatcatacctcggtacggctagatcatcgacagcatcttcttttcctacagggaccgggacgggaagctgca

SEQ ID NO: 16193 - DNA, 364 bp, Sorghum bicolor
  unsure (1)..(364): unsure at all n locations
  Clone ID: LIB3478-021-P1-K1-G6
tcccggtcgaccacgcgtccggagcagtccggtacaggactaccagatgtgcaagatctcagggtgcagagctagcaactgcagatgccgtgtggacgaagacactccagctctatgagagctgctctaagatcccagcgacccgtacttcgacagcccttagtctgtggcatgtggctagcctaggagtactaattcttggcacgtgtgaactagcagtcgacgctagaacagagaagctgcttcccatgacctaggactatactgatgcacatgagtcanccgctggtacgatgatccgcgcgaggcaaaccatagctaaactcatggccagtcaggacagattacacgatgctgtcgagct

SEQ ID NO: 16194 - DNA, 344 bp, Sorghum bicolor
  Clone ID: LIB3478-022-P1-K1-C11
taccgtcccgattcccggtcgccacgcgtcgagcataccagcagctgctacaccacatcgatctgctcggggggctgcaagccaggaacaacaaagagctgctgagtctcagagctaactctcagctctcgaggatgtctctggaaggctgtggacacctggcttggactcgggggcggacccgtcagatcttcggcacggggaggcgcagcccgtgttgccagagcacgcggcgaagaagcacgtcatcggagccgggcaccgggagcctaccgtcgcgctggcgacacctatcagcatgagggttcgcgctgatgaaacccgctaggcgttcccttactacc

SEQ ID NO: 16195 - DNA, 274 bp, Sorghum bicolor
  unsure (1)..(274): unsure at all n locations
  Clone ID: LIB3478-022-P1-K1-E12
cctggtggacgctgctactcccgtggtggctatgtctcaagatggtctgccctttggtggggatcagccgattcagcccccgccccctcctgggctggaaactccctcgtctacaggcgtggtagtctcgtcggtgaccccgcaagcggctgggcccacntgtgtggttgtnccatcgtcaactnncgtcatggctgggacaacccacgagtttgccgtagcggagcagattaccctgcaagcaccgtggctggccccatgcttgctgcacatc

SEQ ID NO: 16196 - DNA, 189 bp, Sorghum bicolor
  Clone ID: LIB3478-022-P1-K1-F3
ccggtcgaccacgcgtccgttttgagttccgacctaggttgtttgttggtggaaaataaagaaccatgtgctactgcaattatcaatgtacaaggaacggccggacgaatgggacagtccaagcttaccgtcgcgaacgtgcaaccacatagcatttatatggtgccaccttaattgaatacactggcc

SEQ ID NO: 16197 - DNA, 188 bp, Sorghum bicolor
  Clone ID: LIB3478-022-P1-K1-G12
gccccggcggcgtcaacgacaggcaccgcttaccctgggagcgtgtcaccacgctctgaagtgatcacctgaactgatgtcatatgacagcgcgttcgctgtagatcactttgtatgctatgcctgactaatcgcttcacatcgaacagatgactaacgcatgtttcaatatggatcaatcagtgtat

SEQ ID NO: 16198 - DNA, 122 bp, Sorghum bicolor
  Clone ID: LIB3478-023-P1-K1-B10
gcagtacggtccgaattccggtcgcccacgcgtccgggcggcagcggtgtcatcagcttcgcgcccaggacgctctacttgacttctaagcgcgtcggagctgccggcccgcagccccctac

SEQ ID NO: 16199 - DNA, 471 bp, Sorghum bicolor
  Clone ID: LIB3478-023-P1-K1-H12
gcgtccggtaggctactaagcttattctcgaagttcctgggtccataggggtcaaggaacatggcgcactacttgctagaggtttttgtaagacacggatgaaattgttcctgaattcctgggacagggacgatttcctgggatgaggaacccagcttcgacctgttttctgatactactaagaaccgcctttctatacatgaagagataatagtatttgattgttttttaaaaaaaaactttggttgttaggagtgggactaatgttaactgaacccttggcactagcttccgtgtgaaatcccttgcattttcttaactgaccttggcatatttttctgcaaattcacatattttatattgacatttacttcctattttgcccctattgtgatgtactccctccatcccaaactataagtcctgacataatatatttctgggtgcgtagcaaaagctatgtacctagaa

SEQ ID NO: 16200 - DNA, 309 bp, Sorghum bicolor
  unsure (1)..(309): unsure at all n locations
  Clone ID: LIB3478-024-P1-K1-F3
cgattccggtcgaccacgcgtcncgttttttactattactacccgaagcggcttggccaagttctttttgtcgatgctccatttgtttttcagccaatgtggcaggtgcttaaacctctgttgaaatcatatgcctccctggtaaggttttgcgacgccaatactgtgagaaaggaatactttaatgaagaaactgtgcctgctgatttctgcaatttgatcccatgatcatttcttcagtaattgcaaaaatgtgcaggtgattttctaaacatcacctttattttatcaatattgatctaccgattt

SEQ ID NO: 16201 - DNA, 447 bp, Sorghum bicolor
  unsure (1)..(447): unsure at all n locations
  Clone ID: LIB3478-024-P1-K1-G2
ccggtcgaccacgcgtccgctaaacagtcgttttaaaaagtccagagacaaaattgagccttgagtaatagtttagagaccaaaatggctattctgccaaaaagatacagtaaagacatgtaccttatgtatgtgcatgcatactcgatggttctgtaagtatacacatcctaccttttatgagcacatgtaagagagtagctatcgacatgtcacatcacttatatcagttaaataatacagaaccaaattgagttaagcttagccgtcatcaaaatagtctttataactcttcgcccaattaaataatctctgttattatcatatgtttactcaacaacgtagcctaagactaagagcgttttccgacgacatttccgcattgtgcaactacatatagaatcagattcccgatnaatggtttttctttttcacgaaaaaatgatc

SEQ ID NO: 16202 - DNA, 305 bp, Sorghum bicolor
  unsure (1)..(305): unsure at all n locations
  Clone ID: LIB3478-024-P1-K1-H2
gattcggagcggaataaggcacctcaaggccgtacagggcacaaggtacggccgcaccactctcgccgcccccgccggcgacctncgcttcaaggcctccgccaccgaggccgccttcgccaacgggccttccctccggggcctcaccctcaccctcgagaagcccggcgccttcctcgtcgacctcaagccccacaaccaggatgtgcgcttccagttcatgaactccgcgctcgtgctcgacaagcgggtcagcctcacctacacccactccaccagtttcgccccgggccccgcgccccccg

SEQ ID NO: 16203 - DNA, 188 bp, Sorghum bicolor
  Clone ID: LIB3478-024-P1-K1-H5
gacccacactacccgtacgataattcttcattatgtacgcacaaatgcaggaacgaaccctattctgtctctcaagcaaccatagtaatgttctggcggggcaaatcttaatctgcatcagtaggtgaagatacaagataacgtcttgttacattttcaaagacactcttattggctaatttttttcc

SEQ ID NO: 16204 - DNA, 318 bp, Sorghum bicolor
  Clone ID: LIB3478-026-P1-K1-B4
cctactatccactctataatatcactacattatcatccatcactaaattgtttccatcctacagcagggcccaatactactacgcggggagggataaagttaattatatctctacaattaaatgaacttttcttgattcatgtgtcttcctatctatctttccttattcacgctttgcacccttaccaatctctcattcattaacatgttactaaaacttttatatcacttactcattccatttaactatcttcttctcactcttttcatttccacaatttaccaatatctttccactaaatacacatccatcctttc

SEQ ID NO: 16205 - DNA, 202 bp, Sorghum bicolor
  unsure (1)..(202): unsure at all n locations
  Clone ID: LIB3478-026-P1-K1-C8
ctctggccagggtctccctccatagcgaggatgtcgagctcttcnccgtcaacgaccccttcatcaccacgcttttctttacaaacatccgcgagggttacaccntnctccctccacttaaccacatttaaatcaccctcaaagactccaanacccttctcttcttttataagccgggggccctccataccatctttttttt

SEQ ID NO: 16206 - DNA, 145 bp, Sorghum bicolor
  unsure (1)..(145): unsure at all n locations
  Clone ID: LIB3478-026-P1-K1-H6
gaagactcaataccaccaacccagcagcagggcacaactaccacaaggcagtgtctgcggcggcggacggcattcggtagcggagatgaaggccacgctcaagggccgctactagggcgacaaggctacggncgncaccactctc

SEQ ID NO: 16207 - DNA, 277 bp, Sorghum bicolor
  Clone ID: LIB3478-026-P1-K1-H7
ggcatcacaccatgagccgtgctaggtggcagaggcacagggcagcgagctgcacctggtacatgccagagcaccaggcggtcgcatcgtggtgggctgcattccggaccgcgtgcggacgtgcgacggctagctggaggtgctggagatcacagtcccataaggggcacgagctgacgttcatacagggcgggcaggaggaggtccagttcatggacacagtcgtatacatcgagggcgcatgcgtggatgcattgctacaatactgcgatatatg

SEQ ID NO: 16208 - DNA, 210 bp, Sorghum bicolor
  unsure (1)..(210): unsure at all n locations
  Clone ID: LIB3478-027-P1-K1-B9
cccgcgtgcgcccacgtatangggaaaccagctgctgctgctgcaagaaaacacatgtacacagacagcagcatggccggagtccaagtgacggcggcggccgtcaacgtggcggggctgaaagggtcaagggttggcaacaccaccggcttgttcgccggcgactggaggaggaaggctcgacgccccgcgtgctctgtctgggcgctc

SEQ ID NO: 16209 - DNA, 341 bp, Sorghum bicolor
  Clone ID: LIB3478-027-P1-K1-C4
acccacgcgtacgtgcatattgccagacatttgctattgatataatggctctctcatcgtagagacacgcactgcctctcactgatgaagatgacgacgacgggcagcgatgtttcactgcttctactgcgtgcagatgggtcactccatcctttctacattatggcttgggcaattagcagcttgcagcgccgaatacagagacaggaggcagctgctctagtgtaacggacgtggtattatcctgcattcgggcaaggaggggaggcactgactatcgtaccggctactctgcccactacagtatgtaccaccgaaccataattatatctatctatgtt

SEQ ID NO: 16210 - DNA, 189 bp, Sorghum bicolor
  Clone ID: LIB3478-027-P1-K1-C5
gaccacgcagcaggctaagcagcatcttacttggggccaaacagaaatggcggcttcttgcgcctccaccctcccttcgctctccttcgttacctcctcttgcagtgcatgtccgtgatttaagcgctctggtgtggtggccattggccagcgttgggcaaaacgtgtatgcgctccgtttggtaggga

SEQ ID NO: 16211 - DNA, 150 bp, Sorghum bicolor
  Clone ID: LIB3478-027-P1-K1-D1
cgccgattccggtcgccacgcgtcgttaagaattgattgtgtgttttccgagagtgagaaaagacctcaatttactggagacagtgatgtaaacatgtagtcagacaggaagtaggaggtattgggaaaagttccacaatggagcgcttt

SEQ ID NO: 16212 - DNA, 150 bp, Sorghum bicolor
  Clone ID: LIB3478-027-P1-K1-E11
gcgtccgacacgatctattatagatctctagctactgcagttggtgagacacaaaaggagattgaatctgcgcacatgaattcaacaactgcaggacaggaggacgagatacttacattggtcccataactcaattaattgaatgcctat

SEQ ID NO: 16213 - DNA, 270 bp, Sorghum bicolor
  Clone ID: LIB3478-027-P1-K1-E8
cgatcccggtcgaccacgcgtccgctgattgcatacccatagaggagtgatgcttcaagctgaagattttaccaaccaaattaccttggatcttgatataataatgcaagggcaatcatgtcatccaggatcataatcataaatagcacatccattagagttcttgaagtgaagatggaccatgctgctcgctcctagattttgcccaccgcacgtagctcatctgagctcatgcatgagcaatatatgggtttctactaatggcaactg

SEQ ID NO: 16214 - DNA, 287 bp, Sorghum bicolor
  Clone ID: LIB3478-027-P1-K1-G6
ttgggaactgtacttctggaaattcttcaactgagccatacatagtgtatcacaacatggcggggtgtcatgccaatagtggcagcatttacaaggaaaacatatcaagggaaacaaggtgcctatattcgaattacacgctctctcaagatgctactgaccatttcgaagtattccaacagatatagtaccagctgaccatggtataagacctcgcgctgcataagtactgcaccggctccttctacccgctgacgatttttcaagagacccctgcatagtttgag

SEQ ID NO: 16215 - DNA, 168 bp, Sorghum bicolor
  unsure (1)..(168): unsure at all n locations
  Clone ID: LIB3478-027-P1-K1-H1
tccgcgatcgtcgccacctcgacgcacgacggctgctcggctgctgcaagagatcggaacatcacagagctggcagctgcgcaggcaacttgtgagcgtgatccaggggagtngccgcgcgcgccactgtcatgtcactttgctgataaacgtcgccagtagcactgt

SEQ ID NO: 16216 - DNA, 220 bp, Sorghum bicolor
  Clone ID: LIB3478-028-P1-K1-A5
atcgacatcactaatatgttatcaaatcataactcgatcaatttcaactcacgtcatatgcaattcaaatagatatgctcttataatgttaaaataaatgaagcttaaagttttctctcttataaagacaatctttcggttgtcgtagctccgattagagtgctttttcacgactgcgcgcttgtagcaaagtgtacattagttttcaaatcattcttat

SEQ ID NO: 16217 - DNA, 210 bp, Sorghum bicolor
  Clone ID: LIB3478-028-P1-K1-A9
acccacgcatccgcctgagagacactattacatacaatcataccatcacaattaacatcccattcccacaactcccttatttccactgataaatctcatgctggtaggggacctcgtcatcgccgataatgtcacaacctcccatattaagaaaaacgcctccaataactatctccaaatcacaaccagacctccgaatggactcatcca

SEQ ID NO: 16218 - DNA, 187 bp, Sorghum bicolor
  unsure (1)..(187): unsure at all n locations
  Clone ID: LIB3478-028-P1-K1-D9
tattgtaataatgaacatcatataatctaattaagatngcaagattntccacttggacttcacaacaagatttacatccatgccaagaaagcgaactctgatacacttgcgttattccactaacaactaacttctcatattcacttccctttcatgaatcaagatacccgctctaaatgacagtccc

SEQ ID NO: 16219 - DNA, 249 bp, Sorghum bicolor
  Clone ID: LIB3478-028-P1-K1-E7
aatcccggtcaccacgcgtgcgtatagtatgtataacattgcctgccgcaaccatgattgatgcatatgcaggaaagatagcgccaattgtactgaattgaaggaagcagattgtttcatggaacgggacaggggattggtgcacagtctagacatcttagtggggcaagcgtggagcgggatcccgtggttcgaggccggctccaacccgggcgccataacgcccttattcttcggatctctgggggg

SEQ ID NO: 16220 - DNA, 231 bp, Sorghum bicolor
  Clone ID: LIB3478-028-P1-K1-G8
aagctgctgcaagataaatattcagctcttgctcacatcactctgtattgtgcccagggattgctgatgctttgaaggactctagcatgcctgtacgcctagcagcaaaacgctgcgcccttcatgttttccagttgactaaaggccagataatgttacatcagcacaaaagtacctaggcatgactgggttgaagtgaaaaaaaatgccaagcttaactaggagagtgat

SEQ ID NO: 16221 - DNA, 194 bp, Sorghum bicolor
  Clone ID: LIB3478-028-P1-K1-H12
aagagtcagactgctcctgcgcgtgacgagacctgtgagcagggctactgtgccacactggggcctgctcagttagaaggaagctctgtccggagaactcactcgcgtgctctacacgcgtctgacatgggagcgcatgtcgtgaccaccgcgagttacagagctgagagcatgctctaccgcgctactcgatc

SEQ ID NO: 16222 - DNA, 453 bp, Sorghum bicolor
  Clone ID: LIB3478-028-P1-K1-H5
ggacacacgagcaatgtggcgtgctatcagtgggatgttccgcaatcgaataattttttatgatgctgaggttcatgatgttcctcaggcgctgctcaaaagtcttggtgtgaagaatcttccagctgtaattggccgaaccgtgaatggtgaggagctccttctgaaggatggcatttcggtgaaagatctcagatctggaatcaaggaattgaagacactgctagaaagttttgagaagaagaataagaagctgtcatcgagtcaagctaacagcaaaccttccagtcaatgggaagaaaaaaaggtccctcttctcacagcttccaactttgaggaaaaatggggagataagacttcagaatgcatcattggtggtgtcggatcaaacaaagccaaggagcagcttgaaacagtcctggctgagatatttaagaagactctgataagggg

SEQ ID NO: 16223 - DNA, 206 bp, Sorghum bicolor
  Clone ID: LIB3478-029-P1-K1-A10
cacgccgtgccgctccatgctagctcgctcgcctgctcatcactgtcgcttgcttgcctcgatcgcaacgcgcttggcatggcgtccgagtgtggctatcgccacgtctcgcctccatctctctcacaacgcccacctgcttcgtccacccacctgcacacaccgctttttttccgcccgctgtcgggcctgcttgtgcgcgcgcg

SEQ ID NO: 16224 - DNA, 355 bp, Sorghum bicolor
  unsure (1)..(355): unsure at all n locations
  Clone ID: LIB3478-029-P1-K1-B1
cacgcgccgttcgagacacccacccgatcccaatccctcgtttctaccgcttgcgatctcgttaagagagatcttggaagacctaccgcagactatacctgaggggagttttgacaccatcgacacgtaaggcaagatccagacaagggggatcccccgaccagcagcgctatcttgctgcaagcagtcgaggacggcncactcttgtgatacaacatccagaaggagagcaccctccacttggtgctgcgtctcaggggaggcatgcagatcttcgtgaagaccctnactggcaagacgatcaccctngaggtggagtcctcggacaccatcgacaacgtcatagggccaagat

SEQ ID NO: 16225 - DNA, 117 bp, Sorghum bicolor
  Clone ID: LIB3478-029-P1-K1-B6
aacaattcgccgccaccacacttttttcgcttcgcttgcaggaggcgcacatccagctcaccagcttcttaccgaccactgccatatctcacgcgggctgtgacaatattgagcaac

SEQ ID NO: 16226 - DNA, 316 bp, Sorghum bicolor
  Clone ID: LIB3478-030-P1-K1-A1
tccgtccgaattccggtcgaccacgcgtccgctgataggtctactgcgtgggatcgaaaagtaggatgcctgaaggagatcaaggatgaccacctatgagtattggaggcttcggcagggcgtgctaagagcattgtctgatcactcgaaggcaaacaggctccctacttatgggcatgagaagttgatagcaattcgtggagcaaagtatgcgtagagaagatcaaggaattgctccgacagtagaggtcacgaggaggctctcttgctgaaggcatgatcattgccgacccagctaaccgtatagtattgcaag

SEQ ID NO: 16227 - DNA, 231 bp, Sorghum bicolor
  Clone ID: LIB3478-030-P1-K1-D5
cgcgcgctcgcgctcgtcgcccaacaccctccgccgccgccaccgggcgtgggttgcctaacatccctgccggccacttggcggcgtgccacgatcagtgcagataggcgatccatgcggactcaacagacccgcagctcctaagcattctttgcagacgtagactactttttcatctatccggcgggtactttttcttgcctccaaccatcaaccctacgttaatcgcgc

SEQ ID NO: 16228 - DNA, 226 bp, Sorghum bicolor
  Clone ID: LIB3478-030-P1-K1-E6
tcgaccacgcgtccggtaacccgggccgcccacactgacgagatggcgactctacacggcggagggcagcatgtacgacactgctacacccggaggacggggtgcagatgaagctactccgcacgacagtctatacacggcagcaccgataggtaggccggtcccacacactgctgctcaaggggggtcgggccgaggaaccgcgctacactatgacagactccgg

SEQ ID NO: 16229 - DNA, 108 bp, Sorghum bicolor
  unsure (1)..(108): unsure at all n locations
  Clone ID: LIB3478-030-P1-K1-H10
tcgtcctttgtcagttcgctcctgcgccgctcatcgncacgcgtgcctacctctcaccccaggagggattcaagcgaggcataactcgtgttgacaagttctcaaaga

SEQ ID NO: 16230 - DNA, 529 bp, Sorghum bicolor
  Clone ID: LIB3478-032-P1-K1-D5
cggtcgaccacgcgtccgtacgcctgcggttccggccagctcacctgtcgctgaagctggccttcaccctctccctcgccgtctccttctccgtctcctgctgcgcgctcctcctcctcttcctcgccccgcacatcagccagctccccggagggcgtagccgcggacctcctctccgtgctcggcggcccgcgcgctgcggcgcgggtgccggcggcggaggcctcgcggctccgcgcctgcctccggttcctcgccccggccaaccccaccacggccccaaaggtctcgtcttggagccgcggaggccctcggaagttccttctggaacgttgcgatgcggggacggcggaggcggacgagatggtgatgtggccgccggccccggtcttggagctggcccggctggccgtcgacttcggaggcgatcccggggccatccaccgggcgctcgacccaacgatgctgccggtgccagatgttgagggcgcccagaagaattaatgcgaactcacaagaacaccatttg

SEQ ID NO: 16231 - DNA, 366 bp, Sorghum bicolor
  Clone ID: LIB3478-032-P1-K1-F5
acgcgtccggcacgcctgcgcccgacaacagcacacactgtaagactaaactgggctactcgatacagggcagggacagcaggcatgcctgaacgggcatctggatgttttttagagactgatggtcggataacaagccacgaggaggaccaggctaatgactgggtctacaccattgactgaagtcacacgcacgatcacacagtgcgcgaagcaattgtctgagacgtgtaagaactcgtgcctcatctgcaggaaagaccccaccagcgtcaacagaatacactgatgatgaactggaatgaagggggccagttacttatttgcttggacaaaggaccacctgaaaaaacaacatctatgggg

SEQ ID NO: 16232 - DNA, 306 bp, Sorghum bicolor
  Clone ID: LIB3478-032-P1-K1-F6
tcccggtcacccacgcgtccggctgtcaaagcatacacagaggctgctaccccaactctacagaaagaacatgcatgagctggtaaaccccacacaacccattggtgcagcctgcgatcaaaatactagttaaggcgcgtgtccaacaagtctcttctgtgctcacggccgaagcagctgttgacgttctatcagctcaactcttgcatctcctacaagcacagaaatattatgttcttataaattgccagcaactgatgcaagaggcatttccattcgcacgaatcacagatcctcaaaattgac

SEQ ID NO: 16233 - DNA, 178 bp, Sorghum bicolor
  Clone ID: LIB3478-032-P1-K1-H8
tggctccttcttgacatagcgccttcgctcgcggccggcgccggccgggcagaggcgtcttaccggcgcgcctttcggaaggccgcggacggccgcgtggcgtggccgcagcgcccttcttgccggcggcgccatggcccaagaggtgctgctgggcgcaaacggaggcgtgctcgtc

SEQ ID NO: 16234 - DNA, 302 bp, Sorghum bicolor
  Clone ID: LIB3478-033-P1-K1-A1
aaatggcggcaaggtcatccatgctcgtcgttgttgcatttaattttatttttgccgttaatgcgacgaacttctcggatcgaagaaacttgcgtgccaccatgacccggaccacaaccggccatcaagcttgactcgggccttgcacaagtacgaccaactgctgtacatgctcgacgcccggtttgacgacgctgtctcatggagcgcgcagactgcgctccatctcgacagcagcggcggcgcatacgacatgacgttgtgcggggtgacgccagcgtatagaactgtaggttatcatc

SEQ ID NO: 16235 - DNA, 168 bp, Sorghum bicolor
  Clone ID: LIB3478-033-P1-K1-A8
cacgcgtccgtgatcataatacatggattcacactctgcatgctcagaaagagagataatgctgtctcagacacagctttacgcattgtagctagcatgaagagagattggatgcagactgggaggaagccaagggattggtgggcacatatacatgtgactcttatg

SEQ ID NO: 16236 - DNA, 397 bp, Sorghum bicolor
  unsure (1)..(397): unsure at all n locations
  Clone ID: LIB3478-033-P1-K1-C5
ccggtttaccacgcgtgcgggggcaccagaggggaaaaaaaaaggcaacagcaacaccgccgcgacgacgacgacgactacgacgatggcagcctcgctccaagccncgtccaccttgatgcagccgggcaagatcggcgttccggcgcactccgcctcgttgccgtcccggccgtcgtcgcacctcgccagggcgttcggcgtctacgccggcgccgccagaatcacttgctccttccagtctgacatcaggaacttctccagcaagtgcgtcaacgccgccaagctcgccggtttcgttttggccacctttgacctccttgtttcgggcgcgagcgcgaagggcacccccagaaggctgacctacaaccatatccagatcttgacgtacatggag

SEQ ID NO: 16237 - DNA, 381 bp, Sorghum bicolor
  Clone ID: LIB3478-033-P1-K1-C8
cgaattcccgatcaccggcgcgggcaaaaaacttccataaaccaaaacctgccccccccctacaattcacaacctaatatctgcggcctggacattctggggcggttccttcattctagtgggcctactgcgactaacgacacgctccatcccaggcccaattatcgcctggccatcgctacacccaactggaaccatcaattgcaccgtcgtgcccgatgcctccccaattgtctgaagccgacacctccgaccaccactcctgctccccaccgcactgataccatgttcacagtcacccaataagcacaatctgcccacggtctgcacaacctccaagtccgtagcaaaagccaagagttttctgcataaataccctac

SEQ ID NO: 16238 - DNA, 262 bp, Sorghum bicolor
  Clone ID: LIB3478-033-P1-K1-G9
ccgacctagacgagcgaagatacttacgcctccattccacatgatagttcatctatagtgtctcataacttcactgcaatcaccttcgtttgagagcggggtaacttagaaagcgctggaggtgcccatcttaatcgtattgccacacattgtgcttactttggatatcactattgatataccgatcatactgatcgtgattttctacagttacacagtctaaatggcgattggaacgcgaccttgaataacaacttaatta

SEQ ID NO: 16239 - DNA, 161 bp, Sorghum bicolor
  Clone ID: LIB3478-034-P1-K1-A8
agcgtgacccacgcgtccgcgctgaacggataaggactccagcttcaagtgacgccgtagccaccgttgtgcaagcgagttcgccgacgagaacaagtccgccggactggtgaagctgaaccccgcgagcgagtacccgccggcgctggaagacacgctca

SEQ ID NO: 16240 - DNA, 343 bp, Sorghum bicolor
  Clone ID: LIB3478-034-P1-K1-B12
taaccttcgcgatcgtcatcggcgttcttgagttggtgctgtttgcgctgctcatcggcaacatgcagtcttatctccaaacaacgatggtgcggctggaggagtggcggacgaagcggacggacatggagcggtggatgcaccaccggcagatgccgcagccgctgaagcagtgcgtgaggaggtaccaccagtaccagtgggtggcgacgcgcggcgtcgacgaagaggccctgctccaggacctccccatggacatccgccgcgacatcaagcgccacctctgcctggacctcgttcggagggtgcccctgttcgacgagatggacgagcggatgctgga

SEQ ID NO: 16241 - DNA, 212 bp, Sorghum bicolor
  Clone ID: LIB3478-034-P1-K1-B4
gtccgattcccgtcaccaccgtcgcacctttacctagagagagagagcagcacaccgaccgacagaaccaaccacacacaacatacagggccaatgggatgacacgggggcacacagcccggacgcgaggggactgacctccccgggttcggtccaccacggacaggagtgggggcactccttgccgcgcggcggcgcgccgcgggtcatat

SEQ ID NO: 16242 - DNA, 358 bp, Sorghum bicolor
  Clone ID: LIB3478-034-P1-K1-C10
acgtccgattccggtcgccaccgcggcattacctacgcaccttctctcacattattccgctcctctccctgcgtcgcggagcagggactcccggggcgtggcctcaaatctgaggtgcgcagggcataaccagctgtgaagagacttcacaccagctgtggtcatcgtgtgtttatgagggaagataaagtcttgtggactgagagcatggctttttggagtggtgccttggtctttggtttgctcaatagcattgtgatgaactgacatggtaggagctcagatatccctggcccatgctggcatcatgagctgttatgatcacgcgtcaattcagcgtgggcatcaagttacacac

SEQ ID NO: 16243 - DNA, 216 bp, Sorghum bicolor
  Clone ID: LIB3478-034-P1-K1-C6
cgatcccggtcgccacgcggcgctataaagggcctacacctatggtattttcaagagtatatatacagcacatatgcatacattgtctatgggaggaggctaaccttttgtgtcgaccggaggaaaaactctactggcttgatcctactctattctgatgggtaagatatgcatcagcgtatggctaaatataatgttcacacttagactgcatgg

SEQ ID NO: 16244 - DNA, 276 bp, Sorghum bicolor
  unsure (1)..(276): unsure at all n locations
  Clone ID: LIB3478-034-P1-K1-D1
ctacatcatctccatattcaccccaccctctaacttactctccgagcgactccttcatctcaaatttaacattctccatacgctccccntgttacctctgttctaaaactaaccgaccttcaactacaccacgtccgtaaaaactcttctcacgactntacatcaaccacataactcatcacatgtatgtctctactccactcacaataccctcctcttcccacttcacttactaccaaaaaataccaaataccaaaatactcataaactaccttt

SEQ ID NO: 16245 - DNA, 229 bp, Sorghum bicolor
  unsure (1)..(229): unsure at all n locations
  Clone ID: LIB3478-034-P1-K1-D2
ttcatacttnactatatatttttatcttaaaaatatactctctaacatncattacattaataatcatattctcactatcaattatttcatatactacatatcaacaaataacatctaatctattcccattactattttttttcttatatatctatatatatcatatatttacacacaaaacacatctttntaatattttctctctaaaaaattcttactatatacaaat

SEQ ID NO: 16246 - DNA, 193 bp, Sorghum bicolor
  unsure (1)..(193): unsure at all n locations
  Clone ID: LIB3478-034-P1-K1-E4
gtccgatcccggcgccacgcggcggttcgcaggagacctgcatgcggctgtacacagctgctgcgcagaactaagccttggaaggagtaggacaatacggggacacacactctctacaatcgtggcacaggacatctgaagcaccttacctgagcagggctgntctggcaatcctacataccaccctgacgtg

SEQ ID NO: 16247 - DNA, 195 bp, Sorghum bicolor
  unsure (1)..(195): unsure at all n locations
  Clone ID: LIB3478-034-P1-K1-G2
tccgatccggtcgccacgcgtccggctctatgtcagctctttcttgatgactccggttatatcggcgctaggtatagggaattttgcatgaatggtgaagctggaacatattctggagaacggaactgcatgacataggcaccgtagttcatatctagctntttgactgctgttggtgggtgacgtggcctcgga

SEQ ID NO: 16248 - DNA, 293 bp, Sorghum bicolor
  Clone ID: LIB3478-034-P1-K1-H11
ccccaacggcgcatgcaatgcatagcaacatatccatatgctgttgtgtgctacgtacattaaaatctctcatctgacaccgtccatagatagtagttacaatggcatgaatgaatacgagtgtacacaagcacaagaaggcgactacaaaataaagaatcgtcaggcgccgctccgtggtgccttctgaaatccttcactgcgccgctgctgcgtcgccgccaccgcatttggcacggcctttgtcgtcgttgtcgccgtcgacacgtccatcggcctgtggctggcgcacc

SEQ ID NO: 16249 - DNA, 165 bp, Sorghum bicolor
  Clone ID: LIB3478-034-P1-K1-H3
ccgatcccggtcgaccacgcgtgcgggctgctctcggcccagtcagtataccagacagagaagaagagaagctgcatactccctttgcgatcgatcacactcgcaataactatagcagcatgacagcatggggcgggcgtcagcaaagcccgccgcccgaacgtg

SEQ ID NO: 16250 - DNA, 362 bp, Sorghum bicolor
  unsure (1)..(362): unsure at all n locations
  Clone ID: LIB3478-035-P1-K1-E12
ccacgcgggcgcaaactgcctaatccaccctccaagctagagcattctccgcgcatggcctccatggcgtacgctatggcaggggccttgaagggcctctacctggcgcccaccacgacctccttcctgcgcggcgaccgagaatcgctctacgtcggcggcagcagcggagccatgggcgtgtcggtgccggcgcggtggcttaccatccanatggcncacaagaagggggccgggagcaccaagaacggacgagactccaatggacaaaactttantgtcaagatatacggcgaccaggtcntcaagccctgggccagcataatacggtaggacggcaccagggactatactggaaataa

SEQ ID NO: 16251 - DNA, 379 bp, Sorghum bicolor
  Clone ID: LIB3478-037-P1-K1-G11
gtcgaccacgcgtcgcggagaacctcctcctcgacgagtccggcgcgctgatggtggccgacttttggctcggcgccgtggccggcaccgccgacggaggcggcagtctcctccggcgcacgatgtgcggcaccccggcgtacgtggccccggagatcctgtctcggaaagggtacgagccggcgaaggtggacatctggtcgtgcggcgtggtgctgttcgtgctgtcggcgggttacctccccttcaacgacgcgagcctcgtgaacatgtaccgcaagatctacgcgggccggttccggtgccccgtgtggttcttgacggcgctgatcgatcctgctgatgtgcgtgctggacccggacccgtcggcgcgcattg

SEQ ID NO: 16252 - DNA, 418 bp, Sorghum bicolor
  Clone ID: LIB3478-038-P1-K1-A2
cacgcacgcgcgcgccatcccccttccctcccgtcgcgcgccgtcgatccaatccacaaaaaccaaaaaatgccgtcgcccttcgccgccgccactttcaccagcgcagccgccagcgccgcgagggacgacatgtcctcggcggaggccccggtggcgatgatggggctggcgaacatggtgtcggtccccatggggctgatgggccgtattccggttggcggtccccgccgaatatgggctggcggcgccaacccccccggggtggggggccggcttcttcccgcgggccaccccgacccggtcggtctggagcgggtggtccgcctggttggggtccgcgggggtttcttccaatccacggtcaccttggagggcccggcgaccaccactccgtgggtcgcgctcaccgcggggg

SEQ ID NO: 16253 - DNA, 135 bp, Sorghum bicolor
  Clone ID: LIB3478-038-P1-K1-A9
gcgttcgccacgcgtacggtacacatcataatggcactcgtatccttctgctcgtcctccaccagcgacgttggggctctccgaggagtgggcagcagcgcgcgtcgcacatgctgctactcgcatgacgctgat

SEQ ID NO: 16254 - DNA, 275 bp, Sorghum bicolor
  Clone ID: LIB3478-038-P1-K1-B2
ggaaggacatacaagcggttagacagagatggtccacaaagaaagtcaattcaaggatgatgatgcacatgaatcttgacttgatgacagtgagaatgatgatggaaatgttcaacaagagcaaggtctctcaacttacgaaaaggagcgtcttgagatgcctgctaaaattgagcaaatggagaaagcttgccttgaacccagcacatggaccatgcaaggagagggttctggtttttagaggcccaaaaacagcggccctaaaaaggggacct

SEQ ID NO: 16255 - DNA, 500 bp, Sorghum bicolor
  Clone ID: LIB3478-038-P1-K1-D3
cgtccggaattccggtcaccacgcgtccgtgtagcataatgataaactaatcctacttgtaatcagcatatacaggcgcgccatgaaatgcgattacaacctacacgtccattacgctagctactaccacatcgatctgttcggcgggactgacaagccaaggaacacacaaagagctagctacagtctcgagaagctatgcttttcaagctatctaggatgtctatggtaaggatgatggacacgctggctctggactactcggtgccgaaccccttcagcatgttcggcacggccagggtcgtcgacacgggggtggccagcgacacgtgggcggtcggcaacacgtacatctagagccaggacaacgatgggggctacgtgttcagcggcgcgcatttcgtcagcgtgaggaatgaggacgtcactagggatgaggacgacggctattgtgcgtttcaatacgctaccagctcattgtctccagggaggagagcgtt

SEQ ID NO: 16256 - DNA, 372 bp, Sorghum bicolor
  unsure (1)..(372): unsure at all n locations
  Clone ID: LIB3478-039-P1-K1-H6
acatcagaacaggttgtacgatttacaactcgcacttagctgctgcagtagtnatcaagctataagtatctgtcgagcattatgtgctgcaagaagtaccccgacctgtaggagaagagcgccgcggctcatgccaccgtcgtcctgggtgtcgccctcgagctcacacttgctgccgagaactaggccgttgaggagtcctgcgccgtgaccttccacggctgcagcttccgtgacagctgcaagtgcaacccctgcaactgctgatcgaccgacgaccacacatggggaacgaagaccaacgagttgcatgctgctgcttatttgatggtgatttcctttttggaccggcaacttacgggactactagct

SEQ ID NO: 16257 - DNA, 235 bp, Sorghum bicolor
  Clone ID: LIB3478-040-P1-K1-A4
taaaacatttatgagaatccaaagcctagaaaacttaaggtatccttcgcatggttcgggcacagagggtgagtaagagccttagatcaggcctaaaggcttaatccttggacaatagatcaattatttctgttctaccacattgtggtacagatggacagaggaggctaggtcatcaaaatagggttgatatgtttaaggacacaatgtgactcttattttgtacgttatgaag

SEQ ID NO: 16258 - DNA, 260 bp, Sorghum bicolor
  Clone ID: LIB3478-040-P1-K1-C5
tccggccggattcggtcgccacgcgtcgggtcctaccgagcggctggttgccaatctacatacactgacgtcacctcaccaacgtagacagttaaggcccgaccgcgtgtcaagagtcgcgcagaacaagcccgcgactgggagtgacccgcagcggtcccgcgggctggaaccctatctacatgaggatcgcgcgcatcaaacaccgctggccgcttcccttactcacctgcagagtactgcacggcaataataatcac

SEQ ID NO: 16259 - DNA, 200 bp, Sorghum bicolor
  Clone ID: LIB3478-041-P1-K1-C6
tcccgtcgctctcgtctcgtcctcgtctaccgccgagcccggcccttccgttcccgacccaccggcctccatcttgcgttctgcgcgccgcgtctcttgccggcggggcccggcgcggcggtgaccccagcccaggacacgagtggggccgagcccgaggcggtccgtgcacgagcacggggcgagcctgagcccgagca

SEQ ID NO: 16260 - DNA, 130 bp, Sorghum bicolor
  unsure (1)..(130): unsure at all n locations
  Clone ID: LIB3478-041-P1-K1-D3
ctcgtacaacgaccaaccatcgctgggccggtctgccatcaaggctaactgcgcgctaacggcgcgcaccaggcgcatcgcgagccggcctctgtcctgcccgctaccgtncgcccgtcgcccatgcgct

SEQ ID NO: 16261 - DNA, 157 bp, Sorghum bicolor
  Clone ID: LIB3478-041-P1-K1-G1
gcgtccccactgccttcagtaatcagttgcagtctgcaatcacatgcgccaacccggattcaactcaatcacgtactggccaacaactaacaggcgaccgcacacctcgatactactgtgtggacgagccaactcgttgtctcttactgaccacgtc

SEQ ID NO: 16262 - DNA, 108 bp, Sorghum bicolor
  Clone ID: LIB3478-041-P1-K1-H4
cgtgactcgccctcgtcatgtactgcacctaacaatgaggagctgtactgtctggcggtatctaagcgtaagttaacttcagggggttccaacggtttatcgtataaa

SEQ ID NO: 16263 - DNA, 474 bp, Sorghum bicolor
  unsure (1)..(474): unsure at all n locations
  Clone ID: LIB3478-043-P1-K1-A7
ccggaatcgaccgcactcgatccacgcgtccggcactagtgcagctccagcagcctctgcaatgcccgcaacgcggctatgatgagctctagctagtccatgagcaaccccgcttctgcggcctcttcttccaggtccagcagcgccgccgcacaagagcaccgcctgccggaagaggaatcccaaactctgcaccaccacaacgaccaagaggtagcctccgccattgctgctccgtttcctcccagtagctgtgaagctgatcatcaagcccacgacgacaaggacgccgagctgtcgccgccgcgctgcgaatgggagttccggctggcggccaccgtgccgaccaccgcccttcccggtgcgtccgacgccatcggcagcgtcgacttcgaccccaccggcccgctncttgccatcggcggcatcgcccggagatccgatgtacgacgggcctcatgctgtgcgtgatga

SEQ ID NO: 16264 - DNA, 227 bp, Sorghum bicolor
  unsure (1)..(227): unsure at all n locations
  Clone ID: LIB3478-043-P1-K1-G6
cgcgtccgaaagaaagaaaactgnaaaccaacacnacactctcaaaagaactgaaaacacactcacacatggccggccgctctatatttcccgggggcttgaggcgccctaccttgcgaacgctttcatacaacctcaccgacattcaatcgagtgcccgaactttaataacctgcgccactgttaaacaacatggcgaaccggaaaaacattggccttgcccaaaa

SEQ ID NO: 16265 - DNA, 316 bp, Sorghum bicolor
  Clone ID: LIB3478-043-P1-K1-H10
ccgggcggtgggcaacataattccccatctatgccatagcagacaataatgagtggtatgaactatccaaatggaaggcatcacatgggtaaccatggagtgcctccgagaatggaacagcctgctggtcggttctggctggcatgttcctggtgataacatggccaatggtcaagcagcatatgatcagtatcagcctgaaaggtcagggccttcttggcattgacgagataacccgggagggcaacggtataacccatatgcaagggagaaccgtcagggattctaagtggaagaattcaacccacatgggata

SEQ ID NO: 16266 - DNA, 284 bp, Sorghum bicolor
  Clone ID: LIB3478-044-P1-K1-D9
acgtcattctttcctactcttaattttggtttatactactaattttatttctatgggtagggtgtattcctgtctatatatctactaaaaatatcaattccatcttacttctctttacaaatcattatctttccattttcaacattcaacagaacttttccttctctaaagaacttaatgctctgtatattcatcatcacttatcatcttaactctgcatgatgctatatcttccctttaatatttatactatattatacattatactaacataataatactac

SEQ ID NO: 16267 - DNA, 236 bp, Sorghum bicolor
  Clone ID: LIB3478-044-P1-K1-F4
cacgcgtccggctggatcgactatctccccctccgccaccactccccccatcgatctctcctcagtcccccgccgggaagctacgctacgaagcatggcgtgcgtgaccgcccgcgccccggtcgcggccctgcgcccgtcggcggcgtcgtcgctcaacagtcggcggcgcctcggcttctggcacttgcgctcgcgacggtgcacccgccactagcggcagcgggcgctctccg

SEQ ID NO: 16268 - DNA, 161 bp, Sorghum bicolor
  Clone ID: LIB3478-044-P1-K1-H9
gacggcgaaccgtcgacacgcgtcgacaccgccgaccacaccaccatggcagctgtcagccgggcccttgagcaccgcaagcgggtcgcgcactcgctgtgcgtccgcgctccacctgcgggcgtgggcacccgccctcggacatgctctcattgacatag

SEQ ID NO: 16269 - DNA, 338 bp, Sorghum bicolor
  Clone ID: LIB3478-046-P1-K1-C2
ccgcatcccggtcgaccacgcgtccggaacgacctcttgctcatagttgactgctagattagggttcaacaataaaagacctagtactgatacacaggaacaccgaactgcagagagtgcgccggttcgtttctctcacgtcgaatacaccgtctcaatggcaccaaacaaacccctccttgctgctggataatgatgatatcttcagacaccatgcagatctagaacaaggagttggcttctgagcagatgactcaaaaccgagcgataatgtgggagaacacaacctgaaagtccttcaatggcgtggccacaccttcaggcttgaaggtcaaatg

SEQ ID NO: 16270 - DNA, 402 bp, Sorghum bicolor
  Clone ID: LIB3478-046-P1-K1-D5
cgaccacgcgtccgtaacttcgaggaatatagcagtcctatgctagactaacacgcttccagtagtacgagtcatacagtacagcagtgcgtacgagctatctatcatgtacacggtgaatgacaatacctacatccgagactactcgttgggcgagggccgcatcaccatgcgcaagaccgcggccaagcccaaggtggcggcgtccggcagcccctggtacgggcccgaccgcgtcaagtacctcggccccttctccggcgagcccacgagctacctcaccggcgagttccccggcgactactgctgggacaccgcggggctgtcggccgaccccgagaccttcgccaaaaaccgggagcagcaggtgatccactccacctgggccatgctgggcacact

SEQ ID NO: 16271 - DNA, 194 bp, Sorghum bicolor
  Clone ID: LIB3478-046-P1-K1-D9
tcgtgcgctgtgtcatagtagagtctgtagttgcatacatagagtgctcaggctttatggcaatgccttgaataccatacttggaggagaggaacactatataagctgttcacatctattactacggctcgatacgcctaagctctactcattaagaccattaagtgctgccatgatctacttcaaatgcttat

SEQ ID NO: 16272 - DNA, 292 bp, Sorghum bicolor
  Clone ID: LIB3478-046-P1-K1-G11
ccgatcccgatcgaccacgcgtccgaccccacgcgcccgcccgcccgcccgcctccaaaaccctacaccccgtaaaccctagccgccgccgacgacctcgttgccggaaatggggggtctcctgcggctcgccttggcccgatccacgtctgggctcgtctcttgtcgcggaccacaccgtaggttatcggcggcagcgatggacgagtgctcatcggtctgtgatgtctaggactctgttgaggctgctctccttgcgctcgcactcgcgctgtcatttgtgctatacatt

SEQ ID NO: 16273 - DNA, 254 bp, Sorghum bicolor
  Clone ID: LIB3478-047-P1-K1-B1
gcgtccgcggacgcgtgggttgaaaacctatattcatactggcgtgccgaacattgattcatataacctgctttctattctcaatttattacttatgtttggaactactcaatgcatattagattggtgtttttgtaaaagcatgcatggaacagactgatatcctgaagaatacgatccatgaagaagagaagaatggcagtggaaagacatggcttggcactagggatgagagttcccggttggacttgata

SEQ ID NO: 16274 - DNA, 190 bp, Sorghum bicolor
  unsure (1)..(190): unsure at all n locations
  Clone ID: LIB3478-048-P1-K1-B11
tcctacccaattatgttcacaatctctgatgacagagtgaggaanatgctatgctgggtccctatgtctacaatattgaacatggtatggagtgtgatgtatcttttttgggaaagccatcttctcttatgactattattaattgcatagttgccaccatgctggattgtctatactttgtctgtagcta

SEQ ID NO: 16275 - DNA, 155 bp, Sorghum bicolor
  unsure (1)..(155): unsure at all n locations
  Clone ID: LIB3478-048-P1-K1-B9
gtccgaatccntgtcaccacgcgtcgcgacagcccgcatcgcggagagccggccctgcccgtcatggcctggagcgcgtcccccgacatccgtcgcaggcgggtggccgatgtccaccaccattatccgtacataagcgcccgtatcatcctgta

SEQ ID NO: 16276 - DNA, 262 bp, Sorghum bicolor
  Clone ID: LIB3478-048-P1-K1-G7
cccggtcgaccacgcgtccgaactatcgagattttgtctgaacctctatgcgcagattctctatgccgctctcgctagggtgagcaggggactcttagctagctcgctggcgggccaggaggcaaccgactgcccgacgaaatggggatgtggaggaggacatgacaggatactcgcgcacagacgagtactatgacaagccgcaggacgaccgcatcacggtgaagcccctgtacgcccaccacgacatggcttgctacaa

SEQ ID NO: 16277 - DNA, 123 bp, Sorghum bicolor
  unsure (1)..(123): unsure at all n locations
  Clone ID: LIB3478-050-P1-K1-A1
aatcangcagatgagattatcagttggttgtcttgaagaaagaaaagccaatattcccatacagtctgcctccagacattgaaaatgttctttctggatgctttgagtatgacttcagaaaac

SEQ ID NO: 16278 - DNA, 199 bp, Sorghum bicolor
  Clone ID: LIB3478-050-P1-K1-E9
accgtcccgattcccggtcgaccacgcgtgcgacacacgatccgatcagaagcagtggaaggatccgtttcagacagagatcagagcgactgagatcttgatacctttgatgcgaataatgtggggcttttataaggactgtctgtacatcagcatgagtctaaatagcgaatgtacatacatacctgttcgattagta

SEQ ID NO: 16279 - DNA, 148 bp, Sorghum bicolor
  Clone ID: LIB3478-050-P1-K1-F3
cgtcgattcgtcaccacgcgtcggtcggggctgtcgtgcatgcatgcggactcgcggcgtcacatggcctatcgactggcgaggcggggggggtatttacgcgggaaccctctgtgatactcccgacctgcggagctacagtgaatga

SEQ ID NO: 16280 - DNA, 175 bp, Sorghum bicolor
  Clone ID: LIB3478-050-P1-K1-F7
ccgagcgtaccgagcgtgcaaaacacgagcgatcatttttgaaaagacaatgctgattacacaatggtgggacactgtgtattgattctttagagtgggtaatgtgggctacatgcgactgctgtaatcagatagattagaggaattacagcattgctacaatatacgtgcgttg

SEQ ID NO: 16281 - DNA, 129 bp, Sorghum bicolor
  Clone ID: LIB3478-051-P1-K1-C8
tttgaaactgaactctgctgcgaggtgaacctacctttatactgctagatggaggtaggttgcaagctcctatacccctcccctaaataggtgccagtgtagtcatgcccctcctagactttattagaa

SEQ ID NO: 16282 - DNA, 166 bp, Sorghum bicolor
  Clone ID: LIB3478-051-P1-K1-E8
tcacccctaggagcgacctgcgacttctccgtttcacttgcgccaggctgcctgcggcgtgaccggggcctcaaccgcgtctctcgctggggagcccaacaggccacgctccgaaggcctagcccaacgtacccttgcgactcggcggtggactgtggcgtggagc

SEQ ID NO: 16283 - DNA, 331 bp, Sorghum bicolor
  Clone ID: LIB3478-051-P1-K1-H3
ccggattcccgggggaggatagggtcgacggcgagcgtggcatggttatcgtacagtccgacggcgacggctgcctgtctgactcggactcggacggctccgactggtcaatcggctggctcgagccgctcgcgccggagttgcagagcgacgcggactccgagggcagcttcgccgtcctcgtgccgtgctatcgacacagccgcctaccggctgccgtctgatggaggtcctgtctgggggcgccacgcgattaatacaaatttggacaaggtgttcctcgacgagttcgtctctactgctcatgttcagatgtcattaacgcaatcta

SEQ ID NO: 16284 - DNA, 172 bp, Sorghum bicolor
  Clone ID: LIB3478-052-P1-K1-A2
cccttcatctccaccgacaacattatactgacctacaatcatctctatatcaatatccgccacctcaaagacgattcccatcttacaaacctaaatttgctctcattcaaccagaattattactaatatcatgataaatttaaactcaacaaacatactccctaccatcgtc

SEQ ID NO: 16285 - DNA, 345 bp, Sorghum bicolor
  Clone ID: LIB3478-052-P1-K1-B1
gatccacgtgctcgctctccttcctgttgcttatgcttgcttgcggttgcaggcagccgctgtgccgcgaccgctagcgacctgtgtagtaaggggagggagggtcggagggagcgaaagaagagaatagaagagaatgtttggtggttgtttggtagaggagaatagttggttggctcatggtcatgggggcgattatcgagcgcacggtggtggcggtgtgccccgtggtcggcttcctcgtcgtcctctacggagtgctgtgattttacaaggaggtcacacgcgtcaagggttcagatgttcaaataagcataacttctggtgaatgcatatacccaaaaa

SEQ ID NO: 16286 - DNA, 198 bp, Sorghum bicolor
  Clone ID: LIB3478-052-P1-K1-B4
gaggcggccgacaggagccgagccaagagctcaggcttcgccgcgaaaccccagacctcgcgcgggtccttccgcgggccggcgtagtcctcgctctccgatccaagatgtataaactggggagaggaaaccgctacaaggtgcagcattttatgactcataaccgtttccagtgagaaggttgtccttctcgcactt

SEQ ID NO: 16287 - DNA, 269 bp, Sorghum bicolor
  unsure (1)..(269): unsure at all n locations
  Clone ID: LIB3478-052-P1-K1-C12
cgatccgtcgccaccgcgacctccaaaagagttattgtcgctgcggcccatggtctacctccgcgtcgggagcggaaccacccaggctttggaggcgatactccagactgtgcaagcaaccacgggtcggagcctgtacggcgaccggtctgtacctggtcgtctcgggagcccaagtcctgccgggagttcccggnactacggctggacactgccgggctgtctgcggaccccgagaccttcgccaagaaccgcgagcttgaagtgat

SEQ ID NO: 16288 - DNA, 215 bp, Sorghum bicolor
  Clone ID: LIB3478-052-P1-K1-G4
cgagatgacaggttagttgcatgttgagctgatctaactctaacatatgatgggcctgtgctctaacccaattcagcaaaccttccaactgaattcctaaaggctggagtgggaatagcatgctggtgataatcactgaaaaaataagtcaaaggaagatgctactatgaaacaggaagagactctgtgctactgagggggaagctctctttgtt

SEQ ID NO: 16289 - DNA, 199 bp, Sorghum bicolor
  Clone ID: LIB3478-052-P1-K1-G6
tgacaaattttaggcatcctatagtctgcagcaggactaagaaaagtcgtaccgctaaattgggcggcatgcttttttttcttgcaaattgttttcttttgcactctaaaggttgtccttatccatggttacctgaacttcatatagtgagttttgatctgctccccgatgggcagaagctcgggttgagaaacccttg

SEQ ID NO: 16290 - DNA, 316 bp, Sorghum bicolor
  unsure (1)..(316): unsure at all n locations
  Clone ID: LIB3478-052-P1-K1-H4
cgcgtgcggtcgcgcctgagaggacgcgtgccagggagccgtcggccgccagagcctggcctgcagcccggngggaagcggcgacacgatgttgcgctgcttgtacacgcagcggcggtgggcgcaccgccggnggggcttcgtgactggcggcaccggttggtccaagccgccaccgccgggcctcggccccgccgcggnggtgggcatgaagaagtcggagtggtgggcggtggacggggagatgcacgagatcggggatggcgtgccgcatcgcgagcgcttcgcatcccgnggacaacctcctaaaccgcgc

SEQ ID NO: 16291 - DNA, 431 bp, Sorghum bicolor
  Clone ID: LIB3480-002-P1-K1-G6
ccgcccggtccatggaccgaccaggcgagcggcagaccacgtagttggtgctgtccgcggcggcagctttgtcttgtttcttgtcggcgccgacgaagtcgtcttccaccatgcatcaccccatcctgtcgatagatcgagcagagggctccatcttgcggccgtaggacaaggtgcagaacgtgccgccaccggatccatggacatccttgcggcctatctccgagtgccaggccgtgccgccgccgccggtgaccgcacgctgcctgtgcccgctggtgtcgcctcgggtgttcttgtatttcttggcgtggtagaagtaccagatcctgctgaagccgtcatcgtcgagaccggtggccggcaccggctccagatcagcgacgagaacctcggaggagcggcgcagacgtcgatgcggtggacgaagt

SEQ ID NO: 16292 - DNA, 487 bp, Sorghum bicolor
  Clone ID: LIB3480-002-P1-K1-H4
gcaaaattaggggatcagaacaaattttactatgatgaaaagttgaagcggtgggtggaagaaggtgctgcggttcctgccgaggagcctcctcttcctccacctccaacaaaaccatctttccagaatggtatgccagaccataagttgaatggccccatgagtgtaaaccatgctcccaatggagtcacagaatggaaatcctcaaattcttcggagcaaggaggtctgggtatgcctccaattccacctagccaaaaccagttttctgctcgtggacggatgggtgtccggtccagatatgttgacacattcaataaatcgggtgcgtctggagcagtgccatcatataacaaaccagctgctccatctgtgacaccaccagctggtgccaagttcttcatgccgactgcagcacctgctgctgcagatcagatggtgccacaccaagcagcagagatacacagtgaaaccatccatcatgatg

SEQ ID NO: 16293 - DNA, 273 bp, Sorghum bicolor
  Clone ID: LIB3480-003-P1-K1-B4
gacccacgcgtccgcccggtccgccgccgctgcggcggcgccgtccgccgaggggagcgcgaaggaggagcccgaggaggactcgtcggcggctgctccagccaccgaggaggctgccgtaaaagaggagtaaggcgtcggaccacgctttgatccaccgacaattgctgttattttggcatttcgtcggaatgttattcatcgtttgcccagcctatgtctactactagtatatctattgtctatctattagagattgcttgtgacatataa

SEQ ID NO: 16294 - DNA, 450 bp, Sorghum bicolor
  Clone ID: LIB3480-004-P1-K1-E8
cgtccggcgcgagatgccgagctgccgcgccggcgactttaccggacgacgatgacatactctccgagatcctcctccgcctaccgccgcggccctcctcgctccctcgcgcctcgctcgtctgcaagcgctggcgccgcctcgtcactgatccccatttccgccgccgctaccggtcccgccacccgaatcccccacttctcggcttcttcgatgaatctgcacacttctctttcttcagatccgcgatggacccgccggatctcatcccacccaagcgcttctgtccgccgatcgccgatgagacgggcggctgtgaccctagccattggagaaacttcggatgtcgccacggccacgtgttcctctacaaccggaagcagaaggagataccgagttgccattccaccggagttggataaggaagagaggatgatctggaggggcgcg

SEQ ID NO: 16295 - DNA, 465 bp, Sorghum bicolor
  Clone ID: LIB3480-004-P1-K1-F9
gcttctctaggaccatctggttctctgccaggccgtccctactttcgtcccctttcagttgagcatgatggtgtccaggatgctctaagtgtgcttataactcccaacaccctggatgatataatgaccaaaatcatcactaccttgtggttcatctggagggctcgcaatgagctctgctttcgacaaaacaaatggtctgttatgcaggtacattacgctgtccaggtgcacattcaagccaatgtccaagcgctcatgaaaaatgcaggatccacagctggaaacggcggcaaaataaatgcaagtctcgaagctccaaaaggccacgcatcacaaagcctggaagaatcgtaaatctgtcttccggggatcacttgttgtactgatgcggcaattgaacctgatggaacctcagaagagccaaaaatagcaggaattggagttctaatcagggacaatcac

SEQ ID NO: 16296 - DNA, 129 bp, Sorghum bicolor
  Clone ID: LIB3480-005-P1-K1-B7
gttacagcccattctcctttgctcgggtggcaacaaagaggaacaggccgatcgcccttcccatcacaagcgcagcccaaatggaaagggggatgggccccgtccctgagcattaaattcagcgggtgt

SEQ ID NO: 16297 - DNA, 350 bp, Sorghum bicolor
  Clone ID: LIB3480-005-P1-K1-B8
cgcgtacagtccacgcgtccgctagcccagttaccgatcatgaattactacaggagtcctgacatgggagatgcggtggacttcacagtccatgtcgcaacacccgtggagaaactgtccctcatgaaggagagactaatgcattaccttgacaacaagaaggagcattggtaccctggctccatggtggtcctgcgcgacgtggacgacacgaacaagctcaaggcctccatctggtgccgccacacgatcaacttccacgacatggggctgaggttcgagcggaaaaagctgctcctccaggagatgatcaagatcttgggagacctcgagaacgagtaccggatgct

SEQ ID NO: 16298 - DNA, 125 bp, Sorghum bicolor
  Clone ID: LIB3480-007-P1-K1-B2
gcgctccggtaccgagattcgcaggtgtcggcgcagacgcacgcgttacagtgctctctttgtaggcctgcggaaccagatgtgcacatatgcaaacaatggcccgcgggcgtatagactattcg

SEQ ID NO: 16299 - DNA, 176 bp, Sorghum bicolor
  Clone ID: LIB3480-009-P1-K1-A9
cgacccgcgctgcagcgcatcattaaccgcgggtggtggtgtgactaccagcatgacgactgctatagttagcagcgtactagccgctgcttcttttgctttctttccttgttttgtcgcgacggtcggctgttctccccgagcagctaataatggggggcctccttgagggctac

SEQ ID NO: 16300 - DNA, 296 bp, Sorghum bicolor
  Clone ID: LIB3480-010-P1-K1-B5
aaggcaaggaagagctcgtcgatcatcaagaagatagccatcgacgtggcttacaccttcctccgcaagaactgcaggggacctgccgtggcgctcaacattccgcacatcagcctcatcgaggttggcatgatctactacgtctagcccagcagcttaattttattttatgtgtacgtgttcatcagatgattcagttgtttgaactgaggctaatttaattaggtttgagggtggattatattcttcagtgtgaataaacacaacattgtatgaagtgaagtcccttctctcac

SEQ ID NO: 16301 - DNA, 376 bp, Sorghum bicolor
  Clone ID: LIB3480-011-P1-K1-H6
gcctgcggtaccgcgcagtaattggggggtcgcacgcgtcgtttgagcttttagggtcatccttttttccgaagagtaatcgacctcacctgctaaagtacggctttaataaaggaaaagcggtgcttgtgatgccaccctcttattcttcagagattcaagagtcagaaatgggatcttggcacattccgatggaagagaagtctggggatgagagaggtaggatttggctttgtattggcaggggaggttcctgcaaagaacatggtgaagttcccacaactaatggagttgtccacgaaattcctccaaccgaggcatctaaagtggtgcagcagaggctggcagaaaataagaatgagacgatctctggtaa

SEQ ID NO: 16302 - DNA, 202 bp, Sorghum bicolor
  Clone ID: LIB3480-012-P1-K1-A1
tgctgcaccatgggctgctcctgacgctggtcgtgaaagtccatgcgctggaggaaaacgccggcgggagggcgctgtcgtatggctcggagccggaggatgagagcttgagagactactcgcgggtcttcgaccagttggcggacgatgcggacagcgtgatggtcccatcattcgtgctgtcgccagatagatcgcctct

SEQ ID NO: 16303 - DNA, 107 bp, Sorghum bicolor
  Clone ID: LIB3480-012-P1-K1-A12
tcgacgtccggggaagtatgatacacgctaggtttctgagagccggtaccctatgcaagacttgatctgcgacacaggatgtttgacgtgatgaactacacatacat

SEQ ID NO: 16304 - DNA, 284 bp, Sorghum bicolor
  Clone ID: LIB3480-012-P1-K1-A7
ttctgcatccccgggaccgacatcaataccttctttgaccgataccagcaagccatcgggaccagcctatggaacgagctgtatgagaatatgcagcgcacgctgagccatctcaaggacatcaatcgcaacctgcgcacagtgattatgcaaaggatgggcgaggatctggacactctggagttcgacgagctgcgcggtcttgagcaaaatggtgatgcggctctcaaggaggttcggcataagaagttccatttgatcgccacacagactgaaacttacaa

SEQ ID NO: 16305 - DNA, 148 bp, Sorghum bicolor
  Clone ID: LIB3480-012-P1-K1-C2
gtccgatataaaaaaaaaataaaaaaaaaagaaagagctctggccgatcagtcaaaaccagaggtgcatgaattaagcgtatgcctgtaatgtatgctcgggggacggatcgcgaggggtcctgatgtgcttgccctttcatacccct

SEQ ID NO: 16306 - DNA, 116 bp, Sorghum bicolor
  Clone ID: LIB3480-012-P1-K1-F3
acacttctgcaccaagcactcaacgccaacacacacctaaagcctcatctggcgactgcgagcatactgaaaacgctacacgaatggctaggttctcctgatcgcttaattcatcg

SEQ ID NO: 16307 - DNA, 266 bp, Sorghum bicolor
  Clone ID: LIB3480-013-P1-K1-C10
gtcgaccacgcgtccggaaagttgaaactgccgtcttggacatcaaaaaaaaaaaaaaaaaaaaaaaaaaaaaaaaggggggggaaaattaaagggaggggagatctaccaaaaatgtccactcgattttaaagtggcacgcttgcatacgcttacatgcggctcactttatggggtggggggttctggagctttcaattttccggcctgagtctttcaacgtgtccgctttattatagtttgtcgttacccaaattaatggccct

SEQ ID NO: 16308 - DNA, 325 bp, Sorghum bicolor
  Clone ID: LIB3480-013-P1-K1-E9
aaagaagaataaaactaaaaacaaaataaataaagaagacaaaaataaaaataaaatacataacagggacgtagaaacacacacaagacgggcgtggtcgcttttaatttcgcactatcactttctcttttttcgcgttcaacttacctcggtttctcatatgatgattcttctaaaaccccactgtgatcccattttattctcctatcttactgtccttttggttcacctacctttatgccttcgtagctttatcgcattcggctctatcacctgtttgccacatggattgctcactataatgtgccatacgaacgcccttttt

SEQ ID NO: 16309 - DNA, 414 bp, Sorghum bicolor
  Clone ID: LIB3480-013-P1-K1-H12
ctctaaatggtccacgctacgaaaacagtaataatggcccaacgtagtaacagcatcgtcgcagagctcaccgtcgtcgtcgccctcatgaccgtggctgctgcttttgtaccagcagcaaccatgtccatcgccgctactggcggcatgcagaaggaggcgaacctggtacctgcaggaggcgcagaatactctacggagggcagtgccagcaccttcggcatgcagaaggatcaagagaccagaggcaacaaggaggcaaccctcggtgaatctattggattgggcaagaatgccatctatgggtaaatcattgtattagtctgcgtcagaaggtatgaaaataatgcggatgcgctgaatcaatctcaactgagatgatgacaataagtcaccagtaggaaacaaaaaggg

SEQ ID NO: 16310 - DNA, 259 bp, Sorghum bicolor
  unsure (1)..(259): unsure at all n locations
  Clone ID: LIB3480-014-P1-K1-D12
cgtccgnnatcccgntcgaccccgcgtccgcaaaaaaaaaaaaaaaaaaaaaatataaaaaaaaaaaaataagggacgcatacattaaaaaaaaaaacttaaataacaaagggggcgggatcatatacaattacctaaataaaaaaaggctggccggctctccgctttcaggtttcctggcttttccttgcctcttcccaactttcccttttttattcggttccataaattcgccctctgtccccaggttcaaacctga

SEQ ID NO: 16311 - DNA, 144 bp, Sorghum bicolor
  Clone ID: LIB3480-016-P1-K1-E3
ttcaacagtgccagctgaggaaggaccccctgacggcataacgcggggtggtcccagggccgtcatgaggctcgcgtcttgttttctctttgagtgcgttccgagttatgggtctaggtcataggttacgactcccaaactgta

SEQ ID NO: 16312 - DNA, 447 bp, Sorghum bicolor
  Clone ID: LIB3480-017-P1-K1-A12
catagtgtggcggcatttattaccagaacaacaaaagggtacaaagagaaaaaagggctacaacaccgtaaacggacaaaaaaggggttccaaaccgacagccgcctgcatgcaaggtcaaagctcacgtacgcgggcacccaaattcaaaccactggcagggggtcaacaacattcaaactgggggaccccggtcgacacccaactgaatgggaaaacactgcattcacccaacgaaagctggcggaataacaaacaggttcggacagatcgcgctatacaaaaaaaggcccaaccggaacggctaacggaacacgccctcaaccggaacagtaaacgcgacgccccctgtggttacgcacaaagcgcccggtacgcttggcaaacccctagcgtgagctcttaacgtggtagtgccctacttcccggtcacgttcgtcggctccc

SEQ ID NO: 16313 - DNA, 436 bp, Sorghum bicolor
  Clone ID: LIB3480-017-P1-K1-D5
aaaaggcaaaacccctgaaaaacggtttattttttttaaaaaacaaaaaactgtccaacccccaaaattttgggttttttttaaaaaaaccccccccccaaccaaaaaaaaaaacttaagttccagggacactttttcttttcgaaaaaaaagtttttttttaaataaaaaaggggcccaccggcccccccgttaggtttcccgggtttttaaaaaaccccccaccctttttgagggccccccccaaagttaaaaacagtctggggacaccccacccaagggggtgtaaatttgcaaagggcctggttacaccccaccaaaaaccttttggttttttttgagaaacttgggggggattaaaaaaaaatagcccaagaaaaaagggcagaccaaagtgtttgggcccatgtttttgggggtcttccaaacattaaaa

SEQ ID NO: 16314 - DNA, 537 bp, Sorghum bicolor
  Clone ID: LIB3480-017-P1-K1-G11
cgaccccgcgtccgaaataaaaaaaaataaaaaaaaaaaaaaaaaaaaaaaaaaaaaaaaaaaaaaaaaaaaaaaaaaaaaaaaaaaaaaaaagggaaaaattacaaacgagggggggcccattaattagtttctggggtgtcctcccttttgtttccctggcttctcctccttttttttctcccctgtgttcatttttttggccctccttttactatttcttggttcgggaaacccttgcgttacccctcgtaattccttttggttcccccccttttttcctttgttgctatttccccttttgtccccgtacttattcgctttctgactctgtcctttccttttttccgaattgtgccctgcctttatggcgacctgttacccccgcctgccgtttggtttccccccggggggctgtttgcttttccttcctccctccgacccatttttttgctttttttcctttcttatttgggcttttttccttttttttctggacaggttttcagtgttggcctccttttaggttacctgggg

SEQ ID NO: 16315 - DNA, 142 bp, Sorghum bicolor
  Clone ID: LIB3480-017-P1-K1-H6
aacctaatcacaccacctcatacgtcatgtatggcgacacctaaattcaccttaatttccttcatccagcaacaggagcagcaagcgacgatccggtccgaccaccatcaataccagtcgacaagatgatgattaaggcact

SEQ ID NO: 16316 - DNA, 394 bp, Sorghum bicolor
  unsure (1)..(394): unsure at all n locations
  Clone ID: LIB3480-018-P1-K1-B1
gaccacgcgtncgcccgcgcgtggcgaactatctcaagagaacttggtccaccaggatatgggcctggagaaaaccagcgcagtatcacttcatggaatacaaggtgcgagtcgggagtatttacgagtcctgtgaccacctcaagagaagacggtccaccaggatatgggcctggagaaaaccaggagaatgacagtacgagctgtgagttgagaatgtttgatccacctacaaccatctccagagaagttgcgccaccaggatatgagcttattggtaaaaacaagggcaacgacacttcatggactacgaattaccagcagggagtgtttacgagtcccanaaccatctcaagagaagcctgtcctccaggatttgggtctgggggagaac

SEQ ID NO: 16317 - DNA, 187 bp, Sorghum bicolor
  Clone ID: LIB3480-018-P1-K1-F8
caaaggccgaccgacgccttcacagtgcagctgaggaaggacccctgacggcataacgcgggtggggacccagggccgtcatgcaggcctacgccgtcttgttttcttcttttcgccgttcgcggttcccgcaagctctaatggggtccttaggtcgattaggcttacggacctgacccaaaactga

SEQ ID NO: 16318 - DNA, 123 bp, Sorghum bicolor
  unsure (1)..(123): unsure at all n locations
  Clone ID: LIB3480-019-P1-K1-B12
cgtccgtnatcccgttcgacccagcgtccgggccaggtntgggtcgactgctgtacgctattcagccacatctactactcgctgcggaagttgacacctaagctgtgttgctgagggcgatgt

SEQ ID NO: 16319 - DNA, 240 bp, Sorghum bicolor
  Clone ID: LIB3480-019-P1-K1-E5
ccgtccgatccggtcgaccacgcgtccgccatggaacatctgatcaaggcatggcggtctggggcttcgggctgcgagcgccccaggaccgttttgcattactgcacacgagcattttacttgcagcgaatgacctactggcatgctgtggaatacgtgcggcgacgggtgtgatggaggctatactacaatggcatggcgctactttgctcaatatggtgtaggcactgaccagtgtga

SEQ ID NO: 16320 - DNA, 432 bp, Sorghum bicolor
  Clone ID: LIB3480-021-P1-K1-A9
ccggatcgaccggctcgaccgatgcgacctcccacgcctcccgtatctctagaccaggagcagcccgtctagactaacgccagtgacttctcccgcattagctcccccggagacggctccaacccttctgacgccaagcgcactcgcagggccttcaacaagcccccagcgcactcctcttgctgctccaagaagagcgccgcggcagagggcggcggtgacgcccgcgggcaccgacaccaccaggagaaccaccgtgagggcgcggcagcagatgaagagaatcgtatgcctagtggccagtactacggcggcacggactaagaggaggagagcgaggaagaggagcagcacttcaagcgacagtcgtcctcgtcctaccggcgtgagcgctagcatgatgcgcatgaagagcagccggcgcactcgcga

SEQ ID NO: 16321 - DNA, 243 bp, Sorghum bicolor
  unsure (1)..(243): unsure at all n locations
  Clone ID: LIB3480-021-P1-K1-B6
ataagcacgcanagcgcagccaaaattgaagagttaatccaggaggaccataatgtgaagcgcaagcgtgaaaaattcaagttacagtcatcccttctttccaaggtcactcgcctgctcagcatccatgacagtcggtcagccagtgctactttgtcgacagactcggctggatcagagagtagcccgaggaaaggtggatactccggtgacgaatggaaatctgcattcgaagctggatcg

SEQ ID NO: 16322 - DNA, 157 bp, Sorghum bicolor
  Clone ID: LIB3480-021-P1-K1-C12
gcgatcgtcgccacctcgttctaccattactgaaggggttgctgcatcatacacctgcgtcctgcggtgaagctcagcagacccaggagcccaggaggcccaggagcagagcgcgctctcgcgtacacgcgcgcaaggagcaaggcaaggcggaagt

SEQ ID NO: 16323 - DNA, 112 bp, Sorghum bicolor
  Clone ID: LIB3480-021-P1-K1-E5
gaccgccttcccgatcgaccacgcgtccactcgttctagatcgcagactgacactctagaggcatcaagcataccttcgcttgcatgccattttatagcatacctcatctat

SEQ ID NO: 16324 - DNA, 257 bp, Sorghum bicolor
  Clone ID: LIB3480-021-P1-K1-E6
tcccgggcacaaagagcagagccatggggacgggttctcaattcgagcacagagctttcatgatatgtcagctagaagaaggccacatgaaaatgaatttctgatggtcaggatggaccaaccacagaatgcgtggattcagactgatccaacaacatcgccatatcttgcacggacaaagcttattgcacacgaggatcatatggcgatcactactaaccttgaaacgaacatggataataactctcgatattact

SEQ ID NO: 16325 - DNA, 101 bp, Sorghum bicolor
  Clone ID: LIB3480-021-P1-K1-G7
ccggaatgaccggctcgtccgagcgcgttcgggcggcgatacgactagtcgcacagcgaacttcatggagctgaaggcgcagcgctccttgccgttcattg

SEQ ID NO: 16326 - DNA, 428 bp, Sorghum bicolor
  Clone ID: LIB3480-022-P1-K1-B6
atggggagcctaagttgattcgttgatgtgcaagctgaaatgagacgcctgatactagaactaaaacagacaatgtatatgtataactctgggggtaaggaatctattgatgcctaacatattgcatcacatatgctccatattattgtagatgagtccaattagtcctagaactactgaatgcattagaggaagctcttgctctatgttatatggataaagcaaattgtacagctgttcttgatacattataagctgcacagataattgcatagctcgaggcgcacaatagattgagagctgactgtgaatgcattacgctatgctttggataggtagaaagtatctgatgcactgaactataatgatatttctgacatgagatactacatagatgacattagatatcttgtacacattattttgat

SEQ ID NO: 16327 - DNA, 168 bp, Sorghum bicolor
  Clone ID: LIB3480-022-P1-K1-C8
tccgtattcccggtcgacggagcgtgcgctcaagcaccacccggtctccatctaggtcgtcgccatcatggagcacatcctggactgctagggcctatatgtaagccgcggggaaggggaacgaggtgggcgcgggtggtgaagcctaatcagtacaggtactctctt

SEQ ID NO: 16328 - DNA, 416 bp, Sorghum bicolor
  unsure (1)..(416): unsure at all n locations
  Clone ID: LIB3480-022-P1-K1-F11
ggatcgactccagcgcgtccgtaaattgctnataataatataaataaaaaaaaaaaaattaataaagaaaaaaaaataaaataataatgtataaaaaataaatccggggaaagtgagtaataatatatataaaataaaaaaataaaaatttattaaaaaataaaaaataaataaaaaaatttaataataaattatggggggggtgtttttaaagtatcaatttttattactggttttttgaaaatttatatttttttttatgggcctttaaattaattttactggccgtatttttaaaaacttttgttttgtaaaaacttggtttttcccatattaattgtttttgaaaaatttttctttctttggattggggttttttaaaaaagggtctaacttgatttcttttctaaaatttt

SEQ ID NO: 16329 - DNA, 405 bp, Sorghum bicolor
  Clone ID: LIB3480-023-P1-K1-G5
tccggattacccatcgaccacgcgtccgtgggccaaagtaggccttcttgttgaacttgtttccacttctaattccacaatcgaagggtttccaataaagtcaatttcctatggatcatttaccaaacttgttagactatggtgttgtcattcaattcaccgaaacccactagggggctagatgcactttaagtgggtccaataggattaatatatttaaaaaagatcatcctcaaggaaggcaacctcaaagccttaacctagctaacctgtggcctgtgcctgcagttgccgttagggaccgtggctgcctgtcctccaccgatggtggggcggccagccgaggctagaccatgatggggttaatgcatgtgcctcccctgcatgctcattggcggttcgtag

SEQ ID NO: 16330 - DNA, 271 bp, Sorghum bicolor
  Clone ID: LIB3480-023-P1-K1-G6
tgtgattgtatcgtcaaatggagatcatgcctcactggatgagatgcttgccaagttgaagtctctgaccacggcggggggagccttctaatgccctagtgtgtgggcagtcttccgtgagggagactgtgcctggtactgtcatagagcatccgatctttctgtcagtgacccctttgattggtgaaactcaagcggttggcatattccatgaccaatgctatttttctcctgagcttgttcagatgtttttattttgtcattcatactt

SEQ ID NO: 16331 - DNA, 387 bp, Sorghum bicolor
  unsure (1)..(387): unsure at all n locations
  Clone ID: LIB3480-023-P1-K1-H6
ccgattcccggtcgaccacgcgtgcgggtcaaggacactctgccccancagtctccatcatccccgctcctgccaccgttccttctgacttacaagatctgtatctgggagggtgactccaaggtcacctgcgaggacgtcactttcattatcatcaccgagctctgagtggtacccaggtcattcgcctgtcacatctactccgacaaaattccctgcagcggcgtcaccatggataaccatattgctcaccatattttcgccaacatcaagaccatggtcgtatctaacaacgcctagggaagcgtcacaagcttgctttaggaactgttcgaggactacgacgaactactttattcacttgatgtcactgatatattagatctt

SEQ ID NO: 16332 - DNA, 197 bp, Sorghum bicolor
  Clone ID: LIB3480-024-P1-K1-A4
acacgttgtatgcgactattttgatgaaaggaaacaacagatggagggaatcactgttctgatcaagaatgtatgacataagctgtacgagagttagtctgctaacgaccagagtggcaaagactggactctcattctgaagcacattgacatgttctcctatactgcgttgaacaaagcacagagtgataacatga

SEQ ID NO: 16333 - DNA, 110 bp, Sorghum bicolor
  Clone ID: LIB3480-024-P1-K1-G8
gtatagcaaaggccgaccgacgccttcaaagtgcagctgaggaaggcccctgacgcataccgcgggggtcccgggcgtatgcggcacgcgtttgtttctcttgccgtgcg

SEQ ID NO: 16334 - DNA, 274 bp, Sorghum bicolor
  Clone ID: LIB3480-024-P1-K1-H6
gtccgagggtatggaaggggtgagttcagttatcgatctgattatggaggccgaggtggtggcaggggtggctcatcacgtggtgatgtcagctaccagcgggttgaccactctggtacagccagtggtcgtggtgcccgggcaccatcggctgccactgctgttgcaaagtgagttcttggtagctatgagttggtaatagttgagttttatggccaccatcatggttgaccaaaagagtggtgggtttggaggattcgggttcatgtgagga

SEQ ID NO: 16335 - DNA, 295 bp, Sorghum bicolor
  unsure (1)..(295): unsure at all n locations
  Clone ID: LIB3480-026-P1-K1-A12
gataggtcgccgcggtcatcgtcctgcggatctgctagctngactctcgcctggatggctggatctcctgtcggtcgccccgtggcggtaggacggggtcacacctgacctccaggcgcccaactgcgggttgcatcgccttgatttttggcaatatcattggtggtgcctcagcacaagtcgggctaggtggaggttatactactggtcggagatagccttgtgactaagttatattttttgctcatacgaatgagaggaggagctcaaaaccttcgatgctgagttcgtcaag

SEQ ID NO: 16336 - DNA, 218 bp, Sorghum bicolor
  Clone ID: LIB3480-026-P1-K1-B12
ccaagaagcaggatgagccagggagaggaatcagctcactcaaacggtcatcgtcttatgatgaggacagagtttatagagcagcacattccaaaagtgatacagaaagctcttgtgagtcgggtagtttcaggtgtcttccacagactatcagaatcatatcatgtaagcagtcgaggaatggaacaatactctcccctgtctctgatgtgagaaac

SEQ ID NO: 16337 - DNA, 429 bp, Sorghum bicolor
  Clone ID: LIB3480-026-P1-K1-C4
cattgctgggtgttctgcgcaattgtttcgcacccagctgacaacctagtttccttcctcaacaatgccaagggggcaacggtcggcgatgctgtgaagaagattggtctagtggggctatttacgcgcggtctcccgttgcgtatcgtgatgattggtaccctcaccggtgcccagtggggtatctatgatgcttttaaagtcatggttggactgccgactactggaggcgctgctccaacacctgctgccactaaggcctgattccacacagccagacttcagacaaaaactggccttgatgaccaaataactcctctttcttaggagcaattcttttattcttttaggaactctaaaatgataaaatctcagatgagtctcaagctcatccatgctaattagattgcaagatttaggaagatgttc

SEQ ID NO: 16338 - DNA, 330 bp, Sorghum bicolor
  Clone ID: LIB3480-026-P1-K1-E11
gatccggtcgacacgcgtcaaaaaaaaaaaaaaataaggcggcgttaagacagctacacctcatgcgaggatactttatggataacaacatgcggtacaccgacgaaccgcgacactaagctgaaatcccttgagtgggaatacaaaggcccgaccgacgccttcaaagtgcacctgaaggaaggacccctgacggcataaccgggtgggggacccagggacgtcatgaggctaccccgtctcgttttctcctttgactcgcggtttccgaagttaatgggctccttaggccgataggcttacggacctgaccaaaactgaaggggaggt

SEQ ID NO: 16339 - DNA, 526 bp, Sorghum bicolor
  unsure (1)..(526): unsure at all n locations
  Clone ID: LIB3480-026-P1-K1-E3
atcccggtcgaccacgcgtccgtgcttgttctattatgatgaaaagtaatgcttacataacttatgttttgctccttatgcagctcggcattggaactgtgccagtgcttctgcataagctcggcatnggaactgtcccagtgcttctgcataagttgcttcaataactgtgatgagctcactgcaattggtcatcacggttgccactataggatgactagcgagcggttgaagtggagaaggcancacaggcagcacatactccattgatctcttgtgtgattttggtattgggtggatcttggctcgagaaatatgagtcaatttgatgggatgagctgcaatttgttaggctcgagaaatatcaattgattcatgagcttcagctgaattttcgcggagaacgctttttcngcnaggtttatccagcaaccacgcaaggtgacctgagaaagttgcatatggagtagtagataaggccagatactgcacttcttttcctgtttggaattaccaagcacctatt

SEQ ID NO: 16340 - DNA, 327 bp, Sorghum bicolor
  Clone ID: LIB3480-026-P1-K1-E6
ccctgctacgtttctaacatatctcatactgaggagaggaatattaactcgttgtagatccatatcaaatttacttctctatcctatactgatccatacatatactccttgtcaagataccactattaacaaggaccaaaattctcgtagagaagcaactgccaccctacgctagaaaataaccaatcgactaatgaactaacgaactacctgcttctttttccttgattgctaaaagaatcataaaagcatgtttgataaatggaccattatgggccagtaatatattttatgatataaatcgatttcatcattgaacagttctgt

SEQ ID NO: 16341 - DNA, 241 bp, Sorghum bicolor
  Clone ID: LIB3480-026-P1-K1-F11
cgtccgattcccggtcgcccacgcgtctctactcggagttactgatattacgccagtacctgtagttgaatgaaagctattactagggtgagactagagaatagaacttactatggacagagagctactcgtaaggagtcacttacgacagatgtacagtgtggtgaaaagatgtccggtggtatgaataaggtggatcatggctgggctggtgctgtatggctggggagtgagtgaaaag

SEQ ID NO: 16342 - DNA, 200 bp, Sorghum bicolor
  Clone ID: LIB3480-026-P1-K1-G6
aatagctaacaatcgtgcatggtgaatgggacacgcgacgcaccgtgtcatgaagcattaagcgcgtggggtgtactcgcaacgcgcacggtgcactttgcagtggcctacgccctagtgcttgctctttttgctttttctctttcgttacgtgcgacggctgtccgctttacgcgctaagctgtaaactggctgctggg

SEQ ID NO: 16343 - DNA, 159 bp, Sorghum bicolor
  unsure (1)..(159): unsure at all n locations
  Clone ID: LIB3480-026-P1-K1-H3
ttctcaaccagttggcgctagcccttgatatggcgatatggggaccgctgctccnntgtagctggctgctattatagctgcctggcggngttggtggtgnngttactgcngctagcngtggacttcgctactatcttgcctagcgcttctaagcgctct

SEQ ID NO: 16344 - DNA, 117 bp, Sorghum bicolor
  unsure (1)..(117): unsure at all n locations
  Clone ID: LIB3480-028-P1-K1-E4
gaattccggtcgacccacgctccgatcatagaagttcatcgcattgctgntcctgctgaagagaacgtgattgatccttcaataatccgagataaagctgacactggagagaaatca

SEQ ID NO: 16345 - DNA, 266 bp, Sorghum bicolor
  unsure (1)..(266): unsure at all n locations
  Clone ID: LIB3480-029-P1-K1-A7
cgacctacacgtacgcgtccagatacgagacaagttggtggaagttgccctcagcactttggcctgctacgcttgagtggtctgtatacagcctttggaaaagttttcttggagttttgggaggtggtgctaanggtgaggctaaagcttcaagtgaagtgaaagtggaattagctatcctgaagatggaagtggctcttgagaagatgcacagagagactgaaaagatgaagtattatgcttacaagatgagatctgaagcttac

SEQ ID NO: 16346 - DNA, 139 bp, Sorghum bicolor
  Clone ID: LIB3480-029-P1-K1-G4
gacgtacgcgccacgcgtacggatcgagaagctagcagctagcgagaagatggcggccaccctcaggctcaggatcctcgccgcggctgcgacgcgccgccgtcatggcactgccgtcgtcgacatcgcaccgcgtccg

SEQ ID NO: 16347 - DNA, 443 bp, Sorghum bicolor
  Clone ID: LIB3480-030-P1-K1-A6
cgcgtccgctcggcgttgccggcgacatcatctccaaggccttccactgcaagcacgggaaggcgtacctcttccataaggttgtcaatgtgacttctggagtaaaagaagatcgcatgatgatcacaggaatgcatactgtttctgatatcttctgtgttggctgtggatccatcgttggatggaaatatgaggctgcacatgagaagagccagagatacaaggaaggaaagtttattctggagaggtacaaggtgtcgggccctgatggaagccagtactggattgcaccagatgttaacttgggtggaagcgacgccgatgatgtatgaagcgtgattcaacaagctcaaacctgttgttcgtcccctgtaaataacccctggtgttgttgctctttagtcagccggggattgctcccattgaaataatccccggcgtaa

SEQ ID NO: 16348 - DNA, 140 bp, Sorghum bicolor
  Clone ID: LIB3480-030-P1-K1-H3
gcttgagaatccctttgcgtgggaatacaaaggcgacgcgcttcacaggcacgaggaagacccctgacggctaacgcggttgtgccgagggcgtcatgcggcacgcgtcttgtttctctttgccgtgcgttccgagttat

SEQ ID NO: 16349 - DNA, 353 bp, Sorghum bicolor
  Clone ID: LIB3480-031-P1-K1-B12
cgaggttgaactctctgctctggggatggccattggtaccgtcgtgactgtcgccgagatcctcaagaataatggcctcgccactgaaaagaagatcctgacatgcaaccatcggcaccaaagacgagtccaagggccggcttgtccgtaaagccaagattgagattctgctgtgcaaatcagagaatttcaacagcatcatgtctagcaagaaatccgaccgcccgaaatccgccgaggaagagatcaaggtgtgatctgaccaacttgtccagccgttctccagcagagccctccctcatgttccatttccagaggttggcagctcaccacagcattacggattgatgggg

SEQ ID NO: 16350 - DNA, 144 bp, Sorghum bicolor
  Clone ID: LIB3480-031-P1-K1-E6
caccacgacctcacgcgtacgcgtgcgcccatgtggatttaccactttgcccttcttcagtggggcctacacatccgccgccgcgtccggcgaaacaaccgggtgtaggtgcaaagtactacctcatggcggccatatcctcac

SEQ ID NO: 16351 - DNA, 264 bp, Sorghum bicolor
  Clone ID: LIB3480-031-P1-K1-H2
ggggggggaaaagtccttgttgttcaaaatattccaaggcatttcccaacccatcccctttttttgaagggtgttccaaagcaactttcctacaccatgcatgcacttaatgccaccgtacaaaaaggatcgcttccttttacacgggcttcgggttgggttaccctactcagacacaacaaaaagggtttcaaatggaactagcagcattagctacatgcacattcaagcttttgtaccccataagggggcatgctcaccttt

SEQ ID NO: 16352 - DNA, 130 bp, Sorghum bicolor
  Clone ID: LIB3480-032-P1-K1-A7
acgcgtccggcctcctccgtccttcagctcgtctcagtctgaccagctcgtcgccgcgcgcccgtatgggagggagtaagggaaccaccggcgcgactttacccgaggtcgtgtggactagcgccacact

SEQ ID NO: 16353 - DNA, 244 bp, Sorghum bicolor
  Clone ID: LIB3480-032-P1-K1-D9
tgctcacgtctacttttataggcacctaggtcaatcactggcgcgttacacttgactgaaaacctgcgtccactaatgctgaccatcccttcgcagtgggtatagcgagaggccgaccgtcgccttccacagtgccagctgatggcgatggacgcgcctggacggggcttagcccgcgggtgtggggttaccgcgcgtgaccgtcacttgcaggccctagccccgttctttgctttcttccttc

SEQ ID NO: 16354 - DNA, 140 bp, Sorghum bicolor
  Clone ID: LIB3480-033-P1-K1-A11
gcgtccggtgcacggcacacgagaaacggcgagcgcagcgacttggcgaggcgcgacgtccggcccagctggtacgtcgcgcccgctcctgacaggcgagatgcgttccggccacctgatgattgaccacgagaccctga

SEQ ID NO: 16355 - DNA, 345 bp, Sorghum bicolor
  Clone ID: LIB3480-033-P1-K1-C5
acatgaacaaaaacaagaccagagattaaccgccagatttagagccagtagtaatcgttgcagagattgacatttacaagcatatatgcacgcttatatgctcgctagttggctacaaggtgtgcgaaaggcagcatgctaagcaactgggcaagtcataggggcgttgatagtggcattgtgtgtaattacatgcttcactacataagccatactggatgtggtactggcttgggactgtgccagtttattgaacatgttagcgaacaagttgctgtacaatttggcgtacttcttgatgtactccttgagggtctcgtatagggacttgacatccaagttgac

SEQ ID NO: 16356 - DNA, 152 bp, Sorghum bicolor
  Clone ID: LIB3480-033-P1-K1-G1
aggccgtgagtgtctggcattgtatcactgctatacgaggcagcccatcccaacgtccaaggcactacctgatactagagacaatctcgtgcatataaatacgccttctggccatacaactgatcaccaagattctaatggctatggaaata

SEQ ID NO: 16357 - DNA, 146 bp, Sorghum bicolor
  Clone ID: LIB3480-033-P1-K1-G5
gtatacaaaggccgacgacgcttcaacgtgcagctgaggaaggacccctgcgcataccggggtggtcccgggcgtatgaggctcgcgtttgtttctctttgagtgcgttccgagttaaggtcttggcgtagtacgctaccaaatgt

SEQ ID NO: 16358 - DNA, 255 bp, Sorghum bicolor
  Clone ID: LIB3480-034-P1-K1-D3
gggacggcccccacccaaagggttcaccccacccaattttgtcttttttaatacagggtttcaacaaaatttcacttggtaaataaaaaaggttaaccgattacaatttttaacacccaatttttaaaaatccttaatgttaaaccaaaaatggtggatcatttttttaaccaaacggccaatttattgtcattcaaatacaacccctatatccctaaaaagggctttttaatttttaaatattctctttaaaaa

SEQ ID NO: 16359 - DNA, 370 bp, Sorghum bicolor
  unsure (1)..(370): unsure at all n locations
  Clone ID: LIB3480-034-P1-K1-H12
cgaccacgcgtccgctgatctgtacacatctatngttacntcattctcggcgaatgcatcttatatagtctccacagtgctatggatttactggggtgttggtattagtgacatgatcccattctatctagggaaactcttcaggcaaactagagcatcagaagacataagcagcaagattggaattggtaaggagaaagcactaagcatatcacaagcagttcagaagtatggaaacctaattggctttgttgaacgnatttcaattggtgttcggaatcctacagcatttcttgctggagcatntggtatatcagcagacnttttcttcgaaggagtttgtttcggttgtctatttactcttccctat

SEQ ID NO: 16360 - DNA, 282 bp, Sorghum bicolor
  Clone ID: LIB3480-036-P1-K1-A1
cgcgacggcaacctggactgcgtccggcaactcctctcctggggcgccgaccgcctccagcgagactccgtcgggagaattccgtatgaggtcgcagtgaagcgaggccacgtcgcgtgcgcggcgctgctgaacccgtcatcggcggagcccctggtctggccgtccgctctcaagttcatcagcgagctggaacccaacgccaagtccctgctcgaagcaacgctgatggaggccaatagagagagggagaggaggatcctcaaaggactaagatgcact

SEQ ID NO: 16361 - DNA, 228 bp, Sorghum bicolor
  unsure (1)..(228): unsure at all n locations
  Clone ID: LIB3480-036-P1-K1-B3
aatttcattgatctcaatgatgacgtaccaaacgatgacaattctgaggaatcagtantgtcacgtgaatgcgaggtggaaccttcacggaacaaccatcctaaacgaacatttgtgattgatttataggcgccngcttgtgaagaggatgctgcatgggattntgatcaagaaagcgtacagcctaaactcgatgcataccangaagctgacaacagatctgataca

SEQ ID NO: 16362 - DNA, 189 bp, Sorghum bicolor
  Clone ID: LIB3480-036-P1-K1-D11
ccggcctcgccgcgcccccgggcctcaaccttgctgactgcggggtcggcgccgccggcctcgagcagctgatccagcaactcgccgagaacgaccccaaccgctacggcacccctcccgccgccaagtccgccgtcgcctcgctccccgacgttgcagggtcagccgacatgatgcatgccgacggct

SEQ ID NO: 16363 - DNA, 256 bp, Sorghum bicolor
  Clone ID: LIB3480-036-P1-K1-D5
gcttataaaactgtggacgaggtaccactagacgcagaggcacgtcgacaggactggatactcctccctggatcctgatgcgaatggtctaccaaggacccatggtctttcttcatccctccacggattcaatgatggaagctaaccatattcaacccagaagcacatcactgtcaagaggtcaaatcattctctcgagcagcccattttcaaccctaatttgagtggcaacgcgcagtgatgccaccctacacga

SEQ ID NO: 16364 - DNA, 163 bp, Sorghum bicolor
  unsure (1)..(163): unsure at all n locations
  Clone ID: LIB3480-036-P1-K1-E1
aattacccactccacccactcttcggacatgtctatactatccactctcacactctccaaaataacctactctttcttcccacatatatacactttatatattttctatataaacncgcgatactaattcactgtccacaccttcacaacttctaaaccccta

SEQ ID NO: 16365 - DNA, 164 bp, Sorghum bicolor
  Clone ID: LIB3480-036-P1-K1-H5
cccccctctctcatgtctcgatacgcccgacggccttcccggctcctccgtccggcggcaccctctccagctcaccgaccagctcgccggagatcacgagaggggccaagccctgcccgcgctcctcgacgccgttcgcccgcccagccgccatgggggacgcc

SEQ ID NO: 16366 - DNA, 192 bp, Sorghum bicolor
  unsure (1)..(192): unsure at all n locations
  Clone ID: LIB3480-038-P1-K1-H8
cgtccgatcccgtcgccnncnnccaagctgaccgagaacaaccttgccgagctgagactctatctatcagatggcattgccaggatcatggggtctggctctggctacactccttgcgctgcgcaacagaactgctgctgcaggcatgttactgttgcatcatgatcgtgttacttgcgcacgaccgacgag

SEQ ID NO: 16367 - DNA, 236 bp, Sorghum bicolor
  Clone ID: LIB3480-039-P1-K1-B1
agcattcgtggtaggctagatcgagagaggacacgacccgtcgcatcaacttttacctcactaacgatatcaccaacgatggaggtacaaagggggattacgtacacgtactcctttaaacttaaaatgacgctaccacgtacaccgacatataagctattcttcagacctaccacagatctttgcatggttgcaatcgatcccatgtctccaagcaaaccactactcttataaca

SEQ ID NO: 16368 - DNA, 330 bp, Sorghum bicolor
  Clone ID: LIB3480-039-P1-K1-E2
ccacgcgtccgcacctgcttgaggtccttctatagagcgtcgcttagtgctgtctcgattccacaaaagagatttaggctctatatcctaagtggtacacgctggacaactctttcaagagcgctggtgcttatactaacggctctggaattccaatcaagacttcaaacacataattgtaactcaatggctggcagatcgatacatttggcaggccagatggacactttgcattatacaacgtgccaggtggcagtcttctaaatgatgattcctcgatcgggtactttgtattcacacatgctgttcatatggaagctaggaatcctg

SEQ ID NO: 16369 - DNA, 300 bp, Sorghum bicolor
  Clone ID: LIB3480-039-P1-K1-F5
gaatgatccgtcgatgaagattccaacttacatgagcggacactctgtatacacccagcattacagggtcaccaactgtaagtgcaggatcagtcttgctacaaccaacacctggttgctacttttcatgatctactcactcgagatcgacgtcgtcgttccatacaccagcgtgaccacatcaccgagttactgtaagctgagcacacgttctcgttgtatttatttataaatccagtactgggagagcacaaaaccatagaccatcataaggtggcatagtttagacatatcacatat

SEQ ID NO: 16370 - DNA, 244 bp, Sorghum bicolor
  unsure (1)..(244): unsure at all n locations
  Clone ID: LIB3480-040-P1-K1-A4
ccacgcgtccgcgagcggaaggtgggnngatagaanggcggatccagactctgatatcaccnaggaggaagacaagtggatgaaattcacatctcatgttatggcgtgatcccttatgatggcaaacatcgctccggaagtgttcagacaagcaaaccatcatgggcacattaagggattcactttcctaggaggcgtaaaggtcgagaactgctcctcaaacagggggggctggtgaggccta

SEQ ID NO: 16371 - DNA, 241 bp, Sorghum bicolor
  unsure (1)..(241): unsure at all n locations
  Clone ID: LIB3480-040-P1-K1-E12
aatactgtttatgtttgtcctgtcttctaatactaattcaaattttatatacttttncgggggggccccttttttgagtttcaattttttcatccccttctttgaaaaaaatttttttttttttatggggcccaaaataaaaatacctgccccggggttaaaaaactttggattggaaaaaccctggttttcccaacattaaaactttttgaaaaaaatcccttttttgcagtgtgggtat

SEQ ID NO: 16372 - DNA, 267 bp, Sorghum bicolor
  Clone ID: LIB3480-040-P1-K1-G1
cgagcgtccactctagaggactccatatctcacggacgcgagcatacactttgatccacaaatatggtgtatgaaataacaagagggggagtatgagggggaggacagctcttgctactcaggctaccattactgggcacagctgaatttctgtggatgacatggccacataacacagatgggaactgactgataatctcctacacaccagtgctaaccagctgtcgcgcatatcgactgtccagatgacaagagcgacttaacgaa

SEQ ID NO: 16373 - DNA, 150 bp, Sorghum bicolor
  Clone ID: LIB3480-040-P1-K1-G5
gattccggtcaccacgctccgcggggagggggatgtatgggcctctttcggtgcagagaggctaagcttacgaacggaggcttgctacgctatgtggtatatatagcggccagggagtgtaatgaagcgtccggcatttgactacaacgc

SEQ ID NO: 16374 - DNA, 135 bp, Sorghum bicolor
  unsure (1)..(135): unsure at all n locations
  Clone ID: LIB3481-001-Q6-K1-A11
cgcgtccggatgatataagagcagaaacccgtgaacatcgacagttgagtcaaagtccttcgttgtagaacaatgtgtcaccaagaccatagaagaactgcagtatactgcagctagtgtttctgnnnatgatgc

SEQ ID NO: 16375 - DNA, 363 bp, Sorghum bicolor
  unsure (1)..(363): unsure at all n locations
  Clone ID: LIB3481-001-Q6-K1-A12
cgtccggaccataatcatgcatcttgactcgtgtgctagtcgtgctaccagcggatgcatgtcaccactatatatgtagagggacgcttgatcatctcctaggttcagcgataggaccggcagtagcttggagaggaatgagaacgacttggttattcggccaccgaggcttagtgtttctgccggagggggggggcagacagatcaccaaagcatgtagaactagtttcaaatggtcataatagcggtcaaaatgaccaggtacgacatctactgagtctactggagaaagaatatnattgttgaatctatctacgctctgtcggtacgattgttataatgggggttttgactgttttttat

SEQ ID NO: 16376 - DNA, 397 bp, Sorghum bicolor
  Clone ID: LIB3481-001-Q6-K1-A2
taacatatatatattgttctcattttacaagcagataatgaagtctacagagggcaaatgagaacaatatatatatgttaaaacgagagacaagagggggcggatagccaggtaacaaacattgcaacatcatgatgtagcatgtttacttacatactccataccaccaagagaagggtagaaccaaacgctgttccacttccccgatcaggatcggatgcttggtcctctgccggagttggtgaagaaaggcgacagagtgcggtacggaacaacaagttaccaagatttcttgaagcaatacttcactgcaaagctggatggaaggaagctcatagagagtttcaagttagagtagtagcaactacgactctgtctaattatcattgcagatgga

SEQ ID NO: 16377 - DNA, 389 bp, Sorghum bicolor
  Clone ID: LIB3481-001-Q6-K1-B11
tgcgtccgtggcggagacccattccttggggggggagggggggaataaatccatcagcaaatctcatacgttggacctggggatcacactggtgtccatatggctgaagattatatctatggacatcatgagcgtagacgctgaccatatttggttggagaggtggaggttagtaccccctaactggagagaggagagtgggtccacctactacgtggactgtgagtactctcgtccagagcctgagagaccttatccctcaaacatgaggaagattccgatccctttcagggctgcggagaagaagaggagtagcacgtccgaagctgctctgctcatgcatgctcatttgggccgataactgggctggctcagagagcacaggacac

SEQ ID NO: 16378 - DNA, 248 bp, Sorghum bicolor
  Clone ID: LIB3481-001-Q6-K1-B2
cgtccgcccacgcgtccgcccacgcgtccggtctcggcgagggcgagtacgagccccgcgtcgtgcaccagttcctcgacctggcataccggtacgtcggagacgtgctcggggacgcccaggtctacgccgaccacgccgggaaggctcagatcgacgccgacgacgtcagcctcgccatccaggccaaggtcaatttctcctttctccagccgccggcgcgcgagggttctctttgagctggcccc

SEQ ID NO: 16379 - DNA, 326 bp, Sorghum bicolor
  unsure (1)..(326): unsure at all n locations
  Clone ID: LIB3481-001-Q6-K1-C10
gtccgnattcccggtcgcccagcgtccgcccagcgtccgatcgccgcatcagcctgtgctcgggatactcccgcatgtcgacaacttcgcgcacatcggcgggttcgcgacgggcttcctgctcggcttcgtgctgctgatccagccccagttcgggtggcttgagcagccctatggatccaagaccaagtccaagtacaggggggggganatcatcctcctgcttgctgccctggtcttgctggctgcagggcttgctgttgtatatggtatggtgttttttggacggatctctaatcctatttctgttgggtgttgttttcttt

SEQ ID NO: 16380 - DNA, 120 bp, Sorghum bicolor
  Clone ID: LIB3481-001-Q6-K1-C12
ccctatcatcctcctcacctgaaaaactacctgatgagaatattgcacctttgcagcaaggtgtttcaaacaacttatacttatgctgtctgcggtttattttttctgcatggagaatcc

SEQ ID NO: 16381 - DNA, 362 bp, Sorghum bicolor
  Clone ID: LIB3481-001-Q6-K1-C8
cgcgtccggctggacctcgagggaacgcgccggttcttcgacgccttcttcgacctggagccgcactactggcacggtttcctgtcatccagactgttcctgccggagctcttgatgttcggcctcgcactgttcgggaacgcctccaacacgtcgaggctggagatcatggccaagggcaccgtgcctcttggcaagatgattggcaacttgatacaggacagagatgggtgaggagggtatgtatgcctgcatttctcacctgaagatctgatctctgattttggcatcgatgatgctcagtgtatttacgaattgcaaacatggattcacaaacacaccacaagtaagaaccaggagtt

SEQ ID NO: 16382 - DNA, 400 bp, Sorghum bicolor
  Clone ID: LIB3481-001-Q6-K1-D10
gcgtccggtgcttctggctcctcccgcttctgcgagcgagcgtgtgtcctctgctccgtccttgtccaggcaccacaaggcaaaagaagctcaggtgagaatgttgtgatggttgatccactggaagctaagcgcctagctgctaaacaaatgcaagaaattagggccaaagaaaagctgaggaggggcggtcaagcagaagcgatcaacggggcattggcaatgataggactgactgctggattggtagtggaagctcagacaggaaagggcatcttagggcagctagctggatatctcacggctatttctagtttatttgggcaataatactggaccatgattggagaattctttttcacgttccttggtcaggataactcttatctgaaacttattt

SEQ ID NO: 16383 - DNA, 282 bp, Sorghum bicolor
  unsure (1)..(282): unsure at all n locations
  Clone ID: LIB3481-001-Q6-K1-E3
cgtccggtttgttgttggcctggtcccatggctaaaatccctaatcatcggcgacggagctccttttaaagttatacaggattccctccagctgatgggtaatggcgcgattccttgcatcaccctcatcctaggtggaaacctgactcaagggcttcggaagtcggggctgaagcgtagggtgatcgtcacaatcctgtgcatccgcttcgtgctcctcccgctgatcggcatcgccgtcgnccacgccgcctacgggctcgggttgctgtcccgtgaccc

SEQ ID NO: 16384 - DNA, 450 bp, Sorghum bicolor
  Clone ID: LIB3481-001-Q6-K1-F9
cgtccgcggagcgccaccatctcaagcaaagcagcaggagctgaatactgttggccgtaagcagcgtttccggaacaagctgaaggaagcagataggaaattcactggcagtgctcaggagaacaaggtggagagcctaagggagctcatgggtgctagagcaagtggtaccagcatgccaaagagctcccctcgtgattggctcgacccgcactgccacgaatcagaatttgacagataaccaactaggtgactggcaaatgatgcggcgtttacctaaaggttgatacactgtaatactggtgcaggtgttattcgccaataatagatactaatagatgaaacaaaacaaaagggtttcctgtggtgtaatatccgagctctgctattctccatgtcgcttaaatacccttagttccaattgtgcgtgtgttgttggatttgtgattt

SEQ ID NO: 16385 - DNA, 342 bp, Sorghum bicolor
  unsure (1)..(342): unsure at all n locations
  Clone ID: LIB3481-001-Q6-K1-G4
cgtccgatgcgagagtatacctgccttgctcgcacactcttaagctctctcgcaaggcatcgcactatgcactattggcctatttccattatgtaggactacttgggtcaaacgaggtgaggtaggtggcccaggccagtctgtaatgatgcatctgttgaggcatcacaaattgcatgaattttggattattcagagggaatgttacatatgtacactggagcttgaagaggatcagttaccttatgatggctaagctttttgatgttctcaagagctgagtcatcacatagtctattctgtccagtttgcanggaaattattaaatgtaatacatgtata

SEQ ID NO: 16386 - DNA, 354 bp, Sorghum bicolor
  unsure (1)..(354): unsure at all n locations
  Clone ID: LIB3481-001-Q6-K1-G6
ctgagggagcgagcgctggacatggcgtcactgtctgtcgccgccgtggcggcaaccacggcgaggccaagcagcagcggtgggagagggcgccgtcgtctcagggtcgcctccatggccacccagaaggggcagaagccgacgacggccaagaccgtgtccggcacgacgagaagatcgcagggcacgacgacgacgacggtgttcccggtgggcgagccgggcccgcgggcggcggggacgacgacgacgaagaaggcggcgccggcggtgaagctgctgacgaacgtggagaagctgcggctgctgacgaaggcggagcgcgcgggcctgctgtnggnggcggagcgcgcg

SEQ ID NO: 16387 - DNA, 165 bp, Sorghum bicolor
  Clone ID: LIB3481-002-Q6-K1-A11
cgtccgattcccggtcgcccacgcgtccgtggccccgagacccacgtaactacccggctgcagagctcgcggctcgcgcactgaccaggcaggagtagcccatgcccgcgatggcggcgccaccgtgctggcgcgcgcgtgcgccgccgtccggtgggaccgggc

SEQ ID NO: 16388 - DNA, 385 bp, Sorghum bicolor
  Clone ID: LIB3481-002-Q6-K1-B1
ccgtccgggtgccgccgagaaggacaaaaagaagccggcggcggggcggagctggggatccccctgggcgggtggccgtcgtacaacccgcacaacttcagccagctcgtccctgccgacccctccgcgcagccctcgaatgtcacaccagccacttatgttgcgacccacaggacagacccgccacccaatcaagtgataacaacggaggccaggaacatcctgctgaggcacttctaccagaaatctgaggagaagctgaggccaaagagagctgctccggacaacctcgctccggagaacaacaacaagcagcccaggggacctgtgggcgacgtcgggggccagtcaagcgcaagaggctgaagccacacagctggtgctg

SEQ ID NO: 16389 - DNA, 288 bp, Sorghum bicolor
  unsure (1)..(288): unsure at all n locations
  Clone ID: LIB3481-002-Q6-K1-B11
ccgtccggatcccggtcgaccacncgtccggagcagccaaagatcaagtggttgggcgcgaacattggataaccatattggttgtgtgagggaacataactgcagttataaatagcacatgacttaaagacagttgcaaaaggtgcatacataaaaaaatactggcagcagcctagggggggagaagaaagaccgtgcagacagaactctgaaataccactttaagcttgtgaagaaaagtcagattgccctgcaagaaagaacagctgaatcatttggggtttatta

SEQ ID NO: 16390 - DNA, 311 bp, Sorghum bicolor
  unsure (1)..(311): unsure at all n locations
  Clone ID: LIB3481-002-Q6-K1-B3
cgtccgggcggcgtgtcggcgctgatggcggagacgacggccagcatcggctgctacgtggcgtcggggtaccggaggctcgccggggtgcagctctccatcaaccacgtcggccccgcgcgcctcggcgacgtcgtccaggcgcgggccacgccgatccagctcggccgcaaaatccaggtttgggaggtccagatatggcagattgatccttccacatcagagcgcaaagatctggtgtcaacagcaagggttaccctgttagccaatctatcaacaccagataagatgaagagcttngaagagggcct

SEQ ID NO: 16391 - DNA, 387 bp, Sorghum bicolor
  Clone ID: LIB3481-002-Q6-K1-B7
cgtccgcgccggccgtgagctagctacctggcagtctgcacacctggagagtactctaagatcgagctagctaggcggcggccatggcgtccatggacttcgtggtccaggtccttgttcgagtggtgatgagaagaagcatccgcaggctgcaagaggtcgttgacatggccgtggagatcggcacggcggtcttcgtggccgtgcgggtctccggcctggtcttccgccgccggctgccgacgagtacgccgtcgtcttcgtcgtcgccggcggtctcgggcggcactgcaactactactacgacgtattactactccccgggagcgtccgccttgatcggcatgtccaggattgacaggcactagctagctagggtcagctagc

SEQ ID NO: 16392 - DNA, 475 bp, Sorghum bicolor
  unsure (1)..(475): unsure at all n locations
  Clone ID: LIB3481-002-Q6-K1-B8
cgtccgtatttttgtacacaacatatacaatcttttggcacatgttccttcaatggattttcaaaaggaatcaacatttgatatgtggagtactgttgggctgtcttctaaaggagaaaaggactcttccaaggacacttctactcacatcaagaaaaaattacaattgaagttcactaaagcatggctgtcttttctcaagttaccactgccgcttgatgtgtataaggaggtccttgcttcaattcatcaaaatgtcattccttcaatgtcaaacccttccatcttatgtgatttcttgactagatcatatgatattggtggtgttatcagtgtgatggccttaagtggccttttcattcttatgacgcancacggnctggagtttccaaaattctatgaaaagctttatgcccttcttactcctgctggnttnatgggaaaacacccggcagnggtcttgcaacttttttga

SEQ ID NO: 16393 - DNA, 220 bp, Sorghum bicolor
  Clone ID: LIB3481-002-Q6-K1-B9
cgtccgaactgtacctactgcatctcctccacgcgccgttggagttggagtcgcactctcctttccctcaatcgcgcccaggcctagtggtgccgtagagcgtgagggcagttctactggcgttgtagatattgcccaagccttgttgcccttatcctactttgttttttttttactatggggggggggccaaatgaagcagctgctttttttttttgga

SEQ ID NO: 16394 - DNA, 314 bp, Sorghum bicolor
  unsure (1)..(314): unsure at all n locations
  Clone ID: LIB3481-002-Q6-K1-C1
cgtccgattgcttgaatcaaatggcatataatcatcacagtttttcgccgatgtgatttttgggcctatcgaagtagatgccatgtctgttattattagttctttgttcttttcccgtggtgctggactattgtctgaactcaaacaaaagcagtagatgatgcggtgtatatagataagcctatggatattctaagatattttgcactagtaaaagttacccgccattcattttatcttttattgtataggctcataccatttctaaatgatgtgcangcaaaaagggtactaccagtactggtgggtggagc

SEQ ID NO: 16395 - DNA, 346 bp, Sorghum bicolor
  unsure (1)..(346): unsure at all n locations
  Clone ID: LIB3481-002-Q6-K1-C10
cgtccgggcctgtggtgctggaagctctgctgctgaccctgcggcgaactacctgctggcacacacgacggacagggacgtctactcagtcgtccagggatcagcattcgtcataccaaagggctccatagtgaactatggcgtggccgagattggccgtgacgccaagttgtgggctgacggggaggtgttcangccggaaaggttccttgaaggtggagaagggttctccatccgngggatccccggggtcgggggggggggggggccngtgccggagatgatgaaaatgataccgttcggtgctgtggggagggcgtgccccggggaagtgtttttaataaag

SEQ ID NO: 16396 - DNA, 450 bp, Sorghum bicolor
  Clone ID: LIB3481-002-Q6-K1-C12
cgtccgcggacgcgtgggctgcagcagtggatctagtggagaatattaactgagcaagttcagatagttagagacaacagcacagacgtcatgctatatcgcatcgctcttgcggttattcaggtcatgcttgactttcaagcagctgagaggcaaagacttgaggagccggcttctgatgtgggggtggaatctctatgtgcattgattaacaataacctgcgttgctacgaactttcatcagagttaagtagcagtacattggaggcacttccacaaaactatgctgaacaggttaattttgaggacacttgcaaaggatttctagaggttgccaaggaggctgtcctccaaactgttagtgttatttttgaagacccaggtgtgcaggatctactcgtgaagctttaccagaaagactggctggagggaatggtcacagaatatctt

SEQ ID NO: 16397 - DNA, 321 bp, Sorghum bicolor
  unsure (1)..(321): unsure at all n locations
  Clone ID: LIB3481-002-Q6-K1-C3
cgtccggaagattaatggtttcacaactttacatcaatttcctttttagctacattttgtctcctccaaatatcatataccacatgatatgttactagctacatatactctttttaaatttcctaatcattagataacaactccatagcacatgaatactgcaatcagtccccaatcattgtggcatatatgtcaaacagtcaactactcaaaagatacatgggacaaatgcatgctcatatagttttcttgtgctgagtatcggtaatgttgtgcaggaagactacaataactggaattactggaaggggccgntgccag

SEQ ID NO: 16398 - DNA, 318 bp, Sorghum bicolor
  unsure (1)..(318): unsure at all n locations
  Clone ID: LIB3481-002-Q6-K1-D3
cgtccggacggactgctgcaaagacatttaatgaatacgcatgtgccttggtagtggctcgctgactcaactccgaacagctgaacttgaggcaattgctgtaccaccacacctgtcctggatgaatcaattgcaatttctaaggctatgcaattactcgaagcacaagaatacatcatgtttagccgcattgtatttgacactgcccctacgggccatacactccggttactgtccttgccagatttattggatgcatccattgggaaaatcttgaaactaaggagccagattgcttttgcaacataatntattaaa

SEQ ID NO: 16399 - DNA, 232 bp, Sorghum bicolor
  unsure (1)..(232): unsure at all n locations
  Clone ID: LIB3481-002-Q6-K1-D6
gtccgnatcccggtcgcccacgcgtccgctgcagcatgttgaagactatgtggacacaacctattatcgactacactgtttcaacgttatggcactgattgctgagagatgtgagtaacactgaggccttgccaccaagctagagattagtctgcataatgatgaggtgaagcattcagggattgctgtggtaggggtgattactaagtcaccaaattnaagaccatttaag

SEQ ID NO: 16400 - DNA, 259 bp, Sorghum bicolor
  Clone ID: LIB3481-002-Q6-K1-D7
gtcgaccagcgtccgggcagcacatcaggaaaggcgttgctcattctttgcaatcgatgagagccgctttacacaaactgatgaggtgagctgcaccccgtacttccattcaagccattcatggggattcttcagaaatagaacacggttgctctgccggaagtgcagtggtcatattggtaatgcttatgaggacgaggatcccaccttgtgcgaggggtcagatgacctggacatgagctccaagagcagcagcaca

SEQ ID NO: 16401 - DNA, 163 bp, Sorghum bicolor
  Clone ID: LIB3481-002-Q6-K1-D8
gtcgccccgcgtccgaatttctatgtggcatgaagaagatataggttcgttaacactgttaaagagggtgatgaggagacacatgcacaggtgagccagatgtacatggttgcaccactggacttgcatttttctatcctatatgatgtattgaagaagcacg

SEQ ID NO: 16402 - DNA, 461 bp, Sorghum bicolor
  unsure (1)..(461): unsure at all n locations
  Clone ID: LIB3481-002-Q6-K1-E1
cgtccgcagtcctcctcgcagacagagcaccgcgcccgcgtcaggagagaggagaggagaggactaggaggagcctggaggccgtcggcgctgatggtggcgtggtggcggaggaaggtgctgccccgcgcgcgccgcgcctgggccgccgtcgccgcgcggctccgcgcgcgtaagcctggatttcacctggacaccatgagatcaggcagtggtggtattctgaagctccacgaggacgtgcagacttgcggctacaaggacgtccaggtcatgttcgacatgttgacatcggaactcgaggctgctgctcaagcccagaaggcaccgccgtcgccgccccgcaaacaggcgctaccgnctgcgtggcccggccggtccacgatcgccgttgcgcannanatcctggcaaacagtgttattacagaaacgtncgncccctgcccttttttcntnnttgg

SEQ ID NO: 16403 - DNA, 362 bp, Sorghum bicolor
  Clone ID: LIB3481-002-Q6-K1-E4
ctgcgtccggatcttccttgatgctggaattgacgtaccgggcatcagcgaatgagcagtatcattttcctccattattggcagggtagatgctgacatcctgagacccaaactgaagaagttgaattctttccaagatgcagcaaagcatatcaaagtcctactcagatggcctcaccgcaaatcaaagagatcaggcagcggccagaaggatctggatgatgatgcctcgtccgtggactctgccaagacctggagccatgaagagactccgacaccactgagacaaaggtattccaggatcagctccttgttcaacaagcggacctatgcgggcaagactttacctagagaagcaatgc

SEQ ID NO: 16404 - DNA, 160 bp, Sorghum bicolor
  Clone ID: LIB3481-002-Q6-K1-E8
cgtccggatcccggtcgccccgcgtccgacggctccggtgccaaccccgaacgtgtccgggggacctggtgatcaacaccggaagacgcatactgcgacacggacgcgggttcgcaggcgcgcggccgtgatgggtctgtggctggacggccgtggtcgg
